United States Patent 10,766,935 (PLANT TRAITS CONFERRED BY ISOLATED POLYNUCLEOTIDES AND POLYPEPTIDES) - sequence listing, part 7

SEQ ID NO: 10388 - DNA, 3475 bp, Phaseolus vulgaris
cgtggtgaatgggtgcatatgtatacaaaacagcatttcaagaagctcccagaatgctccactctcactctattccacgtccaactctctctcttttagcccaaactctgtttcaacacagtaacacggttttcccattctctctttctctttttcttttctcaatacccacgcaacacaaagttccttcttcccttctttaaatttccactctcattccttcttccctcaatgctctcttcctcctcgccaatcgcctccatgacgtcgctttctctctcccacctcgccgtccccttctcctgcaacactaaccgtgctcgcttttaccaccgccgctctccctccttctcaaagcccatttcccttaagccactccaatcgctccccttcaacaaaagacacccttttgcaaatgggttttggacaattcggagaaattcctcacctctcaccgttcgctgtgaagcttcaagtggaaggattacacagcaagagttcacagagatggcgtggcaggcgatagtttcgtcgccggaggtggccaaagagaacaagcatcagattgtggagacagagcacttgatgaaggctttgttagagcagaagaatgggcttgctcgcaggatcttttctaaggttggggtggataacactcgtcttctagaagctactgacaagtacattcagcggcaacccaaggttctaggggaatcgtctggttcaatgttgggacgtgatttggaggcactgattcagagagctagggaccacaagaaacagttcggggattcatttgtttcagttgagcacttggttcttgcttttacccaagatcagcgatttgggaagcaattctttagagattttcaaatatctgagccggctctaaaatctgcagtagagtccattaggggaccgcagtcagttattgatcaagatcctgaagggaagtatgaagccttggaaaaatatggaaaagatttaactgcaatggcaaaagctggaaaacttgatccggtcataggaagagatgatgaaatacgcagatgcatccaaattctctccaggaggacaaagaacaatcctgtgctgattggtgagcctggtgttggaaagactgccatttctgaaggactagctcagagaatagtgcaaggtgatgttcctcaagctttgatgaaccgtaggcttatatctcttgatatgggtgcactgattgctggtgcaaagtatcggggagaatttgaagataggctgaaagccgtgcttaaagaagtaacagattctgatggtcaaactatccttttcattgatgagattcatacagttgttggggcaggagctacaaatggtgctatggatgctggtaatctcttaaagcctatgctgggtcggggagagctccgatgtattggtgcaacaacattggatgagtataggaagtatatcgagaaggacccagcactagagcgacggttccagcaagtttatgttgaccaacctacagttgaagacacaatttcaatactaaggggactgcgagaaaggtatgagctacatcatggagttcgaatatctgacagcgcacttgtggaagctgcaattctttcggatcgatatatcagtgggagatttttgcccgacaaagctattgatctggttgatgaggcagctgccaaactgaaaatggaaatcacttctaaaccgactgcacttgatgagatcaataggtcagtcctgaaactggagatggaaagactctctctcgtgaatgatacagataaggctactaaagataggcttaatcgtctggagacagagctttctctattgaaagagaagcaagctgagctgactgaacagtgggagcatgaaaagtctgtaatgactcgtattcaatcaatcaaagaagagatagacagggtgaatcttgagatccaacaggctgagcgggagtatgatcttaatcgtgctgctgaattaaagtatggcagtctaaactccttgcaacgacaacttgaaagtgcagagaaggagttaaatgaatatatgaatactgggaagtctatgcttagagaggaagtttcaggaagtgatattgctgaaattgtaagcaagtggactggtatccctgtttcaaagcttcaacaatcagagagggagaagttgttgtatttggaggaagtgcttcataagcgtgttgtaggtcaaaaccctgctgttaaagcagttgctgaggctatccaacgctcaagagctggtctttcagatccccatcggccaattgccagctttatgtttatggggcctaccggtgtaggaaagacggagcttgctaaggcacttgcagcctacttgttcaacactgaagaagctcttgtacgaattgatatgagcgagtacatggaaaaacatgctgtttcaagattgattggggctccacctggatatgttgggtacgaagaaggagggcaacttactgagatagttcgccgcagaccatatgctgttatattgtttgatgagattgagaaagcacactcggatgtcttcaatgtcttccttcaaattttggatgatggaagagtaaccgactctcaaggacgcactgtgagttttaccaacactgtcatcattatgacctctaatgttggatcacagtatattctgaacacggatgatgacaccgtgccgaaagagttggcttatgaaaccataaaacagcgagtaatggatgctgcaagatccatcttccgccctgagtttatgaatagagttgatgaatatattgttttccagcctctagaccgtgagcaaataggtagcattgtcaggttacagttggagcgtgtgcagaagagagttgcagaccgcaagatgaaaatccaagtgacagacgctgctctccaacttcttggaagtttggggtatgaccccaattatggtgctaggccagtgaagcgagtgattcagcagaatgtggagaatgaacttgccaagggtattctcagaggagaatttaaggaagaggacgcagttttaatagacacagaactcactgcatttaccaacggtcaacttccccagcaaaagcttgtttttaagaaacttgcagctgaatcagaatctcccactgcagaagactcttccttggaaccctctccacaggctccgtgaactccttctactgctccttattttttccttcacatacaaatttgagtatacagtttccttatactgttgaacaatcacccctgtgtagtttgcatgcaaaatatatattttctactaccaatacgaataacatttgtcactccaaagcagtgtaaatatatactattaccccttttaatgagtcgctttctgcatagccagctcacccccatatcatataaatgatatatactagggatgatgtaaatgagcaaggatgagtattattgagttggtttggtctcagctttgataa

SEQ ID NO: 10389 - DNA, 3408 bp, Lotus japonicus
tagtgatttttctttggtctgcaatcaaatgttggcttccccatctacatatctcaaagaactgtgctacgctcgctaaccacgtctgcactgtgaaccattgaacctggttaagccggcttcagagttggtcggagtttcccagtctccggcgatggccttgacgacgtcgttttcaggccttcaccttccccactctgttccaattttccgccatggaagcgatgctcgaggtgctcagtttcagctctcctttagctctccggcaaaacccacttccctgaagaccttaacttcgctcccgttgaagaaaagagaagctttatcaaatgggtctctgagaattcaaagaaactccaagcagttctctgttcgctgcacagcttcaagtggaaagattacgcagcaggagttcacggaaatggcatggcaagcaattgtcgcatcaccagaagtggcaaaggagaacaagcatcagattgtggagacagagcacttgatgaaagctttgttagagcaaaagaatgggcttgctcgccggatcttttccaaggttggggtagataacactcggcttctagaggctactgataagcatattcagcggcaacccaaggttctaggggaaacagctggtgcaatgttggggcgtgatttggaggcattggttcagagagccagggacttcaagaaagaatatggggattcatttgtgtctgttgagcacttggttcttggttttgcccaggataaacgatttgggaagatattgtttagagattttcaaatatctcagcaagctctaaaatctgccatagagtccataaggggacgccagtcagttattgaccaaggtcatttactatttatctgcttttttgttaattgtctgccattggatagtgctgttaacctgtggattcagattgtccttttctttttcatgaccttttagagatatacattatattttcattctaagcatcttgttgtgcttacgtgcttaagctcaattttgacttgctatagatcctgaaggaaagtatgaagccttggagaaatatgggaaagatttgacagcgatggccaaagcaggaaagcttgatccagtcataggaagagatgatgaaatacgcaggtgcattcaaattctctccaggagaacaaagaacaaccctgtgctaattggtgagcctggtgttggaaagactgcaatttctgaaggacttgctcagagaattgttcaaggagatgttcctcaagctttgatgaatagaaggcttatatcacttgatatgggagcacttattgctggagcaaaatatcggggagaatttgaggataggctgaaagctgttctcaaagaagtaacagaatctgatggtcagactgttcttttcatcgatgagattcatacggttgttggggcaggtgctacaaatggtgctatggatgctggtaatctcttaaagcctatgctgggtcgtggagagctgcgatgtattggtgcgacaacattagacgagtatcggaagtatattgagaaggacccagcattggagcgtcgtttccagcaagtttttgttgaccaaccttcagttgaaaataccatttcaatattaagaggactgcgggaaagatacgagctacatcatggagttcgcatttctgatagtgcacttgtggaagctgcaattctctcagaccgatacataagtgggaggtttttgcctgacaaagctattgatctggttgatgaagcagctgctaaactgaagatggaaattacttctaaacctactgcacttgatgagattaatcggtcagtcttgaaactagagatggagagactctctctcatgaatgatacagacaaggcatctaaagataggttaaatcgtcttgagacagaactctctctcttaaaagagaaacaggatgaactgacagaacagtgggagcatgaaaagtctgtgatgactcgtcttcaatcaattaaagaagagatagatagagtaaatcttgaggttcaacaggctgaacgggagtatgatcttaatcgtgctgctgaattgaagtatggcagtataaactccttgcaacgacaactggaaagtgcagagaaggagttacatgaatatatgaactctggcaagtctatgttgagagaggaagttacaggcagtgatattgctgaaattgtaagcaagtggactggtatccccatttcaaaacttcaacaatcagagagagagaagctgttgtttttagaggatgagctccataaacgtgttgtaggtcaagatcctgctgtcaaggctatagctgaggcaattcaacggtcaagagcaggtctttcagatccccatcgcccaatcgccagtttcatgttcatgggacccacgggtgtaggaaagacagagctagccaagacccttgcttccttcatgttcaatacagaagaagcacttgtacgaattgatatgagtgagtacatggaaaaacatacagtttcgagattgattggggctccacctggatatgttgggtatgaagagggagggcagctaacagagacagttcgccgcagaccatatgcggtaattttgtttgatgagattgagaaggcacactcagatgttttcaatgtattccttcaaattttggatgatggaagagtaaccgattcacagggtcgcaccataagttttaccaacactgttatcatcatgacctcaaatgttggatctcagtacattctcaacacagatgatgacactgtgcccagtgagtccaaatatgaaaccatgaagctgcgggtaatggatgctgcaagatctatctttcgccctgagttcatgaacagaattgatgagtatattgtcttccggcctctagaccgtgaccaaataagtagcattgtcaggttacagttggagcgcgtgcagaagagaatcgcagatcgcaagatgaaaatccaagtaacagaagctgctatcaaacttcttggaaatttggggtatgatccaaattatggtgccaggccagtgaaacgagtgattcagcaaaatgtggagaatgaacttgccaagggtattcttagaggagagtttaaggatgaggacacaattttggtagacacagaagttacagcatttgccaatggtcaacttccccagcaaaagctagtgtttaggagggttgagaccgactctaaatccactgctaaatacagccaggaaccacaaattctgtgaatgcattttactgtacctttttatcacatgcttagtttcacacaaattttgagtatatagatccttttcttataccaatgagaactctgatcatgtgtataatagcttgcataatatttaaagttcttgatttgataatttttattggtcc

SEQ ID NO: 10390 - DNA, 3141 bp, Citrullus lanatus
ttccaattgcaattccgactgttcctcttccagttcagttcattgccacagacttggccgtcaacgctactcgccgttgaggctaatctttagcaatggcctccactactgcggcctcttatgcaattggtattcgttttccttcacattcctcttccatttcctccactacaaacactctcattctcaagcccccgcttgccctttccctcactgtgaaacctaaatcgcccttgctgttgaagagtaatggtgggtgccagaggtttgggaggaattcaaggtttgttgttcgctgtgatgcctcaaatggaaggattacacagcaagaatttacagaaatggcttggcaagctgttgtttcttctccagaaatagcaaaggaaaataagcatcaaattgtagagactgagcatttaatgaagaccctactggagcagaagaatgggctggctcgtcggatattttctaagattggtgttgacaatactcgtctgttggaggctaccgataaattcatcaaacgccaaccaaaggtccttggcgagtccgctggttcaatgttgggacgtgacttggaagcactgatccaacgagccagagaattcaagaaagagtatggggactcatttgtgtctgtggagcacttggttcttggatttgttcaagatcaacgctttgggaaacaactgtttaaggattttcaaatatcattgcaaactttgaaatctgcgatagagtccattaggggccgccaatctgttattgaccaagatcctgaaggcaagtatgaatcacttgaaaaatatggaaaagatctgacagcattggcaaaagctgggaagcttgaccctgtaattggaagggatgatgagattagaaggtgtattcagattctatctagaagaacaaagaacaatcctgtgctcattggtgaacctggtgttgggaaaactgctatatctgaagggcttgctcaaagaattgttcaaggtgatgttcctcaagctttgatgaatagacggttaatatctcttgacatgggggctctaattgctggagcaaaatatcgtggagaatttgaggataggctcaaggctgtactgaaggaagttacagaatcagatggccagattatcttattcatcgacgaaattcacactgtagttggagcaggtgctacaaacggtgcaatggatgctggaaatctattgaagcccatgcttggtagaggtgagctgcggtgtattggtgccacaacgttggatgagtaccgaaaatacattgaaaaggatccagcactggagcgccgattccaacaggtttatgttgatcaaccaactgtggaaaataccatttctatcctccgtgggcttcgtgaaagatatgagttgcatcatggagttcgcatatctgatagtgctcttgtagaagctgcaattctttcagaccggtatattagtggacgatttctacctgacaaagccattgaccttgttgatgaagctgctgctaagctgaaaatggaaattacctcaaaacccactgctcttgatgagatcaatagagcagtgctgaagctcgagatggagagactttcgctgacaaacgatacagacagggcttctagagataggttgagtcgccttgaaactgagttgtctcttctaaaggagaagcaagcccagctgactgagcaatgggagcacgaaaagtctgtcatgactcgtcttcagtcaatcaaagaggagatcgatcgggtaaacttggagatccagcaagctgaaagggagtatgatcttaatcgagcagctgaattgaagtatggaagcttaaattccttgcagcggcagcttgcagatgcagaaaaggagctagatgaatatatgaattctggaaagtccatgttgagagaagaagtgactggaagtgatattgcggaaatagttagcaagtggactgggatccctgtatctaagcttcaacagtccgagagggaaaagcttctacatttggaggaagaacttcacaagcgcgttgtgggtcaagaccctgcagttaaatccgttgccgatgccattcaaagatctcgagctggtctttctgatccaaaccgtcctattgctagtttcatgttcatgggtccgactggtgttgggaaaacagaactagctaaggcccttgcttcctatttattcaacacagaggaggctcttgtgcgtattgatatgagtgaatacatggaaaagcacgcagtttcaagattgattggagctccacctggttacgtaggttatgaggagggggggcagttaacagagactgttcgccgaaggccctatgcagtcattctgtttgacgagatagagaaggctcactctgatgtgttcaacgtgttccttcagattttggatgacgggcgagtaactgactcacaaggtcggactgtgagctttactaacacagttattatcatgacttcaaatgtgggttcacagtatattcttaacactgatgatgatacattaacaaaggaaacaacatatgaaaccataaaacgacgggttctggaagctgcacgatcgatttttcgtcctgagttcatgaacagagttgatgaatacatagttttccaacctctagatcgtgatcagatcagcagtattgttcggttacagctgcaacgggttcaaaagagagttgcagacaagaagatgaagatcgaggtgagcgatgcagcaattcaacttcttggaagtcttggatacgacccgaactatggggctaggccagtgaagcgtgtaatacagcagaatgtggagaatgaaattgcaaagggtattttgaaaggagaattcaaggatgaagacactattttaatagacacagaagtatcggcattctcgaacggccaacttccgcagcaaaaacttgttttcagaagaatggagaacaaggcaactgagaatccaaatgcagatagccgagaagcgtctgctcaagttctatgaaacagtgcctaaacatcttctcggtagcttttgttcttagtaaatttccataccaagataattgtttttctcttccgtatacagttcaggaaatcaatgctcatataaaaagttggttttcaaaatatac

SEQ ID NO: 10391 - DNA, 3783 bp, Citrus clementina
cccagctcgagctttaacaataacgacactagtacttgaagctcaagaaagctctagatttttgttattctcttccacttcttttaacattcccaagcaatcccaatcccgcaacagtttttgataattttttgtaatacccacatcggaaaaaagttttgtttacgatggctgcaagggcgtcgttaagtggagtcagcctttgtactcccccgccgtcgcagaagaggaatgttgtggtgtttgggcagccgcagtgcttgctgagcttcccaaggagagctaattcctttaaaggtttgaactttaattctgtacaattgaagaagcgtaatgggttgttcagtaaaggacacgacaagtcgtttcttattagatgtgaagctactagtggaagaattacgcagcaggactttacagatatggcctggcaggccattgtttcatcaccagatgtggcaaaagagaacaagcatcaaattgtggagactgaacacttgttgaaggcactgttagagcaaaagaatgggcttgctagaaggatcttttccaaggttggagttgataatacacgtcttctggaagccactgagaagtttatccaacgtcaaccaaaggtgcttggcgaaacagctggttctatgttaggacgtgatttggaagcccttatccagcgaagcagggaatacaagaaagaatatggagactcatttgtttctgttgagcatttggttcttggattcacccaggatcaacgatttgggaagcaattgttcagggattttcaaatatccttgccgacactgaaatctgcaattgaagctataaggggacgtcaatcagttattgaccaagatcctgagggtaagtatgaagcactggagaaatatggaaaagatctgacagctatggcaagtgcagggaagctagacccagtgatagggagagatgatgaaatacggaggtgtatccaaattctttccaggagaacaaagaacaatcctgtgctaattggtgaacctggtgttggaaaaactgcaatttctgaagggctggctcagagaattgtgcaaggggatgttccacaggccctaatgaaccgcaagctgatatctcttgacatgggtgcactcattgctggagcaaaatatcgtggagagttcgaagatagactgaaggcggtgcttaaagaagtaacggagtctgagggccagatcatcctattcattgatgagatacacacagttgttggagcaggtgctacaaatggagcaatggatgctggcaatctcttgaagcctatgcttggtcggggagagttgcgatgtattggtgcaactacacttgatgaatatcggaaatatatcgagaaagatccagcattggaacgtcgtttccagcaagtttatgttgatcaacctactgtggaggatacaatttctatactaaggggtctgcgtgaaagatatgaactgcatcatggagtccggatttctgacagtgcacttgtggaagctgctattctctctgatcgttatataagtgggcggttcttgcctgacaaagctattgaccttgtggatgaagcagctgccaaactgaaaatggaaattacttcaaaacctactgcccttgatgagatcaatcgttcggtattgaaactagagatggagaggctatctctgacaaatgatacagacaaagcttcaaaagataggttgaaccgccttgaggctgaactgtcacttctgaaggagagacaagctcagctgactgagcagtgggagcacgaaaagactgtcatgacgcgcattcagtccattaaagaagagattgacagagtaaatcttgagatccagcaggctgagcgtgagtatgatcttaatcgtgctgctgagctgaagtatgggagcctcaatgctttgcagcgccaacttgaaagtgccgaaaaagagttaaatgagtacataagctctggaaagtccatgttgagagaagaagttacgggaagtgacattgctgaaattgttagtaaatggactggtattcctgtttccaagcttcaacaatcagagagggagaagctgttacatttggaggaagagctgcacaaacgtgttgtgggtcaagatccagcagtgaaatcagtagctgaggcgattcagcgatctcgagcaggtctttctgatcctcaccgtccaatagctagtttcatgttcatgggtccaactggtgttggaaagactgaactggctaaggcactagcttcctacatgttcaacactgaagaggcccttgtacgaattgatatgagtgagtatatggaaaagcatgctgtttcaagattgattggagccccacctggttatgtgggatatgaggaaggaggacagttgacggaggtagttcgccgtaggccctatgcagtaattctgttcgacgagattgagaaggcccactctgatgtatttaatgtgtttcttcaaattctggatgatgggagagttactgattcacagggtcgtactgtgagtttcaccaatactgtcatcattatgacttcaaacgtgggttcacaatacatacttaatatggatgatgagacattcccgaaggagacagcctatgaaactatcaaacagcgggtaatggatgctgcaagatcaatattccgccccgagttcatgaaccgagtagatgagtatatagtattccaaccactggaccgtgaccagataagcagtattgtgaggttacagttggatcgggtgcagaagaggattgcagaccggaagatgaaaatgcaagtgaccgatgcagctattcagctccttgggagtcttgggtatgaccccaactatggtgcaaggccggtcaagagggtgattcagcagtacgttgaaaatgagcttgccaagggcattctgagaggggagttcaaggatgatgacacaattgtaacagacactgaagttacagcattttccaatggccagcttccgcagcaaaagctagtcttcaggagacttgataccagttcggatgcttctgctgcagataaccaagaagctttctcacagacagcataaatgtctgtccaatgtgtttaattttacgaaattatatttgtgttcagcaaaattatgagcgaattttcttaactgataggctgtaacctgcttcttgtatatgatgatgctttatacaaaatcataagccttgaagtgtttctttttcaacgatcatcacaaattcacattcgttttatcaatgttcctagtgataatttttggtcctctatctgttacgttatacgtggaaagtaagatgctttcgtcgtcatcaatgtattttgtgtgtcatgttatcaagtctgtttcaattgtgtgagaaacgactgtttctgattcggatactacaagcaaatgaatcaggaaaatgcaatatcaattatatacagacatataaaagaacatgtaatttgcttaaactatggtacagtgtaggtcagtaagttttcttctttgtaacgttcttcattcgatgtaagccacaaacattggtgcattataatgggcttcgatactaagtgagtccttgtttaaatctttctctgtcagtttgtttaaatctttctctgtaagttctgaagcatcaatgcccgtgttttgccatccggtttaaggccactctcacgcattcttgtgtacaccttctttgctgattcaaacttgcctcttaaacacattccttgaataacagcattataaagagatacatctg

SEQ ID NO: 10392 - DNA, 3783 bp, Citrus sinensis
cccagctcgagctttaataataacgacactactacttgaagctcaagaaagctctagatttttgttattctcttccacttcttttaacattcccaagcaatcccaatcccgcaacagtttttgataattttttgtaatacccacatcggaaaaaagttttgtttacgatggctgcaagggcgtcgttaagtggagtcagcctttgtactcccccgccgtcgcagaagaggaatgttgtggtgtttgggcagccgcagtgcttgctgagcttcccaacgagagctaatttctttaaaggtttgaactttaattctgtacaattgaagaagcgtaatgggttgttcagtaaaggacacgacaagttgtttcttattagatgtgaagctactagtggaagaattacgcagcaggactttacagatatggcctggcaggccattgtttcatcaccagatgtggcaaaagagaacaagcatcaaattgtggagactgaacacttgttgaaggcactgttagagcaaaagaatgggcttgctagaaggatcttttccaaggttggagttgataatacacgtcttctggaagccactgagaagttcatccaacgtcaaccaaaggtgcttggcgaaacagctggttctatgttaggacgtgatttggaagcccttatccagcgaagcagggaatacaagaaagaatatggagactcatttgtttctgttgagcatttggttcttggattcacccaggatcaacgatttgggaagcaattgttcagggattttcaaatatccttgccgacactgaaatctgcaattgaagctataaggggacgtcaatcagttattgaccaagatcctgagggtaagtatgaagcactggagaaatatggaaaagatctgacagctatggcaagtgcagggaagctagacccagtgatagggagagatgatgaaatacggaggtgtatccaaattctttccaggagaacaaagaacaatcctgtgctaattggtgaacctggtgttggaaaaactgcaatttctgaagggctggctcagagaattgtgcaaggggatgttccacaggccctaatgaaccgcaagctgatatctcttgacatgggtgcactcattgctggagcaaaatatcgtggagagttcgaagatagactgaaggcggtgcttaaagaagtaacggagtctgagggccagatcatcctattcattgatgagatacacacagttgttggagcaggtgctacaaatggagcaatggatgctggcaatctcttgaagcctatgcttggtcggggagagttgcgatgtattggtgcaactacacttgatgaatatcggaaatatatcgagaaagatccagcattggaacgtcgtttccagcaagtttatgttgatcaacctaatgtggaggatacaatttctatactaaggggtctgcgtgaaagatatgaactgcatcatggagtccggatttctgacagtgcacttgtggaagctgctattctctctgatcgttatataagtgggcggttcttgcctgacaaagctattgaccttgtggatgaagcagctgccaaactgaaaatggaaattacttcaaaacctactgcccttgatgagatcaatcgttcggtattgaaactagagatggagaggctatctctgacaaatgatacagacaaagcttcaaaagataggttgaaccgccttgaggctgaactgtcacttctgaaggagagacaagctcagctgactgagcagtgggagcacgaaaagactgtcatgacgcgcattcagtccattaaagaagagattgacagagtaaatcttgagatccagcaggctgagcgtgagtatgatcttaatcgtgctgctgagctgaagtatgggagcctcaatgctttgcagcgccaacttgaaagtgccgaaaaagagttaaatgagtacataagctctggaaagtccatgttgagagaagaagttacgggaagtgacattgctgaaattgttagtaaatggactggtattcctgtttccaagcttcaacaatcagagagggagaagctgttacatttggaggaagagctgcacaaacgtgttgtgggtcaagatccagcagtgaaatcagtagctgaggcgattcagcgatctcgagcaggtctttctgatcctcaccgtccaatagctagtttcatgttcatgggtccaactggtgttggaaagactgaactggctaaggcactagcttcctacatgttcaacactgaagaggcccttgtacgaattgatatgagtgagtatatggaaaagcatgctgtttcaagattgattggagccccacctggttatgtgggatatgaggaaggaggacagttgacggaggtagttcgccgtaggccctatgcagtaattctgttcgacgagattgagaaggcccactctgatgtatttaatgtgtttcttcaaattctggatgatgggagagttactgattcacagggtcgtactgtgagtttcaccaatactgtcatcattatgacttcaaacgtgggttcacaatacatacttaatatggatgatgagacattcccgaaggagacagcctatgaaactatcaaacagcgggtaatggatgctgcaagatcaatattccgccccgagttcatgaaccgagtagatgagtatatagtattccaaccactggaccgtgaccagataagcagtattgtgaggttacagttggatcgggtgcagaagaggattgcagaccggaagatgaaaatgcaagtgaccgatgcagctattcagctccttgggagtcttgggtatgaccccaactatggtgcaaggccggtcaagagagtgattcagcagtacgttgaaaatgagcttgccaagggcattctgagaggggagttcaaggatgaagacacaattgtaatagacactgaagttacagcattttccaatggccagcttccgcagcaaaagctagtcttcaggagacttgataccagttcggatgcttctgctgcagataaccaagaagctttctcacagacagcataaatgtctgtccaatgtgtttaattttacgaaattatatttgtgttcagcaaaattatgagcgaattttcttaactgataggctgtaacctgcttcttgtatatgatgatgctttatacaaaatcataagccttgaagtgtttctttttcaacgatcatcacaaattcacattcgttttatcaatgttcctagtgataatttttggtcctctatctgttacgttatacgtggaaagtaagatgctttcgtcgtcatcaatgtattttgtgtgtcatgttatcaagtatgtttcaattgtgtgagaaacgactgtttctgattcggatactacaagcaaatgaatcaggaaaatgcaatatcaattatatacagacatataaaagaacatgtaatttgcttaaactatggtacagtgtaggtcagtaagttttcttctttgtaccgttcttcattcgatgtaagccacaaacattggtgcattataatgggcttcgatactaagtgagtccttgtttaaatctttctctgtcagtttgtttaaatctttctctgtaagttctgaagcatcaatgcccgtgttttgccatccggtttaaggccactctcacgcattcttgtgtacaccttctttgctgattcaaacttgcctcttaaacacattccttgaataacagcattataaagagatacatctg

SEQ ID NO: 10393 - DNA, 3294 bp, Trifolium pratense
agtgatggcttctacgacgtcgttttctcttccttattcagttccaatttcatgctacagaaactcttctcgccgccatctttctctttccttctcagccaaatccatttccctcaaatcatcacttcaattcaatcaaacgaagcttcttccaaatggcttttccagaacaattcaaaccaattcatcacgtttctctgttcgctgtgaagcttctggaaccaactggaactggaaggattacacagcaagagttcacagagatggcctggcaggcgatagttttgtcaccagaggtggccaaagagaacaagcatcagattgtggagacagagcatttgttaaaggctttgttggagcagaagaatggacttgctcgtaggattttttccaaggttggggtggataacactcggctgctagaagctactgataagtacattcaacggcaacctaaggttataggggaatcagctggttcaatgttggggcgtgatttggaggcattgattcaaagagccagggactacaagaaagaatatggggattcatttgtttcagttgagcacttggttcttggttttatccaagaccaacgatttggaaagcaactctttaaagaatttcaaatatctcagcaaggtctaaaatctgcaatagagtcaattaggggacgccaggcagtaattgaccaagatccggaaggcaagtatgaagccttggaaaaatatggaaaagatttgacggcaatggctaaagcaggaaaacttgatccagttataggaagagatgatgaaatacgcaggtgcatccaaattctctccaggagaacaaagaacaatcctgtgctgattggtgagcctggtgtcggaaagactgcaatttctgaaggacttgctcagagaattgttcaaggagatgtacctcaagctttgatgaatcgaaggcttatatctcttgatatgggtgcacttattgctggagcaaaatatcgcggagaatttgaggacaggctgaaagccgttctcagagaagtaacagaatctgatggtcaaactatacttttcattgatgagattcatacagttgttggggcaggtgctacaaatggtgctatggatgctggtaatctcttaaagcctatgcttggtcgaggggagctgcgatgtattggtgcaacaacattggatgagtatcggaaatatattgagaaggatccagcactagaacgtcgctttcagcaagtttacgttgaccaaccttcagttgaaaataccatttcaatactaagggggctgcgggaaagatacgagttgcatcacggagttcgcatttctgacactgcactagtggatgctgcgattctctcagatcgatacataagtgggaggtttttgccagacaaagctattgatctggttgacgaagcagctgctaaactgaaaatggaaatcacttctaagcctactgcactcgatgagattaataggtcagttttgaaactagagatggagagactatctctcatgaatgatacagacaaggcttctaaagatagattaaaccgtctcgagacagagctctctctcctaaaagggaaacaggatgagctgtccaaacaatgggagcatgaaaagtctgtaatgactcgtcttcagtctatcaaggaagagatagacagggtaaaccttgagatccaacaggccgagcgggaatatgatcttaatcgtgctgctgaattgaagtatggcagtcttaattctttgcaacgacaactcgagggtgcagagaaggaattacatgaatatatgagctccggtaagtctatgctgagagaggaagttactgggaacgatattggtgaaattgtgagcaagtggaccggtatcccaatttctaaacttcaacaatcagagagagagaagttgttatatttagaggacgaactccataagcgtgttgtaggtcaagatcctgcggtaaaggcggtagccgaggcgatccaacgttcaagagcaggtctatcagaccctcaccgcccaattgctagcttcatgttcatgggtcccactggtgtaggaaagactgagttagccaaggcccttgcttcgtacatgttcaacacagaagaagcacttgtgcggattgatatgagtgagtacatggaaaagcatacagtttcaagattgatcggagctccacctggatatgttgggtacgaagagggtgggcaactaacagaggtagttcgtcgaagaccatatgcagttattttgtttgatgagatagagaaggcgcactcggatgttttcaatgtattccttcaaattttggatgatggaagagtaaccgattcacagggccgcacagtaagttttaccaacactgttatcatcatgacctcaaatgttggatcatcatacattctcaacacagatgatgacactacaccgaaagatatagcatatgaaaccataaagcagcgggtaatggacgctgcaagatccatctttcgccccgagttcatgaatagagttgatgaatatattgttttccggcctcttgaccgtgaccaaataagcaggattgtcaggttacagttggagcgcgtgcagaaaagaattgcagaccgcaagatgaaactccgagtaacagaagctgctatccaacttcttggaagtttagggtacgatccaaactacggtgctaggccggtgaagcgagtgattcagcaaaatgtggagaatgaacttgcaaagggtattcttagaggagattttaaggaagaggacacaattttagtagacactgaagtcacagtacttgccaatggtcaaattcctcagcaaaaactaacttttaggagggtggaagctgattcagagtcttctgctaaaaacagcagggaaagctctccacagattctatgaaaggattgcaattgatgttcctttatctccacatgccaagtttacacaaattttgagaatagatcattttctttattatagaattgaactctggtcctgtgtatagcttgcatataatttatagttatttatgttttactttttattggtcactacagattatcataaaaaagagtataggtacaaggtaacattatctttaatttcatgaaaacagtgtgaagtgacatgcattttgtcacatattagaaattttgatatgttagtttgaaaactaaactctatcaacacctaaagtaagcagataactaaacaatgttatactgttgaaggcggtgaagagtaaagaggttattgggatatg

SEQ ID NO: 10394 - DNA, 3244 bp, Vitis vinifera
cccacacccccagaacctcccagaagactctgcccaaacatttatttaattcctcacaaaacccttctctcttccaattcaaacctcctaatggccgcaacgacgtcgttttcccgtgttcaccttcgttttcccaccaactgctccaacggacccgctctttctcctcacccccgcctctctctcaacttgtctgcaaggcgtaggtctttgaaagccctaaattcgttgaggttgaagcaaaacgatgtctttctttccaaacggtttgctgggtcgggtaagtgtcccaggtctttcgttgttcgatgcgatgcttccggtggaaggatcactcaacaagatttcacagagatggcttggcaagcaattgtttcttcaccagaagtggcaaaggagaacaagcatcagatagtagagacagagcatttgatgaaggctctgctggagcagaagaatggacttgctcgcagaatcttctcgaaggctggggttgataatacccgtctccttgatgccactgacaagttcattcaacgccagcctaaggttattggtgaatcagctggttcaatgttaggacgggacttagaaagcttgattcagcgggccagggagtacaagaaagagtatggtgattcctttgtgtcagttgagcacttggttcttgcctttgcacaagatcaacgttttgggaagcaactgtttaaggattttcaaatctcccagaaagccttaaaatctgcaatcgaggccataagaggacgccaacaagtcattgatcaagatcctgaagggaagtatgaagcacttgagaaatatggaaaagatttgacagccatggcaaaagcaggaaagcttgacccagtaataggaagagatgatgaaatacggaggtgcatccagattctctccaggagaacaaagaacaatcctgtgctaattggtgagccaggtgttggaaaaactgcaatttctgaagggcttgctcagagaatcgtgcaaggggatgtgcctcaagctttgatgaatcgtaagcttatatctcttgacatgggtgcactcatagctggggcaaaatttcgaggggaatttgaggataggctgaaggctgtactcaaggaagtaacagaatcagatggccagactatcctttttattgatgagatccacacagttgttggagcaggtgctacaaatggtgcaatggatgcgggcaatctactgaaaccgatgcttggtcgtggagagttgcgatgtattggtgcaacaacactggatgagtatcggaaatatattgagaaagatccagcattggaacgtcgtttccagcaagtttatgtggatcaacctacagtggaagatacaatttccatacttcgtgggttgcgggaaagatatgaactgcatcatggtgtccgcatttctgacagtgcacttgtggaggcggcaattctgtctgatcgttacatcagtggtcgctttttacctgacaaagctattgacctagttgatgaagcagctgctaaactgaaaatggaaattacatccaaacccactgcacttgatgagatcaaccgttctgtactgaagctggagatggaaaggctgtctcttacaaatgatacagataaagcttcaaaagataggttgagtcgccttgaggctgagctgtctctgttaaaagagaaacaagcagagctgagtgagcaatgggagcatgaaaaatcagttatgacacgccttcagtcaatcaaagaagagattgacagggtgaatcttgagattcagcaggctgagcgggagtatgaccttaatcgtgctgctgaactcaagtatgggagcctgaactctttgcagcgtcaacttgaaaatgcggaaaaagagttggatgagtatatgaaatctgggaaatccatgctaagagaagaggttacagggaatgatattgctgaaattgtcagtaaatggactggtatccctgtttccaagctacaacaatcagagagggagaaactgttacatttggaagaagagctacataaacgtgtcgttggtcaagatcctgcagtgagatcagtagctgaggccatccagcggtcccgagcaggtctctctgatccacaccgcccaattgctagtttcatgttcatgggtcctacaggtgttgggaagacagagctagccaaggcccttgcttcctacatgttcaacactgaagaagcccttgtgcgaattgatatgagcgagtacatggaaaaacatgcagtttcaagattgataggggcaccgcctggttatgttggttacgaggaaggagggcagttgacagagacagtccgcaggaggccatatgcagttattctgtttgatgaaatagaaaaggcccattcagatgtgttcaatgtgtttcttcagatcctggatgatgggagggtgactgactcacagggtcgcactgtgagctttaccaacactgtcatcattatgacttcaaatgtgggttcacagtacattctcaatatggacgatgagaccttaccaaaagagacagcttatgaaactattaagcagagggtaatggatgctgcaagatcaattttccgtcctgagttcatgaaccgagttgatgagtacatagttttccagcctctggaccgtgatcagataagcagtattgtcaagttacagttggaacgggtacagttgagactagcagaccggaagatgaaactccaggtgaccgaaacagcgattcagctcctaggaagtcttgggtatgatcccaattatggtgctaggccagtcaagcgggtgatccagcaaaatgttgaaaatgaacttgccaagggcatattaaggggtgagtttaaggacgaggacacggtgttgattgacacagaggtcacagcattttccaatggccagcttccccagcaaaagctaattctgagaaaactggagtctgattcagacacaccagctgcagaaggccaagaagctttttcacaaaccatctgaacgtctttttgtagttttatggtcacctctagtttctaactttctacaaatgcctataaagatatccggtttatacaaggtgatgttcatctcaccttgcatgctgcacttccatctctcaatctagtgtgtattagaattgtcttttctttttcctttcttttctcattggcttaacactattcacatttccccagagtgccttgggtcttttaacacagcg

SEQ ID NO: 10395 - DNA, 3226 bp, Prunus persica
atcttttctcaattcctacgcaaagcttcttcttacttctccaacatttcaaggcaagctcctttttcttttctcaatctgaaaatccaaacccacttcactctcacgaactccacaacatcaacgataagcagctttccgagctccgccaatggcgtccgcgacctcctttgcttctggggtcggtcttcctcttccccaatcggtttcttccaaatggtgcaataaagctgctatctttgctcgcccacacatctccctcagcttccatgccagaaccgaatccttcagggccttaacttcgcggcaattgagccaaaacggtgcgttccgaactgggttgcggagaaatagtcggagttcgaggccttttgttgtgcgctgcgatgcttcaactggaaggattacacaacaggactttacagaaatggcatggcaatcgattgtttcgtctccagaagtggcaaaagagaacaaacatcagatagtggagactgagcatttgatgaaagcactcttggagcaaaagaatggccttgctcgtcgcattttctccaaagctgggatcgacaatacccgtcttcttgaggcaactgataagtatattcaacgccaaccaaaggttcttggtgaatctgcgggctcaatgttaggacgtgacttggaagccttgattcaacgagccagggattacaagaaagagtatggggactcattcgtctctgtggagcatttggttcttggtttcactcaagatcaacgatttgggaagcaattatttagagattttcaaatatccaaggaaactttgaaatctgctatagaatccatacggggacgccaatcagttattgaccaagatcctgaaggaaaatatgaagcacttgaaaagtatggaaaggatttgacagctatggcaaaggcaggaaagcttgacccagtaataggaagagatgatgaaatacgcaggtgcatccagattctctccagaagaacaaagaacaacccggtgctgattggcgaaccaggtgtcggaaaaactgcaatttccgaagggcttgctcaaagaattgtgcaaggggatgtcccacaagctttgatgaaccgtaagctaatatcccttgacatgggttcactaattgctggggcaaaatatcgtggagaatttgaggataggctgaaggcagtacttaaggaagtaacagaatcagagggccagataatcctttttattgatgagatccacacagttgttggggcaggtgctacaaatggtgcaatggatgctggcaatctcttaaaacccatgcttggtaggggagagttgcggtgtataggtgcaacaacactggatgagtatcgtaaatacattgagaaagatccagcattggagcgtcgtttccagcaagtttatgttgatcagcctactgtggaagataccatttcaatactccggggactgcgtgaaagatatgagttgcatcatggagtccgcatttctgatggtgcactcgtggaagctgcgattctctcagaccgttacatcagtgggcgatttttacctgacaaagctattgacttagttgatgaagctgctgctaaattgaaaatggaaattacgtcaaagcccacagccctagatgagatcaaccgttcagtgttgaaacttgaaatggagagactatcacttacaaatgatacagacaaagcttctaaagagagactgaaccgccttgaggctgagttgtctctcttaaaagagaaacaagctgagctggctgagcagtgggagcatgaaaaatcggtcatgactcgcattcagtcaatcaaggaagagattgacagggtaaatcttgagatccagcaggctgaacgagagtatgatctcaaccgggctgctgagttgaagtatgggagtctgaattctttgcagcgccaacttgttggtgcagaaaaagagctagatgagtatatgaagtctgggaagtccatgctgagagaggaagttactggaaatgacattgctgaaatagtcagcaagtggactggtattcctgtttccaagttgcaacaatcggagatagaaaagctcttgcacttggaggatgagctgcataaacgtgttgtgggtcaggatcctgcagtgaaatcagtagctgaagctattcagcggtctcgagcaggtctctcagatcctcatcgcccaattgctagtttcatgttcatgggtcccactggtgttgggaagacagaactagctaaggcccttgcctcctacatgttcaacactgaagaagcacttgtaagaattgatatgagtgagtacatggaaaagcatgctgtttccagattgataggagctccacctggttatgtggggtatgaggagggaggacagctgacagagactgttcgccggaggccgtattcagttattttgtttgatgagatagagaaagcacattctgatgtgttcaatgtgttccttcaaattttagatgatgggcgagtaactgactcacagggtcgcactgtgagtttcaccaacactgtcatcatcatgacctcaaatgtgggttcacagtacatactaaacactgatgatgacaccatgccaaaggacttggcttatgacactataaagaagcgggtaatggaagctgcaagatcaatatttcgacctgagttcatgaaccgggttgatgagtacatagttttccagcccttggaccgtgatcagataagccgtattgtcaagttacagttgaaccgagtgcaaaagagaattgcagaccgcaagatgaaagtcaaggtgagtgatgcagccatccagcttcttgcaagtctcgggtatgatccaaactatggtgctaggccagtcaagcgggtgatacagcagtacgtcgaaaatgagcttgccaagggcatcttgagaggagattttggggaagaagacactgtatttatagacacagaggttacagcattttcgaatggccaactaccccagcaaaagcttttgttcaagaggcttgaaactgatgattcagaatctccagctgcagagaaccaagaggctttctcagagactctatagatgctaacaaagttggggcgaggtcctctggacatagtcaggagatttctttcttgtatatgggataatgttatgttacagaaacttataagcttcaaaatatgctttaatcttttgttcatatcaata

SEQ ID NO: 10396 - DNA, 3447 bp, Prunus mume
aaaaaataaagaaatttcgaaatttgagcttcgttaatcggtacttcgcttcagtgacaggaagttgcgagaagcctcttcacctcacctcataaatctccatatcttttctcaattcctacgcaaagcttcttcttccttctccaacatttcaaggcaagctcctcttccttttctcaatctgaaaatccaaacccacttcactctcacgaactccacaacatcaacgataagcagctttccgagctccgccaatggcgtccgcgacctcctttgcttctggggtcggtcttcctcttccccaatcggtttcttccaaatggtgcaataaagctgctatctttgctcgcccacacctctccctcagcttccatgccagacccggatccttcagggccttaacttcgcggcaattgagccaaaacggtgcgttccgaactgggttgcggagaaatagtcggagttcgaggccttttgttgtgcgctgcgatgcttcaactggaaggattacacaacaggactttacagaaatggcatggcaatcgattgtttcgtctccagaagtggcaaaagagaacaaacatcagatagtggagactgagcatttgatgaaagcactcttggagcaaaagaatggccttgctcgtcgcattttctccaaagctgggatcgacaatacccgtcttcttgaggcaactgataagtatattcaacgccaaccaaaggttcttggtgaatctgcgggctcaatgttaggacgtgacttggaagccttgattcaacgagccagggattacaagaaagagtatggggactcattcgtctctgtggagcatttggttcttggtttcactcaagatcaacgatttgggaagcaattatttagagattttcaaatatccaaggaaactttgaaatctgctatagaatccatacggggacgccaatcagttattgaccaagatcctgaaggaaaatatgaagcacttgaaaagtatggaaaggatctgacagctatggcaaaggcaggaaagcttgacccagtaataggaagagatgatgaaatacgcaggtgcatccagattctctccagaagaacaaagaacaacccggtgctgattggtgaaccaggtgttggaaaaactgcaatttccgaagggcttgctcaaagaattgtgcaaggggatgtcccacaagctttgatgaaccgtaagctaatatcccttgacatgggttcactaattgctggggcaaaatatcgtggggaatttgaggataggctgaaggcagtacttaaggaagtaacagaatcagagggccagataatcctttttattgatgagatccacacagttgttggggcaggtgctacaaatggtgcaatggatgctggcaatctcttaaaacccatgcttggtaggggagagttgcggtgtataggtgcaacaacactggatgagtatcgtaaatacattgagaaagatccagcattggagcgtcgtttccagcaagtttatgttgatcagcctactgtggaagataccatttcaatactccggggactgcgtgaaagatatgagttgcatcatggagttcgcatttctgatggtgcactcgtggaagctgcgattctctcagaccgttacatcagtgggcgatttttacctgacaaagctattgacttagttgatgaagctgctgctaaattgaaaatggaaattacgtcaaagcccacagccctagatgagatcaaccgttcagtgttgaaacttgaaatggagagactatctcttacaaatgatacagacaaagcttctaaagagagactgaaccgccttgaggctgagttgtctctcttaaaagagaaacaagctgagctggctgagcagtgggagcatgaaaaatcggtcatgactcgcattcagtcaatcaaggaagagattgacagggtaaatcttgagatccagcaggctgaacgagagtatgatctcaaccgggctgctgagttgaagtatgggagtctgaattctttgcagcgccaacttggtggtgcagaaaaagagctagatgagtatctaaagtctgggaagtccatgctgagagaggaagttactggaaatgatattgctgaaatagtcagcaagtggactggtattcctgtttccaagttgcaacaatcggagatagacaagctcttgcacttggaggatgagctgcataaacgtgttgtgggtcaggatcctgcagtgaaatcagtagctgaagctattcagcggtctcgagcaggtctctcagatcctcatcgcccaattgctagtttcatgttcatgggccccactggtgttgggaagacagaactagctaaggcccttgcctcctacatgttcaacactgaagaagcacttgtaagaattgatatgagtgagtacatggaaaagcatgctgtttccagattgataggagctccacctggttatgtggggtatgaggagggaggacagctgacagagactgttcgccggaggccatattcagttattttgtttgatgagatagagaaggcacattctgatgtgttcaatgtgttccttcagattttagatgatgggcgagtaactgactcacagggtcgcactgtgagtttcaccaacactgtcatcatcatgacctcaaatgtgggttcacagtacatactaaacgctgatgatgacaccatgccaaaggacttggcttatgacactataaagaagcgggtaatggaagctgcaagatcaatatttcgacctgagttcatgaaccgagttgatgagtacatagttttccagcccttggaccgcgatcagatcagccgtattgtcaagttacagttgaaccgagtgcaaaagagaatcgcagaccgcaagatgaaaatgaaggtgagtgatgcagctatccagcttcttgcaagtctcggatatgatccaaactacggtgctaggccagtcaagcgggtgatacagcagtacgtcgaaaatgagcttgccaagggcatcttgagaggagattttagggaagaagacactgtgtttgtagacacagaggttacagcgttttcgaatggccaactcccccagcaaaagctattgttcaagaggctggaaactgatgattcagaatctccagctgcagagaaacaagaggctttctcagagactctatagatgctaacaaagttggggcgaggtcctctggacatagtcaggagatttctctcttgtatatggcataatgttatgttacagaaacttattagcttcaaaatatgctttaatcttttgttcatatcaatatttcatgtttccaaaatcccatcgttgcagattttgttagtgtctcgacagaaaaagctgcattattgcctttacattgcttgaaatattaagaataataaagatcatattttaccct

SEQ ID NO: 10397 - DNA, 3534 bp, Cannabis sativa
ttatcgtgtaaatctaggacacgtgtacgaacataaagaaactgatgagaaccaaccaagggatgagagctgaggtgagcccagcccaacccaaaccaccagactcccgacgtttcacgaacactctccactcttctttcttttgtttcttttctctctattcacaacacaaacctctgtatttttatggtgtaattgttgggcttcattttcaaaaccaaatcaccaacaaagaacactaaacaaaaacaatactcaaacaaagatttactgtgagttttctaaattctcacgcaaagctaaacaagtctcttcctgtacttgattattactattttcctcttttttccaaaattctaggcaactgtaaataatcacactttctacatatatataattgcaactggaaaaatttggagtggagtggacggaggagtagagagctgtaaaaatggcttccaccgcttcctttgcttctggagtcagttttcatctctcttccaaccgttgtagtaaaactgctttctttgctcggccgcagctttctttgatctttcctccgaaacccaattcgtttcgggccttaaagtcgctgcaattgaagcgaaatggtgctttctcgaatgggtttcaaagagttggtcggagttcgaggcggcttgttgttcgttgtgatgcttcgactggaactggaaggattactcaacaagagttcactgaaatggcttggcaagccattgttccagaagtggcgaaagagaacaagcatcagatagtggagactgaacatctaatgaaggcccttttggagcagaagaatggtcttgctcgtaggattttctcaaaagttggggtcgacaatactcgtcttcttgagaccactgataaattcatccaacgccagcccaaggttctgggtgagtctgcgggttcaatgttaggtcgtgatttggaggccttaattcaacgtgccagagattacaagaaagagtatggtgactcatttgtgtctgtggagcatttggttcttggttttattcaagaccaacggtttgggaagcaattgctgaaagattttcaggtgtctactcaaagtttgaaaactgcaattgagtccataaggggtcgccaaacagtaatcgaccaagatcctgaagggaagtatgaagcattggaaaagtatggaaaagacttgacggccatggctaaagcaggaaaacttgatcctgtaataggaagagatgacgaaatacgcaggtgcattcagattctctctagaagaacaaagaacaatcctgttcttattggtgagccaggtgttggtaaaacagctatttctgaagggctagctcaaagaattgtgcaaggtgatgtgccacaagctttgatgaaccgtaagcttatatctcttgacatgggtgcactcattgctggagcaaaatacaggggtgaatttgaagataggctaaaggcggttctcaaggaagtaacagattcagaaggacagattgttctttttattgatgagatccacacagttgttggtgcaggtgccacaaatggtgcaatggatgcgggcaatctcttgaagcctatgcttggacgaggggagttgcggtgcattggtgcaacaacactggatgaatatcgcaagtacattgagaaagatcctgcattggagcgtcgtttccagcaagtatatgtagatcaacctacagttgaagatacaatatcaatcctcaggggattacgcgagagatatgagttgcatcatggagtccgaatatctgatggtgcccttgttgaagctgctattctatcagatcgttatatcagtgggagatttttacctgacaaagctattgacttagttgatgaagcggctgctaaactgaaaatggagattacttcgaaacccactgctcttgatgagatcaatcgttcagtgctgaaacttgagatggaacggttatctcttacgaacgatacagataaagcttctaaagacaggttgagtcgccttgatgctgagttgtctctcttgaaagagaaacaagctcagttgactcagcaatgggagcatgaaaagtctgtgatgaccgggcttcagtcaatcaaagaagagatcgacagggtaaaccttgaaatccagcaggccgaacgggagtatgatcttaaccgtgcagctgaactgaagtatgggagtctgaactcactgcagcgccaacttgcagctgcagaaaaagagttggatgagtatatgaaatcagggaagtctatgctcagagaggaagttactggaaatgatattgctgaaatagtcagtaaatggaccggtattcctgtttccaagcttcaacagtctgagagggaaaagctgcttcacttggaggaagagctgcataaacgtgtggttggtcagaaccctgcagtaactgccgttgctgaggccatccaacgatcacgagcaggtctatcagatcctcacaggccaattgctagtttcatgtttatggggccaactggtgttgggaagacagagctagctaaggcccttgcttcttacatgttcaatacagaagaagcacttgtgagaattgacatgagtgaatacatggaaaaacatgctgtgtcaagattgattggtgcgccacctggttatgtagggtacgaggaaggaggacagctgacagagactgttcgccggaggccttacgcagttattttgtttgatgagattgagaaggcacattctgatgtcttcaatgtcttccttcaaatattagatgatggcagagtaactgactcgcagggtcgcactgtgagtttcacaaacactgtcatcatcatgacatccaatgttggttcacagtacattctcaacacagatgatgacacctcaccaaaggagttggcctatgaaaccataaagcaacgggtaatggaagctgcaagatcagtctttcgccctgagtttatgaaccgtgtggatgagtacatagtattccaacccctggaccgcgaacagatcaacagcattgtgcgcttacagttggcacgagtgcaaaagaggattgcagatcgcaaaatgaagatcacagtaagcgatgcagctatcgagcttctcggtagccttggctatgatcctaactatggtgccagaccagtgaagcgagtgatacagcagtatgttgagaatgaacttgccaaaggcatactgagaggagattttaaggaagaagactgcgtggctatcgacacagaagtgacggccttcaccaatggccagctcccccagcacaagctagtcttccagaggcaagagcctgaaactgagcctcaagcttcagaaggccaagaggctttgtcaggaaccgtatgattgtctttgaatttcacatcttcacaataaattagcttttaacctaaattttggaacgtataacaatgcttcaatagatgtctttattattgtcaataaaaataaataaatatataattcaaatcagtgattgattcttactttaattcatc

SEQ ID NO: 10398 - DNA, 3444 bp, Lactuca sativa
tggaaataatggaaatatggactgatgggttgtgacttgtggtggcaggaacagaaacaactcgacaagcctcgcactctcttgaaccatcttcttccttcttcatatccttccgtatatatatctcaactgtttcgaccctcgcctccactcatcacttaactcacaagttttgcgttggaacttaccagaaccctatctttcccgtattcccactcaatcccctctacttttccattccttaatcaatcccaagaaccttaatttattggtcactggactcactcttcttccgtcaccgatggcaacgacgacgtccttccccggcgtccgcatccacgttacatcctctactggcatcgatagaactacattgtttgctcaaccgtctgtctccttgaactctttttccaaacctagaacaactaccctacgttcgttgaaattaaggagcaggagtaatgatgttttgttgctcgctcggacgggtgataggtttggaggcaagagctcccggtcttttgttgttcgttgcgacgcttcatccaatgggaggatcactcaacaagaattcacagagatggcatggcaagcaatagtgtcttcacctgaagtggcaaaggagaacaagcatcagatagtggagactgagcatttgatgaaagcccttctggaacagaaaaacgggttagctagacgaatcttctccaaggctggtgtggataacacccgcctacttgaagccactgataaatacattcagcgacaaccaaaggttcttggtgagtcagctgggtcgatgctagggcgtgatttggaaggcctaatgcaaagagcaagggattacaagaaagagtatggtgactcatttgtgtctgttgagcatttggtacttggttttgtacaagataaccgatttgggaaacaattgttcaaagatttccaaatttctttaaaaaccttaaagaacgcaatagaatccatcagaggacgacaaacagtaatagaccaagaccctgaagggaagtatgaatcattagagaagtatggtaaagatttgactgctatggcgagagcagggaagcttgatcctgtgataggaagagatgatgaaatacgcagatgcatccagattttatcaaggagaactaagaacaaccctgtcctcattggtgaaccaggtgttggaaagactgcaatttctgaaggacttgctcagagaatagtgcaaggtgatgtgcctcaagctctaatgaaccgaaagttgatatcccttgacatgggtgcacttattgctggagcaaaatatcgtggagaatttgaagatcgactcaaggcagtgctcaaggaggtgactgaatcagatggacaaatcgttctgttcattgatgagatccatactgttgttggggcaggtgctacaaatggtgcaatggatgctggaaatctgttgaaaccaatgcttggtcgtggagagttgagatgcattggtgcaacaacattggacgagtatcgtaaatatatcgaaaaagatcctgcattagaacgccgatttcaacaggtttatgttgaccaacctacagtagaagatacagtatctatcctccgtggactccgtgagagatatgaattacatcatggagtgcgcatttccgatagtgcccttgttgaggctgcaattctctcagatcgatacatcagtggtcgttttttacccgataaagccattgatctggtagatgaagcagctgctaaactgaaaatggagatcacttcaaaaccaaccgcacttgatgagatcaatcgttcagtactgaaattggaaatggagaggctatcactcactagtgatacggataaagcctcgaaagatcggttgagtcgactcgaggctgagttggctctgttgaaagagagacaagccgagttaaatcaacaatgggaacatgaaaaaggtgtcatgacaaatatgcagtccattaaagaagagattgacagggtgaatctagagatccaacaagcggaacgtgagtatgatttaaaccgtgctgctgagttaaaatacgggagtttgaactctttgttgagacaacttgaaactgctgaaaaggaattggttgaatacatgagctcagggaagtcaatgcttagagaagaagtcacaggtgatgacattgctgaaattgtaagcaaatggactggcatcccgctttctaaactcaaacaatccgaaagggagaaactcctacacttagaggaagagcttcacaaccgggtcgtgggtcaggacccggcggtgacagctgtcgcggaggcgatccaacggtcaagagcgggtctatcagatccccaccgtccaatcgcgagtttcatgttcatgggacccacgggagtcggaaaaaccgagctagcaaaagcacttgcttcatacttgttcaacacagaggaagctcttgtacggatcgacatgagcgaatacatggaaaaacacgcggtgtctagattaatcggcgcgccacctggctatgttgggtacgaggaaggcgggcagctgaccgagacagtgcgcaggagaccatatgctgttattctgtttgacgaaattgaaaaagctcacgcggatgtattcaatgtgtttctccagattttggatgatggtagggtcactgattcgcaaggtcgtacagtcagctttacaaatacagtcatcatcatgacatcgaacgtcgggtcccagtatatattagatacggatgatgactccatgccaaaagaacgtgcttatgagactataaaacagagagtcatggatgcagctaggtcgattttccgccccgagtttatgaaccgggttgatgagtatatagtattccaaccacttgacagatcacagatcaacagaatagtccgtttacagttggaaagagtacagaagaggatagcggataggaaactgaagattaatgtaagtgaagctgcgattgagcttttggggagtcttgggtatgacccgaactatggtgctagacctgtgaagcgggttattcaacaacatgtggaaaatgagcttgccaagggtatcttgagaggtgagtttaaggatgaggacaggatatcagtggacacagaagtcacggcattttcaaatggtcaactcccgcaacagaagttggttttcaagagagtggagatgtcgtcaccgggtgatgcacctaaggatgaacaagcgttttcacaagctttgtagaggtttatgaatgcacatgtagatgatgatacataaagttatacggaatattacacatcgtagttgatgtgacattagctagagcatgtttatctattgtatgcataataaatgcttatgcattatgctatagtgaatgtttttttgccacttaataattcggtcacctattattgttgcaaatcaaagttttaagc

SEQ ID NO: 10399 - DNA, 3489 bp, Ambrosia trifida
tattctcttgaaccatcctcttccttgttcatctcctctataaaccacttaccactctttgaaccctcttcactcaacaacacaacattttcttctctgtatagaacctgctagaagcaagacccctaacaacacttttccatattctcactctatccctcgtacctccctactttattattattatataataataatcatcttcactcaaatctattatccatctctcaatacagtttacacacacttcttcttcttcttcttctataaccatgtccactatgtctaccttattccatctcccttcatcaatttgcactgacagaacaataacatcaccatttgctcaaccatctgtttctgttaattcgttttctaaacctagaagagtttccctacgttcgttgaaattgaagacaaggagtaatgatgttttgttacgcaaaagttctcgatctcttgttgttcgttgtgatgcttcttccagtggaaggattactcaacaagaattcactgaaatggcatggcaagcaattgtgtcttctcctgaagttgcaaaggagaacaagcatcagattgtggagactgagcatttgatgaaagctctgctggagcagaaaaatgggttggctcgcaggatattctccaaggctggtgtggataatactcgccttctagaggctactgataagttcattcagcgccaaccgaaggttattggtgagtcagcgggctcgatgttagggcgagatttggaaagcttgatgcagagagctagggattacaagaaagagtatggtgactcgtttgtttctgttgagcatctggtgcttggttttgtgcaggataaccggtttgggaaacaattgttcaaggaattccaaatttcgttgaaaaccttaaagagtgcaatagaatccatcagaggacggcagacagtgatagaccaagatcctgaagggaagtacgaatctttagagaagtatggtaaagatttgactgccatggccagggcagggaagcttgaccctgtcataggaagagatgacgaaatacgcagatgcatccagattctctctagaagaaccaagaacaaccctgtgctcattggtgaaccaggtgttggaaagactgcaatttccgaagggcttgctcagagaatagtgcaaggtgatgtgcctcaagcattgatgaatcgaaagttgatatctcttgacatgggtgcgcttattgccggggcaaaatatcgtggagagtttgaagatcgactcaaggcagtcttgaaggaggttactgaatcagatggccagattattcttttcattgatgagatccatactgttgttggagctggggccaccaatggtgcaatggatgctggcaatctgttgaagccgatgcttggtcgtggagagttgagatgcattggtgcaacaacattggacgagtatcgtaagtacatcgaaaaagatcctgcattggaacgccgttttcaacaagtttatgttgaccaaccgacggttgaagatacaatttctatacttcgtggactgcgtgaaagatatgaactgcatcatggagtacgtatttcagacagtgcacttgttgaagctgcaattctctcagatcgttacatcagtggacgctttttacccgataaagccattgatctggtagatgaagcagctgctaaactgaaaatggagattacttcaaaacctaccgcacttgatgagatcaaccgtgcagttttgaaactcgagatggagaggctatcactcactagtgatacagataaagcttcaaaggacaggttgaatcggcttgagactgagctggctctcttaaaggaaaggcaagccgagttgaccgaacaatgggagcatgaaaagagtgtcatgacaaatatacaatctattaaagaagaaattgatcgggttaatctagagatacaacaagcagagcgtgagtatgatctgaaccgtgcagctgagctgaaatacgggagtctgaactcattgttacgtcaacttgaaactgctgaaaaagaattagtcgagtatatgagttcagggaagtctatgcttcgtgaagaggttactggtgatgacattgctgagatcgtgagcaaatggactggaattccgctttcaaagctgaaacaatccgagagggagaagctcttatatttggaggacgagttacataaacgggttgtgggtcaggatcctgcggtgacatcagtagccgaagctatccaacggtccagagccggcctatccgatcctcatcgtccaatagctagcttcatgttcatgggacctacgggagtcggaaaaaccgagctggcaaaagcgcttgcttcttacttgttcaacaccgaggagtctcttgtaaggatcgacatgagtgaatacatggagaagcatgctgtttctagattaatcggggctccacctggatatgtagggtatgaggaaggaggacagttgaccgagatagtacgcaggaggccatatgctgttatcttgtttgatgaaattgaaaaggctcatgctgatgtgttcaacgtgttcctccagattttggatgatggcagagtgaccgactcacaaggtcgtacagtcagcttcaccaacaccgtcatcatcatgacctcaaatgtgggctcgcagtacatactagacactgatgatgactctgcgccaaaagaacaagcttacgagaccataaagcgtagagtaatggatgcagccaggtcagtctttagacccgagttcatgaaccgggtcgatgagtatatagtattccagccgctcgaccgctcacaaatcaacagaattgtccgattacagttggaaagggtacagaagagaatagcagacaagaagctaaagatcgaggtaagtgaagctgcagttgagcttctagggagtcttggatatgatccaaactatggtgctagacctgtgaaacgagtgatccaacaatatgtcgaaaacgagcttgcaaagggtattctgagaggcgaatttaaagacgaggacaccatatcagttgacacagaagtcacggctttttccaacggtcaactcccccaacaaaagcttgtcttcaagcgcgttgactcgccatctggtgacacagctgaaggtcaagaagcagtgccacaaagtatctaaactatgagccaaaccaacatgtagatgatctataaaaattgtaatgtttttaccattagcaatacagcatgtacaactagtatgcataataaatgcttacgctatcgagtcttttgccacttctgaaaataaatctacattataatttatacagatcatgctgtcatgatttagcttcttggtaagattgcagcatcattgctcgtgttttatggtcagacgaaagcttgagttctcgcatttcctggtacaacttggttgccgactcggtcttttctcttagacaaaaaccttgaactgcagcgtt

SEQ ID NO: 10400 - DNA, 3520 bp, Theobroma cacao
aaaaaaaaaaatcaatacttgtttttccttcctcaaaacgacatcttcgcactatataaaacgttagcaggcaaaacgaaaaaggacctccgagaaaagccgagtgaacagcagaaagaaagaaagaagagacccttattcccacgcaaagccgttcaattcagtgcacaccaactatatcttagctttctcttgtggactcatcactccggcaatggctgctgctgcttcttcttccacggcgtcgtttagtggggtcagtttatgtgctacgcgttccatttccaataagaacaatctcttcttagctcccccacgcctttctttgagctttccttcaaaacccaactccttaaaatcgcttcagtttaagagaaatggaggttttcgaaggtttccaaagacttcttcaagctctttcattgttcgttgtgatgcttcaactggaaggattactcaacaagagtttacagaaatggcctggcaagccattgtttcttctccagatgtagctaaggagaacaagcatcagatagtggagacagaacacttgatgaaggctctcttggagcagaagaatggtcttgctcgtcggatcttttctaaagtcggagttgacaatactcgccttcttgaagccactgataagttcatccaacgccagccaaaggttttgagtgagtcagctggttcaatgttaggacgtgatctggaagctctgatccagcgagctagggagtgcaagaaagagtatggggattcatttgtttctgttgagcatctggtccttgggtttacacaagatcaacgttttgggaagcagttgttcagggatttccagatatcccacctatccttgaaatctgcaatagaatccattaggggacgtcagtcagttattgaccaagatcctgaaggaaagtatgaagcgttggaaaaatatggaaaagatttgactgaaatggcaaaggaaggaaagcttgacccggtgataggaagggatgatgaaattcgcaggtgcatccagatcctctctaggagaacaaagaacaatcctgtgttaattggtgaacctggtgttggaaagactgcaatctctgaagggcttgcccaaagaattgtgcaaggggatgtccctcaagcattgatgaaccgtaagctgatatcccttgacatgggtgcactcatagctggggccaaatatcggggagaatttgaggatagactgaaggctgtacttagggaagtaacagaatcagaaggccaaattatcctcttcattgatgagattcacacagttgttggggcaggtgctacaaatggagcaatggacgcaggcaatcttctgaaacctatgcttggtcgaggagaattgcgatgtattggggcaacaacactggatgagtatcgtaaatatattgagaaagatccagccctggaacgtcgtttccagcaagtgtatgtcgatcaaccatcagtagaagatacaatttctatactcaggggactgcgtgagagatatgagctgcatcatggagtccgtatttctgacagtgcacttgtggaagctgcaatcttgtctgaccgttatatcagtggccggtttttacctgacaaagctattgacctagttgatgaggcagctgctaaattgaaaatggaaatcacttcaaaaccaactgcccttgatgagattaatcgttcagtgctgaagctggagatggagaggctgtctctcacaaatgatactgacaaagcttcaagagataggctgagccgccttgaggctgagttgtccctcttaaaggagaaacaggctgagctgactgagcaatgggagcatgagaagactgttatgacacgcattcagtcaatcaaggaagagattgacagggttaatcttgagatccagcaggctgagcgggagtatgatctcaatcgtgctgctgagctgaagtatggaagtttgaactccttgcagcgtcaacttgctgatgcagaaaaagaattagatgagtacataaaatccggaaaatccatgctgagagaagaagttacaggaaatgatattgctgaagtagttagtaaatggactggtataccagtttccaagcttcaacaatcagagagagagaaactattacatttggaggaagagttgcataaacgtgttgtgggtcaagatcctgcagttagatctgtagctgaggccattcagcgatctcgagctggtctctcagatccccgtcgcccaatagccagtttcatgtttatgggtcccactggtgtagggaaaacagaacttgctaaagcacttgcatcctacttgtttaatacagaagaagcccttgtacgcatcgatatgagtgagtatatggaaaaacatgcagtttctagacttataggtgctccacctggttatgtggggtatgaagaaggaggacagctgaccgagatagttcgcaggaggccatatgctgtaattctttttgatgagatagagaaagctcatggtgatgtatttaatgttttccttcaaattttggatgatgggagagttactgattcccagggtcgcactgtaagcttcaccaacactgtcattattatgacttcaaatgtgggttcacagtacattcttaattcagatgaagacacaccaaaggatatagcttatgacactattaagcagagggtgatggaggctgcaagagcagtctttcgtcctgaatttatgaaccgggttgatgagtatatagttttccagcctttggaccgtgagcagataaacagtattgtgaaattacagttggaacgggtgcaaaagaggattggagataggaaaataaaacttcaggtgacagatggtgctattcagcttcttggtagtcttggttatgatccaaactatggtgctagaccagtcaaaagagtgattcagcaaaatgtagaaaatgaacttgccaagggcatcttgagaggggagttcaaggatgaggattctattttagtagacacagagctcacagcattcgcaaatggccagctcccccagcaaaagctaattttcagaagacttgatcgtgattcagaaactcaagcaacagatagcgaagaagctttatcacagactgtctgagagttgtacttaagttttgcctaaatactataggttttacacaattttgcgcagggaattaataactcagctcacacttgaatctcagattggatatgacttttatgttacaagttatcctattattcttatacagtgcgtccttacaagtaatcatgtcacagtgtttacattgctacccaaatccattctggttcaattgtccttgatcgaagatgagaagtggtatcttggagaaagtggtgccagtggaagatttgatatcctctgcggctaatctaatttccactgggtcactggaattccatttgctttttggcatatcttgcatttaagtaataggtgaaagacaggagctgaaattaaacattagtaagtcat

SEQ ID NO: 10401 - DNA, 4893 bp, Malus domestica
tttttcatgtttcaaaaaatgaattctgtgagataaagccaccggccgattttctcttcttttgaaaaatgaaaaagaaataaaaagacattggaagaagcggaagttcgcaaaagccaaagggtgacactttaaaaagagagaaaaatgtgtccattttcatggccgtaggagaattcaaggagcaaggtaatggggtcgttgaccacgatttagaagactttgaaaactccgaaacaccctcgtttgcctccgggaacttcttcttatttgatctcttcttcctctccgacttccctctctattagttaaatccaataaactcccgttccacttcttccgcttgtatatctgaaccaccactcatcggctctgcaaaaataagaagaaaccggatcagttttgcagccaaaaaagcccaagaaactgctgggattttcaatccatttgaagaagtagaataaaaagcctttgaagttttgaaatcgttggagatggcaggggtgcaagatcaattggagatcaagtttcggttgaccgatggatcagatattggccccaaaagctttcctgctgctaccactgttgtaaacttgaaggaaagcattcttgctcaatggcctaaagataaggataatggaccaaggactgttaaagatgtcaagctaatatgtgcgggaagagtactggagaacaacaaaacagttgctgagtgccggagtccattatgtgatgtccctggtggagttacaactatgcatgtcgttgttcaaccaccttcacaggagaaagaaaaaaaactgatgaatgaaccgaagcagaacaagtgcgtttgtgttatattataacttttgcatctcagatagcggcgataacatcatttttaggtaaaacacgatgaagttggtaaaattgctgatagattcaactccgttggaattatgcaggcgtgttgttaaatgtcatactttattttctgtttaagtccgtcggactatgctacatcacgcattcataatcatatctaagatttttatgtaaagagttcttgtgctgcatttatgttcgcattttacaatcgaatctgtttcattctccgtgtataattttcaaccgtatcatcttggaaatcatgttatgtcaacaaggaatcgccaaagctcttggcggggttgccactgtgctgcgttatgcacttcgttccgtggtgcaacaaaatgctatgcctccacaacttggatcatgagcaagggttatagtttaggtacagatcttaaggacaggcgaaccgtgacggaggaggatggtaaagcgcgaaaatgtctgcgttcttcattttcaggttgcattcgatccgaaaatttattcacattgcattgttttgatgtttatcgtaaccctatccccatttgttttcaagattatgaagctaaatttttgacatcggtttggattgtgcaacatgtttcgcctgaaaaagttaaaaagaagagccacaaatcaagtggtgaatgcgaaaatattcacgcgagtcatatgacattgaatattgagcgccgaacgtcattgaggcttatgcatgtgtgccgcaaaagttataccaagaaattttacagtttattcaaaatacaggtcggaagccgcgaaaaagctctccacagagtccacatcttttcccaattcccacgcaaagctccttcttcttccttcttccttcctcccaccgtttcaaagcaacctccccttcctcctctgcatatccaatacccacttcccacaacgctcccacaacaatcacaaccttttcttcgagctcctccaatggcgtcggcggcctcgttcgcttccggggtcggtctacttcatcttccccaatcggtttctcccaaatgctgcaataaagcttccgtctttgcccgcccccaccactccctcagcttcaattcccaacccgactccttccgggccttaatttcgaggcaatcgactccgaacggtgcgttccgaactgggttgcggcgactcggtcggaattcgaggcctttcgtcgtgcgctgtgatgcttcgactggaaagattacacagcaggattttacagaaatggcgtggcaagcgattgtttcgtcgccggaagtggcgaaagagaacaagcatcagatagtggagactgagcatttgttgaaggcactcttggagcagaagaatggtcttgctcgtcggattttctccaaggccggggtcgacaatacccggcttctcgaggccactgataagtatattcaacgacaaccaaaggttcttggtgaatcttcggggtcagtgttgggacgtgatttggaagccttgattcagcgagccagggattacaagaaagagtatggggactcatttgtgtctgtggagcatttggttcttggtttcgcccaagatcaacgattcgggaagcaattatttagggattttcaattaaccaaggaaagcttgaaatctgctatagaatccataaggggacgtcaatcagttattgaccaagatcctgaagggaaatacgaagcacttgaaaggtacggaaaagatttaacagctatggcaaaggcaggaaagcttgaccccgtgataggaagagatgatgaaattcgcaggtgcatccagattctctccagaagaacaaagaacaatccggtgctgattggtgaaccaggtgttggaaaaactgcaatttccgaagggcttgctcaaagaattgtgcaaggggacgtcccacaagctctgatgaatcgtaaggtttgatatcccttgacatgggatcgctgattgctggggcaaaatatcggggagaatttgaggacaggctgaaggcagtactcagggaagtaacagaatcagagggccagataatcctttttattgatgagatccacacagttgttggggcaggtgctacaaacggtgcaatggatgctggtaatctcttaaaacccatgcttggtcgaggagagttgcggtgtataggtgcgacgacgctggatgagtatcgcaaatatattgagaaagatccggcattggagcgtcggttccagcaagtttatgttgatcaacctacagtagaagataccatttcaatactccggggactgcgtgagagatacgagttgcatcatggagtccgaatttctgatggtgcactggtggaagctgcaattctctcagaccgctacatcagtgggcgatttttacctgataaagcaattgacttggttgatgaagctgctgctaaattgaaaatggagattacgtcaaagcccacggccctagatgagatcaatcgttcagtgttgaaacttgaaatggagagattgtcccttacaaatgatacggacaaagcttcaaaagagagattgaaccgccttgaggctgagttatctctcttaaaagaaaaacaatccgagttggctgagcagtgggagcatgaaaaatctgtcatgactcgcattcagtcaatcaaggaagagattgacagagtaaatcttgagatccagcaagccgaacgagagtatgatctcaaccgtgctgctgagttgaagtacgggagtctgaattctttgcagcgacaactcggtggtgcagaaaaagagcttgatgagtatatgaggtctgggaagtccatgctgagagaggaagttactggaagtgatattgctgaaatagtaagtaagtggaccggtattcctgtttccaagcttcaacaatcggagagggagaagctcttacatttggaggatgagctgcataaacgtgttgtaggtcaggatcctgcagtgagatcagtcgctgaagctattcagcggtctcgggcaggtctctcggatcctcatcgccctattgctagtttcatgttcatgggtcccactggtgttgggaagacagaactagctaaggcccttgcctcctacatgttcaacacagaagaagcactcgtaagaatcgatatgagcgagtacatggaaaagcatgctgtttcgagattgataggagctccacctggttatgtggggtatgaggagggaggacagctgacagaggtggttcgccggagaccgtattcagttattttgttcgatgagatagagaaggcacattctgatgtgttcaacgtgttccttcaaattttagacgatgggagaataaccgactcacagggtcgcactgtgagtttcaccaacactgtcatcatcatgacctcaaatgtgggctcacagtacatactaaacgctgatgatgacagcactccaagggagttggcttacgaaactataaagcagcgggtaatggaggctgcaagatcaatattccgtcctgagttcatgaaccgggttgatgagtacatagttttccagcccttggaccgcgatcagataagccgtattgtcaagttacagttggaccgagtgcaaaagagaattgcagaccggaagatgaagctcaaggtgagcgatgcagctctccagcttctcggaagtcttgggtatgatccaaactacggtgctaggccggtgaagcgggtgatacagcaatatgtcgaaaacgagcttgccaagggcatattgagaggagagtttagggaggaagacactgtttttatcgacacagaggtcacggcattttccaatggccagctcccccagcaaaagctagtgttcaggacgttagaaacggactcagaatctccggctacagagaaccaagaagctttgtcggagactcgatagacgatgacatagttgggcagagatacttaaattatactcgggatgtttctcttgtatatgacatgttttatgtcgaagattataaacttctaaatatgctttaatcttcgtgttcgtattatta

SEQ ID NO: 10402 - DNA, 3248 bp, Vinca minor
tccactcctcagttcactcgccggaaaatccaactaagaaggaaaaaaaaactcagcatagtggcaaaggaatggccgccactaccacgtccttcgtcggcgttcaattccacgttccgccgcctaccagtacttctactacaagagtagcttccttgttctcacagtcgcctccgatttcggttaatttcacagctaaccggaaatttattaaatcgtttaattcacttcaattgaaacggaataatgctttttttactagaaattcgccgcaatttggccggagttcgaggtcattggtagttcgatgccaaacttcatcaagtggaaagataacgcaaacagagtttacggagatggcgtggcaagcaattgtgtcgtcgcccgaagttgctaaagagaataatcatcagattgtggagacagagcatttgatgaaggcgcttttggaacagaagaatggactggctcgtcgtatattctccaagattggtgtggataatactcgtcttctcgaagctactgacaagtttattcaacgccaacctaaggttcttggtgagacagctggttcaatgttaggtcgagatttggaagccttgtttcagcgagccagggattacaagaaagaatatggtgattcatttgtatcagttgagcatcttgtccttggtttcatacaagataacagatttgggaaacaattattcaaagatttccaaatttctttaactgcattgaaagatgccatacaatccatacggggacgccaaacagtcattgaccaagatcctgagggaaaatatgaatcactggagaagtatgggaaagatttaactgccatggcgagagctggaaaattggatcctgttataggacgagatgatgagatacgtaggtgcatccaaattctttctcggagaacaaagaacaatcctgttttgattggtgagccaggtgtcgggaaaactgcaatatctgaagggcttgcccaaagaattgtgcaaggagatgtccctcaagcattgatgaaccgaaggttgatatcacttgacatgggtgcgctgattgctggtgctaaatatcgtggagaatttgaagataggttgaaagctgtgctcaaggaagtcacagattcagatgggcagattgtccttttcatcgatgagatacataccgtggtgggagcaggtgctacaaatggagccatggatgctggtaatctattgaaacccatgcttggtcgtggggaattgcggtgcattggtgcaacaacactggatgaataccgtaaatacattgagaaggatcctgctttagagcgccgcttccagcaagtttatgttgaccaaccgacagtagaagataccatctccattctccgtggactccgtgaaagatatgagctgcatcatggagttcgaatttcagatagtgcgcttgtagaagctgcaatcctctctgatcgttacattagtggacgttttctacctgataaagctattgatctggtagatgaagctgctgccaagctgaagatggaaataacatcgaaacctacagctcttgatgaaatcaaccgtacagtgttaaagctggagatggagagactttctcttaccaatgatacagacaaagcatcaagagagagatttaatcgcttagaggctgaattatctctgttaaaggctcgacaatctgaacttactgagcaatgggaacatgagaaatctgttatgacacggatacaatcaatcaaggaagagattgacagggtgaatgtggagattcagcaggctgagcgagagtatgaccttaatcgtgcagctgaactaaagtatgggagcctgaattccttgcagcgtcaacttgaagctgctgaaaaagaattagttgaatatatgaaatctggaaagtccatgcttcgagaagaagtctctgggagtgacattgctgaaattgtcagcaaatggactgggattcctgtttccaagttacagcagacagagagggagaagcttttgcatcttgaggaagagttacataaacgtgttatcggtcaagatcctgcagtgagatctattgctgaggctattcagcgatctcgagctggcctttcagatcctcatcgtccaattgctagtttcatgttcatgggtcctacaggtgttgggaagacagaactagcaaaggccctcgcctcctatatgttcaacactgaggaagctcttgtacgaattgatatgagtgaatatatggaaaagcatgcagtttctaggttgataggagcaccacctggttatgttgggtacgaagaaggaggacaactgactgaaactgttcgcagaaggccatattcagtcattttgtttgatgaaattgaaaaggctcatgctgacgtgttcaacgtgttccttcagatcttggatgatggtagagtcactgattctcagggccgcaccgtgagttttaccaacactgtcatcattatgacatcaaatgttggttcacaatacatactcaacactgatgatgaaaacttgccgaaggaaatggcctatgaaactatcaagcaaagagtgatggaggctgcaagaggaatcttccgacctgaattcatgaacagagttgacgaatacatagtgttccaaccccttgaccgtgatcaaatcagcagtattgtccgattacagttggaacgagttcaaaagaggattgcagataggaagatgaaacttgaagtgagtgacgctgctcttcagcttctaggaagtctcgggtatgatccaaactacggagctaggccagttaagcgagtgattcaacaacacgtcgaaaacgagcttgccaaaggtatcttaagaggagaatttaaggatgaagataccatattggtagatactgaggtgactgcatttggcaatggtcagcttcctcaacagaagttggtattcagaaaattggaatctggttcagatacctcttctgaaaccaaagaagaggtgacacaaacattatgagataatagtgacatttcaagagaagacatcaaataatacagtgttaaaagtaattccataaataattatattgatttattttcagtgatgtatactgtaaaaaggcttcataatctagaagttttccccatgagtattactattataaggtcttttagtaattttatttcttttaataacgtttggccttttacaagttttaaaggctatattcttcggggatttcaa

SEQ ID NO: 10403 - DNA, 3292 bp, Solanum lycopersicum
aacttttccggcaaaacactctctcctatccgctgaaactttgtcgtttttcttccttcttcaataacgttgagataacagaatagtacattttgttcaccggtatgtctaccgtgacgtcattttccggcgtacagttttgcgttccttcttcttcttccaattcttcaaacagagttgctttattttcatcccattcagcgccgtacctgaacttctcaggcaaatcgcgagttcttggcaagtgtaattcgttgaaactgaagaggaaggatgtgttcttcagtaggaaaactgagaaactttctcagggttcaaggcttaccgtacgttgtgatgcttcaaatggaaggatcactcagcaagattttacagaaatggcatggcaagcaattgttgcatcgccagaaatagctaaagagaacaagcatcaaatagtagagactgagcacttgatgaaggcactgttggagcaaaagaatgggctggctcgtcgcatattctccaaggcgggtgtagataatacccgccttttagaggctactgataagtttattagacaacaaccaaaggttattggtgagacagcaggttctatgttaggccgagagttggaaggtttgatgcagagagccagggagtacaagaaagagtatggtgattcctttgtgtcagttgagcatttggtgcttggcttcattcaagataaacgatttgggaagcaactgtttaatgatttccagatttccctgaagacactgaaaactgccattgaatccataaggggacgccaaaatgttattgatcaagatcctgaagggaagtatgaatcactagaaaaatatggaaaagacctgactgctatggctagagcggggaagcttgacccagttataggaagagatgatgagatacgtagatgcatacaaatcctctcaaggagaacaaagaataacccagtgttaattggtgagcctggagttgggaaaactgcaatctctgaagggcttgctcagagaattgtgcaaggagatgtacctcaggctttgatgaatcgaaggttgatatctcttgatatgggtgcgctcatagctggtgcaaaatatcgtggtgaatttgaagacagattgaaggcagtgcttaaggaagtgacagaatctgaaggacagatcatcctttttattgatgagatacatactgttgttggtgcaggtgctactaatggtgcaatggatgctgggaatctattgaagccgatgcttggtcgaggagaactacgatgtattggtgcaaccaccttggatgaataccgtaaatatattgagaaagatcctgccctggagcgtcgtttccagcaagtttatgttgaccagcctacagttgaagacactgtctccatacttcgcggattacgtgaaagatatgagctgcatcacggggttcgcatttcagacactgcgcttgtcgacgcagctattctttcggaccgttatattagtggacgttttctacctgacaaagctattgacctagttgatgaagctgctgcaaaactgaaaatggagatcacctcaaaacctacagcccttgacgagatcaatcgtgcagttttgaagttggagatggagaggctatctctaactaatgatacagatagagcatcgaaagaccggttaaaccgtcttgagacggagttgtctcttttgaaggagaggcaagctgagctgactgagcagtgggagcatgaaaagagtgtgatgactcgcttgcagtccattaaggaagagatcgaccgggtaaatcttgagatccagcaagcagagcgggaatatgatcttaatcgtgctgctgaacttaagtacgggagtctaaacaccttgcagcgtcaacttgaagcttcagaaaaagaactgagtgattatatgaagtctggaaaatcgatgctcagagaagaagtaactgggaatgatattgcagagattgtcagtaagtggactgggattcctgtttctaagctacaacagtcggagagggaaaagctgttgcatttagaggaagagttgcacaaacgtgttgttggtcaagatccagcagtaagagcagtagcagaggcaatccagcgctcgcgtgctggactttcagatcctcatcgtcctattgcaagctttatgttcatgggtcccactggagttggaaagacggagttagctaaggcccttgctaactatttgttcaatactgaagaggcacttgtgcgcatcgatatgagtgaatacatggagaagcatgcagtttcaagattgataggagctccccctggttatgtcgggtatgaagaaggggggcagttgacagagattgttcgccgaagaccttatgcagttatattgtttgatgaaattgagaaggcccattcggatgtatttaatgtgttcctgcaaatcttagatgatggtagggtgaccgactcgcaaggacgcacagtgagtttcaccaatactgtcatcatcatgacatcaaatgttggttcacaatatatcctaaatacagatgataatgatgatgattcatcgaaggaagcgacttatcaaacaataaagcaaagggtgatggatgctgcacgtgcagttttccgccctgagttcatgaaccgggttgatgaatatatagtattccagcctcttgatcgtgaccagatcagtagcattgtgcgattacagcttgaaagagtgcagcagagattagctgatcgtaaaatgaagattcaagtgagcgaagctgctattcaactgcttggaagtcttggttatgaccccaactatggagcacggccagtgaagcgggtgatccagcagaatgttgagaacgaattggccaaaggaatattaagaggagaattcaaggatgaggatactattttagtagacacggaggtcagcgcattctccaatggacaacttcctcagcagaagctagtgtttaaaagacaagagtctggttcagattctccagctgagaaccaagaagctttctctcagaaactatgagactacacctcaacatcttgtttagacacatactatgatttcgagcatcgaactagtagtagctcttgtatctagattatggatatacatatttcacggctttgaatagcaaatacctacacagttgaacagtgtggagttctgttttcgtataataaatagcttattagtctatagaaagttaacggttattcacccatgtttttttttaatcatatataagaatgaaggtcgacttaggggaa

SEQ ID NO: 10404 - DNA, 3396 bp, Ricinus communis
gaacactccacaagattgcctctttctactataacaaacacttgcaactcttttctctctttattagttctttacaaaagaaaatcaaattccctctttcccttttgtttcaattccttcattcccactcaattcctctctctcctgctctctctcaatttcacctgcctgcaatggctgcaacaccaacaatggcgtcgttcaatggagtaaccatttgtccacctcatcaaagtaacagaaacacattgtttgctcaatttctaaccttaccttcaaaacccagttctttaaactcacttcatttaaagaaaaagcacagaaatccttctcttaattatcacagggtttccactaatactccaagaagatctttcattgttcgatgtgatgcttcttctaatggaaggattactcaacaagagttcacagaactggcatggcaaggaattgtgtcttcacctgatgtggctaaagagaataagcatcagatagtagagactgagcatttaatgaaagcattattagagcagaaaaatgggcttgctagaaggatcttttctaaagttggagttgataatactcggctcttagaagctactgataagtttatacagcggcaacctaaggttcttggtgaatctgctggttcaatgttaggacgtgatttggaggctttgatccagcgagccagggattataagaaagaatatggtgattcatttgtttctgttgagcacttggttcttgcttttgctcaggatcaacgatttggaaagcaattgtttagggattttcagatatctctgcaaacagtgaaatctgctgttgaatcaataaggggacgccaatctgttatagaccaagatccagaaggaaagtatgaagcactggagaaatatggtaaagatttgaccgccatggcgaaagcaggaaagcttgaccctgtaattggaagggatgatgagatacgcagatgtatccagattctctctaggagaacaaagaacaaccctgtgctgattggtgaaccaggtgttggaaaaactgcaatttctgaagggcttgcccagagaattgtgcaaggggatgtgcctcaagctctgatgaacaggaagctaatatccctggatatgggtgcattaattgctggagcaaaatatcgaggagaatttgaagatagactcaaggctgtgcttaaagaagttacagagtcagatggtcagattatccttttcattgatgagattcacacagtagttggggcaggtgctacaaatggtgcaatggatgcgggtaatctcttgaagcctatgcttggtcgaggagagctacggtgcattggtgcaaccacactggatgagtatcgaaaatatattgagaaggatccagccttggagcgtcgtttccagcaagtttatgttgatcaaccttcagtagaagacacaatctctatacttcggggattgcgtgaaagatatgaactgcatcatggagttcgtatatctgacagcgcacttgtggaagctgcaattctatctgaccgttacatcagtggaaggtttttgcctgacaaagctattgatctagttgacgaagcagctgcaaaactgaaaatggagatcacttcaaaacctactgcccttgatgagattgaccgttcagtactaaaactggagatggagaagttatctcttacaaatgacacagatagagcttcaagagacaggttgagccgtctggatgctgagttgtctctgttaaagaagaaacaagctgagctgacagagcaatgggagcatgagaagacagtcatgacacgtattcagtccataaaggaagagatcgacagggtaaatcttgagattcagcaggctgagcgtgagtatgatctcaatcgtgctgctgaactgaagtatggtagcttgaactctttgcaacgacaacttgaaattgctgagaaagagttggatgagtatatgagatctggaaagtccatgctgagagaagaagttacaggagatgatattgctgaagtcgtcagcaagtggactggcatccctctttctaagctcaagcaatcagaaagagaaaagctgctacatttggaggaagagctgcataaacgtgtggtaggccaggatcctgcagtgaaagcagttgctgaggcaatccagaggtctcgtgccggtctctcggatcctaggcgtccaattgctagcttcatgttcatgggtcccactggtgttggaaaaacagaattagctaaagcactagcctcgtatatgttcaacacagaagaagcccttgtacgaattgacatgagcgaatacatggaaaagcatgcagtttcacggttgattggtgcaccacctggttacgtagggtatgaggaagggggacagttgacagagacagttcgcaggaggccatatgcagttattctctttgatgagatagaaaaggcccatgctgatgtgtttaatgtcttcctccagatattagatgatgggagggtgactgattcgcagggtcgcactgttagtttcaccaacaccgtcatcattatgacttccaatgtgggttcacagtacatactggacacagatgatgacatgccaaaggaggtagcttatgaaactatcaagcagagggttatggaagctgcaagatcagtctttcgaccggaattcatgaacagggttgacgaatacatagtcttccagcctctggatagatctcagataaacagtattgtcaaattacagttggaaagagtgcaacagagggttgcagatcggaagatgaaactacgagtgactgaggcagctgtggatcttttagggagtcttgggtatgaccccaactatggagctaggccagtcaagcgtgtaattcagcaatacgttgaaaatgaacttgccaagggtatcttaagaggagaattcaaggacgaggacgccgtgttaatagacacagaagttacagcattttccaatgggcagcttccccaacaaaagctagtcttcaaacgaattgaaagtgatgcagatactgcagctgcagataatcgtgctctttctcaaactctttgagacatctttttgattctccaaactatgaaaatgttttaagcaggttgtataaatgagattctgggcgtatactaaatgaactcgtcatgtaaaacctcttatagaaaatatacacccacaaggtatacatttctgcaatgttcaagcagttcagtggttgcttcgttgccctgacatttttgtaaatccttttccatccgagggagttgctgctctggaagcaggaccacggctttatactcttgataaataaagtagggacagcggaagaatgtgatatatctaatcgacaatgcattct

SEQ ID NO: 10405 - DNA, 3385 bp, Gossypium raimondii
acagaaaacgcagagtaaaaccaaccaaaaccgagggatttcgagaaaagccgagagacagcaactagaacgctacaagttcattttttcccccttactccacgcaaagccaatcgattatttttgttaaattcatttgaacttatttcatctttttgaaatctgaacttaaatcagtccaacaatggcggcttcttcttctactacttcaatggcgtctgttaatggtttcagtttttgtgctacacgttctgtttctaatataaacaatctccttttaactcacccacgcctttctttgagctttccttcaaaacccaattcattgaaatcctttaaaccacttcagttaaggaaaaatggggtttttgagaggttttcaaggacttcttcaaggcctttcgttgttcgttgtgaagcttcaactgggaagattacacaacaggacttcactgaaatggcctggcaagccattgtttcttcaccagatgtggctaaagagaacaagcatcaaatagtggagactgaacacttgatgaaagctctattggagcagaagaatggtcttgctcggcgaatatttttgaaagtcggagttgacaatactcgccttctcgaagcgactgataagttcatccaacgccagccgaaggttttgggtgaatctgctggttcaatgttaggacgtgatttggaagcactgatccagcgagcaagagagtacaaaaaggagtacggggattcgtttgtttctgtcgagcatttggttcttggatttacacaagatcggcgtttcgggaagcagttgttcaaggatttccagatatccaaccaagccttgaaatccgcaatagaatctattaggggacgtcagtcagttaccgaccaagaccccgaaggaaagtatgaagcgttggagaagtatgggaaagatctaacagcaatggcgagagaaggaaagcttgatccagttattggaagagatgatgaaatacgtaggtgcattcaaatcctttctaggaggacaaagaacaaccctgtgctcattggtgaaccgggtgtcggtaaaactgcaatttctgaagggcttgcccaaagaatcgttcaaggggatgtccctcaggctttgatgaaccgtaagcttatctcactcgacatgggtgcgctcatagctggggctaaatatcgaggagagtttgaagatagactgaaggctgtacttcgagaagtcactgattcagaaggccaaattatcctcttcattgatgagattcacacagttgttggggcaggtgccaccaatggtgcaatggacgcaggcaatctgttgaagcctatgcttggtcggggagaactgcgatgtattggggcaacgactctagatgaatatcgtaaatacattgagaaagatcctgccctggaacgtcgtttccagcaggtttatgttgatcaaccaacagtagaagatacaatttctattctccgggggcttcgtgagagatatgagcttcatcatggagtccgtatttctgacagtgcactcgtggaggctgcaatcttgtctgaccgttacattagtggccgatttttacctgacaaagctattgatttagttgatgaagcagctgctaaattgaaaatggaaatcacttcaaaacctactgccctcgatgagattaatcgttcggtactgaagttggaaatggagaggttgtctctcacaaatgatactgataaagcttcaagagatagactgagccgccttgaagctgagttggcgctcttaaaggagagacagtccgagttgactgaacaatgggagcatgagaagtctgtaatgacaaacattcagtcgatcaaggaagagattgatagggtcaatgttgagattcagcaggccgagcgggagtatgatctcaatcgagctgctgagctgaagtacggaagtctgaactctttgcagcgccaacttgctgacgctgaaaaagaattagatgagtatatgaaatctggaaaatcgatgctaagagaagaagttaccggaaacgatattgccgaagtagttagtaaatggactggcataccggtttccaagcttcaacaatctgagagggagaaactattatatttagaagaagtgttgcataaacgtgtcgtaggtcaagatcctgcggtcagatccgtagctgaggccattcaacgatctcgagctggtctctcagatccccgtcgtccaattgccagtttcatgtttatgggtcctactggtgtagggaagacggaactagctaaagcacttgcatcttacttgtttaatacggaagaagcacttgttcgaatcgatatgagtgagtatatggaaaaacatgcggtttcaagacttataggtgctccacctggttatgttgggtatgaagaaggaggacagctgacggaaacagttcgccggaggccctatgctgtaattctttttgatgagatcgagaaagctcatggtgatgtatttaatgttttccttcaaattttggatgatgggagagtcactgattcacaaggtcgtactgtgagctttaccaacactgtcatcattatgacttcgaatgtgggttcacaatacattctaaactcggatgaagacacacctaaagacttagcttatgaaactatcaagcagagggtaatggaagctgcaagagctatctttcgacctgagttcatgaatcgtgttgacgagtatatagtgttccaacctttggaccgcgaacaaataagcagtattgtgagattacagctggaacgtgtgcaaaataggattgcagataggaaaataaaacttcaggtaacggacagtgccattcaacttctcggaaatcttggttatgatccaaactacggtgctagaccggtgaaacgagtgattcagcagaacgttgaaaacgaacttgccaaaggcatattgagaggagagttcaaagatgaggatacaatcttggtagacaccgagctaactgcattcgcaaatggtcaactcccccagcaaaagctagtcttcaagaaactcaataatgattccgatactcaagcaaccggcagtcaagaagctttatctcagactgtctgaaagttggaagaaactcgacaatgatttggatacttgagcaactgacagtcgagaagcttcatcacagtctgtctgaaagttaataactattaagtttctttcccctaaatgctgtaagtattacacagttttgcattgtatatgaattctctgtaagtcccaaatcaacagttatatctatatctatatattcttttaagtgatgattttcttgtggcttgtatttttattttttagtttcaaaattctagtctaattattaat

SEQ ID NO: 10406 - DNA, 3124 bp, Gossypium hirsutum
tcacccacgcctttctttgagctttccttcaaaacccaattcattgaaatcctttaaaccacttcagttaaggaaaaatggggtttttgagaggttttcaaggacttcttcaaggcctttcgttgttcgttgtgaagcttcaactgggaagattacacaacaggacttcactgaaatggcctggcaagccattgtttcttcaccagatgtggctaaagagaacaagcatcaaatagtggagactgaacacttgatgaaagctctattggagcagaagaacggtcttgctcggcgaatatttttgaaagtcggagttgacaatactcgccttcttgaagcgactgataagttcatccaacgccagccgaaggttttgggtgaatctgctggttcaatgttaggacgtgatttggaagcactgatccagcgagcaagagagtacaaaaaggagtacggggattcgtttgtttctgtcgagcatttggttcttggatttacacaagatcggcgttttgggaagcagttgttcaaggatttccagatatccaaccaagccttgaaatccgcaatagaatctattaggggacgtcagtcagttaccgaccaagaccccgaaggaaagtatgaagcgttggagaagtatgggaaagatctaacagcaatggcgagagaaggaaagcttgatccagttattggaagagatgatgaaatacgtaggtgcattcaaatcctttctaggaggacaaagaacaaccctgtgctcattggtgaaccgggtgtcggtaaaactgcaatttctgaagggcttgcccaaagaatcgttcaaggggatgtccctcaggctttgatgaaccgtaagcttatctcactcgacatgggtgcgctcatagctggggctaaatatcgaggagagtttgaagacagactgaaggctgtacttcgagaagtcactgattcagaaggccaaattatcctcttcattgatgagattcacacagttgttggggcaggtgccaccaatggtgcaatggacgcaggcaatctgttgaagcctatgcttggtcggggagaactgcgatgtattggggcaacgactctagatgaatatcgtaaatacattgagaaagatcctgccctggaacgtcgtttccagcaggtttatgttgatcaaccaacagtagaagatacaatttctattctccgggggcttcgtgagagatatgagcttcatcatggagtacgtatttctgacagtgcactcgtggaggctgcaatcttgtctgaccgttacattagtggccgatttttacctgacaaagctattgatttagttgatgaagcagctgctaaattgaaaatggaaatcacttcaaaacctactgccctcgatgagattaatcgttcggtactgaagttggaaatggagaggttgtctctcacaaatgatactgataaagcttcaagagatagactgagccgccttgaagctgagttggcgctcttaaaggagagacagtccgagttgactgaacaatgggagcatgagaagtctgtaatgacaaacattcagtcgatcaaggaagagattgatagggtcaatgttgagattcagcaggccgagcgggagtatgatctcaatcgagctgctgagctgaagtacggaagtctgaactctttgcagcgccaacttgctgaagctgaaaaagaattagatgagtatatgaaatctggaaaatcgatgctaagagaagaagttaccggaaacgatattgccgaagtagttagtaaatggactggcataccgatttccaagcttcaacaatctgagagggagaaactattatatttagaagaagtgctgcataaacgtgtcgtaggtcaagatcctgcggtcagatccgtagctgaggccattcaacgatctcgagctggtctctcagatccccgtcgtccaattgccagtttcatgtttatgggtcctactggtgtagggaagacggaactagcaaaagcacttgcatcttacttgtttaatacggaagaagcacttgttcgaatcgatatgagtgagtatatggaaaaacatgcggtttcaagacttataggtgctccacctggttatgttgggtatgaagaaggaggacagctgacggaaacagttcgccggaggccctatgctgtaattctttttgatgagatcgagaaagctcatggtgatgtatttaatgttttccttcaaattttggatgatgggagagtcactgattcacaaggtcgtactgtgagctttaccaacactgtcatcattatgacttcgaatgtgggttcacaatacattctaaactcggatgaagacacacctaaagacttagcttatgaaactatcaagcagagggtaatggaagctgcaagagctatctttcgacctgagttcatgaatcgtgttgacgagtatatagtgttccaacctttggaccgcgaacaaataagcagtattgtgagattacagctggaacgtgtgcaaaataggattgcagataggaaaataaaacttcaggtaacggacagtgccattcaacttctcggaaatcttggttatgatccaaactacggtgctagaccggtgaaacgagtgattcagcagaacgttgaaaacgaacttgccaaaggcatattgagaggagagttcaaagatgaggatacaatcttggtagacaccgagctaactgcattcgcaaatggtcaactcccccagcaaaagctagtcttcaagaaactcaataatgattccgatactcaagcaaccggcagtcaagaagctttatctcagactgtctgaaagttggaagaaactcgacaatgatttggatacatgagcaactgacagtcgagaagcttcatcacagtctgtctgaaagttaataactattaagtttctttcccctaaatgctgtaagtattacacagttttgcattgtatatgaattctctataagtcccaaatcaacagttatatctatatctatatattcttttaagtgatgattttcttgtggcttgtatttttattttttagtttcaaaattctagtctaattattaatattattaagtttcttgttaaa

SEQ ID NO: 10407 - DNA, 3251 bp, Flaveria ramosissima
tccttcttataacaaactctccaaatttcacccataataatcacaataacaataataagttcttccataagaatctcctagaacaaccctatctttaccttattcttactcaatcaccttatactttaattctcccccaagaaatctggtttatagttcactggattcactcacatcttccagtattcatggcgacttctccggcgactttctccggcgtccgcatccaccgtccctccgccgtctgcaccgatacgacgtcgtcatttgctcatccctcggtctccgtcaactcgtttgctaaacctggaagaagtaacctacggttggtgaaattgaagaggagtagtgatgttgtgttgagcactcgtgtttctggtcgtaggagttcgagatcgtttgttgtgcgttgtgatgcgtcctccaatggaaggattactcagcaagagtttacagagatggcatggcaagcaattgtgtcttctcctgaagttgcaaaggataacaagcatcagattgtggagactgagcatttaatgaaagctctgctggaacaaaaaaacgggctggctcgccgaatattttccaaggctggtgtggataatacgcggcttttagaggccactgataagtttattcagcgccaaccaaaggttattagcgaatcagcgggctcaatgttagggcgtgatttggaaagcctgatgcagagagctagagattacaagaaagagtatggtgactcgtttgtgtctgttgagcatctggtgcttggttttgtgcaagataaccgatttgggaaacaattgttcaaggatttccaaatttcactaaaaaccttaaagagtgcaatagaatccattagaggacggcagacagtaatagaccaggatcctgaagggaagtatgaatcattagagaagtatggtaaagatttgactgccatggccagggaagggaagcttgaccctgtcataggaagagatgatgaaatacgcagatgcatccagattctctcaagaagaaccaagaacaatcctgtgctcattggtgaaccaggtgttggaaagactgcaatttccgaagggcttgctcagagaatagtgcaaggtgatgtgccgcaagcattaatgaatcgaaagttgatatctcttgacatgggtgcacttattgctggggcaaaatatcgtggagaatttgaagatcgactcaaggcagttttgaaagaggttacagaatcagatgggcagattattcttttcattgatgagatccatactgttgttggcgcaggggctaccaacggtgcgatggatgctggcaatctgttaaaaccgatgcttggtcgtggagagttgaggtgcattggtgcaacaacattggacgagtatcgtaaatatattgaaaaagatcctgcactggaacgccgttttcaacaagtttatgttgaccaaccaacagttgaagataccgtttctatactgcgtggactacgtgaaagatatgaacttcatcatggagtacgcatttcagatagtgcacttgtggaagctgctatcctctcagatcgttacatcagtgggcgctttttaccagataaagccattgatctggtagatgaagcggctgctaaactgaaaatggagattacttcaaaacctaccgcacttgatgagatcaatcgtgcagttttaaaactggagatggagaggctatcacttacgagtgatactgataaagcttcaaaggataggttgaatcggctcgaggctgagctggctctcttgaaggaaaggcaagccgagttaaatgaacaatgggagcatgaaaagaatgtcatgacaaatatacaatctattaaagaagaaatcgatcgggttaatctggagatacaacaagcagagcgtgagtatgatctgaatcgtgcagctgagctgaaatacgggagtctgaactccttgttacgccaacttgaaacggctgaaaaggaattagttgagtatatgagttcaggaaagtctatgcttcgtgaagaggttactggtgatgacattgctgagatcgtgagcaaatggactggaattccgctttcaaagctgaaacagtccgagagggagaaactgttatatttggaggatgagttacacaaacgggtcgtgggtcaggatcctgctgtgagatctgtagctgaagctatccaacggtcccgagccggcctatctgatcctcaccgtccaatagcgagtttcatgtttatgggacctactggagtcggaaaaactgagctggcaaaagcacttgcctcttacttgttcaacacggaggaggctcttgtaaggatagacatgagtgaatacatggaaaaacatgctgtttctagattgataggggctccacccggatatgttggatacgaggaaggagggcagttgaccgagatagtacgcaggaggccgtatgctgttatcttgtttgatgaaattgagaaggctcatgctgatgtgtttaatgtgttcctccagattctggatgatggcagggtgaccgactcacaaggtcgtaccgtcagctttaccaacactgtcatcatcatgacctcaaacgtgggttcacagtacatactagacactgatgatgactctatgccaaaagaacaagcttacgagaccataaaacgaagagtcatggatgcagccagatcaatcttcagacctgagttcatgaaccgggttgacgagtatatagtattccagccacttgaccgctcacagatcaacagaattgtccgattacagttggaaagagtacaaaagaggattgcagaccggaagctaaagatcgaggtaagtgaagctgcagttgagcttcttggaagtcttgggtatgatccaaactatggtgctagacccgtgaaaagggtgatccaacagtacgtcgaaaacgagcttgcaaagggcattttgagaggagactttaaagacgaggacaccatatccgttgacacagaagtcacggctttctccaacggtcaactccctcaacaaaagctagtcttcaagcgagttgactcacaacctggtgacgcacccgagggtcaagaagccctatcacaaactttctaagttacgacttacgaattcacatgtagatgatgcataaaattataatgtttaccattagcaaatagcaatacagcatatacatgtagtatgcacaataattgcttatgctataacaactattttgcctac

SEQ ID NO: 10408 - DNA, 4026 bp, Helianthus annuus
ctctctctctaggtttacacttacacttctccggcatccatggctaccacggcgaccttctccggcgtccgcatctcatccatctgcaccaacagatcctcatcagcatcattcgctcagccgtctgtttccgtcaattccttctctaaacctagacgaattgctgttcgctcgttgaaattgaagagcgggagtagtgaggttttgttgcgcaatcgcatttctgatagatttggcggtaaaagttctagttctcggtcctttgttgttcggtgtgttgcttcgtccaatggaaggattactcaacgagagttcacagagatggcatggcaagcaattgtgtcgtctcccgaagttgcaaaggagaacaagcattagattgtggagaccgagcatttgatgaaagctctgctggagcagaaaatcgggctggctcgccgtatattctccaaggctggtgtggacaatactcgtcttttagaagctacggataagttcattcaacgccaaccgaaggttattagtgagtcagcgggttcgatgttgggacgggatttggaaagcctgatgcagagagctagggattacaagaaagagtatggtgactcatttgtttctgtcgaacatctggtgcttggttttgtgcaagataatcggtttgggaaacaattgttcaaggaattccaaatttcattgaaaaccttaaagagtgcaatagaatccatcagaggacggcaaacagtaatagaccaggatccggaagggaagtacgaatcactagagaagtacggtaaagatttgactgcaatggcccgggaagggaagcttgaccctgtcataggaagagatgatgaaatacgcagatgcatccagattctctctagaagaaccaagaacaaccctgtgctcatcggtgaaccaggtgttggaaagactgcaatttccgaagggcttgctcagagaatagtgcaaggtgacgtgcctcaagcattaatgaatcgaaagttgatatctcttgacatgggtgcgcttattgctggcgcaaaatatcgtggagagttcgaagatcgactcaaggcagtcttgaaggaggttacagaatcagacggccagattattcttttcattgatgagatccatactgtcgttggagccggggctaccaatggtgcaatggatgctggcaatctgttgaagccgatgcttggtcgtggagagttgagatgcatcggtgcaacaacattagacgagtatcgtaaatatatcgaaaaagatcctgcactggaacgccgttttcaacaagtttatgttgaccaaccgacagttgaggatacagtttccatacttcgtggactgcgtgaaagatatgaactgcatcatggagtacgtatttccgatagtgcacttgttgaagctgcaattctctcagatcgttacatcagtggacgctttttaccggataaagccattgatctggtagatgaagcggctgctaaactgaaaatggagattacgtcaaaacctactgcacttgatgagatcaatcgtgcggttttgaaactggagatggagaggctatcgctcactagcgatacagataaagcttcaaaggaccggttgaatcggctcgaggctgagctggcgctcttgaaggaaaggcaagccgagttgaccgaacaatgggagcatgaaaagagcgtcatgacgaatatgcaatccattaaagaagaaatcgatcgggttaatctggagatacaacaagcagagcgtgagtatgatctgaaccgtgcggctgagctgaaatacgggagtctgaactcattattacgtcaacttgaaactgccgaaaaggaattagtcgagtatatgagttcgggaaaatctatgcttcgtgaagaggttaccggtgatgatattgctgagatcgtgagcaaatggaccggaattccgctatcaaagctgaaacaatccgaaagggagaaactcttgtatttggaggacgagttgcataaacgggtcgtgggtcaggatcctgcggtgacatcagtagccgaagcgatccaacggtccagagcgggcctatctgatcctcatcgtccaatagctagcttcatgttcatgggacccacaggagtcggaaaaactgagctggcaaaagcacttgcgtcttacttgttcaacaccgaggaggctctcgtaaggatcgacatgagtgaatacatggagaagcatgcggtttctagattaatcggggccccacccggatacgtagggtacgaggaaggaggacagttgaccgagatagtacgcaggagaccatatgcggtcatcttgtttgacgaaatcgaaaaggctcatgctgatgtgttcaacgtgttcctccagattttggatgacggcagggtgaccgactcgcaaggtcgtacagtcagcttcaccaacaccgtcatcatcatgacctcaaacgtgggctcacagtacatactagacactgatgatgactctgtgccaaaagaacaagcttacgagaccataaagcggagagtaatggatgcagccaggtcaatctttcgacctgagttcatgaaccgggttgatgagtatatagtgttccaacccctcgaccgctcacaaatcaacagaattgttcgattacagttggaaagggtacaaaagaggatagcggaccggaagctaaagattgaggtaagtgaagctgcggttgagcttctcggtagtctcgggtatgatccaaattacggtgctcgacctgtgaaacgggtgatccaacagtatgtcgaaaacgagcttgcaaagggtattttgagaggagagtttaaagacgaggacaccatatctattgacacagaagtcacggctttctccaacggtcaactcccccaacagaagctagtcttcaagcgtgttgactcaccatccggtgatgcagccgagggtcaagaagcagtgtcacaaagtgtgtagattccgaacccaaccaacatgtagatgatatataagattgtaacgtttaccattagcaatacatgtacaactagcatgcataataaacgcttacgctatgagtctttttgctactttcgaaaataaatctacattataatttatacagattagcttcttggtaaaaattgcagcatcattgctcgtgttttatgatcagacgaaagcccaagttcacgcatttcctggtacagcttggttgccgactcggtcttttctcgtagacaaaaaccttgaaccgcggcgttgtaaagatgcgcattcggtggaaccagtttcagaatctcatgcacttcatcataaagagaaccccagatgcaagatctaatcagtgatagcagagttaacgtatctggagttttcttttgatgaaccatatgttggtatacttgcaacgcgactttcggctcgtttccaacttcacaagttccaatcacccgacaatacgatgtaaccggaacctctaatcccgaatcttccatttcccataatatctgcaaagctcttctccacgcaccaacttgcttgcaagccgttaacgccgtgttatacaaatgcaacccgagtgcagacggggtctcatgttggatcttttcgaatagtcgaagcgcatcaccgtattgctcggctctgcacaatgcaacaagcagtgcattccatgtgtatgatgtgggaacatgccctaacgacttcatgcaatcgaagactttaaacgcgagattcacctgaccgttgttcccgagcgagtggatcaatgcgttgaatatgatgacgttcggattctcttttcttttcatcataccgcgaaaaacagtcaacgcgaaatcccatcttccgtctttcgcaaacgcgattataacactttccatggtgcgcgaatccggttccaccctgtgttgaaccatttcaagatatgcttcgatcgctaatccatactgactagacgcaagaaacgtggtaaccaataaccgatacgtcactgcattcccaacacagttgtta

SEQ ID NO: 10409 - DNA, 3325 bp, Chenopodium quinoa
ccttggttcaaaagactcgattgccacctcaaaatccgagtattgtgattttggaagtactcttttaagcaattttttgtactattgcaaccttcttgaactctctctcatctccttcctttccccacctagaaaccactggaacatactgcaaaaatcccaatttagcaaatcaataaatagaaagcgcaaacacccacaatcacattttcccaatctttcctttattcaattcctactcaaagcatcatcactgtcaattgtttccctcattaatcttcaattcagagctctacaatccaattttatacttcaatcatggctactgcaacgacgtcgtttccaggagcttatcttcgtgttccacccaaaaatggcgtccgaaatgcgttgttttctcagcctattttctctcttcggctcaagtcgaagacacccatttcgctaaattccctaaattcactcaaattcagtagaaattccactagttttttgttgtttaagaattctgggcagtttaaaaagggttcgtaaatctgggtcttttgttgttcgatgtgatgcttcaggtggtagcaggattacccaacaagaattcacagaaatggcatggcaagcagttgtttcttgtccggaagtggcaaaagagaacaagcaccagatagtggagacggagcatttgctgaaggcccttctggagcaaaaaaatggacttgctcgccgcattttctccaaagctggagttgacaatacacgtttgcttgaagcaactgacaaatttatacaacgacaaccaaaggttttgggagaatctgctgggtctatgttgggacgagatctcgaagctctaattcaaaaagccagggattacaagaaagagtacggagattcatttgtctctgtagagcatttggttcttgcttttgcacaggacaaaagatttgggaaacagttatttagtgattttcagatttctgaaaaatcattacgatctgccatacaagctgtaaggggacggcagtcagtcattgaccaagaccccgaaggaaaatatgaagctctggagaagtatggaaaagatttgactactatggcaagggaaggtaaacttgatcctgtaatcggaagagatgatgagatacggagatgcatccagattctatctaggagaacaaaaataatccagttcttattggtgaacctggtgttggtaaaaccgcgattgctgaagggcttgctcaaagaatagtcgagggggatgttcctcaagctttgatgaaccgtaagttaatttcccttgacatgggagctctcattgctggagctaaatatcgtggagaatttgaagatcggctgaaggctgtattgaaggaggtgacagacgctgagggtcaaactattcttttcatagacgagattcatacagtagttggagcaggtgccacaaatggtgctatggatgctggcaatcttttaaagcctatgcttggtcgtggagagttgcgatgcattggtgctacaacacttgatgaatatcgtaaatacattgaaaaagatccagcattggagcggcgttttcaacaggtttatgttgaccaaccaagtgttgaagatactatctccatacttcttgggctgcgtgagagatacgagttgcatcacggagttaggatttctgatggtgctcttgtggaggctgctgtgctttcagatcgctacattagcggacggttcttacctgacaaagctattgacttggtagatgaagcagctgctaaactaaagatggagatcacatcaaaacctactgccctggatgagatcaatcgttctgtattgaagtttgagatggaaagactctcacttacaaatgatactgacaaagcatcaaaggagaggcttaatcgacttgatgcagaactttccctgttaaaggaaaagcaggctgagttgactgagcaatgggagcatgaaaaatactgtaatgacacgaatacagtctatcaaagaggagattgacagggtgaatattgagatccaacaggcagagcgagaatacgatcttaatcgtgctgctgaactgaagtatggcagcctcaactctctacaacgccaattggaaagtgctgaaaaagaattggatgagtacatgaaatctggaaagtcaatgttacgtgaagaagtaactgggaccgatattgctgaaatagtcagcaagtggactggaattccttttatcaaagctgcaacagtcagagagggagagaaattattgcatttggaagaagaactacacaaacgtgttgtgggccaagatcctgcagtgacagctgttgccgaggctattcagcggtctagagctgggctttcagatccacaccgtcccattgctagtttcatgttcatgggtcccacaggtgtgggaaaaacagagttagcaaaggcccttgcctcttacctgttcaacactgaagatgcccttgtccgaattgatatgagtgaatacatggagaaattcgccgtctcaagactgataggtgctccgcctggttatgtgggctatgaggagggaggtcaattaacagagatagttagaaggaggccttatgccgtgatcctatttgatgaaatagaaaaagctcacgctgatgttttcaatgttttccttcaaattctagatgatggtagggtgacagactctcaaggacgaacagtgagcttcaccaatactgtcatcattatgacttcaaatgtcggatcacagtacatccttaatgcagctgatgatgagacaacatcaaaggaggtaacatatgaaaaaataaagcagagagtaatggatgcggccagatcaatcttcagacctgagttcatgaatagagtagacgaatacatagtcttccagcctcttgatcgtgatcagattaacagcattgttcaattacagctgcaaagagtacagtcaagaattgcagatcgtaagatgtctattcaagtgaccgatgctgcagttcagcttcttggcagccttggatatgatcccaactacggtgctaggccagtcaagcgtgtcatacaacaatatgttgagaacgaaattgctaaaggcatattgagaggggaatttaaggaagaggattgcattcttgttgatacagaggtcacggcatattcaaatggccagctccctcagcagaagctattgttccgcaaattggagcctgactcagggtcttcttctgaagaagccaagcaagctgtttctcctttgtagatttaaaaatataactgtgatctaaatttctgatgatcgttttcacattgc

SEQ ID NO: 10410 - DNA, 3041 bp, Trifolium pratense
ttcatcttcgttgtagcttatcctcacaggtttcacctctctctctgaattgttcgaaagaaatggaatggaagctgcgatggcactgatgcggaggagtccaccgaaacacacagaaacaagctctgtcagcgctcctcagtcttatgcataaccactcttccgatctcctctctcaagtcgatcaacccctgcaggtctctctagatttccttgttcatcgtttcaattgcattggttttgcatactcacaaattagggtacaaaattgaagataatgtggttgatccaacgtatttctctatatctctctttccctggaaggcaatagttttgtcgccagaggtggccaaagagaacaagcatcagattgtggagactgatgaaggctttgttggagcaaaagaatggacttgctcgtgggattttttccaaggttggggtagataacattcggctgctagaagctactgataagtacattcagcgacaacctaaggttataggggaatcagctggttcaatgttggggcgtgatttagaggcattgattcaaagagccagggacctcaagaaagaatatgggggttcatttgtttcagttgagcacttggttcttggttttatccaagaccaacgatttggaaagcaactcttcaaagaatttcaaatatctaagcaaggtctaaaatctgcaatagagtcgattaggggacgcaagtcagtaattgaccaagatgcagaaggatgaagccttggaaaaatatggaaaagatttgacggcaatggctaaagcaggaaaacttgatccggttataagaagagatgatgaaatacgcaggtgcatccaaattctctccaggagaacaaagaacaatcctgtgctgattggcgagcctggtattggaaagacttcaatttctgaaggacttgctcagaggattgtgcaaggagatgttcctcaagctttgatgaaccgtaggcttatatcccttgatatgggtgcacttattgctggagcaaaataccgaggagaattcgaagataggctgaaagctgttcttaaagaagtaacagaatctgatggtcaaactatccttttcattgatgagattcatacagttgttggggcaggtgctacaaatggtgctatggatgctggtaatctcttaaagcctatgcttggtagaggagagttgcggtgtattggtgcaacaacacttgatgagtatcggaagtatattgagaaggacccagcattagagcgccgtttccagcaggtttatgttgatcaacctactgttgaagataccatttcaatactaaggggactgcgggaaagatacgagctgcatcatggagtccggatttctgacagtgcacttgtcgaagctgcaattctctcagatcgatatatcagcgggaggtttttgcccgacaaagctattgatttggttgatgaggcagctgccaaactgaaaatggaaatcacttcaaaacctactgcacttgatgaaatcaaccgttcggtcctgaagtttgagatggagagactctctctcatgaatgatacagacaaggcttctaaagatagacttaatcgtcttgaggcagagctctctctcttaaaggagaaacagtctgagctgactgaacagtgggagcatgaaaagactgtaatgactcggattcaatcaatcaaagaagagatagacagggtaaatcttgagatccaacaggctgagcgggagtatgatctaaatcgtgctgctgaattaaaatatggtagcctaaactccttgcagcgacaacttgagagtgcagagaaggaattagatgaatatatgaactctggaaagtctatgctgagagaggaagtaacagaaaatgatattgctgaaattgtaagcaagtggactggcattcctgtttcaaaacttcaacaatcagagagggagaagttgttgtatttagaggaagtacttcataagcgcgttgtaggtcaagaccccgctgttaaagcagtagcggaggctatccagcgttcaagagcaggtctttcagatcctcatcgtccaattgctagcttcatgtttatgggacctactggtgtaggaaagactgagctagctaagacactagcttcctacatgttcaatactgaagaagcactagtaagaattgatatgagcgagtacatggaaaagcatgcagtttcaagattgattggagcaccacctggatatgttgggtacgaagagggagggcagcttaccgagacagttcgccgcagaccttatgctgttattttgtttgatgagattgagaaggcacactcggatgtgttcaacatattccttcagattttggatgatggaagagtaaccgattcacagggtcgaacagtgagttttaccaacactgttatcattatgacctcaaacgttggatcacagtacattctcaacacggatgatgacacaacgcctaaagagttagcttatgaaaccataaagcagcgagtaatggacgctgcaagatccatatttcgccccgagttcatgaatagagttgatgaatatattgttttccggcctcttgaccgtgaccaaataagtagcattgtcaggttacagttggagcgcgtgcagaaaagaattgcagaccgcaagatgaaactccgagtaacagaagctgctatccaacttcttggtagtttagggtatgatccaaactacggtgctaggccggtgaagcgagtgattcagcaaaatgtggagaatgaacttgcaaagggtattcttagaggagattttaaggaagaggacacaattttagtagacactgaagtcacagtacttgccaatggtcaaattcctcagcaaaagctaacttttaggagggtggaagctgattcagaatcttctactaaaaacaacagggaaagctctccacagattctatgaaggcattgcaattaatattcctttatctcccacatgccaagtttacacaaattttgagtatagatcattttctta

SEQ ID NO: 10411 - DNA, 3310 bp, Capsicum annuum
cagcactcccctatctcctacaacttctcatttttctaacgctaagataaaagaattaccgtcaccggtaacgctaccggctccggcacatcttgttttccgatatgtcaactgtgacgtcattttccggcgtgcagctctgcgttccttcttcttccaattcttcaaatagagtaggtttattttcttcacattcaccgccttacgttaacttctccggcaaatctcgagttctcgggaagtgtaattcgttgaaattgaagagaaaggatgtgtttttcttcactaggaaaactgagaaactgtccaaaggttccaggtttaccgtacgttgtgatgcttcaagtggaaggatcactcagcaagagtttacggaaatggcatggcaagcaattgtttcatcgccagaaatagcgaaagagaacaagcatcaaatagtagagactgaacatttgatgaaggcactgttggagcagaagaatgggctggctcgccgtatattctccaaggctggtgtagataatacccgccttttagagtctaccgataagtttattcaacgacaacctaaggttattggtgagtcagctggctctatgttaggccgagacttggaaggtttgatgcagagagccagggagtacaagaaagagtatggtgattcttttgtgtcagttgagcatttggtgcttggcttcgttcaagataaacgatttgggaagcaattgtttaatgatttccagatttccctgaagacattaaaagctgccattgaatccataaggggacgccaaaatgttattgatcaagatcctgagggaaagtatgaatcactagaaaaatatggaaaagatctgactgctatggctagagcggggaagcttgacccagttataggcagagatgatgagatccgtagatgcatacaaatcctctccaggagaacaaagaataacccagtgttaattggtgagcctggagttgggaaaactgcaatctctgaggggcttgcacagagaattgtgcaaggagatgtacctcaggctttgatgaatcgacggttgatatctcttgatatgggtgcgctcatagccggtgcaaaataccgtggtgaatttgaagacagattgaaggctgtgcttaaggaagtgacagaatctgaaggacagattattctttttattgatgagatacatactgttgttggcgcaggtgccactaatggtgcaatggatgctgggaatctcttgaagccgatgcttggtcgaggagaattacgatgtattggtgcaacaaccttggatgaataccgtaaatatatcgagaaagatcctgccttggagcgtcgtttccagcaagtttatgtggaccagcccacagttgaagacactgtctctatacttcgtggattgcgtgaaagatatgagctgcatcatggggtccgcatttctgacactgcacttgtcgacgcagctattctttctgaccgttatattagtggacgttttctacctgacaaagctattgacctagttgatgaagctgctgcaaaactgaaaatggagatcacctcaaaacctacagcccttgatgagatcaatcgtgcagttttgaagttggagatggagaggctttctctaactaatgatacggatagagcatcaaaagatcggttaaaccgccttgagactgaattgtctcttttaaaggagaggcaagctgagctgactgagcagtgggagcatgaaaaaaccgtcatgactcgcatacagtccgtcaaggaagagattgacagggtaaatcttgagatccagcaagcagagcgggaatatgatcttaatcgtgctgctgaactgaagtacgggagtctaaacaccttgcagcgtcagcttgaagctgcagaaaaagaactagatgattatatgaagtctggaaaatcaatgctcagagaagaagtgactgggaatgatattgcagagattgtcagtaagtggactgggattcctgtttccaagttgcaacagtcagagagggaaaagctgttgcatttggaggaagagctacacaaacgtgttgttggtcaagatccagcagtgagatcagttgcagaggcgatccaacgctcacgtgctggactttcagatcctcatcgtcctattgcaagctttatgttcatgggtcccactggagttggaaagacggagctagctaaggcgcttgctaactatttgttcaatactgaagaagcacttgtgcgcattgatatgagtgaatacatggagaaacatgcagtttctagattgataggagctccccctggttatgtagggtatgaagaaggagggcagttgaccgagattgttcgcaggagaccgtacgcagttattttgtttgatgaaattgagaaggcccattcggatgtatttaatgtgttcctacaaatcttagatgatggtagggtgactgactcacaaggacgcacagtgagtttcaccaatactgtcatcatcatgacatcaaatgttggttcacaatatattctaaatgcggatgatgatgatgattcgtcaaaggaagcaacttatcaaacaataaagcagagagtgatggatgctgcacgtgcagttttccgcccagagttcatgaatcgggtggatgaatatatagtattccaacctcttgatcgtgaccaaatcagtagcattgtgcggttacagcttgagagggtgcagcagagattagctgatcgcaaaatgaagattcaagtgagtgatgctgctattcaactgcttggaagtcttggttatgatcccaactatggagcacggccagtgaagcgggtgatccagcagaatattgagaacgaattggccaaaggtatcttaagaggagatttcaaggatgaggatactgttttaatagacacggaggtcagcgctttctccaatggacaacttcctcagcagaagctagtatttagaagacaagaatctggtggttcagactctccagcagagaacgaagaagctttctctcagaaactatgaggctgcacgtcagtgtcaggttcacagaaacgtgaggttgcatacgtactatgagctaccaactttgtagctcttgtattatagattttggatatacatactgaaggttaaataatatggagttattttctttttatatagcttattagcctgaagtagcttgttggtaaacgcaaactcttaggtaacggggtggaggttcactaccaacatgagataaaagtaacttatttgtattatttattattttcaagtaaaggatg

SEQ ID NO: 10412 - DNA, 3238 bp, Malus domestica
atctccttcctccttcctcctcccaccatttcaaagcaacctccttttcctcctcctctgcaaacccggatcccacttcccacaacgctcccacagcaatcgcaaccttttcttccagctccttcaatggcgtcggcgacctcgctctcttctggggtcgctcttgttcatcttccccaatcgggttttccgaaatgctgcgataaagcttccgtctttgcccgcccccaccactccctcagcttcaattcccgtgccgactcctttcaggcgttcatttcacggcagttgactccgaacggttcgttccgaaccgggttgtggagaactaatcggaattcgaggcctttcgtcgtgcgctgtgaagcttcaactggaaggggaaggattacacagcaggattttacagaaatggcgtggcaagcaattgtttcgtcgccggaagtggcgaaagagaacaagcatcagatagtggagactgaacatctgttgaaggcactcttggagcagaagaatggtcttgctcgtcggattttttccaaggttggggtggacaatgcccggcttctcgaggccactgataagtatattcagcgccaaccaaaggtttttggtgaatctgcgggctcaatgttgggacgtgatttggaagccttgattcagcgagccagggattacaagaaagagtatggggactcatttgtgtctgtcgagcatttggtacttggtttttctcaagatcaacgctttgggaagcaattatttcgggattttcaaatatccaaggaagctttgaaatctgctatagaatccataagggggcgccaatcagttattgaccaagatcctgaagggaaatatgaagcacttgaaaagtacggaaaagatttaacagctatggcaaaagtaggaaagcttgacccagtaataggaagagatgatgaaattcgtaggtgcatccagattctctccagaagaacaaagaacaacccggtgctgattggtgaaccaggtgtcggaaaaactgcaatttctgaagggcttgctcaaagaatcgtgcaaggggatgtcccacaagctctgatgaatcgtaagttaatatcccttgacatgggcgcactaattgctggggcaaaatatcggggagaatttgaggacaggctgaaggcagtactcagggaagtaacagaatcagagggccagataatcctttttatcgatgagatccacacagttgttggtgcaggtgctacaaacggtgcaatggatgctggtaatctcttaaaacccatgcttggtcgaggagagttgcggtgtataggtgcaacaacactggatgagtatcgtaaatatattgagaaagatccggcattggagcgtcggttccagcaagtttatgttgatcaacccacagtggaagataccgtttcaatactccgaggactgcgtgagagatatgagttgcatcatggagtccgcatttctgatggtgcactggtggaagctgcaattctctcagaccgttacatcagtgggcgatttttacccgacaaagctattgacttagttgatgaagctgctgctaaattgaaaatggagattacgtcaaagcccacggccctagatgagatcaatcgttcggtgttgaaacttgaaatggagagattatctcttacaaatgatacggacaaatcttcaaaagagagattgaaccgccttgaagctgagttagctctcttaaaagaaaaacaatccgagttgtctgagcagtgggagcatgaaaaatctgtcatgactcgcattcagtcaatcaaggaagagattgacagactaaatcttgagatccagcaagccgaacgagagtatgatctcaaccgtgcggctgagttgaagtacgggagtctgaattctttgcagcgtcaactcgttgatgcagaaaaagagctcgatgagtatatgaggtctgggaagtccatgttgagagaggaagttactggaagtgatattgctgaaatagtaagtaagtggactggtattcctgtttccaagcttcaacaatcggagatggagaagctcttacatttggaggatgagctgcataaacgtgttgtaggtcaggagcctgcagtgagatcagtggctgaagctattcagcggtctcgggcaggtctctcagatcctcatcgccccattgctagtttcatgtttatgggtcccactggtgttgggaagacagaactagctaaggccctcgcctcctacttgttcaacacggaagaaacacttgtaagaatcgatatgagtgagtacatggaaaagcatgctgtttcaagattgataggagctccacctggttatgtggggtatgaggagggaggacagctgacagaggtggttcgccggagaccatattcagttattttgttcgatgagatagagaaggcacattctgatgtgttcaatgtgttccttcaaattttagacgatgggagaataactgactcgcagggtcgtactgtgagcttcaccaacactgtcatcattatgacctcaaatgtgggttcacagtacatactaaacgctgacgatgacgacactcctaaagagttggcttacgacactataaagcaccgggtactggaggctgcaagatcaatatttcgccccgagttcatgaaccgtgttgatgagtacatagttttccagcccctggaccgtgatcagataagccgtattgtcaagctacagttggaccgagtgcgaaagagaattgcagaccgcaagatgaagatcaaggtgagcgatgcagctatcgagcttctcggaagtcttgggtatgatccaaactacggcgccaggccagtgaagcgggtgatacagcagtacgtcgaaaacgagcttgccaagtgcatattgagaggagagtttagggaagaagacacagtggccatagacacagaggtgacggcattttccagtggccagctcccccagcaaaagcttgtgttcaggaggttggaaaccaccgactcagaatctccggctacagagaaccaagaggctttctcggaggctcggtagacgatgacaaagttaggcagaaaatatagtcggacgttttctcttgtatatgaccttttttttataattcccgacatcttatttttcactgcatgtaaaagaaggccggagactcatgaagtgtggcgtttcttgcaataaatgtggttttatatta

SEQ ID NO: 10413 - DNA, 3273 bp, Chenopodium quinoa
ttttttgtactattgcaaccttcctgaactctctctctcatctcctttctttccccatccagaaatcactggaacatactgcaaaaatcccaattcagaaaatcaataaaaagaaagcacaaacacccacaaatcaccttttcccaacatccctttattcaattcctactcaaagcatcatcactttcaattgtttctctcattaatcttcaattcagagctctacaatccaactttatacttcaatcatggctactgcaacgacgtcgtttccaggagcttatcttcgtgttccacccaaaaatggcgtccgaaatgcgttgttttctcagcctattctctctcttcggctcaattcgaagacacccatttcgctaaagtccctaaattcactgaaattcagtagaaattccactaattttttgttgtttaagaattctgggcaatttaaaaagaattcgaaatctgggtcttttgttgttcgatgtgatgcttcaggtggtagcaggattacccaacaagaattcacagaaatggcatggcaagcagttgtttcttgtccggaagtggcaaaagagaacaaacaccagatagtggagacggagcatttgttgaaggcacttctagagcaaaaaatggacttgctcgccgcattttctccaaagctggagttgacaatacacgtttgcttgaagcaactgacaaatttatacaacgacaaccaaaggttttgggagaatctgctgggtctatgttgggacgagatctcgaagctctgattcaaaaagccagggattacaagaaagagtatggagattcatttgtctctgtagagcatttggttcttgcttttgcacaggacaaaagatttgggaaacagttatttagtgattttcagatttctgaaaaaacattacgatctgccatacaagctgtaagggggcggcagtcggtcattgaccaagaccccgaaggaaaatatgaagctctggagaagtatggaaaagatttgactactatggcaagggaaggtaaacttgatcctgtaattggaagagatgatgagatacggagatgcatccagattctatctaggagaacaaaaaataatccagttcttattggtgaacctggtgttggtaaaaccgcgattgctgaagggcttgctcaaagaatagtcgagggggatgttcctcaagctttgatgaaccgtaagttaatttcccttgacatgggagctctcattgctggagctaaatatcgtggagaatttgaagatcggctgaaggctgtattgaaggaggtgacagacgctgagggtcaaactattcttttcatagatgagattcatacagtagttggagcaggtgccacaaatggtgctatggatgctggcaatcttttaaagcctatgcttggtcgtggagagttgcgatgcattggtgctacaacacttgatgaatatcgtaaatacattgaaaaagatccagcattggagcggcgttttcaacaggtttatgttgaccaaccaagtgttgaagatactatctcgatacttcgtgggctgcgtgagagatacgagttgcatcatggagttaggatttctgacggtgctcttgtggaggctgctatgctttcagatcgctacattagcggacggttcttacctgacaaagctattgacttagtagatgaagcagctgctaaactaaagatggagatcacatcaaaacctactgccctggacgagatcaatcgttctgtattgaagtttgagatggaaagactctcacttacaaatgatactgacaaagcatcaaaggagaggcttaatcgacttgatgcagaactttccctactaaaggaaaagcaggctgaattgactgagcaatgggagcatgaaaaatctgtaatgacacgaatacagtctatcaaagaggagattgacagggtgaatattgagatccaacaggcagagcgagaatacgatcttaatcgtgctgctgaactgaagtatggcagcctcaactctctacaacgccaattggaaagtgctgaaaaagaattggatgagtacatgaaatctgggaagtcaatgttacgtgaagaagtaactgggaccgacattgctgaaatagtcagcaagtggactggaattcccttatcaaagctgcaacagtcggagagagagaaattattgcatttggaagaagagctacacagacgtgttgtgggccaagatcctgcagtgacagctgttgccgaggctattcagcggtctagagctgggctttcagatccacaccgtcccattgctagtttcatgttcatgggtcccacaggtgtgggaaaaacagagttagcaaaggcccttgcctcttacctgttcaacactgaagatgcccttgtccgaattgatatgagtgaatacatggagaaattcgccgtctcaagactgataggtgctccgcctggttatgtgggctatgaggagggaggtcaactaacagagatagttagaaggaggccttatgccgtgatcctatttgatgaaatagaaaaagctcacgctgatgttttcaatgttttccttcaaattctagacgatggtagggtgacagactctcaaggacgaacagtgagcttcaccaatactgtcatcattatgacttcaaatgtcggatcacagtacatccttaatgcagctgatgatgagacaacatcaaaggaggtaacatatgaaaaaataaagcagagagtaatggatgcggccagatcaatcttccgacctgagttcatgaatagagtagacgaatacatagtcttccagcctcttgatcgtgatcagattaacagcattgttcaattacagctgcaaagagtacagtcaagaattgcagatcgtaagatgtctattcaagtgaccgatgctgcagttcagcttcttggcaaccttggatatgatcccaactacggtgctaggccagtcaagcgtgtcatacaacaatatgttgagaacgaaattgctaaaggcatattaagaggggaattcaaggaagaggattgcattcttgttgatacagaggtcacggcatattcaaatggccagctccctcagcagaagctattgttccgcaaattggagcctgactcagggtcttcctctgaagaagccaagcaagctgtttctcctttgtagattcgaagatataactgtgatctaaatttctgatgattgttttcacattgcacatagatttataatggcagtaa

SEQ ID NO: 10414 - DNA, 3142 bp, Flaveria ramosissima
taacaatctcctagaacaaccctatctttaccttattcttactccatcacctatatactttaattctcccccaagaaatctggtttatacttcactggattcactcacatcttccactattcatggcgacttctccggcgactttctccgccgtccgcatccaccgtccctccgccgtctgcaccgacacgacgtcgtcatttgcgcatccctcggtctccgtcaactcgtttgctaaacctggaagaagtgctctgcggttggtgaaattgaagaggagtagtgatgttgtgttgagtactcgtgtttctggtggtaggagctcgagatcgtttgttgtgcgttgtgatgcgtcctctaatggaaggattactcagcaagagtttacagagatggcatggcaagcaattgtgtcttctcctgaagttgcaaaggagaacaagcatcagattgtggagactgaacatttgatgaaagccctgctggaacagaaaaacgggctggctcgccgaatattctccaaggctggtgtggataacacgcgccttctagaggccactgataagttcattcagcgccaaccgaaggttatcagtgagtcagcaggctcgatgttagggcgggagttggaaagcctgatgcagagagctagggattacaagaaagagtatggtgactcgtttgtgtctgttgagcatctggtgcttggttttgtgcaagataaccgatttgggaaacaattgttcaaagatttccaaatttcactaaaaaccttaaagactgcaatagaatccattagaggacggcagacagtaatagaccaggatcctgaagggaagtatgaatcattagagaagtatggtaaagatttgactgccatggccagggaagggaagcttgaccctgtcataggaagagatgatgaaatacgcagatgcatccagattctctcaagaagaaccaagaacaatcctgtgctcattggtgaaccaggtgttggaaagactgcaatttccgaagggcttgctcagagaatagtgcaaggtgatgtgcctcaagcattaatgaatcgaaagttgatatctcttgacatgggtgcgcttattgctggggcaaaatatcgtggagaatttgaagatcgtctcaaggcagtcttgaaggaggttacagaatcagatggccagattattcttttcattgacgagatccatactgttgttggagctggggccaccaacggtgccatggatgctggcaatctgttgaaacctatgcttggtcgtggagagttgaggtgcattggtgcaacaacattggatgagtatcgtaaatatattgaaaaggatcctgctctggaacgccgttttcaacaagtttatgttgaccaaccaactgtagaagatacagtttctatacttcgtggactgcgtgaaagatatgaactgcatcatggagttcgcatttcagatagtgcactagtggaagctgcaatcctatcagatcgttacatcagtggacgctttttaccagataaagccattgatctggtagatgaagcagctgctaaactgaaaatggagattacttcaaaacctactgcacttgatgagatcaatcgtgctgttttaaaactggagatggagaggctatcgcttacgagtgatactgataaagcttcaaaggataggttgaatcggctcgaggctgagctggctctcctgaaggaaaggcaagccgagttaaatgaacaatgggagcatgaaaagaatgtcatgacaaatatacaatctatcaaagaagaaatcgatcgggttaatttggagatacaacaagcagagcgtgagtatgatctgaatcgtgcagctgagttgaaatacgggagtctgaactccttgttgcgccaacttgaaactgctgaaaaggaattagtcgagtatatgagttcagggaagtctatgcttcgtgaagaagttactggtgatgacattgctgagattgtgagcaaatggactggaatcccgctttcaaagctgaaacagtctgagagggagaaactgttatatctggaggatgagttacacaaacgggtcgtgggtcaggatcctgcggtgagatctgtagctgaagctatccaacggtcccgagccggcctatctgatcctcaccgtccaatagcgagtttcatgtttatgggacctactggagtcggaaaaactgagcttgcaaaagcacttgcctcttacttgttcaacacggaggaggctcttgtaaggatagacatgagtgaatacatggaaaaacatgctgtttctagattgataggggctccacccggatatgtaggatacgaggaaggagggcagttgaccgagatagtacgcaggaggccgtatgctgttatcttgtttgatgaaattgagaaggctcatgctgatgtgttcaatgtgttcctccagattctggatgatggcagggtgacggactcacaaggtcgtaccgtcagctttaccaacactgtcatcatcatgacctcaaacgtgggttcacagtacatactagacactgacgatgactctatgccaaaagaacaagcttacgagaccataaaacgaagagtcatggatgcagccagatcaatcttcagacccgagttcatgaaccgggttgacgagtatatagtattccagccacttgaccgctcacagatcaacagaattgtccgattacagttggaaagagtacaaaagaggattgcagaccggaagctaaagatcgaggtaagtgaagctgcagttgagcttcttggaagtcttgggtatgatccaaactatggtgctagacccgtgaaacgggtgatccaacagcacgtcgaaaacgagcttgcaaagggcattttgagaggagactttaaagacgaggacaccatatccgttgacacagaagtcacggctttctccaacggtcaactccctcaacaaaagctagtcttcaagcgagttgactcacaacctggtgacgcacccgagggtcaagaagccctatcacaaactttctaagttacgacttacgaattcacatgtagatgatgcataaaattataatgtttaccattagcaaatagcaatacagcatatacatgtag

SEQ ID NO: 10415 - DNA, 3756 bp, Populus trichocarpa
acactaacaaagtgccacgtgtttgaacacagtaaaatcacgcttttctaccaattttgagagctttcaagaagtctccacagacccctctctctctctcttttatcttctcttctgtgttttaacaaacagcacaggtttcgcttactcgctagtcgctacagcctccgatacatagaattcttttttattttattctcttcttcattctcactctaaattaaagtaaagtccttttctttcgctttaatttcttccagctcccttctctcttcttgtcaatctccaagttgtattactggcttgccacctgctcagccaaaatggcaaccaccgctacagcggcgtcgtttaccggagtgagtctgtgtccttcctcatcatctcccctttcacattcagcttccattaggaatgctttgttgcctcaaaagtctcttattagtttcgctggaaggcggatttctgtgaagtcgcttgagttgaagagaaatggtgcccgttttcagaggactagtagacccacttcctttgttgttagatgtgatgcttctaatggaaggattacacagcaagaatttacagacatggcatggcaaggaattgtatcttccccagatgtggcgaaagagaacaaacatcagatagtggagaccgagcatttgatgaaagtcctcttggagcaaaagaatggccttgctcgccgtatcttttccaaggttggggttgataatactcgtcttcttgaagccaccgataaatttatccaacgccagcccaaggttctaagcgattctgctggttcaatgttgggacgtgacttggaggccctgatccaacgagccagagaatacaagaaagagtatggggattcatttgtttctgttgagcatttggttcttgcattcactcaagatcaacgatttgggaagcaattatttaaagattttcaaatatctctacaaactctgaaacctgcaatagaatccataaggggacgccaatcagttatagaccaagatcctgaaggaaagtatgaagcactggagaagtatggaaaggatttgacagccatggcaaaagcaggaaagcttgacccagttattggcagggatgatgaaatccgtagatgcatccagattctctccaggagaacaaaaaacaatcctgtgctaattggtgaaccaggtgtggggaaaactgcaatttctgaagggcttgcccagagaattgtggaaggggatgttcctcaagctttgatgaaccgcaagctaatatcccttgacatgggtgcactcattgctggggcaaaatatcgaggggaatttgaggatagattgaaggctgtacttagggaagtcacggattcagatggtcagattatccttttcattgatgagattcacacagtggttggtgctggtgccacaaatggagcgatggatgcgggcaatctcttgaagcctatgcttggcagaggagagttgcgctgcattggtgcaacaacactggatgagtatcgtaagtatattgagaaagatcctgcattggagcgtcgtttccagcaagtttttgttgatcaacctacagtagcggatacagtatctatactccggggactgcgtgaaagatatgagctgcatcatggagtccgaatttctgacagtgcacttgtggaagcagcgattctgtctgatcgttacatcagtggaagatttttacctgacaaagctattgatttagttgatgaagcagctgcaaaactgaaaatggaaattacttcaaagcctactgcccttgatggaatcaaccgttcagtattaaagctggagatggagaggttatctcttaaaaatgatacggataaagcttcaaaagataggctgagccgccttgatgctgagttgtccctgttaaaaaagaaacaagctgagctgacagagcaatgggagcacgagaagtctgtcatgacacgcattcagtcaattaaggaagagattgacagggtcaatcttgagattcagcaggctgagcgagagtatgatttaaatcgtgctgctgaattgaagtacgggagcctgaattctttgcaacgccaacttggaagtgctgaaaaggagttggatgagtacatgaagtcaggaaagtccatgctgagagaagaagttacaggtgatgacattgctgaaattgttagcaagtggactggcatccctgtttccaagcttaaacaatctgagaaggagaagctattgcatttggaagaagagctgcataaacgtgtggtgggtcaagaccctgcagtgaaagcagtagctgaggccattcagcgatctcgtgctggtctctctgatcctcgccgtccaattgctagtttcatgttcatgggccccactggtgttggaaaaacagaactagctaaagccctagcttcctatatgttcaatactgaagaagcccttgtacgaattgatatgagcgaatacatggaaaagcatgcagtttcacgattaattggcgccccacctggttatgtagggtatgaggaagggggccagttgacagagacagttcgtaggaggccatatgcagttattctctttgatgagatagaaaaggctcattctgatgtatttaatatcttccttcagattttggatgatggtagggtgactgattcacaaggtcgcacagtcagtttcacaaacactgtcatcattatgacttcaaatgtgggttcacaatatatacttgacactgatgatgacttgccaaaggaggtagcttatgaaacaattaagaggagggtaatggatgctgctagatcagtcttccgacctgagttcatgaacagggttgatgagtacatagttttccagcctctggatcgtgatcaaataaacagcattgtcaggttacagcttgaacgtgtccagcaaaggcttgcagaccggaagataagagtattggttaccgatgcagctggagaccttcttgggactcttggatacgatcccaactatggtgctaggccagtcaaaagggtgattcagcagtatgttgaaaacgaacttgccaagggtatcttgagaggggaattcaaggatgaggattctgtcttaatagacaccgaggttacagcatttgctaatgggcagctcccccagcaaaagctagttttcaagcgtcttgaaactagtgaagaaaaagcagctgcagaaaatcgagttttctcacgaactgtctgaatgtttataccttcactacactatataggttttatacattttgtgtagagggttcgtagctcatgctaaatggctttttccatcttgtatgatgtttccattataaaactaaatggctttttccatcttgtataatgtttcattataaaagtacaggtctcgaggtttatgttcttttgttgtaaggtatgtacaccctgccaacactaatattttttatgccttgaatggttgccaaagttgggggcgatctagtgttcctgaagtgttaaatgcacaagagagcgacgtaataatctatttcatagaccagagttttcatgcatgctccagttgaagaaattggctatccatattgacaccattgtttttaatatttcatttcaattaagctgtatgaatcatttacgaaattttgtgaactggagaaaacaatggaaaaggtgcgagtaaaaattgatcggagagagtcatttctaatgtatttggttgtgctgctattatgatc

SEQ ID NO: 10416 - DNA, 3353 bp, Ambrosia trifida
gatagtggttagagactagacaacactggtattctcttgaaccatcctcttccttgttcatctcctctataaaccacttaccactctttgaaccctcttcactcaacaacacaacattttcttctctgtatagaacctgctagaagcaagacccctaacaacacttttccatattctcactctatccctcgtacctccctactttattattattatataataataatcatcttcactcaaatctattatccatctctcaatacagtttacacacacttcttcttcttctataaccatgtccaccctgtctaccttattccatctcccttcatccatttgcactgacagaacaataacatcatcatttgctcaaccatctgtttctgttaattcgttttctaaacctagaagagtttccctacgttcgttgaaattgaagacacggagtaatgatgtgttgttgcgtaagagttctcgatctcttgttgttcgttgtgatgcttcttccagtggaaggattactcaacaagaattcactgaaatggcatggcaagcaattgtatcttctcctgaagttgcaaaggagaacaagcatcagatcgtggagacggagcatttgatgaaagctctgctggagcagaaaaatgggttggctcgcaggatattctccaaggctggtgtggataatactcgccttctagaggctactgataagttcattcagcgccagccgaaggttattggtgagtcagcgggctcgatgttagggcgagatttggaaagcctgatgcagagagctagggattacaagaaagagtatggtgactcgtttgtttctgttgagcatctggtgcttggttttgtgcaagataaccggtttgggaaacaattgttcaaggaattccaaatttcgttgaaaaccttaaagagtgcaatagaatccatcagaggacggcagacagtgatagaccaagatcctgaagggaagtacgaatctttagagaagtatggtaaagatttgactgccatggctagggaagggaagcttgaccctgtcataggaagagatgacgaaatacgcagatgcatccagattctctctagaagaaccaagaacaaccctgtgctcattggtgaaccaggtgttggaaagactgcaatttccgaagggcttgctcagagaatagtgcaaggtgatgtgcctcaagcattgatgaatcgaaagttgatatctcttgacatgggtgcgcttattgccggggcaaaatatcgtggagagtttgaagatcgactcaaggcagtcttgaaggaggttactgaatcagatggccagattattcttttcattgatgagatccatactgttgttggagctggggctaccaatggtgcaatggatgctggcaatctgttgaagccgatgcttggtcgtggagagttgagatgcattggtgcaacaacattggacgagtatcgtaaatacatcgaaaaagatcctgcattggaacgccgttttcaacaagtttatgttgaccaaccgacggttgaagatacagtttctatacttcgtggactgcgtgaaagatatgaactgcatcatggagtacgtatttcagacagtgcacttgttgaagctgcaattctctcagatcgttacatcagtggacgctttttacccgataaagccattgatctggtagatgaagcagctgctaaactgaaatggaaattacttcaaacctaccgcacttgatgagatcaaccgtgcagttttgaaactcgagatggagaggctatcactcactagtgatacagataaagcttcaaaggacaggttgaatcggctcgagactgagctggctctcttaaaggaaaggcaagccgagttgaccgaacaatgggagcatgaaaagagtgtcatgacaaatatacaatctattaaagaagaaattgatcgggttaatctagagatacaacaagcagagcgtgagtatgatctgaaccgtgcagctgagctgaaatacgggagtctgaactcattgttacgtcaacttgaaactgctgaaaaagaattagtcgagtatatgagttcagggaagtctatgcttcgtgaagaggttactggtgatgacattgctgagatcgtgagcaaatggactggaattccgctttcaaagctgaaacaatccgagagggagaaactcttatatttggaggacgagttacataaacgggttgtgggtcaggatcctgcggtgacatcagtagctgaagctatccaacggtccagagccggcctatccgatcctcatcgtccaatagctagtttcatgttcatgggacctacgggagtcggaaaaaccgagctggcaaaagcacttgcttcttacttgttcaacaccgaggagtctcttgtaaggatcgacatgagtgaatacatggagaagcatgctgtttctagattgatcggggctccacctggatatgtagggtatgaggaaggaggacagttgaccgagatagtacgcaggaggccgtatgctgttatcttgtttgatgagattgaaaaggctcatgctgatgtgttcaacgtgttcctccagattttggatgatggcagagtgaccgactcacaaggtcgtacagtcagcttcaccaacaccgtcatcatcatgacctcaaatgtgggctcgcagtacatactagacactgatgatgactctgcgccaaaagaacaagcttacgagaccataaagcgtagagtaatggatgcagccaggtcagtctttagacccgagttcatgaaccgggtcgatgatatatagtattccagccgctcgaccgctcacaaatcaacagaattgtccgactacagttggaaagggtacagaagagaatagcagacaagaagctaaagatcgaggtaagtgaagctgcagttgagcttctagggagtcttggatacgatccaaactatggtgctagacctgtgaaacgagtgacccaacaatatgtcgaaaacgagcttgcaaagggtattctgagaggcgaatttaaagacgaggacaccatatcagttgacacagaagtcacggctttttccaacggtcaactcccccaacaaaagcttgtcttcaagcgcgttgactcgccatctggtgacacagccgagggtcaagaagcagtaccacaaaatatctaaatcatgaacctaaccaacatgtagatctaataaaaattgtaatgtttttaccattagcaatacagcatgtacaactagtatgcataataaatgcgtatgctatcgagtcttttgccacttctgaaaataaatctacattataatttataca

SEQ ID NO: 10417 - DNA, 3299 bp, Vaccinium corymbosum
cggttcccggtttcggaccgtaacgttcctacgaacggaagacgtagtaggtactacaacgcagtaggtcggacctacgttaaccggaaccggggaacgacgtaggttaggtactacacgcagtaggtcgacctacgttaccgggccggttactttctaattccccaccccaaacccccctacctttttcccatatttcactttcactcctgaaacacccctgaactgtcaccgtcaaacctcgccggagattctaaactcctccaccgactccaacaatggcctctgtgacgtcactatccggcgtccagtttcttttcccgccctccggttgcggtgatagagccgccgcctcgttctctaagcaacctctctcgtctctgaggttcgcaaaaaccagttgcgcttaaaaacccgaaattcgttgagattgaagaagaagactggcgattctttgtttccccgggagaagagttgagaggtcggttgtcgtacgatgcgatgcttctaatggaggaaggattacccaacaagaattcacggaaatggcttggcaaggtattgtttcatcgccagaagtggcaaaagagaacaagcatcagatagtggagacagagcatttgatgaaggccctgctggagcagagaatggccttgctcgccgtatcttctccaaagccggggttgacaatacacgtcttctagaagctactgatcagttcatcaagcgccaaccgaaggttcttggagagtcagcgggttcaatgttaggacgggatttggaagccctgatacagcgagccagggactacaagaaagagtatggcgattcatttgtgtcagttgagcatttggtccttggttatgcacaagacaatcgatttgggaaacaattatttaaggatttccaagtttccctcaacatcttgaaaaatgccatacaggccattagggggaaaccagaatgtcattgatcaagatcctgagggcaaatatgaagcactggagaagtatggcaaagatttgactgccatggccagagcaggaaagcttgatcctgttataggaagagatgatgaaatacgcagatgtatccagattctctcccggagaacaaagaacaatcccgtgcttattggtgagccaggtgtcgggaaaacagctatttcagaagggcttgcccagagaatagtacaaggggatgtgcctcaggctttaatgaaccggaggttgatatccctcgacatgggtgcacttattgctggggcaaagtatcgtggagaatttgaagaccggctaaaggctgtgctgagggaagtaacagaatcggatggacaaactatccttttcattgatgagatccacacggttgttggggcaggtgctactaatggtgcgatggatgctggcaatctcttgaagcccatgcttggtcgtggagaattgagatgcattggtgcaacaacattggatgaatatcgtaaatatattgagaaggatccagcattggaacgccgttccagcaagtttatgttgatcaaccaacagtggaaggtacaatttctatccttcgtggactgcgaggaagatatgagctgcatcatggagtccgcatttctgatggtgcacttgttgaagcagcaattctctcagatcgttatataagtggggttttttaccagacaaagctattgacctggttgatgaagcagctgctaaactgaaaatggaaatcacttcaaaacctacagcccttgatgagataaaccgttcagtgttgaagctggagatggagaggctatctcttacaaatgacaccgacaaagcttcaaaagataggttgagccgtcttgaagcagagttggctctcttaaaagaaaagcaagcacagctcaatgagcagtgggagcatgaaaagactgtcatgacccgcctacagtcgattaaagaagagatcgacagggtaaatcttgagatccaacaggctgaacgggaatacgatcttaatcgtgctgctgaactcaagtatgggagtttgaactctttgcagcgtcaacttgaaactgcagaaaaagaattggacgagtacattaagtcagggaaatccatgctgagggaagaagtcaccggggacgacattgctgaaattgtgagtaaatggacaggaattcctatttccaagctacaacaatcagagagggagaagttattacatttggaagaagaactacataaacgtgttgtgggtcaagatcctgcggtgacggccgttgctgaggccatccaacgatctcgagcaggtctctcggatcctcaccgtccaattgccagttttatgttcatgggtcccacgggtgttgggaagacggagctagcaaaggcattggcttcctatatgtttaacactgaagaagcccttgtgcgaattgatatgagcgagtacatggaaaaacatgcagtttcaaggttgattggagccccacctggttacgtagggtatgaggaaggtgggcaattgacagagactgttcgtaggaggccttatgcggttatcttgtttgatgagataagaaaaggcccattccgatgtgtttaatgtgtttctccaaattttggacgatggaagagtgactgactcgcaaggtcgcactgttagtttcacaaacactgtcatcatcatgacatctaatgtgggggtctcaatacatactgaatatggatgatgacaccataccgaaggagatggcctatgagactatcaagcatagggtaatggaagctgcaagatcggtttttcgccctgagttcatgaaccgtgtggacgagtacatagtgttccagcctctcagccgtgagcaaattaaccgtatcgttaggttacagttggaacgagtgcagaagaggatagcagatcgaaaaatgaagatcatagtaaccgatggtgctgttcaactccttggaagtcttgggtacgaccccaactatggtgctagaccagtgaagcgggtgatacagcagaatgttgaaaatgaactggcaaaaggcatcttgcgaggagagttcaaggatgaggacaccgtgctaatagacacagaagtaacggcattctccaatggccagcttccacagcaaaagttggtcttcaagaggttagaacctggttcagatgctcctgctgaagaaaaccaagaagctttttcacagactttgtgattgccgtttgtaaatattacgttgatataggttttactgagccctgagctaaggcaactagttttgtattgaattttgtttgtaatt

SEQ ID NO: 10418 - DNA, 3209 bp, Sesamum indicum
aatttagcttcatatacggtgttagtttccctggaacctcccagaatacgctattgtcctccttttattctagtgtagtgtagtatctcgccaatcccattgcggctatccccaaaatctccatctcagtctgcgtccgaggatcccgaaaacctgctgtagtgtagtgagttctgtttgttgatggccttggcgtcgtcgttcgccgcggttcaggttaatgtgccgccggcggattgcgcggttgggaccgcgttgttctctcgcccgccggtgtgtgtccacttctccaacaaaacaggaggtttaaaaccccttagtttggtgaaattgaggcgtagggatgtgggttttgcaaggagatcggataaatttactaggagttcgcgctcattccgtatacgttgcgaagcctctgccggtggaagaattacgcagacggaatttactgaaatggcatggcaagcgatcgttgcttcgccggaagtggcgaaggacaagcagcatcagatagtggagactgagcatttgatgaaggctcttttggagcagaagaatgggcttgctcgacgaatattttccaaggcaggcgtggataatactcgacttcttgaagctacggataagtacattcaacgccagccgaaggttatgggtgactcagctggatcaatgttaggacgagatctggaagggctaatacaacgagccagggagtacaagaaagagtttggtgattcatatatctcagtggagcatttagttcttggttttatgcaagataaccgatttgggaagcaattatttaaggattttcaactttcccccaaaatgctgaaagatgccgttcaggcaataaggggacaccaaacagttattgaccaagatcctgaaggaaaatatgaagcactagaaaagtatggaaaggatttaacagccatggcaagagcaggaaagctagaccctgttataggaagagacgatgagatacgcagatgcatacagattctttcaaggagaaccaagaataaccctgttctaattggtgagccaggtgttgggaaaactgcaatttctgaagggcttgcccagagaattgtgcaaggagatgttcctcaggctttgatgaatcgcaggttgatatctcttgacatgggggctcttattgctggtgcaaaataccgtggagaatttgaagatagactgaaggctgtgcttaaggaagtcactgattcggatggccagataatcctttttattgatgaaattcatacagtagttggtgcaggtgcgacgaatggtgcaatggatgctggaaacctcttaaagcccatgcttggtcgtggtgagctccggtgcattggtgcaactaccttagatgagtaccgtaaatacattgagaaagatccagcactagagcgcaggttccagcaagtttacgtcgaccaacctacagtagaagacacggtctctattcttcgcggactgcgtgaaagatatgagctgcaccatggagtccgcatttcagacagtgcccttgttgaagctgcaattctatcagatcgttacatcagtgggcgtttccttcctgacaaagctattgatttggttgatgaagcagctgccaaactgaaaatggagataacttcaaagccaacagctcttgacgaaattaaccgtgcagttctgaaacttgagatggaaaggctctctctgacaaatgacactgacaaagcatcaaaagataggttgaatcgccttgaggctgaactttctctcttgaagcagagacaagctgagctgactgagcagtgggaacatgaaaaaactgtcatgacacgcatacaatctattaaggaagagattgacagagtaaatgtggagatccagcaggctgagcgagaatatgatctcaatcgtgcggctgagttgaagtatgggagcctgaattctttacagcgtcagctcgaaactgcagaaaaggaactagatgagtatatgaggtccggaaagtccatgcttagagaggaagttaccgggaatgacattgccgagatagttagcaaatggactggaattcctgtttccaaactacaacaatcagagagagagaagctgttgcatttggagcaagaactacataagcgtgttgttggccaagatcctgcagtaacagcagtggcggaggctatacaaagatcaagggctggcctttctgatcctcaccgtccaattgccagttttatgttcatgggtcctacaggagttggaaagacggagctagctaaggcactcgcttcttatttatttaacactgaagaagctcttgttagaattgatatgagtgagtacatggagaagcatgcagtttcacgattgataggagcacctcctggctatgttggatatgaagagggaggacaattaacggagactgtccgtaggaggccctatgcagttattttatttgatgagatagagaaggctcattcagacgtattcaatgttttccttcaaatcctggatgatggcagagtaactgactcacaggggcgcaccgtgagcttcaccaatactgtaattattatgacgtcaaatgttggttcgcaatacatactaaacacagaggatgatgaggcatctaaggagatggcttatgaaactataaagcgaaaggtaatggaggctgcaagatcaattttccgacctgagttcatgaatcgtgttgatgagtacatagtattccaaccccttgatcgtgatcagatcagcagtatcgttaggttacagttggaacgggtgcaaaagaggatagcagaccgaaagatgaagattcaggtaagcgatgctgcagttcaactcctaggtagtctcggctatgatccaaactatggagcgaggccagtgaagcgggtgatccaacaatatgtcgaaaacgagcttgccaagggaattttgagaggtgacttcaaggatgaggacagtgttctaatagacactgaagtcacagcttttgccaatggtcagctaccccagcagaaacttgtcttcagaaagatggggtcaggctcggatatatcgtctgaaacccgagaaccatttccacagacaacttgagaacacctgcgcttctagtgtaaagattatgcgatatttcttgtctgctctattccaactggtttaggcaagatagggaatatataacaccc

SEQ ID NO: 10419 - DNA, 3125 bp, Panax ginseng
tctccccatagctaaaaccgccggaaaatctcatctacggtgtttatcccgatcaattttgtgctggtccgagctccggcaatggcttctacgacgtctttctctgccgcccaccttcgtcttcaacctccttctacctgttctgatagggccgctttgttttctcactcactgctctctgttgtgaacctatcttcttcaaagtctaatacagttctcaaatcctcaaattattcagtttcctcaaaaagattgaatagaaacaataatgcgatgcggaagaattccaggtcctttgttgttcactgcgaagctggaaggattactcaagcagagtttacggaaatggcttggcaagccattgtttcttctccagaagtggcgaaagagaacaagcatcagatagtggagacagaacatttgatgaaggctctgttggagcagaagaatgggcttgctcgtcgtatcttttccaaggctggtgtagataatacccgtctccttgaagctactgataagttcatcaatctccagccaaaggttcttggtgagtctggtggttcgatgttagggagagacttggaagccctaatacaacaagccagggattacaagaaggagtacaatgattcattcgtgtcagttgagcatttggtacttggttttgcgcaagataaacgatttggaaaacaattgtttaaggattttcagatttcactaaaaaccttaaagaatgctgttgaagctataaggggaagccaaacagtaattgacaaagatcctgagggaaagtatgaagccctagagaaatatggcaaagatttgactgccatggctagagaaggaaagcttgaccctgtgataggaagggatgatgaaatacgtagatgcatccagattctttccaggagaacaaagaacaatcctgtgctaattggtgagccaggtgttgggaaaactgcaatctctgaagggcttgcacagagaattgtgcaaggagatgtccctcaagctttgatgaaccgaaagttgatatccctggacatgggtgcactcattgctggggccaagtaccgcggagagtttgaagatagattaaaggctgtgctcaaggaggtaacagagtcagatgggcagattgtccttttcattgatgagatccataccgttgtgggggcaggtgcaaccaatggggcaatggatgctggcaatctcttgaagcccatgcttggacgtggagagttgcgatgtattggggcgaccaccttggatgaatatcgtaaatacatagaaaaagatcctgccctggagcgtcgtttccaacaagtttatgttgaccaacccacggttgaagataccatctctatattgcgtggacttcgtgaaagatatgagctacatcacggggttcgcatttctgacggtgcacttgtggaagctgcaattctctcagatcgttacatcagcgggcgcttcttacccgacaaagctattgacctagttgatgaagcagctgcaaaacttaagatggaaatcacctcaaaaccaacagcgcttgatgaaatcaaccgctcagtattgaaactagagatggagaggctatctcttacaaatgatacagataaagcttctaaagatagactaaatcgacttgaggcagagttagatctcttaaagaagagacaagccgaactgaatgagcagtgggagcatgaaaaatctgtcatgacacgcttacaatcgattaaagaagagattgacagggtaaatcttgagatccagcaggctgagagggagtacgatctcaatcgtgcagccgagttgaaatatgggagcttaaactctttgcagcgtcaactcgaaactgcagaaaaggaattggatgagtatatgaggtctgggaagtccatgcttagagaagaagtaactgggagtgatatcgctgagattgtgagtaaatggactggtattcctgtttccaagctacaacaatcggagagggagaagctgttacatttggaagaagagctacataaacgtgttgttggtcaagatcctgcagtgaaatctgtggctgaggctatccaacgatctcgagcaggtctgtcagatcctcaccgtccaatagctagcttcatgttcatgggtcctacaggagttgggaaaacagaactagccaaggcccttgcaaattatatgttcaacacggaggatgcccttgtaaggatagatatgagtgagtacatggaaaagcatgcagtttcaaggttaataggagctccacctggttatgttgggtatgacgaaggaggtcagttgacagaaactgtccgcaggaggccatatgcagttattttgtttgatgagattgagaaagcccattctgacgtgttcaatgtgttccttcaaatactggatgatggtagagtgactgactcacagggtcgcactgtgagtttcaccaacactgtcatcattatgacttcaaatgtgggttcacaatacatacttaatacagacgatgatgcctcctcaaaggagacaacttatgaaactataaagcaaagggtaatggatgctgcaaggtcagttttccggcccgagttcatgaatcgggttgatgagtacattgtattccagcctcttgatcgtgaccagatcaacgctatcgtcaggatacagctggaacgagtacaaaagagaatagcagatcggaagataaaactccaagtgaccgacgctgctgtcgaactcctgggaagtcttggatatgacccgagctatggtgcgaggccagtgaagcgcgtgatccagcagaatgtggaaaatgagcttgccaagggcattttgagaggagagtttaaggacgaggacaccgtgttgatagacacggaggtgacagtattatccaatggccaacgtccccagcaaaggctagtttttagaaaattagattctggttcagatgttgccgcagaaaaaacacaaactttctcgcggactgtctgatgttacttgtactttatgtatattcttacggcaaaaaggggttccccattgtgattgttgacttttaagcacctaactttaaaaatatatatcatgatatagtagcctattatgtt

SEQ ID NO: 10420 - DNA, 3140 bp, Chrysanthemum coronarium
acactactcgtctcccaattaaaataaacaaacttgctacatatccacttcactattttctttccgtgactaatggcgactccggcgtctttttccggcgtactagctccgttatccgacataacaacaacattgtttgctcaaccttctgtttcggttcattcgttttcttataaacctacttcttcttctagttctcttaggttgttaaaattaaagaccagaaatactagtatttattctggtggtgctatattgcgtactcatactagtcataggtttggtggaaagaaaccgtttgttgttcgtgctgctgctggtgatgcttcttctaatggaaggatttctcaacaagaattcacagaaatggcatggcaagcaatcgtgtcttcgcctgaagtagcaaaggaaaacaagcatcagattgtggagactgagcatctgttgaaagccttgctggaacaaaagaatgggttggcccgacgaatattctccaaggctggtgtggataatactcggcttttagaagctactgataagttcattcagcgtcaaccaaaggttattggtgaatcagctggctcgatgttaggacgggatctggaaggcctgatgaatagagccagggattacaagaaagagtacggagactcgtttgtgtctgttgagcatttggtgcttggttatgtgcaagataatcgatttgggaagcagttgtttaaggatttccaaatttcattgaaaaccttaaagaatgcaattgaatccatcagaggacggcaaacagttatagaccaagaccccgagggaaagtatgaatcactagagaagtatggtaaagatttgactgctatggcgagggaaggaaagcttgaccctgtcattggaagagatgatgaaatacgcagatgtatccagattctctccaggagaactaagaacaaccctgtgctcattggtgaaccaggtgttggaaagactgcaatttctgaagggcttgctcaaagaatagtgcaaggcgatgtgcctcaagctctgatgaaccgaaagttaatatcgctcgacatgggtgcacttattgctggagcaaaatatcgtggagaatttgaagatcgactcaaagcagtgctgaaggaggttacagaatcagatgggcagattattcttttcattgatgaaatccataccgttgttggggcaggggctaccaatggtgcaatggatgctggcaatctcctgaagccaatgcttggtcgtggggagttacgatgcattggtgcaacaacgttggatgagtaccgtaaatatatcgagaaggatccagcactggagcgccgctttcaacaagtttatgtcgatcagcctacagtagaagatacagtttccatacttcgtggactgcgtgaaaggtatgaactgcatcacggagtgcgcatttcagatagtgcacttgttgaagctgcaattctttcagaccggtacatcagtgggcgctttttaccagacaaagccattgatctggtagatgaagcagctgctaaactgaaaatggagatcacatcaaaacctactgcacttgatgagatcaatcgctcagtactgaaactggagatggagaggctatcactcactagtgatacggacaaagcttcaaaggataggttgagtcggctcgaagcggagttggctctcttgaaagaaaagcaagcccagttaaatgaacaatgggaacatgaaaagagtgtcatgacaaatatgcaatctattaaggaagaaattgatcgggttaatttggagatactgcaagcagagcgagagtatgatctcaaccgtgcagctgagctcaagtatggaagtctgaactctttgctacgtcaacttgaaactgccgaaaaagaattggtcgagtatatgagttcagggaagtccatgcttcgagaagaagttactggtgatgacattgctgagatcgtcagcaaatggactggcattccactttccaagctgaaacaatccgaaagagagaaactcttacatttggaggaagagctacacaaacgagttgtgggtcaaaatcctgcggtgacagctgtggctgaggctatccaacggtccagagctggcctatcggatcctcaccgtccaatagctagtttcatgttcatgggaccaactggagttggaaagactgaactagcaaaagcacttgcttcttacttgttcaataccgaggaggcccttgtacggattgacatgagtgaatacatggaaaagcatgctgtttctagattaataggcgctccacctggatatgtagggtatgaggaaggagggcagttgactgaaacagtgcgcaggagaccctatgctgtcatcctgtttgatgaaattgagaaggctcacgctgacgtgttcaacgtgttcctccagattttggatgatggcagagtgacagactcacagggtcgtacagtcagcttcacaaacaccgtcatcatcatgacctcaaatgtaggttcacagtacatacttgatactgaagactcctccatgccaaaagaacgagcttatgagaccattaaacagagagtaatggatgcagcacggtcaatctttcgtccggagttcatgaatcgtgttgatgagtacatagttttccagccacttgaccgctcgcaaatcaacagaatagttcgattacagttggaacgagtacaaaagaggatagcagatcggaagctaaagattatggttagcgaagctgcggttgagcttctaggaagtcttgggtatgatccaaactacggtgctagaccggtgaagagggtgatccaacagcatgtggaaaacgagcttgcgaagggtatcttgagaggagacttcaaagatgaggataccatatcagttgacaccgaagtcactgctttttccaatggccaactcccccaacaaaagctagtattcaagagagtggactcacctggaggagcacctgagggtcaacaagccctctcacaaactttctagactataaacctacatgtagattatatattatacacacttgtagttgatatttcaaatctgtaccatttgcaacagctagtattgcataatacaaatgcttgtgctatggtgag

SEQ ID NO: 10421 - DNA, 3005 bp, Daucus carota
cacgctaactccctcccccttatcacactctcgactcatttctcatactcacacagcatcgttatcaatggctactacgccgtcgtttcccactctccgtctccaacccctctctaacaaaacgactacactctctcctctctattctcgcccatctctctctcttagttccacttctacccctcacaaattagccctaaaaacccgcccaaacaatgccttgttcgccgcaccttctagaaccttccggaacaactcctcgttcgttgtccgttgcgaagcttccggtggaagaattacgcaagaggagttcactgaaatggcgtggcaagctatcgtctcgtcgcccgaggttgcgaaggagaataagcatcagattgtggagactgagcatcttttgaaggctttgttggagcagaagaatggacttgctcgcaggatcttctcaaaagccggtgtcgataatactcgccttcttgaagctactgataagttcatcaatctccagcctaaggttcttggggagtctgctggctcgatgttggggcgggatttggagtccttgatacagagggccagagattacaagaaagagtacaatgattcatttgtatcagttgagcatttggtgcttggatatgtggaagatagacgatttggaaagcaattgtgtaaagattttcagatttcacttaaagccctaaagaatgctatagaagctattaggggacgccaaacggtgattgacaaagatcccgagggcaagtacgaagcattagagaaatatggaaaagacttgactgccatggcaagggcaggaaagcttgatccagtgattggaagggatgatgagatacggagatgcatacagattctttctaggagaacaaagaataatccagtcctaattggtgagcctggtgttggaaaaactgcaatttctgaggggcttgctcagagaattgttgaaggagacgtccctcaagctttgatgaacaggaagttgatatcactggacatgggtgcacttattgctggagctaaatatcgtggagaatttgaagacagattaaaggctgtgctcaaggaagttactgaatcagatggacagactattctatttattgatgagatccatacagtcgttggggcaggtgcaaccaatggggcaatggatgctggcaatctcttaaagcccatgcttggacgtggagaattgcgatgtattggggcaactaccttggatgaatatcgtaaatacatcgaaaaagatccagccttggagcgccgttttcaacaagtctatgtcgatcaacccacagtggaagatacaatctctatattgcgggggcttcgggaaagatatgaactacaccatggggttcgcatatctgatggggcattggtggaggctgcgattctctcagatcgttatattagtggccgtttcttacccgacaaagctattgatctagttgatgaagcagcagcaaaactgaaaatggaaatcacgtctaaaccaacagcactcgatgagatcaaccgttcagttctaaaattggagatggagaggttatctcttaccaatgacacagataaagcttcaaaggacagacttgatcgccttgaggcagagttggatcttttgaagaagaaacaaactgaattaaatgagcaatgggaacatgagaaaactgtcatgacacgattgcagtcaattaaagaagagattgacagagtaaatcttgagatccagcaggcagagagggagtatgatcttaatcgtgcagctgagttgaagtatggaagcttgaactctttgcagcgtcaactggaaactgcagagaaagaactagatgaatatatgaggtcagggaagtccatgctaagagaagaagttagtgggagtgatattgccgagattgttagtaaatggactggtattcctgtttcaaagctacaacaatcggagagagagaagttgttacatttggaagaagagctgcacaaacgcgtggttggccaaaatcctgctgttacatctgtagctgaggctatccagcgatctcgagcaggtctatcagatcctcaccgccctatagcaagcttcatgttcatgggtcctacaggagttggaaaaacagaactagcaaaggcccttgcatcctatatgttcaacactgaggatgctcttgtgaggatagacatgagtgagtatatggaaaagcatacagtttcaagattaataggcgctccacctggttatgttggatatgacgaaggaggacagctgacggagacggtccgcaggaggccatatgcagttatattgtttgatgagattgagaaggctcattctgatgtgttcaatgtgtttcttcaaatactggatgatggtagggtgactgattctcagggtcgcactgtgagtttcaccaacactgtcataattatgacttcgaatgtgggttcacaatacatacttggcatggatggtgaagagacaagttacgagactataaagcggagggtattggatgctgcaaggtcagtgtttaagccggagtttatgaaccgagttgatgagtacattgtatttcagcctcttgatcgtgaccagattaacagtattgtcaggatacagcttgaacgagtacaaaagaggatagcagaccggaagatgaagcttaaggtcactgatgctgcagtagaactcctaggaagtcttgggtatgacccaagttatggtgcgagaccggtgaagcgtgtgatccagcaaaatgttgaaaatgagctagctaaaggtatattgagaggagagtttaaagacgacgacactgtattggtagacaccgaggttacagcatttttggatggccagcttccacagcaaaaactagtgtttagaaaactagatccgggcacagatgttgaagcaaataacaaaaaagtagtttcacagactttttaacatacatgttacatatatacagaagttgtaaaat

SEQ ID NO: 10422 - DNA, 3093 bp, Centaurea maculosa
gaaacagaaacagaaccctatctttcccatattctcacgcatcacttttcctctttactcttcttcttcctctcttcccaataacttgttgctttacacgattcacactcatcatctctcatggcgactatgccctcctccttctccggcgtccttccgtcctccacctgcatcgataggaccgcattgtttgctcagccttctctctctttcaattcaatttctaaacctagaagaacggccgtacgctccttgaaattgaagaccagaagtaatgatgttttattgctcaaaaggacggctgataggtttggcggaaagagttctcgatcttttgttgttcgttgtgatgcttcttccagtggaaggatcactcaacaagaattcacagagatggcatggcaagctatagtgtcttcacctgaagtggctaaggagaacaagcatcagattgtggagactgagcatctgatgaaagcgctgctagaacagaaaaatgggctagcacggagaatattctccaaggctggggtggataatacccgccttcttgaagccactgataagtacattcagcgccaaccaaaggttattggtgagtcagctggctccatgttagggcgggatttggaagccctgatgcagagagctagagactacaagaaagagtatggtgactcatttgtctctgttgagcatttggtgcttggttatgtgcaagataaccgattcgggaaacaactgtttaaggatttccaaatttcattgaaaaccttaaaaagtgcaatagaatccatcagaggtcggcaaacagtaatagaccaagatcctgaggggaagtacgaatcgttagagaagtatggtaaagatttgactgccatggcaagggaagggaagcttgaccctgtcataggaagagatgatgaaataagaagatgcattcagatcctctccaggagaaccaagaacaaccctgtgctcattggtgaaccaggtgttggaaagactgcaatttctgaagggcttgctcagagaatagtgcaaggtgatgtgcctcaagctctaatgaaccgaaagttgatatcccttgacatgggtgcacttattgctggagcaaaatatcgtggagaatttgaagatcgactaaaggcagtgcttaaggaggtaacagattcagatgggcagattgttcttttcattgatgagatccatactgttgttggggcaggggctaccaatggtgcaatggatgctggcaatctcttaaagccaatgcttggtcgtggagagttgcgatgcattggtgcaacaacactggacgagtatcgtaaatatatcgaaaaggatcctgcattggagcgccgttttcaacaagtttatgttgaccagcctacagtagaagatactgtttctatacttcgtggactgcgcgagaggtacgaactgcatcatggagtacgcatctcagatagtgcacttgttgaagctgcaattctctctgaccggtacatcagtggacgctttctgccagataaagccattgacctggtagatgaagcggcggctaaactaaaaatggagatcacttcaaaacctaccgcattggatgagatcaatcgctcagtactgaaactggaaatggagaggctgtcactcactagtgatacagataaagcttcaaaggataggttgagtcgccttgaggcggagttggctcttttgaaggagaggcaagctgagttaaatgaacaatgggaacatgaaaagagcgtcatgacaaatttgcaatctattaaagaagaaattgacagggttaatctggagatacaacaggcggagcgagagtatgatctcaaccgtgcagctgagctgaagtatgggagtctgaacgctttgcaacgtcaactcgatactgctgaaaaagatttggtcgagtatatgagcactgggaagtccatgctcagggaagaagttactggtgatgacattgctgagatcgtaagcaagtggactggcatcccactttctaaactaaaacaatccgagagggagaaactgttgcatttggaggaagaactacataaacgagtcgtgggtcagaatcctgcggtgacagctgtggccgaggccatccaacggtccagagctggcctatcggatcctcaccgtccaatagctagtttcatgttcatgggacctaccggagtgggaaaaacagagctagcaaaagcacttgcatcctacttgtttaacaccgaggaggccctcgtacggattgacatgagtgaatacatggaaaagcacgcggtttctagattgataggcgctcctcctggatacgtagggtatgaggaaggagggcagttgacagagacagtacgcagaaggccctatgctgttatcctgtttgatgagatcgaaaaggctcatgccgatgtgttcaacgtgttccttcagatcttggatgatggcagggtgaccgactcacaaggtcgaaccatcagcttcaccaacaccgtcatcatcatgacctcaaacgttggttcacagtacatactagacactgaagacgactccatgccaaaagggagagcttatgagaccatcaaacagagggtgatggatgcagcaaggtcggtctttcgacctgagttcatgaaccgtgttgacgagtacatagtcttccagcctctagaccgctcacaaatcaacaggatagtctggttacagttggatcgggtacagaagaggatagcagatcggaagctaaagattgtggtaagcgaagctgcggttgagcttttagggagtcttgggtatgacccgaactatggtgctagaccggtgaagcgggtgatccaacaatacgttgaaaatgagcttgcaaagggtatcttgagaggagagtttaaggatgaggacaccatatcgatagacacagaagtcacagcattctccaatggtcaacttccccaacaaaagctagccttcaagagactcgactcatcatctggtgacgcgcccgaaggtcaagaagccctctcacaaagttacagagcttaacaacccaccatatgtagatgatacataaaa

SEQ ID NO: 10423 - DNA, 3153 bp, Panax ginseng
aagcattaattcttaattttcttctaacctttaccggtagtactgactccgacaatggcatcaatgtcgtcgttctccggcgtccaccttggtcttcgtccacctccttccacctattgtgatagttgtagaattactcagtcactgctttctgtgaacctatcttccaaatctgcagctcacaaaaacctaaatttcttttccttaaaattgaacagaaacaatgcgtttttaactacaagagctggcaagctcggtaaaaattccaggtccttcgtcgttcgatgccaagcttcaagtggaaagattggtcaagaagagtttacagaaatggcttggcaagccattgtttcttcaccagaagtggcaaaagagaacaagcatcagatagtggagacagaacatttgatgaaggctctgttggagcagaagaatgggcttgctcgtcgtatcttttcaaaggctggtgtagataatactcgtcttcttgaagctgcggataagttcatcaaacgccagccaaaggttcttggtgagtctgctggttcaatgttaggacgagacctagaagccctaatgcagcgagccagggattacaaaaaagaatacaatgattcatttgtgtcagttgagcatttggtacttggttttatgcaagataaacgatttggaaaacaattgtacaaggattttcagatttcactgaaaaccttaacgaatgctgtgcaagcaataaggggacgccaaacagtaattgaccaagatcccgaggggaagtatgaagcactagagaaatacggcaaagatttgactgccatggcaagagcaggaaagcttgaccctgtgataggaagggatgatgaaatacgcagatgcatccagattctttccaggagaacaaagaataatcctgtgctaattggtgagccaggtgtcggtaaaactgcaatttctgaagggcttgcccaaagaattgttcaaggagatgtccctcaagctttaatgaaccgaaagttgatatccctagacatgggtgcactcattgctggggcaaagtaccgtggagagtttgaagatagattaaaggccgtgctcaaggaagtaactgaatcagatgggcagactattcttttcattgacgagatccatacagttgtgggggcaggtgcaaccagtggggcaatggatgctggcaatctcttgaagcctatgcttggacgtggagagttgcgatgtattggggcgaccaccttggatgaatatcgtaaatacattgagaaagatccagctctggagcgtcgtcttcaacaagtttatgttgatcaacccactgtagaagatacaatctctatattgcgtggacttcgcgagagatatgaactacaccatggggttcgcatttctgacagcgcacttgtggaagctgcaattctctcagatcgttacatcagtggacgctttttacctgacaaagctattgacctagttgatgaagcggctgcgaaactgaagatggaaatcacctcaaaaccaactgcacttgatgaaatcaaccgtgcagtactgaaactagagatggagaggctatctcttacaaatgatacggataaagcttctagagatagactaactcgccttgaggcagagttggatctcttaaaggagagacaagctgaactgaatgagcagtgggagcatgaaaaaactgttatgacacgcttacaatcaatcaaagaagagattgacagggtaaatcttgagatccagcaggctgagagggagtacgatctcaatcgtgcagccgagttgaaatatgggagcttgaacactttgcagcgtcaactcgaaactgcagaaaaggaattggatgagtatatgaggtctgggaagtccatgcttagagaagaagtaactgggagtgatatcgctgagattgtgagtaaatggactggtattcctgtttccaagctacaacaatcggagagggagaagctgttacatttggaagaagagctacataaacgtgttgttggtcaagatcctgcagtgaaatctgtggctgaggctatccaacgatctcgagcaggtctctcagatcctcaccgtccaatagctagcttcatgttcatgggtcctacaggagttgggaaaacagaactagccaaggcccttgcaaattatatgttcaacacggaggaggcccttgtaaggatagatatgagtgagtacatggaaaagcatgcagtttcaaggttaataggagctccacctggttatgttgggtatgacgaaggaggtcagttgacagaaactgtccgcaggaggccatatgcagttattttgtttgatgagattgagaaagcccattctgacgtgttcaatgtgttccttcaaatactggatgatggtagagtgactgactcacagggtcgcactgtgagtttcaccaacactgtcatcattatgacttcaaatgtgggttcacaatacatacttaatacagacgatgatgcctcctcaaaggagacaacttatgaaactataaagcaaagggtaatggatgctgcaaggtcagttttccggcccgagttcatgaatcgggttgatgagtacattgtattccagcctcttgatcgtgaccagatcaacgctatcgtcaggatacagctggaacgagtacaaaagagaatagcagatcggaagataaaactccaagtgaccgacgctgctgtcgaactcctgggaagtcttggatatgacccgagctatggtgcgaggccagtgaagcgcgtgatccagcagaatgtggaaaatgagcttgccaagggcattttgagaggagagtttaaggacgaggacaccgtgttgatagacacggaggtgacagtattatccaatggccaacgtccccagcaaaggctagtttttagaaaattagattctggttcagatgttgccgcagaaaaaacacaaactttctcgcggactgtctgatgttacttgtacttttatgtatattcttacggcaaaaagggtttccccattgtgatttgtgatcgtcgacttttaaaatatttaattaatcggatgtcaaatttgagcttctattttcaaatgtggattaaaaaagccacaaaaatatatatcatgaac

SEQ ID NO: 10424 - DNA, 2949 bp, Cichorium intybus
tgatgttttgttgctcactcgaacgggtgataggtttggaggcaagagttctcggtcttttgttgtgcgctgtgatgcttcttccaatggaaggattacacaacaagaattcacagaaatggcatggcaagcaatagtgtcttcacctgaagttgcaaagaagaacaaacatcagattgtggagactgaacatttgatgaaagccctgttggaacagaagaatgggctagccagacgaatcttctccaaggctggtgtggataacacccgcctgcttgaagccactgataagtacattcaacgccaaccaaaggttattggtgaatcagctggctcgatgttagggcgggatttagaagccctaatgcagagagctagagattacaagaaagaatatggtgactcttttgtgtctgttgagcatttagtgcttggttttgtgcaagataaccgatttggaaaacaattgttcaaagatttccaaatttcattaaaaaccttaaagaacgcaatagaatccatcagaggtcgacaaacagtcatagaccaagatcctgaagggaaatatgaatctttagagaagtacggtaaagatctgaccgctatggctagggcaggaaaacttgaccccgtaataggaagagatgatgaaatacgcagatgcatacaaattctatcaagaagaaccaagaacaaccctgttctcattggtgaaccaggtgttggtaagactgctatttctgaaggacttgctcagagaatagtgcaaggtgatgtacctcaagctctaatgaaccgaaagttaatatcccttgacatgggtgcacttattgctggagcaaaataccgcggagaatttgaagatcgactcaaggcagtgctgaaagaggtgacagaatcagacggacaaatcatccttttcatcgatgagattcatactgttgttggggcaggggctacaaatggtgcaatggatgcaggcaatctgttgaaaccaatgctgggtcgtggagagttgcgatgcattggtgcaacaacattggacgagtaccgtaaatatatcgaaaaagatcccgctttagaacgccgctttcaacaagtctatgttgaccaaccgactgtagaagatacggtttctatcctccgtggactgcgcgaaagatacgagctccatcacggtgtacgcatttcagatagcgcgcttgttgaagccgcaattctctcggatcgctacatcagtggtcgctttttaccagataaagcgattgatctggtggatgaagcagctgcgaaactgaagatggagatcacttcaaagccaactgcacttgatgagattaatcgttcggttttgaaattggaaatggagaggctatcgctcactagtgacacagataaagcctcgaaagatcggttgagtcgactcgaggctgagttggctctgttgaaagagagacaagctgagttgaatcaacaatgggagcatgaaaaaggtgtcatgacaaatatgcagtctattaaagaggagattgacagggtgaatttagagatacaacaagcggaacgcgagtacgatttgaaccgggctgctgagttaaaatacgggagtttgaactctttgttacgtcaacttgaaactgctgaaaaggaattagtggaatacatgagttccgggaaatcgatgcttagggaagaagttacaggtgatgacatagctgaaattgtaagcaaatggaccgggattccactttccaaactcaaacaatccgagcgggaaaaactcctacacttggaggaagagttgcacaaacgggtcgtgggccaggatccggctgtgacagctgttgccgaggccatccaacggtcgagagccggtttatcagatcctcaccgtccaatagcgagcttcatgttcatgggacccactggggtcggaaaaaccgagctagcaaaagcgcttgcttcgtaccttttcaacactgaagaagcgcttgtacggattgacatgagtgagtacatggaaaaacacgcggtttcacggttaatcggcgcgccaccaggatatgttgggtatgaggaaggcggacagttgacggagacagtacggaggcgaccttacgcggtcattctttttgacgaaatcgaaaaagctcatgcagacgtgttcaatgtgtttctccagattttagacgatggaagggtgaccgattcgcaaggtcggaccgttagtttcactaatacagtcatcatcatgacatcaaatgtcgggtcccagtacatactagacacagatgatgactcaatatcaaaagaacgcacttacgagactataaaaaatagagtgatggatgcagccaggtcgatcttccgtcccgagtttatgaaccgggttgacgagtatatagtcttccaaccgcttgaccgttcacaaatcaacagaattgttcggttacagttggaacgggtacaaaagaggatagcggatcgaaaattaaagataaatgtaagtgaagctgcggttgagcttttggggagtcttgggtatgacccgaactggtgctagacccgtgaagcgggtgatccaacaacatgtggaaaatgagcttgccaagggaattttgagaggtgactttaaggatgaagacacgatatcagtggacacggaagttacggcgttttcaaacggtcaactcccgcaacagaagttggtcttcaagagagtggacacgtcaccgggtgatacacctaaggatcaagaagctttctcacaaactttctagaggtttttgattttgcatatgtagatgatgatacataagtttatacggaacatcatggtttaccattagcgacaacatatttttatctagcatgtttaataaatgcttatgctattgggagtctttttgccacttatgcatatcaaaaatcctatttatttgatctcag

SEQ ID NO: 10425 - DNA, 3377 bp, Spinacia oleracea
cttctctctcctctccttcctcatcccacctcagcctccctagaaccttctgtaaaacactgcaaaaaatccaattcatctcacatttcaataaaaagcgcaaatacccacatcacattttcccaatcttcctttgatcaattcctacgaaaatcatcaccttttctcataaatcttcaatttaatccactcttttgagctcaataatccaaccatccttcagtaatggctaccgcaacgacgtcgtttcttggagcctatcttcgtgttccacccaacaatggcgttcggaatgggttgttttctcaaccctttccctctcttcggatcaagtcgaagagaaccaagtcgctaaattcattgaaatttactggggattccagtaaaattttgttgttcaagtgttctaggccatttgagaaaggcttgaaatctgggtcatttgttgtacgatgtgatgctgcaggtggtagcaggattactcaacaagacttcactgaaatggcatggcaagcaattgtttcttgcccagaagtggcaaaagagaacaaacaccagatagtggagacagagcatttactgaaggctcttttagagcaaaagaatggacttgctcgccgcattttctctaaagctggagttgacaatacgcgtttgcttgaagcaactgacaaatttatacaacgtcaaccaaaggttttgggtgaatctgctggttctatgttgggacgagatcttgaagccctaattcaaagaggcagggattttaggaaagagtatggagactcatttgtctctgtggagcatttggttcttgcttttgcacaagacaaaagatttgggaaacagttgttcggtgattttcggctttctgaaaaatcattacgatctgctattcaagctgtaaggggacggcaatcagtcattgaccaagacccagagggtaaatatgaagctctggaaaagtatggaaaagatttgactgctatggcaagggaaggaaaacttgaccctgtaatcggaagagatgatgagattcgtagatgcatccagattttgtcaaggagaaccaaaaataacccagttcttatcggtgaacctggtgtaggaaaaactgcgattgctgaggggcttgctcaaagaattgttgagggggatgttcctcaagctttgatgaaccgtaagctaatttccctggacatgggagctctcattgctggagctaaatatcgtggcgaatttgaggatcggctgaaggctgtactcaaggaggtgacagatgctgatggtcaaactattcttttcattgatgagattcatacagtagttggagcaggtgccacaaatggtgctatggatgctggcaatctgttaaagcctatgcttggtcgtggggagttgcgttgcattggtgctactacccttgatgaatatcgtaaatacatagagaaagatccagcattggagcgacgttttcaacaggtttatgttgaccaaccaagtgttgaagatactatctcaatacttcgtgggctgcgtgagagatatgagttgcatcacggagttaggatttctgatggtgctcttgtagaggccgctatgctttcagatcgctacattagtggacggtttttacctgacaaagctattgacttagttgatgaagccgctgctaaactaaagatggagattacatcgaaacctactgctctggatgagatcaaccgttctgtattgaagtttgagatggaaagactctcacttacaaatgatactgacaaagcatcaaaagagaggcttagccgacttgatacagaactttccctactaaaggaaaagcaagctgaattgactgaacaatgggagcatgaaaaatctgttatgacacgcatacagtcaatcaaagaggagatagacagggtgaatattgagatccagcaggcggagcgagagtatgatcttaatcgtgctgctgaactgaagtatggtagccttaactctctgcaacgacaattagaaagtgcggaaaaagagttggatgagtatatgaaatcagggaagtcaatgctacgtgaagaagtaactgggaacgatattgctgaaatagttagcaagtggactggaattcctgtttcaaagctacaacagtcagagagagagaaattattgaatttggaagaagagctacacaaacgtgttgtgggccaagatcctgcggtgacggctatagctgaggctattcagcgatctagagctgggctttcagatccacatcgtcccattgctagctttatgttcatgggtcccacaggtgtggggaagacagagctggcaaaggcccttgcctcttacctgttcaacactgaagatgcccttgtcagaatagatatgagtgaatatatggaaaaatttgccgtgtcaagactgacaggtgccccgcctggttatgtgggttatgaggaaggaggccaattaacagaggtagttagaaggaggccttatgcagtgatcctatttgacgagatagaaaaagctcatgctgatgttttcaacgtatttcttcaaattttggatgatggaagggtgacagactcacaaggacgaacagtgagcttcaccaatactgtcatcattatgacttcaaatgttggatcacagttgatccttaatgctggtgatgatgatgagacatcatcaaaagaggcaacatacgaaataataaagcagagagtgatggatgcagcaagatcaatcttccgtcctgagttcatgaacagagtagatgaatacatagtgttccagcctcttgatcgtgatcagataaatagtattgttcgattacagctgcaaagagtacagacgaggattgcagatcgtaagatgacaataaaagtgacggacgctgcagttgagcttcttgggagccttggatatgatcccaactacggtgctaggccagttaagcgtgtcatacaacagcatgttgagaatgagattgctaaaggcatactaagaggggatttcaaagaagatgattgcattcttgttgatactgagctcacagcattttcaaatggccaactacctcaacagaagctcatgtttcgcaaacttgaccttcaatctggctcttcctcacaagaacccaaggaagctgtttctcctttctaggttgccaaacacattgcatatagatttctgcccaacgttgtttagatgacggtatataatcatagcagtgtctttttacacttgaaagattttgtacacacttgcacaatattatttctttacttcccacaagtcaatcatattttctcccgtttgatatcaaacttagtcaaactttacatggagatccctgaaatgaaataaaa

SEQ ID NO: 10426 - DNA, 2949 bp, Cichorium intybus
tgatgttttgttgctcactcgaacgggtgataggtttggaggcaagagttctcggtcttttgttgtgcgctgtgatgcttcttccaatggaaggattacacaacaagaattcacagaaatggcatggcaagcaatagtgtcttcacctgaagttgcaaaggagaacaaacatcagattgtggagactgaacatttgatgaaagccctgttggaacagaagaatgggctagccagacgaatcttctccaaggctggtgtggataacacccgcctgcttgaagccactgataagtacattcaacgccaaccaaaggttattggtgaatcagctggctcgatgttagggcgggatttagaagccctaatgcagagagctagagattacaagaaagaatatggtgactcttttgtgtctgttgagcatttagtgcttggttttgtgcaagataaccgatttggaaaacaattgttcaaagatttccaaatttcattaaaaaccttaaagaacgcaatagaatccatcagaggtcgacaaacagtcatagaccaagatcctgaagggaaatatgaatctttagagaagtacggtaaagatctgaccgctatggctagggcaggaaaacttgaccccgtaataggaagagatgatgaaatacgcagatgcatacaaattctatcaagaagaaccaagaacaaccctgttctcattggtgaaccaggtgttggtaagactgctatttctgaaggacttgctcagagaatagtgcaaggtgatgtacctcaagctctaatgaaccgaaagttaatatcccttgacatgggtgcacttattgctggagcaaaataccgcggagaatttgaagatcgactcaaggcagtgctgaaagaggtcacagaatcagacggacagatcattcttttcattgatgagattcatactgttgttggggcaggggctacaaatggtgcaatggatgcaggcaatctgttgaaaccaatgctgggtcgtggagagttgcgatgcattggtgcaacaacattggacgagtaccgtaaatatatcgaaaaagatcccgctttagaacgccgctttcaacaagtctatgttgaccaaccgactgtagaagatacggtttctatcctccgtggactgcgcgaaagatacgaactccatcacggtgtacgcatctcagatagcgcgcttgttgaagccgcaattctctcggatcgctacatcagtggtcgctttttaccagataaagcgattgatctggtggatgaagcagctgcgaaactgaagatggagatcacttcaaagccaacagcacttgatgagattaatcgtgcggttttgaaattggagatggagaggctatcgctcactagtgacacggataaagcctcgaaagatcggttgagtcgactcgaggctgagttggctctgttgaaagagagacaagccgagttgaatgcacaatgggagcatgaaaaaggtgtcatgacaaatatgcagtctattaaagaagagattgacagggtgaatttagagatacaacaagcggaacgcgagtatgatttgaaccgggctgctgagttaaaatacgggagtttaaactctttgttacgtcaacttgaaactgctgaaaaggaattagtggaatacatgagttccgggaaatcgatgcttagggaagaagttacaggtgacgacatagctgaaattgtaagcaaatggaccgggattccgctttctaaactcaaacagtccgagagggaaaaactcctacacttggaggaagagttacacaaacgggtcgtgggccaggatccggccgtgacagctgtcgccgaggcaatccaacggtcgagagccggtttatcagatccgcaccgtccgatagcgagcttcatgttcatgggacccactggggtcggaaaaaccgagctagcaaaagcgcttgcttcgtaccttttcaacactgaagaagcgcttgtacggattgacatgagtgagtacatggaaaaacacgcggtttcacggttaatcggcgcgccaccaggatatgttgggtatgaggaaggcggacagttgacggagacagtacggaggcgaccttacgcggtcattctttttgacgaaatcgaaaaagctcatgcagacgtgttcaatgtgtttctccagattttagacgatggaagggtgaccgattcgcaaggtcggaccgttagtttcactaatacagtcatcatcatgacatcaaatgtcgggtcccagtacatactagacacagatgatgactcgatatcaaaagaacgcacttacgagactataaaaaatagagtgatggatgcagccaggtcgatcttccgtcccgagtttatgaaccgggttgacgagtatatagtcttccaaccgcttgaccgttcacaaatcaacagaattgttcggttacagttggaacgggtacaaaagaggatagcggatcggaaattaaagataaatgtaagtgaagctgcggttgagcttttggggagtcttgggtatgacccgaactatggtgctagacccgtgaagcgggtgatccaacaacatgtggaaaatgagcttgccaagggaattttgagaggtgactttaaggatgaagacacgatatcagtggacacggaagttacggcgttttcaaacggtcaactcccgcaacagaagttggtcttcaagagagtggacacgtcaccgggtgatacacctaaggatcaagaagctttctcacaaactttctagaggtttttgattttgcatatgtagatgatgatacataagtttatacggaacatcatggtttaccattagcgactacatatttttatctagcatgtttaataaatgcttatgctattgggagtctttttgccacttatgcatatcaaaaatcctatttatttgatctc

SEQ ID NO: 10427 - DNA, 3547 bp, Panax ginseng
aagcagtggtatcaacgcagagtacatggggacttctcaccactctcaccatagctaaaaccgccggaaaatctcatctacggtgtttatcccgatcaattttgtgctggtccgagctccggcaatggcttatacgacgtctttctctgccgtccaccttcgtcttcaacctcctcctacctgttctgatagggccgctttgttttctcactcactgctctctgttgtgaacctatcttcttccaagtctaatacagttctcaaatcctcaagttattcagtttcctcaataagattgaatagaaacaataatgcgatgcggaagaattccaggtcctttgttgttcaatgcgaagctggaaggattactcaagaagagtttacggaaatggcttggcaagccattgtttcttctccagaagtggcgaaagagaacaagcatcagatagtggagacagaacatttgatgaaggctctgttggagcagaagaatgggcttgctcgtcgtatcttttccaaggctggtgtagataatacccgtctccttgaagctactgataagttcatcaatctccagccaaaggttcttggtgagtctggtggttcgatgttagggagagacttggaagccctaatacaagcagccagggattacaagaaagagtacaatgattcattcgtgtcagttgagcatttggtacttggttttgcgcaagataaacgattcggaaaacaattgtttaaggattttcagatttcactaaaaaccttaaagaatgctgttgaagctataaggggaagccaaacagtaattgacaaagatcctgagggaaagtatgaagccctagagaaatatggcaaagatttgaccgccatggctagagaaggaaagcttgaccctgtgataggaagggatgatgaaatacgtagatgcatccagattctttccaggagaacaaagaacaatcctgtgctaattggtgagccaggtgttgggaaaactgcaatctctgaagggcttgcacagagaattgtgcaaggagatgtccctcaagctttgatgaaccgaaagttgatatccctggacatgggcgcactcattgctggggccaagtaccgcggagagtttgaagatagattaaaggctgtgctcaaggaggtaacagagtcagatgggcagattatccttttcattgatgagatccatacagttgtgggggcaggtgcaaccaatggggcaatggatgctggcaatctcttgaagcccatgcttggacgcggagagttgcgatgtataggggcgaccaccttggatgaatatcgtaaatacatagaaaaagatccagccctggagcgtcgtttccaacaagtttatgttgaccaacccacggttgaagataccatctctatattgcgtggacttcgtgaaagatatgagctacatcacggggttcgcatttctgacggtgcacttgtggaagctgcaattctctcagatcgttacatcagcgggcgcttcttacccgacaaagctattgacctagttgatgaagcagctgcaaaacttaagatggaaatcacctcaaaaccaacagcgcttgatgaaatcaaccgttcagtattgaaactagagatggagaggctttctcttacaaatgatacggataaagcttctaaagatagactaaatcgacttgaggcagagttagatctcttaaagaagagacaagccgaactgaatgagcagtgggagcatgaaaaatctgtcatgacacgcttacaatcgattaaagaagagattgacagggtaaatgttgagatccagcaggctgagagggagtacgatcttaatcgtgcagccgagttgaaatatgggagcttgaacactttgcagcgtcaactcgaaactgcagaaaaggaattggatgagtatatgaggtctgggaagtccatgcttagagaagaagtaactgggagtgatatcgctgagattgtgagtaaatggactggtattcctgtttccaagctacaacaatctgagagggagaagctgttacatttggaagaagagctacataaacgtgttgttggtcaagatcctgcagtgaaatctgtggctgaggctatccaacgatctcgagcaggtctctcagatcctcaccgtccaatagctagcttcatgttcatgggtcctacaggagttgggaaaacagaactagccaaggcccttgcaaattatatgttcaacacggaggaggcccttgtaaggatagatatgagtgagtacatggaaaagcatgcagtttcaaggttaataggagctccacctggttatgttgggtatgacgaaggagggcagttgacagaaactgtccgcaggaggccatatgcagttattttgtttgatgagattgagaaagcccattctgacgtgttcaatgtgttccttcaaatactggatgatggtagagtgactgactcacagggtcgcactgtgagtttcaccaacactgtcatcattatgacttcaaatgtgggttcacaatacatacttaatacagacgatgatgcctcctcaaaggagacaacttatgaaactataaagcaaagggtaatggatgctgcaaggtcagttttccggcccgagttcatgaatcgggttgatgagtacatagtattccagcctcttgatcgtgaccagatcaacactatcgtcaggatacagctggaacgagtacaaaagagaatagcagatcggaagataaaactccaagtgaccgccgctgctgtcgaactcctgggaagtcttggatatgacccgagctatggtgcgaggccagtgaagcgcgtgatccagcagaatgtggaaaatgagcttgccaagggcattttgagaggagagtttaaggacgaggacaccgtgttgatagacacggaggtgacagtattatccaatggccaacgtccccagcaaaggctagtttttagaaaattagattctggttcagatgttgccgcagaaaaaacacaaactttctcgcggactgtctgatgttacttgtactttatgtatattcttacggcaaaaaggggttccccattgtgatttgtgatcgtcgacttttaaaatatttaattaatcggatgtcaaatttgagcttctatttttcaaaatgtggattaaaaaagccacaaaaaattatatatcatgaacggattatgtttctacaaatatgcaccattttcagagcttaaacaagaagcagtaaattagggtttttttttgtatgggtcaagactcaagaggaaaaaggtggagatggaggcaggtggccccatttaaagtgcaccacgaatattttcctctttaagatttcagatttgaagaagatacgtaaaatcatatagaggaacaataagaagaagataggtttcttcaattctctctcctcatgctcgtacaaagttgctcttcatcttcctgttgttgcttcattttctcctaaatcaggcttttgcttcatcttctccaacaaccaaaaccagc

SEQ ID NO: 10428 - DNA, 3463 bp, Populus trichocarpa
aagaaaccaacacatagttgatgatagtacagtactacttactgtaccacccaacagtttcttcttcttcttcttcttcttgttttttttttttacaaaaatatatatataagaaagttctttcctttcactttaactgcttctatctcctcactttgttttattttctttcgtaactctgccccgccgtatggcaaccacgaccgctacggcggcttcgtttagtttgtgtcctttctattcagattctatcagtaatggtttgttaccccgaaagtctcttataagcttccccgtaaagcggaattctgtgaagtcgctggagttgaacaagagaaatggtgccttttcgacaagggctaaaccctcttcctttgtcgttagatgtgctgcttcttctaatggaagggttacgcagcaagaatttacagacatggcatggcaaggaattgtatcttctctagatgtggcgaaagagaacaagcatcagatagtcgagacggagcatttgatgaaagccctcttggagcaaaagaatggccttgctcgccgcatcttttccaaagttggggttgataatactcgtcttcttgaagccaccgacaagtctatacaacgccaacccaaggttcatagcgaatctactagttcaatgttggggcgtgacttggagaccctgatccagcgagccagggaatacaagaaagagtatggagattcatttgtttctgttgagcatttggttcttggatttgctcaggatcaacggtttgggaagcaattatttaaggatttccaaatatctttacaaactctgaaatctgcaatagaatccattagggggcgccaatcagttatagaccaagatcccgaagggaagtatgaagcactggagaagtatggaaaagatttgacagccatggcaaaagcaggaaagcttgacccagttattggaagggatgaggaaatccgtagatgcatccagattctatccaggagaacgaaaaacaatcctgtgcttattggtgaaccaggtgtggggaaaactgcaatttccgaagggcttgcccagagaattgtggaaggggatgtacctcaagctttgatgaaccggaagctaatatcccttgacatgggttccctcattgctggggcgaaatatcgaggagaatttgaggatagattgaaggctgtacttaaggaagtcacggattcagatggtcagataatccttttcattgatgagattcacacagtggttggtgctggagccacaaatggggcgatggatgcggggaatctcttgaaacccatgcttggcaggggagagttgcgatgtattggtgcaacaacactggacgagcatcgtaagtatattgagaaagatcctgctttggagcgtcgtttccagcaagtttttgttgatcaacctacagtagaggatacaatatctatactccggggactgcgtgaaagatatgagctgcatcatggagtccgtatttctgatagtgcacttgtggaggctgcggttctgtctgaccgttacatcagtggaagatttttacctgacaaagctattgatctagttgatgaagcagctgcaaaactgaaaatggaaattacttcaaagcctactgccctagatgaaatcaaccgttcagtattaaagctggagatggagaggttatctcttatgaatgacacagataaagcttcaaaagataggttgagccgccttgatactgagttatctctgctaaaaaagaaacaagctgagctgacagagcaatgggagcacgagaagtctgtcatgacatgcattcaatcaattaaagaagagattgacagggtaaatcttgagattcagcaggctgagcgagagtatgatctaaatcgtgctgctgaattgaagtataggagcctgagctctctgcaacgccaacttgaaagtgctgaaaaggagttggatgagtatataaagtcaggaaagtccatgctgagagaagaagtaacaggtgatgacattgctgaaattgttagcaagtggactggtattcctatttccaagcttaaacaatctgagagggagaagctattacatttggaagatgaactgcataaacgtgtggtgggccaggaccctgcggtgaaagcagtagctgaggccattcagcgatctcgtgctggtctctcagatcctcaccgtccaattgctagtttcatgttcatgggccccactggtgttggaaaaacagaactagctaaagccctagcttcctatatgttcaacactgaagaagcccttgtacgaattgatatgagtgaatacatggaaaagcattcagtctcacgattagtaggagccccacctggttatgtagggtatgaagaaggggggcagttaacagagacagttcgcaggaggccgtatgcagttattctctttgatgagatagaaaaggctcactctgacgtgtttaatatcttccttcaggttttggatgatggtagggtgactgattcacaaggtcgcactgtcagtttcacgaacactgtcatcattatgacttcaaacgtgggttcacaatatatactcgacacagatgataacttgccaaaggaggtagctaatgaaacaattaagaggagggtaatggatgctgctagatcagtctttcggcctgagttcatgaatagggttgatgagtacatagttttccagcctctggatcgtgatcagataaacagtattgtcaggttacagctcggacgtgtccagcaaaggcttgcagaccgaaagattaaattattggtcaccgatgcagctgtagagtttctagggactcttgggtacgatcccaactatggtgctaggccagtcaaaagggtgattcagcagcatgttgaaaacgaacttgccaagggtatcttgagaggggaattgaaggatgaggattctgtcgcaatagatacgcaggttacagcatttgctaatggccacctcccccagcaaaagctagttttcaagcgtctggaaactagtgaagataaggcagctgcagaaagtcgagctttttcacagactgtctaaatgtttttacccgcactacactatacaggtgctatacattttgggtagagggttcataactcatgctaaatgagtatttcccatcttgtgtaaaattacaggtctcgaggagtttttgtaaggtgccttgacttcctaacaacatattttatattcctttgtggttggtgaagttggggtgatcttgtgttcttgtagtctaaagtgcacgagagcgacatgatactaatttgacagaccagaactgttgttatacatgctcttaaaagtgaaacgaattgacagtatttttatttaaatgaattctttgcgaggtattttggagtggacaaaacaaaggaaaagtcgctcttacaaagccattcctaa

SEQ ID NO: 10429 - DNA, 3239 bp, Mimulus guttatus
ttttttttttttttcatttaaattaaatttcctccgcccatcaactaactcatcgcagaatctccctcaattctctcgccggtgaattccaaaacccttgattttacttgagttccgtttcatggcttctacgtcgtcgctcgccgccgtgcagcttaatctccggcggcctgatactccgggtacaagtacaaccgccttgttcccccgtccgatggtgtccatcaacctttcagcgaagctccgacacctgaggaatctcaattcactgaaattgagacctaaagacgccgcctttaccagaaaatcggatgaatttaccagaaattcgcgctcattccgcgtgcggtgcgatgcctcgtccaatggaagaattacacaggcggaatttactgaaatggcgtggcaagcgattgtggcttcgccggaagtggcgaaggagaataagcatcagattgtggagactgagcatttgatgaaggctctactggagcagaagaatgggcttgctcgtcgtatattttccaaggccggtgtggataatactcgacttctcgaagctacggataagtacattcagcgtcagccgaaggttcttggtgattcagctggatcaatgttaggacgagaactggaagggctgatacagcgagccagggagtacaagaaagagcttggtgattcatttgtgtcagtcgagcatttagttgttggatttgcacaagataatcggtttgggaagcaattatttaaagattttcaactctcactaaaatcggtgaaggatgccattcagtccgtaaggggacgccaaactgttatagaccaagaccctgaaggaaaatacgaagcactagaaaaatatggaaaagatttgacggccatggcgagagcaggaaagctggatcctgttataggaagagatgatgaaatacgtagatgcatacagattctgtcaaggagaaccaagaataaccctgttctgatcggcgagccaggtgtcggaaaaactgcaatttccgaagggcttgcgcagagaattgtgcaaggagatgttcctcaggctttgatgaatcgtcggctaatatctcttgacatgggagctctcattgctggtgcaaaataccgcggagaattcgaagatagactgaaagccgtacttaaggaagtcaccgattccgatggccaaatagttcttttcatcgatgagattcacacagtagtcggtgcaggtgctacaagcggggctatggatgctggcaacctgttaaagcccatgcttggccgtggagagttacgatgcattggagcaactactttagatgagtatcgtaaatacatcgaaaaagatccagctttggaaagacgttttcaacaagtttatgttgaccagcctacagtggaagacactatctctattttgcgtggactaagagaaagatacgagctgcaccatggggtccgcatttcggacagtgcacttgtggaagctgctattttatcagaccgttacattagtggtcgttttcttcctgacaaagctattgacctggttgatgaagcagccgccaaactgaaaatggagattacttcgaagccaacagctctagatgagattaaccgtactgttctaaaactcgagatggaaaggctatctctgacaaacgacactgacaaggcgacaaaagataggttgaatcgccttgaagctgaactgtctctcttaaagcagagacaagctgagctgaatcagcagtgggaacacgaaaagaatgtcatgacaaacatacagtctattaaggaagagatcgacagagtaaatctcgagatccaacaagccgaacgagagtacgacctcaaccgtgcagccgaattaaaatacgggagcttaaattctctacagcgccagctggccaccgcagaaaaggaactcggtgagtacatgaggtccggaaagtccatgcttagggaagaagtttccggaagcgacatagcagaaatcgtcagcaaatggaccggaatccccgtttcgaaactccaacaatccgaaagagacaagctcttaaatctggagcaagaacttcacaatcgtgtcgtaggtcaaaaccctgcagtaaaagcagtggcagaagccatacaaagatcaagagcaggcctttccgatccacaccgtccaatcgccagcttcatgttcatgggccccacaggtgttggcaaaaccgaactcgcgaaggcattagcagcatatttattcaataccgaagaatctttagtaagaattgatatgagtgagtacatggagaagcacgcggtttcaagattgatcggagcgccacctggctacgttgggtacgaggaaggagggcagttgactgagatagtgaggagaaggccttacgcagttattttattcgacgagatagaaaaggcgcatgcggatgtgtttaatgtgttccttcagatattggatgatggtagggtgactgattcgcaagggcgtactgtgagcttcacgaatactgtgattattatgacttcgaatgtggggtcgcagtatatattgaatacagaggatgatgattctccgaaggagatggcttatgagacgattaagaggagggttatggaggctgcgagatcgattttccgccccgagtttatgaatcgtgttgatgagtacattgtattccaaccgttggaccgtgatcagatcggcagtattgttaagttacagttggcaagagtgcagaagaggatagccgatagaaagatgaagattcaagtgagtgatgctgcagttcaacttctaagcagtctcggttatgatccaaactacggagctcggcccgtaaaacgtgtgatccaacagtacgtagaaaacgagcttgccaagggaatcttgagaggagatttcaaagacgaggaaactatatatgtcgacactgaagtcaccgctttctccaacggtcaacttccgcagcagaagctcgttttcagaaagttagattcgagttcaggtgcttcttcggaagatcaagaagcagctttctctcagacaatgtgagaagatgcgttgtatttctcgtatgaaatacttagttgtaattctagtctacgattaggagtctcgatatctaaatttatggagtaataaatacgattgattatctcatcgagtatatttgaaatcatttttgtggtgaactaacaaatcacgaaataaagttccagtattaaat

SEQ ID NO: 10430 - DNA, 3174 bp, Petroselinum crispum
cccaaattcaccccctttttaaattcccacgcaaagctcaatctcatcatctacaaccttcttgttcacacttgacatcatttctcatattcttcatcaatggcttctacgacgtcgttttccaccgttcgtctccaacctctctctactcgttactctaacagaactactaagccagcttctttttatcttcgctcacctttctctctcaattccactcccagattaaccctaaaaactaaccctaacaatgccttgttcactaaaccttctagaaccttccggaacaactccagttctttcgttgtccgttgcgaagcttccggcggtagaattacgcaagaggagtttactgaaatggcttggcaagctattgtttcttcgcctgaagttgcgaaagagaataagcatcagattgtggagactgaacatttgttgaaggctttgttggagcagaagaatggacttgctcgtaggattttttccaaggctggtgtcgataatactcgactccttgaagctaccgagaagttcattaatctccagcctaaggttcttagtgagtctgctggctcaatgttagggcgagacttggaatccttgatacagcgagccagagattacaagaaagagtacaatgattcatttgtatcagttgagcatttggtgcttggatatgtggaagatagacgatttggaaagcaattgtgtaaagattttaagatttcacttaaagctttaaagaatgctatagaagctatacgtggacgccaaacagtgattgacaaagatcccgaggggaagtatgaggcactagagaagtatggaaaagacttgactgccatggcgaggtctggaaagcttgatccagtcattggaagggatgatgaaatacggagatgcatacagattctttctaggagaacaaaaaataatcctgtcctaattggtgagcctggtgttggaaaaactgcaatttctgaggggcttgcccagagaattgtcgaaggagatgtccctcaagctctgatgaacaggaagttgatatcactggatatgggtgcacttattgctggagctaaataccgtggagagtttgaagacagattaaaggctgtgcttaaggaagtaactgaatcagatggacaaacgatccttttcattgatgagatccatacagttgtcggggcaggtgccaccaatggggcaatggatgctggaaatctcttgaagcccatgcttggacgtggagaattgcgatgtataggggcaacaaccttggatgaatatcgtaaatacattgagaaagatccagccttggagcgtcgtttccagcaagtctatgtagatcagcccacagttggagataccatctctatattgcgtgggttgcgggaaagatatgaactgcaccatggggttcgcatctctgatggggcactggtggaggctgcaattctctcagatcgctacattagtggccgtttcttaccagacaaagctattgatctagttgatgaagccgcagcaaaattgaaaatggaaatcacctcaaaaccaacagcacttgatgagatcaatcgttcagtacttaaactagagatggaaaggttatctcttaccaatgacacagataaagcttccaaagatagactggatcgcctcgagtcagagttagatctcttgaagaagagacaaactgaattaaatgagcaatgggaacatgagaaaactgtcatgacacgcttgcagtcaatcaaggaggagattgatagagtaaatcttgagatccagcaggcagagagggagtatgatcttaatcgtgcagctgagttgaaatatgggagtttgaactccttgcagcgtcaacttgaaactgctgagaaagaactagatgaatatatgaggtctgggaagtccatgcttcgagaagaagtcagcgggagtgatattgctgaaattgtcagtaaatggactggtattcctgtctcaaagctacaacaatcggacagagagaagttgttacatttggaagaagagctgcacaaacgtgtggttggccaagatcctgcggtcacatctgtggctgaggcaatccagcgatctcgagcaggcctgtcagatcctcaccgcccaatagctagtttcatgttcatgggtcctactggagttgggaaaacagaactagcaaaggcccttgcatcttatatgttcaacactgaggatgctcttgtgaggatagacatgagtgagtatatggaaaagcatacagtttcaagattaataggtgctccacctggttatgtaggttatgatgaaggaggacagctgacggagacggtccgcaggaggccatatgcagttattttatttgatgagattgagaaagctcattctgatgtgttcaatgtgttccttcaaatactagacgatggcagggtgactgattcacagggtcgcactgtgagtttcaccaacactgtcataattatgacttcaaatgtgggttcccaatacatacttggcacagatgatgaagagacaagttatgagactataaagcgaagagtattagatgctgcaaggtcagttttcaagccagagttcatgaatcgagttgatgagtacatagtattccagccacttgaccgtgatcagattaacagtattgtcaggatacagcttgaacgagtacaaaagaggattgcagaccggaagatgaagcttaaggtgactgatgctgcagttgaactcttagggagtcttgggtatgacccaagttatggtgcaaggccagtgaagcgtgtgatccagcaaaatgtcgaaaatgagcttgccaaaggtatattgaggggagagttcaatgacgacgacactgttttggtagacacagaggttacagcatattccgatggccagcttccccagcaaaagctagtttttaggaaactagattctggcacggatgttgaagcaaataacagagaagttgtttcacagaccatgttatagccaggctatccattacgattttgttttcctcggtgtaattaatattgtaagtggctgtagagtttatgttgctatggcaatggagagctgaatgtttgaaataaatgtagaagcagagtaataatatgatttgatacattttatataaatgcttttggatgg

SEQ ID NO: 10431 - DNA, 3245 bp, Petroselinum crispum
tttgttcagtaaaaaacaggtgaaaatgcacaccaattgaaattgaatcccaaaccaaccaattcattactctaacctcaccggcaatggcttcattctccggcatacatctccctctcctccggcctcctactaataaaactagtctcttctctcactcacttagttgtacagctcccccaaccctaacttgctctgtttcattcaaattcaactcaaacacctcccctaattatagtttcccatgcttttctacacctcctcttgttcgctgccaagcttctagcggaaaggtttcacaagaggagtttacggaaaaggcttggcaggcgattgtttcgtcgccacaagtggcaaaagagaataaccatcagattgttgagaccgaacatttgatcaaggctttgttggaacaaaagaatggacttgctcgtcgtattttttctaaggctggtgtggataatacgcgccttcttgatgctactcataagtttattaaacgtcaaccaaaggttatcggtgattctgcgggttcaatgttagggcgagacctggaagccctgttacaacgagcaagagactacaaaaaagagtataatgattcatttgtagcagttgagcatttagtacttggttatgtgcaagataagcgatttggaaaacaattgtttaaggattttcagatctcaatgaaagctttaacggatgctgtgcaagcaataagaggacggcaaacggtaattgaccaagatcccgaagggaaatatgaagcactggagaaatatggtaaagatttgacagccatggcaaaagcgggaaagcttgacccagtgataggaagagatgatgaaattcgcaggtgcattcaaattctttccagaaggaccaagaataaccctgtgctaattggtgaaccaggtgttgggaaaactgcaatttctgaagggcttgcccagagaattgtgcaaggagatgttcctcaagcgttaatgaacagaaagttaatatccttggacatgggtgctctcattgctggggcaaagtaccggggtgagtttgaagatagattaaaagctgtgctcaaggaagtaacagaatcagatgggcagacaatccttttcatagacgagattcatacagttgtgggagcaggtgcaaccagtggggcaatggatgctggcaatctcttgaagcctatgcttggtcgtggagagttgcgttgtattggggccaccaccttagatgaatatcgtaaatacattgaaaaagatccagccctggaacgtcgttttcaacaagtgcttgttgatcaacccacggtaggagataccgtctctatactgcgtggacttcgcgaaagatatgagctgcaccacggggtacgcatttctgatggtgcactcgttgatgctgcaattctctcagatcgttacatcagcggacgctttttacctgataaagctattgacttggtcgatgaagcggccgcgaaactgaagatggaaattacctcaaagccaactgctcttgatgaaattaatcgttcagtactgaagttagagatggagaggctatctcttacgaatgatactgataaagcttccagagaccgattgagtcgtcttgagggggagttggattccttaaaggtgacgcaggctgagttaaatgagcagtgggaacatgaaaaaactgtcatgacacgcttacaatcaataaaagaagagattgacagagtaaatcttgagatccagcaggcagagagggaatatgatcttaatcgtgcagccgagttaaagtacgggagcttgaactcattacagcgtcaacttgaaactgcagaaaaagaactagatgagtacatgaagtcagggaagtccatgcttagagaagaagtgagtgggagtgatattgctgagcttgtgagtaagtggactggtattcctgtttccaagctacaacagtcagagagggagaagctgttgcacctggaactggagctacataaacgtgtggtcggtcaagatcctgcagtgacatctattgctgatgctatccagcgatctcgagcaggtctctcagatcctaaccgtccaatagctagctttatgttcatgggtcctacaggagttggtaaaacagaactagcaaaggcccttgcctcttatatgttcaacactgaggaggcccttgtaagaatagatatgagtgagtacatggagaagcatgcagtttcaaggttgataggagctccacctgggtatgtaggttatgaggaaggaggacaattgagtgagactgtccggaggaggccatatgcagttattttgtttgatgagattgagaaagcccattctgatgtgttcaacgtgttccttcaaatactagatgatggtagagttacagattcacagggccgaaccgtgagtttcacaaacaccgtcatcattatgacttcaaatgtgggttcacaatatattcttaatacagatgatgactctgtgtcgaaagagacaacgtatgaaactataaagcagagggtaatggatgctgctagatcagtattccgaccggagttcatgaatcgagttgatgagtatatagtgtttcagcctcttgatcgtgatcagatcaataggattgtcaggatacagctggaacgtgttcaaaagaggatagcagatcgaaagatgaagcttcaagtcagtgatgctgctattaaactcctaggaagtcttgggtatgatccaagctatggtgccaggccagtgaagcgagtgatccagcagaatgtggagaatgagcttgccaagggtatcttaaggggagactttaaggacgaagacacagtcttcatagatacggaggtcacggcattttctaatggccagctacctcagcaaaagctagtttttaaaagattagattccgattcaggtaccacagctgaaaaatcagaagcattttcacagaccatttaaggtccagcacacttgcaatagcattcatatagttgttataccaaacagagctgaagatacatgtaatttgtcaattctttgatcttgtataggattctgtcaattatgagcgtgcggataaagcattttgttattgtaattgtaacatatggtagttgtaaatgaaaatagttatttagaggtgaagatcagtaaagttaaacggcgaggcaatggacatgaagtaatcacgtttccaaactagcgtagttgtaacacttagcg

SEQ ID NO: 10432 - DNA, 3472 bp, Brassica rapa
aacacgtgtcagaagaagatctacgtgcgtagttgagcacctcatcccgcgggttcacgaagcctccggcgtcgtttagcaccttccacccttcttatcatcaccttccttcgccttctcctacttctcgctaaaccacgcgaagacggaagaaaaaataacaaaaagcgttaacctttgctgaattctcaagtaaacacctcgccgtttcggcgaattcgtactaaaccgcctgtcgtctcacatcctcctatctgaacagtttgccgtttttaaaattctccgaccaaatggcgacgactgctacgtcggcgtttagtggcgtgatcggcgtaggatcggagtcccgaaaggtttctactttctctcatctccaaccatctgtagcttttccggcgaagcccagttccttcaaatcgctgaaactaaagcacagcgcgaggctcacgcggaggctcgagcatcggcccttcgtcgtccgatgcgaagcttcttccaacggaaggctgacacagcaagagttcacagagatggcgtggcaatcgatagtttcttcaccagacgtggctaaagagaataagcaacagattgtggagacagagcatttaatgaaagctctcttggagcagaagaacggtttagcgaggaggatcttctctaagatcggtgtggataacactaaggttctagaagcaacagagaagttcattcaacgccaaccaaaggtgtatggagaatctgctggttcgatgttgggacgtgaccttgaaggtctgtttgagagagctagaaagtataagaaagacttgggagactcttacgtctcagtggagcatttggttcttgcttttgctcaggacaagcggtttggtaaacagttgtttaaggattttcagatatctgagaagagtttgaaaactgctattgagtccattagagggaaacaatcagtcattgaccaagatccggaagggaagtatgaggcgttggagaagtatggtaaagacttgacagcaatggcgagagaaggaaagcttgatcctgtgattggaagagatgatgagatccgtagatgcattcagattctgtccaggaggacaaagaacaaccctgtgttgattggtgaacctggtgttggtaaaaccgcaatttcagaaggacttgctcagaggattgtgcaaggagatgtacctcaagctttgatgaatagaaagttgatatctctagacatgggtgcacttatagctggagcaaagtatagaggagagttcgaagatagactaaaggctgttctcaaggaagtcacagactcggaaggccaaatcattttgttcatcgatgagatccacacagttgttggtgcaggtgcaactaatggggcaatggatgctggtaatctactaaagccaatgcttggtcgaggcgagctaagatgtataggtgcaacaacgcttgatgagtacaggaagtacatagagaaagatccagccttggaacgtaggtttcaacaggtttatgtagatcagcccaccgttgaagacactatttcaattctccgtggtttgcgggaaaggtatgagcttcatcatggagttcgcatctcggacagtgctctagtggaagctgctatcctctctgaccgttatatcagtggccggtttctacctgacaaagcaattgacttggtcgatgaagcagcagccaaactaaaaatggaaatcacctcaaaacccacagctctcgacgagctcgaccgtgcagtgataaagctcgaaatggagaggctgtcactaaccaacgacacagacaaagcttccagagaaaggctgagccgtatcgaaaccgagctattatcactaaaagagaagcaagccgagttaacacaacagtgggagcacgagaggtccgtcatgtcccgtctccagtccatcaaagaagagatcgacagagtaaacctcgagatccagcaggctgagcgcgagtacgatctaaaccgcgcggcagagctcaaatacggaagcttgaactcgctccagcgtcagctaaacgaagctgagaaggagcttgacgagtacttaagctcgggcaagtcgatgtttagagaagaggtgttgggaagcgacatagctgagattgtgagtaaatggactggcatacctgtctcgaagctccaacagtcagagagagataaactcttacatttggaagaagagttgcataagcgtgtagtgggtcagaaccctgcagtgactgcagtagctgaagcgatccaacggtcgagagccgggctatctgatcctggccgtccgatagcttccttcatgttcatgggaccgaccggtgtcggtaaaaccgagctggctaaggccctcgcgtcttacctcttcaacacggaggaagctttggtgagaatcgacatgagcgagtacatggagaaacacgctgtttccagactcatcggagctcctcctggatacgtcgggtacgaggaaggagggcagttaactgagacggttaggagaaggccttactcggtgatcctcttcgacgagattgagaaggctcacggagacgtgttcaatgtgtttctccagatcctggacgatgggagggtcaccgactctcagggacgtacggtgagtttcaccaatacggtgattatcatgacatcgaacgtcggctcgcagtttatcctgaacaacactgatgatgatgcgaaggagctcgcgtacgagacgattaaacagagagtgatggatgctgctagatcgatttttcgtcccgagtttatgaacagggttgatgagtatatagtcttccagcctctcgaccgcgaccagatcaacagcattgtccggttacagcttgctcgtgtgcagaagaggattgcggacaggaagatgaagatagaggtcacagatgcggcggtggatcttcttgggagccttgggtatgatcctaactatggagctagacctgtgaagcgtgtgatacagcagaacattgagaacgagctggctaaaggtatcttgagaggagatttcaaggaagaagatggcattttgattgatacggaggtcactgcgttctccaatggtcagttacctcagcagaagctcattttcaagaagatcgagtcggaaacagctgatgctggaaaagaagaagctttctcaaaatagataccttttgaagctcaacaagtttcttactttttagtacagaacttttagtgagtcacttgtgacagaacacaatgttaaaacagttttttttatgtcaatgtgagttatataagtgctgatgtctcaaaatcctgtatatgaatgaatctctagagatgcggtacacttggcagaattacacaaattgtcaaatttacagatgttttcacacatcaatgttacattgattcgaatttgttagtagtttttgagaggaaattccattttcacttccaccaaacaaagaa

SEQ ID NO: 10433 - DNA, 3239 bp, Brassica napus
ttctcaagtaacacctcgccgtttcggcgaattcgtactaaaccgcctgtcgtctcacatcctcctatctgaacagtttgccgtttttaaaattctccgaccaaatggcgacgactgctacgtcggcgtttagtggcgtgatcggcgtaggatcggagtcccgaaaggtttctactttctctcatctccaaccatctgtagcttttccggcgaagcccaattccttcaaatcactgaaactgaagcacagcgcgaggctcacgcggaggctcgagcatcgacccttcgtcgtccgatgtgaagcttcatccaacggaaggctgacacagcaagagttcacagagatggcgtggcaatcgatagtttcgtcaccagacgtggctaaagagaataagcaacagattgtggagacagagcatttaatgaaagctctcttggagcagaagaacggtttagctcgtaggatcttctctaagatcggtgtggataacactaaggttctagaagcaacagagaagttcatacaacgccaaccaaaggtgtatggagaatctgctggttcgatgttgggacgtgaccttgaaggtctgtttgagagagctagaaagtataagaaagacttgggagactcttacgtctcagtggagcatttggttcttgcttttgctcaggacaagcggtttggtaaacagttgtttaaggattttcagatatctgagaagagtttgaaaactgctattgagtccattagagggaaacaatcagtcattgaccaagatccggaagggaagtatgaggcgttggagaagtatggtaaagacttgacagcaatggcgagagaaggaaagcttgatcctgtgattggaagagatgatgagatccgtagatgcattcagattctgtccaggaggacaaagaacaaccctgtgttgattggtgaacctggtgttggtaaaaccgcaatttcagaaggacttgctcagaggattgtgcaaggagatgtacctcaagctttgatgaatagaaagttgatatctctagacatgggtgcacttatagctggagcaaagtatagaggagagttcgaagatagactaaaggctgttctcaaggaagtcacagactcggaaggccaaatcattttgttcatcgatgagatccacacagttgttggtgcaggtgcaactaatggggcaatggatgctggtaatctactaaagccaatgcttggtcgaggcgagctaagatgtataggtgcaacaacgcttgatgagtacaggaagtacatagagaaagatccagccttggaacgtaggtttcaacaggtttatgtagatcagcccaccgttgaagacactatttcaattctccgtggtttgcgggaaaggtatgagcttcatcatggagttcgcatctcggacagtgctctagtggaagctgctatcctctctgaccgttatatcagtggccggtttctacctgacaaagcaattgacttggtcgatgaagcagcagccaaactaaaaatggaaatcacctcaaaacccacagctctcgacgagcttgaccgtgcagtgataaagctcgaaatggagaggctatcactaaccaacgacacagacaaagcttccagagaaaggctgagccgtatcgaaaccgagctattatcactaaaggagaagcaagccgagttaacacaacagtgggagcacgagaggtccgtcatgtcccgtctccagtccatcaaagaagagatcgacagagtaaacctcgagatccagcaggccgagcgcgagtacgatctaaaccgcgcagcagagctcaaatacggaagcttgaactcgctccagcggcagctaaacgaagctgagaaggagcttgacgagtacttaagctccgggaagtcgatgttcagagaagaggttttgggaagcgacatagctgagattgtgagtaaatggactggcatacctgtctccaagctccaacagtcagagagagataaactcttacatttggaagaagagttgcataagcgtgtagtgggtcagaaccctgcagtgactgcagtagccgaagcgatccaacggtcgagagctgggctatctgatcctggccgtccgatagcttccttcatgttcatggggccgaccggtgtcggcaaaaccgagctggctaaggccctcgcttcttacctcttcaacacggaggaagctttggtgagaatcgacatgagcgagtacatggagaaacacgctgtttccagactcatcggtgctcctcctggatacgtcgggtacgaggaaggagggcagttgactgaaacggttagaagaaggccttactcggtgatcctcttcgacgagattgagaaggctcatggagatgtgttcaacgtgtttctccagatcctggacgatggtagggttactgactctcagggacgtaccgtgagtttcactaatacggtgattatcatgacatctaacgtcggctcgcagtttatcctgaacaacactgatgatgatgctaaggagctcgcttacgagaccattaaacagagagtgatggatgctgctagatcgatctttcgccccgagtttatgaacagggttgatgagtatatagtcttccagcctctcgaccgcgaccagatcaacagcattgtccggttacagcttgctcgtgtgcagaagcggattgcggacaggaagatgaagatagaggtcacagatgcggcggtggatcttcttgggagccttgggtatgatcctaactatggagctagacctgtgaagcgtgtgatacagcagaacattgagaacgagctggctaaaggtatcttgagaggagatttcaaggaagaagatggcattttgattgatacggaggtcacagcgttctccaatggtcagttacctcagcagaagctcattttcaagaagattgagtcggaaacagcggatgctggaaaagaagaagaagttttttcaaaatagagcagttgagaaacgacaagtttcaagactttttagtagtcacttgtgacggaacacaatgttaaaaaaattatctcaatgtgagttatataagtgctcatgtctcgaaatcctttgtgaatgaatctcaagagatgcggtacacttggcagaattacacaaattgtcaaatttacagatgttttcacacatcgatgttacattgatttgaatttgttagtcgtttttgagaggaaagtt

SEQ ID NO: 10434 - DNA, 3260 bp, Tabernaemontana elegans
aaagcagatcctctctgcctctcccacttttttaaattcccacgcaaagtcctcaccatttccaataatccccttccgctcctgttctcgccgggaaaaactataagaggagttgctgcgtctttctccccagacatagcaaacaagctcagtgagctacggcagtggcaaagcaatggccgctacctcgtcgttagtaggcgtaccattccaccttcggccttccaattctgctagcagagcctccttgttttcgcagccgcctcctttatcggttaacttcattgcaaatcctagagctctcaaatccccaaagtcacttaagttgaaacggaaagatgcgttttctactagaaaagtggaggaattcggtcggagttcgaggtcattggtcgtccggtgcgaggcctcaagtggaaagcagataacgcaaacagagtttacggacatggcgtggcaagggattgtgtcgtcgcctgaagtagcaaaagagaacaagcatcagatagtggagacagagcatttgatgaagtcgcttttggaacagaagaatggtttggctcgtcggatattctccaaagttggtgtggataatactcggcttctggaagctactgataagttcattcagcgccaacctaaggttcttggtgagtcagctggttcaatgttaggaagggatctggaagccttgattcagcgagccagggattacaagaaagaatatggtgattcgtttatatcagttgagcatcttgtcctaggttttgcacaagataacagattcgggaaacaattattcaaggactttcaaatttcattaactgcattgaaagatgccatacaagccatacggggacgccaaacagttattgaccaagatccagagggaaaatatgaagcactagagaagtatggacaagatttaactgccatggcaagagctggaaaattggaccctgttataggaagagatgatgagatacgtaggtgtatccaaattctttctcggagaacaaagaacaatcctgttctaattggtgagccaggtgttgggaaaactgcaatttctgaagggcttgcccaaagaattgtgcaaggagatgtccctcaagcattgatgaatcgaaggttgatatcacttgacatgggcgcactcattgctggtgctaaatatcgtggagaatttgaagatagattgaaagctgtgctaagggaagtcacagattcggatgggcagattattcttttcattgatgagatccatacagtggtgggagcaggtgctaccaatggtgctatggatgctggaaatctcttgaaacccatgcttggccgtggggagttgcgatgcattggtgcaacaacattgaatgaataccgtaaatacatcgagaaggatgctgcattagagcgtcgcttccagcaagtgtatgtcgaccaaccaacagttgaagatgccatctccattctccgtggactccgtgaaagatatgaactgcatcatggagttcgtatatcagatagtgcacttgtagcagctgcagtcctctctgatcgttacattagtggacgttttttgcctgacaaggctattgacctggtagatgaagctgctgccaaactgaaaatggaaataacctcaaaaccaacagctcttgatgaaatcgaccgtgcagtactgaaactggagatggagagactttctcttaccaatgatacggacaaagcatcgaaggagagattgaaccgtttggaggctgaattaactttgttgaaggctcggcaagctgaattgactgagcagtgggagcatgagaagactgttatgatgcgcatacaatcaatcaaggaagagattgacagggtaaatttggagatccagcaggctgagcgagagtatgaccttaatcgtgctgctgaactgaaatatgggagcttgaactctttgcaacgtcaacttgaagctgctgaaaaagaattagacgagtatatgaagtctggaaagtccatgcttagagaagaagttaccgagggtgacattgctgagattgtcagtaaatggactggaattcctgtttccaagttacagcagtcagagaaggagaagcttttgcttcttgaggaagagttacataaacgggttgttggtcaagatcctgcagtgaaatctgtggcagatgctatccagcgatctcgagctggcctttcagatcctcaccgtccaattgctagcttcatgttcatgggtcctacaggtgtagggaagacagaactggcgaaggcccttgcctcctatttgttcaacactgaggaagctctagtacgaattgatatgagtgagtatatggaaaagcatgcagtttcaaggttgataggagctcctcctggttatgttgggtacgaggaaggagggcagttgactgaagctgttcgcaggaggccatattcagtaatcttatttgatgaaatcgaaaaggctcattctgatgtatttaatgtgttccttcaaattttggatgatggcagagtgactgattctcaggggcgtacggtgagttttaccaactgtgtcatcattatgacttcaaatgttggttcacaatatatactcaactccgatgatgaagacttgccgaaggaaatggcatatgaaagaatcaagcagagggtgatggaggctgcgagagctattttccgtcctgaattcatgaatagggtggatgaatacatagtattccagccccttgatcgtgatcaaatcaacaagattgtcagattacagttggaaagagttctaaagaggattgcagagaggaagatgaaacttgaagtgactgatgctgctgttgagcttctgggaagtcttggctatgatccaaactatggagctaggccggtaaagagagttattcaacactacgtagaaaatgagcttgccaaaggtatcttgagaggagaatttaaggatgaagatatcatagagatagacactggggtgactgcattttccaacggtcagcttccccaacagaagttggtcttcagaagattggaagcagggtcagatgcctccgcagaaaacaaagaagcagtgtcacagacattttgagatactatggacatgatggagatgtaacgattcaagagtatatatcaccgaattgagttttaaagcaatgccagttgctgatataactgcagttactattttgtatactcgtggaagtgtataatgtaaagcttcgtataagaagttg

SEQ ID NO: 10435 - DNA, 3207 bp, Euphorbia peplus
acacctacgcttaatcacatcacaaccccaccgatctccatatggcggcggcagcagccactactccggcgtatctcgccggcgttactctctgccaatctcaaaacacccgcaacgcattcttttctcctaaattgttaaactttcctctcaaacattccactctcaactcccttcacttcaagaagtcgtcctccgccgcccgcggtggtcggaggccggcatttgttgttcgctgcgtcggtgattctacttctagtggaaggattactcagcaggagtttacggaaatggcgtggcaagggattgtgtcgtccccggatgtggctaaagataataagcatcagattgtggagactgagcatttgttgaagtcgttattggagcagaagaatggtcttgctcgtaggatcttttctaaagtcggggttgataatacccgtcttttagaagctactgataagttcattcaacgccaacctaaggttcttggtgaatccgctggttcaatgttagggcgtgatttggaggctttgatccagagagcaagggattataagaaagaatacaatgattcgtttgtttctgtcgaacatttggttcttgcatatgctcaagactctcgatttgggaagcagttgtttaaggattttcagatatctctgccgactctgaaatctgccgtagaatcaataaggggacgccaatcagttatagatcaagatcctgaagggaagtacgaagcattggaaaaatatggaaaggatttgacagcaatggcaaaagcaggaaagcttgaccctgttattgggagggatgatgagattcgtagatgtattcaaattctttctaggagaacgaagaacaatcctgtgctgattggtgagccaggtgttgggaagactgcaatttctgaagggcttgcccagaggattgtgcaaggggatgtacctcaagctctaatgaacagaaagcttatatcccttgacatgggtgcacttattgctggggcaaaataccgaggagaatttgaagatagattgaaggctgtacttaaggaagtaactgattcagatggtcagattatccttttcattgatgagatccacacagttgttggggcaggtgctacaaatggtgcaatggatgcgggcaatctcttgaagcccatgcttggccggggagagttacgttgtattggtgcgactacattggacgaataccgaaaatatattgagaaggatcctgccttggagcgtcgtttccaacaagtttatgttgatcaaccaacagtagaagatacagtttccatactccgtggactgcgagaaagatatgagctgcatcatggtgtaagtatttccgacagtgcacttgtggaagcagcaattctttctgaccgttacataagtggaaggttcttaccggataaagctattgatctagttgatgaggcagctgcaaagctgaagatggagatcacttctaaaccgacagcccttgatgaaattgaccgttctgtattgaaactggagatggagaaactgtcacttaaaaatgatacggatagagcttcgaaagataggttgagccgtcttgatgctgagttatctctcttgaagactaaacaagctgaactgacagagcaatgggagcatgagaagactgtcatgacacgcattcagtcaattaaggaagagatcgacagggtaaaccttgagattcaacaggctgagcgtgagtatgatctaaatcgtgctgcagaattgaagtatggtagcctgaactctttgcaacggcaacttgaaggtgctgaaaaagagttggatgagtatatgaaatctggaaagtccatgctgagggaagaagtaacaggagatgatatcgctgaaattgtcagtaaatggaccggtatccctctctccaaactcaaacaatcagaaagagagaagctgctacatctggaggaagagttgcataaacgtgtggtgggccagaatcctgctgtaacagcagttgccgaggcaattcagagatctcgtgctggtctatcagatcctcgacgtccaatagctagtttcatgttcatgggtccaactggtgttggaaaaacagaattggcgaaagcattagcttcctacatgttcaacaccgaagaagctcttgtaaggattgacatgagtgaatacatggaaaaacatgcagtttcaagattgattggtgcaccacccggttatgtagggtacgaggagggagggcaattgaccgagatagttcggaggaggccatatgcagtaattctttttgatgagatagaaaaggctcatgcagatgtgttcaacgtcttcctccagatcttagatgacgggagggtgactgactcgcaaggtcgcactgttagttttactaacacagtcattattatgacttccaatgtgggttcacagtacatcctggataccgatgatgacatgccaaaggaggctgcttatgaatctatcaagcggagggtgatggaagctgcaagatccgtatttcgaccagagttcatgaacagggttgatgaatacatagtcttccagcctctggatcgcgatcaaataaacaggattgtcagcttacagttggcgcgggtgcaacagagagttgctgaccggaagatgaagatccaggtgactgaagctgctgtggagctattaggaaatctagggtacgacccgaactacggagcacgaccagttaagagggtgatccagcaatacgttgagaatgaacttgcaaaaggtatcttaagaggagaatttaaggatgaggatatcattttagtagacacagaagttacggctttttcaaatgggcagctcccgcagcagaagctcatctttaaaaagcttgaagttgatgcagacgctaaagctgcagatgcggaaaaccaagctgtgtcccagacattttagacgttcttttttgttcgaatttcttgaaattatactcctttagtatggaaatggaaatgtcagtgctgataggactttgcatcttgtgtaatgctttaacttgcaaaaagcgcaaagccctgtttatataactttctctgtaattaggcacgtcttcaaatatgttatttatcaataatgaagccgttcattcgagcaggttagattaagaaatactccctcaaaattattatttttcaaaatattggac

SEQ ID NO: 10436 - DNA, 3224 bp, Chrysanthemum coronarium
aacttgctatctacttgactaataagcactcttttccgtcagtaatggcgactccggcgtctttttccggcgtaaacatcaacaacgttccgttagacagaacaacagcattgtttgctcagccttctgtttctgttcattcattttcttataaacctagaacaactacttccgttaggtcgttaaaattgaggagcagaagtagttatggtggtggcgttttgttgaccactagaactactggtggtgttaggttcggtagcaaaagatgcaacagatcgtttgttgtccgtgctgatacttcttctaacggaaggatttctcaacaagaattcacagaaatggcatggcaagcaatcgtgtcttcgcctgaagtggcaaaggaaaacaagcatcagattgtggagactgagcatctgttgaaagccttgctggaacagaagaatgggttggcccgacgaatattctccaaggctggtgtggataatactcggcttttagaagctactgataagttcattcagcgtcaaccaaaggttattggtgaatcagctggctcgatgttaggacgggatctggaaggcctgatgaatagagccagggattacaagaaagagtacggagactcgtttgtgtctgttgagcatttggtgcttggttatgtgcaagataatcgatttgggaagcagttgtttaaggatttccaaatttcattgaaaaccttaaagaatgcaattgaatccatcagaggacggcaaacagttatagaccaagaccccgagggaaagtatgaatcactagagaagtatggtaaagatttgactgctatggcgagggaaggaaagcttgaccctgtcattggaagagatgatgaaatacgcagatgtatccagattctctccaggagaactaagaacaaccctgtgctcattggtgaaccaggtgttggaaagactgcaatttctgaagggcttgctcaaagaatagtgcaaggcgatgtgcctcaagctctgatgaaccgaaagttaatatcgctcgacatgggtgcacttattgctggagcaaaatatcgtggagaatttgaagatcgactcaaagcagtgctgaaggaggttacagaatcagatgggcagattattcttttcattgatgaaatccataccgttgttggagcaggggctaccaatggtgcaatggatgctggcaatctcctgaagccaatgcttggtcgtggggagttacgatgcattggtgcaacaacgttggacgagtatcgtaaatatatcgagaaggatccagcactggagcgccgctttcaacaagtttatgttgatcagcctacagtagatgatacagtttccatacttcgtggactgcgtgaaaggtatgaactgcatcacggagtacgcatttcagatagtgcacttgttgaagctgcaattctctcagaccggtacatcagtggacgctttctaccagataaagccattgatctggtagatgaagcagctgctaaactgaaaatggagatcacttcaaaacctactgcacttgatgagatcaatcgctcagtactgaagctggagatggagaggctatcactcactagtgatacagacaaagcttcaaaggataggttgagtcggctcgaagcagagttggctctcttgaaagaaaagcaggcccaattaactgaacaatgggagcatgaaaagagtgtcatgacaaatattcagtccatcaaggaagaaattgatcgggttaatttggagatattgcaggcagagcgagagtacgatctcaaccgtgcagctgagctcaagtatggaagtctgaactctttgctacgtcaacttgaaactgctgacaaagaattggccgagtatatgagttcagggaagtccatgcttcgagaagaagttactggtgatgatattgctgagattgtcagcaaatggactggcattccactttccaagctgaaacaatccgaaagagagaaactcttacatttggaggaagagctacacaaacgagttgtgggtcagaatcctgcggtgacagctgtggctgaggctatccaacggtccagagctggcctatcggatcctcaccgtccgatagctagtttcatgttcatgggacctactggagttggaaagactgagctggcaaaagcacttgcttcttacttgttcaataccgaggaggcccttgtacggattgacatgagtgaatacatggaaaagcatgctgtttctagactaataggcgctccacctggatatgtagggtatgaggaaggagggcagttgactgaaacagtgcgcaggaggccctatgctgtcatcctgttcgatgagattgaaaaggctcatgctgatgtgttcaacgtgttcctccagattttggatgatggcagggtgacagactcacaaggtcgtacagtcagcttcacaaacactgtcatcatcatgacctcaaacgtaggttcacagtacatacttgacactgaagacgactccatgccaaaagaacgagcgtatgagaccataaaacagagagtaatggatgcagcacggtcaatctttcgtcccgagttcatgaatcgggttgacgggtacattgttttccagccacttgaccgctcacaaatcaataggatagtccgattacagttggaacgagtacaaaagaggatagcagaccggaagctaaagattatggttagtgaagctgcggttgagcttctaggaagtctcgggtatgatccaaactacggtgctagaccagtaaagagggtgatccaacagcatgtggaaaacgagcttgcaaagggtatcttgagaggagacttcaaagatgaggataccatatcagttgacaccgaagtcacagcgttttccaatggccaactcccccaacaaaagctagtattcaagaaagtggacacacctggtggagcacctgagggtcaacaggccctctcgcaaactgtctagactataaacgtacaactgtacaagtagatatttcataaaattacacacttatagttgatatttcaaaatctgtaccattagcaacagctagtattgcataataaatgcttatgctatggtgagtctttttgctacttttaaatatcaaatcgcatattaccagcatgttcttcttttatacagattgttgatttgtttacaatgataagagcaaatcaagtt

SEQ ID NO: 10437 - DNA, 3052 bp, Daucus carota
ctggtctctcactcctccacactctccgtcaatctctctcccccttatccacctctcccagctttaacttgctctctctcattcaaattcaatgcacactccgcgtctttcacccgaaaaactcgccctgtcttttccccagccaatcctagaccgtctctagttcgttgccaagcttctagcggaaaggtttcgcaagaggagtttacggaaatggcctggcaagcgattgtttcgtcgccagaagtggctaaagagaataagcatcagattgttgagacggaacatctgatgaaggctttgttggaacagaagaatggacttgctcgtcgtattttttcgaaagctggtgtcgataatacgcgccttcttgatgctacggataagtttatcaaacgacaaccaaaggttatcggtgattctgcgggttcaatgttagggcgagacctggaaaccctattacaacgagccagagattacaaaaaagagtataatgattcatttgtagcggttgagcatttagtacttggtttcgtgcaagataagagattcggaaaacaattgttcaaggattttcagatctcaatgaaagctttaacagatgctgtgcaagcaataagaggacgccaaacggtgattgaccaagatcctgaagggaaatatgaagcattggagaaatatggtaaagatttaacagctatggcaaaagcgggaaagcttgacccggtgataggaagagatgatgaaattcgtaggtgcatccaaattctttccaggagaactaagaataaccccgtgctaattggcgaaccaggtgttgggaaaactgcaatttctgaagggcttgcccagagaattgtgcaaggagatgtgcctcaagctttaatgaatagaaagttgatatccttagacatgggtgctctcattgctggggcaaagtaccgtggtgagtttgaagatagattaaaagctgtgctcaaggaagtgacagaatcagatgggcagacaattctgttcatagatgagattcatacagttgtgggggcaggtgcaaccagtggggcaatggatgctggcaatcttttgaagccgatgcttggtcgtggagaattgcgttgtattggggcgaccaccttggatgaataccgtaaatacattgagaaagatccagccctggaacgtcgttttcaacaagtgcttgttgatcaacccacggtaggagataccgtctctatactccgtggacttcgcgaaagatatgagctgcaccatggtgttcgcatttctgacggtgcacttgtcgatgctgcaattctttcagatcgttacattagcggacgctttttacctgataaagctattgacttggtcgatgaagcggccgcaaaactgaagatggaaatcacctcaaaaccaactgctctcgatgagattaatcgtgcagtactgaagttagagatggagaggctatctcttacaaatgacactgataaagcttccagagaccgattaagtcgtcttgaaggggagttgaatttattaaaggagacccaggccgaattgaatgagcagtgggaacatgaaaaaacagtcatgacacgcttacaatcaataaaagaagagattgacagagtaaatcttgagatccagcaggcagagagggaatatgatcttaatagggcagctgagttgaagtacgggagcttaaactcattgcagcgtcagcttgaaactgcagaaaaagaacttgatgagtacatgaagtcagggaagtccatgcttagagaagaagttagtgggagtgacattgctgagcttgtgagtaaatggactggtattcctgtttccaagctacaacagtcagagagggagaagctgttacacttggaattggagctacataaacgcgtggttggtcaagatcctgcagtgacatctgttgctgatgctatccagcgatctcgagcaggtctctcagatcctaaccgtccaatagctagctttatgttcatgggtcctacaggagttggtaaaacagaactagcaaaggcccttgcctcttatatgttcaacactgaagaggcccttgtaagaatagatatgagtgagtacatggaaaagcatgcggtttcaaggttgataggggctccccctgggtatgtagggtatgaggaaggaggacagctgagtgagactgtccggaggaggccatatgcagttattttgtttgatgagattgagaaagcccattctgacgtgttcaatgtttttcttcaaatactagatgatggtagagttacagattcacagggccgaactgtgagtttcactaacactgtcatcattatgacttcaaatgtgggttcacaatacattcttaatacagatgatgactccgtgtcgaaagaaacaacgtacgaaaccataaagcagaaggtaatggatgctgctaggtcagttttccgaccggagttcatgaatcgggttgatgagtatatagtttttcagcctcttgatcgtgaccagatcaacagtatcgtcaggatacagctggaacgtgttcaaaagaggatagcagatcgaaaaatgaagcttcaagtcagtgatgctgctattaaactcctaggaagtcttgggtatgatccaagctatggtgccaggcctgtaaagcgagtgatccagcagaatgtggagaatgagcttgccaagggtatcttgaggggacagtttaaggatgaagatacagtcttaatagacacagaggtcacagcattttccaatggccagctacctcagcaaaagctagtttttaagagattagattctgattcagatactacagcagagaaagcagaaaggttttcaaagaccgtttaaggttccatgcacttgcaatcataccaaactgagctgaatatacttgtaatctgttaacaaaattctttaattttgtacaggattctgtaattatgaggataaagcattgtattattgtaaactatgttagttgtaacaaataatatgctgagatgaatatatatttagacgtaaa

SEQ ID NO: 10438 - DNA, 3045 bp, Daucus carota
ctcctctctattctcgcccatctctctctcttagttccacttctacccctcacaaattagccctaaaaacccgcccaaacaatgccttgttcgccgcaccttctagaaccttccggaacaactcctcgttcgttgtccgttgcgaagcttccggtggaagaattacgcaagaggagttcactgaaatggcgtggcaagctatcgtctcgtcgcccgaggttgccaaggagaataagcatcagattgtggagactgagcatcttttgaaggctttgttggagcagaagaacggacttgctcgcaggatcttctcgaaagccggtgttgataatactcgccttcttgaagctaccgacaagttcatcaatctccagcctaaggttcttggtgagtctgctggctcgatgttggggcgggatttggagtccttgatacagcgggccagagattacaagaaagagtacaatgattcatttgtatcagttgagcatttggtgcttggatatgtggaagatagacgattcgggaagcaattgtgtaaagattttcagatttcacttaaagccctaaagaatgctatagaagctattaggggacgccaaacggtgattgacaaagatcccgagggcaagtacgaagcattagagaaatatggaaaagacttgactgccatggcaagggcaggaaagcttgatccagtgattggaagggatgatgagatacggagatgcatacagattctttctaggagaacaaagaataatccagtcctaattggtgagcctggtgttggaaaaactgcaatttctgaggggcttgctcagagaattgttgaaggagacgtccctcaagctttgatgaacaggaagttgatatcactggatatgggtgcacttattgctggagctaaatatcgtggagaatttgaagacagattaaaggctgtgctcaaggaagttactgaatcagatggacagactattctatttattgatgagatccatacagtcgttggggcaggtgcaaccaatggggcaatggatgctggcaatctcttaaagcccatgcttggacgtggagagttgcgatgtattggggcaactaccttggatgaatatcgtaaatacattgaaaaagatccagccttggagcgccgttttcaacaagtctatgtcgatcaacccacagtggaagatacaatctctatattgcgggggcttcgggaaagatatgaactacaccatggggttcgcatatctgatggggcattggtggaggctgcgattctctcagatcgttatattagtggccgtttcttacccgacaaagctattgatctagttgatgaagcagcagcaaaactgaaaatggaaatcacgtctaaaccaacagcactcgatgagatcaaccgttcagttctaaaattggagatggagaggttatctcttaccaatgacacagataaagcttcaaaggacagacttgatcgccttgaggcagagttggatcttttgaagaagaaacaaactgaattaaatgagcaatgggaacatgagaaaactgtcatgacacgcttgcagtcaattaaagaagagattgacagagtaaatcttgagatccagcaggcagagagggagtatgatcttaatcgtgcagctgagttgaagtatggaagtttgaactctttgcagcgtcaactggaaactgcagagaaagaactagatgaatatatgaggtcagggaagtccatgctaagagaagaagttagtgggagtgatattgccgagattgttagtaaatggactggtattcctgtctcaaagctacaacaatcggagagagagaagttgttacatttggaagaagagctgcacaaacgcgtggttggccaaaatcctgctgttacatctgtggctgaggctatacagcgatctcgagcaggtctatcagatcctcaccgccctatagctagcttcatgttcatgggtcctacaggagttggaaaaacagaactagcaaaggcccttgcatcctatatgttcaacactgaggatgctcttgtgaggatagacatgagtgagtatatggaaaagcatacagtttcaagattaataggcgctccacctggttatgttggatatgacgaaggaggacagctgacggagacggtccgcaggaggccatatgcagttattttgtttgatgagattgagaaggctcattctgatgtgttcaatgtgtttcttcaaatactggatgatggtagggtgactgattctcagggtcgcactgtgagtttcaccaacactgtcataattatgacttcgaatgtgggttcacaatacatacttggcatggatggtgaagagacaagttacgagactataaagcgaagggtattagatgctgcaaggtcagtgtttaagccggagttcatgaaccgagttgatgagtacattgtatttcagcctcttgatcgtgaccagattaacagtattgtcaggatacagctcgaacgagtacaaaagagaatagcagaccggaagatgaagcttaaggtcactgatgctgcagtagaactcctaggaagtcttgggtatgacccaagttatggtgcaagaccagtgaagcgtgtgatccagcaaaatgttgaaaatgagcttgctaaaggtatattgagaggagagttcaaagacgacgacactgtgttggtagacaccgaggttacagcatttttggatggccagcttccacagcaaaaactagtgtttagaaaactagattcgggcacagatgttgaagcaaataacaagaaagttgtttcacagactttttaacatacatgttatacatatacagaagttgtaaaatttcagagtgtaagttatttttaggctctccattataagatttttcctcagtgtagattacttttgtgaatggctgtagaatatatgttgccaaggcgacggagggctaacgttcccaataacatgtaagaggaagtaataagatgatctgtttctctaactttttgggttcaag

SEQ ID NO: 10439 - DNA, 4904 bp, Chrysanthemum coronarium
cttgctatctacttgactaataagcactcttttccgtcagtaatggcgactccggcgtctttttccggcgtaaacatcaacaacgttccgttagacagaacaacagcattgtttgctcagccttctgtttctgttcattcattttcttataaacctagaacaactacttccgttaggtcgttaaaattgaggagcagaagtagttatggtggtggcgttttgttgaccactagaactactggtggtgttaggttcggtagcaaaagatgcaacagatcgtttgttgtccgtgctgatacttcttctaacggaaggatttctcaacaagaattcacagaaatggcatggcaagcaatcgtgtcttcgcctgaagtggcaaaggaaaacaagcatcagattgtggagactgagcatctgttgaaagccttgctggaacagaagaatgggttggcccgacgaatattctccaaggctggtgtggataatactcggcttttagaagctactgataagttcattcagcgtcaaccaaaggttattggtgagacagctggctcaatgctagggcgtgacttggaagccctgatgaatagagctagggattacaagaaagagtacggagactcgtttgtgtctgttgagcatttggttcttggttatgtgcaagataatcgatttgggaaacagttgttcaaggatttccaaatttccttgaaaacattgaagaatgcaatagaatcaatcagaggaaagcaaacagttatagaccaagatccagagggaaagtatgaatcattagagaagtatggtaaagatttgactgctatggcgagggaaggaaagctcgaccctgtcataggaagagatgatgaaattcgcagatgcatccagattctatccaggagaactaagaacaaccctgtgctcattggtgaaccaggtgtcggaaagactgcaatttctgaagggcttgctcagagaatagtgcaaggtgatgtgcctcaagctctgatgaaccgaaagttgatatcgcttgacatgggtgcacttattgctggagcaaaatatcgtggagaatttgaagatcgactcaaagcagtgctgaaggaggttacagaatcagatgggcagattattcttttcattgatgaaatccataccgttgttggagcaggggctaccaatggtgcaatggatgctggcaatctcctgaagccgatgcttggtcgtggggagttacgatgcattggtgcaacaacgttggacgagtatcgtaaatatatcgagaaggatccagcactggagcgccgctttcaacaagtttatgttgatcagcctacagtagatgatacagtttccatacttcgtggactgcgtgaaaggtatgaactgcatcacggagtacgcatttcagatagtgcacttgttgaagctgcaattctctcagaccggtacatcagtggacgctttctaccagataaagccattgatctggtagatgaagcagctgctaaactgaaaatggagatcacttcaaaacctactgcacttgatgagatcaatcgctcagtactgaagctggagatggagaggctatcactcactagtgatacagacaaagcttcaaaggataggttgagtcggctcgaagcagagttggctctcttgaaagaaaagcaggcccaattaactgaacaatgggagcatgaaaagagtgtcatgacaaatattcagtccatcaaggaagaaattgatcgggttaatttggagatattgcaggcagagcgagagtacgatctcaaccgtgcagctgagctcaagtatggaagtctgaactctttgctacgtcaacttgaaactgctgacaaagaattggccgagtatatgagttcagggaagtccatgcttcgagaagaagttactggtgatgatattgctgagattgtcagcaaatggactggcattccactttccaagctgaaacaatccgaaagagagaaactcttacatttggaggaagagctacacaaacgagttgtgggtcagaatcctgcggtgacagctgtggctgaggctatccaacggtccagagctggcctatcggatcctcaccgtccgatagctagtttcatgttcatgggacctactggagttggaaagactgagctggcaaaagcacttgcttcttacttgttcaataccgaggaggcccttgtacggattgacatgagtgaatacatggaaaagcatgctgtttctagactaataggcgctccacctggatatgtagggtatgaggaaggagggcagttgactgaaacagtgcgcaggaggccctatgctgtcatcctgttcgatgagattgaaaaggctcatgctgatgtgttcaacgtgttcctccagattttggatgatggcagggtgacagactcacaaggtcgtacagtcagcttcacaaacactgtcatcatcatgacctcaaacgtaggttcacagtacatacttgacactgaagacgactccatgccaaaagaacgagcgtatgagaccataaaacagagagtaatggatgcagcacggtcaatctttcgtcccgagttcatgaatcgggttgacgggtacattgttttccagccacttgaccgctcacaaatcaataggatagtccgattacagttggaacgagtacaaaagaggatagcagaccggaagctaaagattatggttagtgaagctgcggttgagcttctaggaagtctcgggtatgatccaaactacggtgctagaccagtaaagagggtgatccaacagcatgtggaaaacgagcttgcaaagggtatcttgagaggagacttcaaagatgaggataccatatcagttgacaccgaagtcacagcgttttccaatggccaactcccccaacaaaagctagtattcaagaaagtggacacacctggtggagcacctgagggtcaacaggccctctcgcaaactgtctagactataaacgtacaactgtacaagtagataattcataaaattatacacacttatagttaatatttcaaaatctgtaccattagcaacagctagtattgcataataaatgcttatgctatggtgagtctttttgctacttttaaatatcaaatcgcatattaccagcatgttcttcttttatacagattgttgatttgtttacaatgataagagcaaatcaagttttaagatacattatcgaacactctgagtgatacttgtgatgtgtttgctgtgatgatttgttctgctacaagccaatagatcatagtagctttgatacattagcaatttagcatcttggcaagaattgcagcatcattgctcgtgtcttatgatcagccgaaagcttaagttcacgcatctcctggtacaacttggttgctgaatcagtcttttctctcagacaaaaaccctgaaccgcagcattgtaaagattcgcatttggtggaacaagtttcaaaatttcatgtacttcatcataaagagaaccccatacgcaagatctaatcagtgacagcaaagttaatgtatctggagtttgcttctgatgaaccatccgctggtatacttgcaatgcaactctcggctcatttccaacctcacaagcttcaataactcgacaatatgatgtaaccggaatcgacaatcctgaactctccatctcccatagaatctgcaaagctcgtctccaagaaccaagctgcttgcaggctgttagtgcagtattatacaaatgcaactcgagtgcagacggtgcctcttgttggactctttcaaaaagcctaagcgcatcaccatattgctcagctctacatagagaaacgagcaatgcattccaagtgtacgatgtaggaatgtgccctaatgatttcatacaatcgtagactttaaaagcgagattaacctgaccattgttcccaagtgaatgaatcaacgcgttaaatattataatgttaggattctcttttcttttcatcataccacgaaaaacattcaacgcgaaatcccatctcccatctttcgcaaatgccataatagcagcttccgtagtacgagtatctggttcaaccccattctgaaccatttcaagatacgcttcaatagccaatccatactgacaaaacgtaagaaatatagtaaccaataaccggtacgtaactgaattccccacacaaccattatccttcatcctcatccaaactctctcgctctttatccaatctttttcatcccgacacaaagtcaacatcatattaaacaaaacttgatcaactttcttcttatgctcctcatcactcacaagctcctcaaacattttaaaagccgcttcaaaccctcgagctttagcaaccccttgtaagatcaagttataactatgtccacttgttcggtcatacgacttcatagactcaaacactgccaaagcatcatcaagctcatcatttctcaacaaacacgacagtagagcattaaaagcatgtgactcaggtctcagtcccatgaaatccatagacgcgtaaagctcaagcgcacttctaaccttatcgcccctactaagctttaataaacgccacgacagattcttttcatttctttcttccaaaaactgcagcctatggtcataaactactgaaccatcgtcactaacaccatcaacatcttcttcatatctatcaacgcatgttggatgttccttaatacccgacccgtatgcaactgaaaccttagctacaaacctgtcaagtctagtcctttttaaagatttacgttttgcacaccaactgttcggcgaaatgtatgaaccaaaaacttcgcaaaacctagaattgggaaaatgggttttgtagtattcagaaaaccca

SEQ ID NO: 10440 - DNA, 3153 bp, Panax ginseng
aagcagtggtatcaacgcagagtacatggggacagccgggagatttcactccaagcattaaatcttaattttcttcttacctttaccgctagtaccgactccgacaatggcatctatgacgtcgttctccggcgtccaccttggtcttcgtccacctccttccacctattgtgatagttgtagaattgctcagtcactgctttctgtgaacctatcttccaaatctgcagctcacaaaaacctaaattccttttccttcaaattgaacagaaacaatgcgtttttaactacaagagctgacaagctcggcaaaaattccaggtcctttgtcgttcgatgccaagcttcaagtggaaagattggtcaagaagagtttacagaaatggcttggcaagccattgtttcttcaccagaagtggcaaaagagaacaagcatcagatagtggagacggaacatttgattaaggctctgttggaacagaagaatgggcttgctcgtcgtatcttttcaaaggctggtgtggataatactcgtcttcttgaagctgcggataagttcatcaaaaaccagccaaaggttcttggtgagtctgctggttcaatgttaggacgagacctagaagccctaatgcagcgagccagggattacaaaaaagaatacaatgattcatttgtgtcggttgagcatttggtgcttggttttatgcaagataaacgatttggaaacaattgtataaggattttcagattcactgaaaaccttgacgaatgctgtgcaagcaataaggggacgccaaacagtagttgaccaagatcccgaggggaagtatgaaacactagagaaatacggcaaagattgactgccatggcaagaacaggaaagcttgaccctgtgataggaagggatgatgaaatacgcagatgcatccagattctttccaggagaacaaagaataatcctgtgctaattggtgagccaggtgtcggtaaaactgcaatttctgaagggcttgcccaaagaattgttcaaggagatgtccctcaagctttaatgaaccgaaaagtttgatatccctagacatgggtgcactcattgctggggcaaagtaccgtggagagtttgaagatagattaaaggctgtgctcaaggaggtaacagagtcagatgggcagattgtccttttcattgatgagatccataccgttgtgggggcaggtgcaaccaatggggcaatggatgctggcaatctcttgaagcccatgcttggacgtggagagttgcgatgtattggggcgaccaccttggatgaatatcgtaaatacatagaaaaagatcctgccctggagcgtcgtttccaacaagtttatgttgaccaacccacggttgaagataccatctctatattgcgtggacttcgtgaaagatatgagctacatcacggggttcgcatttctgacggtgcacttgtggaagctgcaattctctcagatcgttacatcagcgggcgcttcttacccgacaaagctattgacctagttgatgaagcagctgcaaaacttagatggaaatcacctcaaaaccacagcgcttgatgaaatcaaccgctcagtattgaaactagagatggagaggctatctcttacaaatgatacagataaagcttctaaagatagactaaatcgacttgaggcagagttagatctcttaaagaagagacaagccgaactgaatgagcagtgggagcatgaaaatctgtcatgacacgcttacaatcgattaagagagattgacagggtaaatcttgagatccagcaggctgagagggagtacgatcttaatcgtgcagccgagttgaaatatgggagcttgaacactttgcagcgtcaactcgaaactgcagaaaaggaattggatgagtatatgaggtctgggaagtccatgcttagagaagaagtaactgggagtgatatcgctgagattgtgagtaaatggactggtattcctgtttccaagctacaacaatctgagagggagaagctgttacatttggaagaagagctacataaacgtgttgttggtcaagatcctgcagtgaaatctgtggctgaggctatccaacgatctcgagcaggtctctcagatcctcaccgtccaatagctagcttcatgttcatgggtcctacaggagttgggaaaacagaactagccaaggcccttgcaaattatatgttcaacacggaggaggcccttgtaaggatagatatgagtgagtacatggaaaagcatgcagtttcaaggttaataggagctccacctggttatgttgggtatgacgaaggagggcagttgacagaaactgtccgcaggaggccatatgcagttattttgtttgatgagattgagaaagcccattctgacgtcttcaatgtgttccttcaaatattggatgatggtagagtgactgactcacagggtcgcactgtgagtttcaccaacactgtcatcattatgacttcaaatgtgggttcacaatacatacttaatacagacgatgatgcctcctcaaaggagacaacttatgaaactataaagcaaagggtaatggatgctgcaaggtcagttttccggcccgagttcatgaatcgggttgatgagtacattgtattccagcctcttgatcgtgaccagatcaacgctatcgtcaggatacagctggaacgagtacaaaagagaatagcagatcggaagataaaactccaagtgaccgccgctgctgtcgaactcctgggaagtcttggatatgacccgagctatggtgcgaggccagtgaagcgcgtgatccagcagaatgtggaaaatgagcttgccaagggcattttgagaggagagtttaaggacgaggacaccgtgttgatagacacggaggtgacagtattatccaatggccaacgtccccagcaaaggctagtttttagaaaattagattctggttcagatgttgccgcagaaaaaacacaaactttctcgcggactgtctgatgttacttgtactttatgtatattcttacggcaaaaaggggttccccattgtgatttgtgatcgtcgacttttaaaatatttaattaatcggatgtcaaatttgagcttctta

SEQ ID NO: 10441 - DNA, 3243 bp, Valeriana officinalis
atgtagattcgtttcgtttcgtcgctattcacattcagtagaacagccgagaacactccaacggccacactaaaatccctaacaatccatgaaatcagagcaaagacttcacatttttgattacttcctgttatctcccaaatctcaattgaaattatttgataatacaatctgcgattacagctgaattctcgagggaaatggcatctgcaaagacgatatcaagcatcgccaatttctcaatctctagttgtagtagaagcacagctcagccgcctatttcagtaacattctctgcgaaacctgttgcgtttaaagccctaaaatcggtgaatttgaagagcagcaatgtgttgaacaatcagagagttcagaggtccggaaggagttcgagttcgagatcttttgtggttcgatgcgaagcttcaaatggaaacgatagaattactcaacaagagttcactgaaatggcttggcaagccatagtttcttcacctgaagtggccaaagagaacaaacatcaaatagttgagactgaacatttaatgaaagctctcttagaacaaagaaatgggcttgctaggaggatattttcgaaggccggtgtcgataatacacgtctccttgaagctactgaaaaatatattcaacgtcagccgaaggtgattggcgagtcatctggttcgatgttggggcgtgatttggaatctctggttcagcgagccagggagtacaagaaagagtataaggattcgtttgtgtcggttgagcatttggtactcgggttcttacaagataaccgatttggaaaacaattgttcaaggattttcagatatctctgaaaaccttaactgatgcaattcaagccattagggggactcaaacagtgatagaccaggatcctgagggtaaatatgaatcactagagaaatatgggaaagatttgacagccatggctagggctggaaaacttgaccctgttatcggaagagatgacgaaatacgcagatgcatccagattctatctaggagaacaaagaacaatcctgttctcatcggcgagcctggtgttggaaaaacagcaatatcagaggggcttgcccagagaatcgtgcaaggagacgttcctcaagctttaatgaatagaaggttgatatctctggacatgggcgcgcttattgccggagcaaaatacagaggagaatttgaagatagactaaaggcagtgttgaaggaagttactgaatctgatggtcaaactattctcttcattgatgagattcacacagttgtcggggcaggagctactagtggtgcaatggatgctgggaatcttttgaagccaatgcttggccggggagagctgcgatgtattggagcaacaactttggatgaatatcgtaaatatattgaaaaggatccagccttagagcgtcggtttcagcaagtatatgtcgatcaaccaactgtagaagataccgtttctatactacgtggacttcgtgaaaggtatgaattgcaccacggggttcgaatctctgacggtgcgctggttgaggctgctattctgtcagatcgttacattagtggacggtttttaccagacaaagctattgatttggtcgatgaggcggctgcgaagttgaaaatggagataacgtcgaaaccaactgcacttgatgagattgatcgtgcggttttaaaactagagatggagaaactatctctgaaaaacgatactgataaaggttctaaagatagattgagtcgattagagtcagagttggatctattgaagaaaagacaaactgaactaaacgagcagtgggatcatgagaaaaatgtcatgacgcgtctgcagtcgatcaaggaagagattgacagggtaaatcttgagatacaacaagctgaaagagagtacaatctcaaccgtgcagccgaattaaaatacggtagcttaaattccttacagcgtcagcttgaaactgcagagaaggaactggacgaatatatgaactccggaaagtcaatgctaagagaagaagttaccggaagcgatattgccgaaatcgtcagtaaatggaccggaattccagtgtcgaagctacaacaatcagacagagagaaactgctatatctagaggatgagctacacagacgcgtagtaggccaagatccagccgtacgatcggtcgccgaggcgatccaacggtcacgagcaggcctatccgatcctcaccgtccgatcgccagcttcatgtttatgggacccacaggtgtcggcaaaacagagctagcaaaagcgctagcttcctacatgtttaataccgaagaagctcttgtgaggatcgatatgagcgagtacatggagaagcatgccgtatcgcgcttgatcggtgcgccacctggctacgtaggctacgaggaaggagggcaattaacggagatcgtcagaagaaggccgtacgccgtcatcttgttcgacgagatcgagaaagctcattctgatgtctttaatgtgttcctccagattttggatgacggtagagtgacagactcgcagggtcggaccgtcagtttcaataacactgtcattattatgacttcaaatgtcggttcgcagttcatattgaatactgacgatgaagatttacctaatggatctgcttatgaaaccataaaacgaagggtaatggatgcagcaagatcagttttccgtccagagtttatgaaccggattgacgagtacatagttttccagcctctcgaccgtgagcaaattaacagtatcgtcagattacagctggaccgagtacaaaagaggatagcagacagaaaaatgagcctgaaagtgacagattcagcggttgagcttctaggaagtctaggttatgatccgaattacggagctaggccggtgaagagggtgattcagcagaatgtcgagaatgaactggcaaagggaatcttgagaggagaattcaaggaggaagattctattttgatagataccgaagtcggcttattttccaacggccagcttccacagcagaagctcgttttcaaaagaatttcagattcagatactgcagaggccaacaacaaagaagcattttcacaacagaccatctgaatctgaaactattacaaaatcttttgcactcaaatcatagtttatttcgaaatgtaaagatttgattgaggatgcattgtaattaaccgattgtaagtgaactattaca

SEQ ID NO: 10442 - DNA, 3692 bp, Brassica oleracea
atttccgtgatggaacacgtgtcagaagaaggactacgtgcgtagatgcgcacctcatcccgcgaggttcacgaagcctccggcgtcgtttagcaccttccacccttcttatcaccaccttcctcgccaaaccacgcgaagacggaagaaaaataacaaaaagcgttacctttgctgaattctcaagtaaacacctcgccgtttcggcgaattcgtactaaaccgcctgttgtctcacatcctcctatctgaacagttcgccgtttttaatttctccgaccaaatggcgacgactgctacgtcggcgtttagtggcgtgatcggcgtaggatcggagtcccgaaaggtttctactttctctcatctccaaccatctgtagcttttccggcgaagcccaattccttcaaatcactgaaactaaagcacagcgcgaggctcacgcggaggctcgagcatcggcccttcgtcgtccgatgcgaagcttcttccaacggaaggctgacacagcaagagttcacagagatggcgtggcaatcgatagtttcttcaccagacgtggctaaagagaataagcaacagattgtggagacagagcatttaatgaaagctctcttggagcagaagaacggtttagctcggaggatcttctctaagatcggtgtggataacactaaggttctagaagcaacagagaagttcattcaacgccaaccaaaggtgtatggagaatctgctggttcgatgttgggacgtgaccttgaaggtctgtttgagagagctagaaagtataagaaagacttgggagactcttacgtctcagtggagcatttggttcttgcttttgctcaagacaagcggtttggtaaacagttgtttaaggattttcagatatctgagaagagtttgaaagctgctattgagtccattagagggaaacaatcagtcattgaccaagatccggaaggtaagtatgaggcgttggagaagtacggaaaagacttgacagcaatggcgagagaaggaaagcttgatcctgtgattggaagagatgatgagatccgtagatgtatacagattctgtccaggaggactaagaacaaccctgtgttgattggtgaacctggtgttggtaaaaccgcaatttcagaaggacttgctcagaggattgtgcaaggagatgtacctcaagctttgatgaatagaaagttgatatctctagatatgggtgcgcttattgctggagcaaagtatagaggagaattcgaagatagactaaaggccgtacttaaggaagtcacagactcggaaggccaaatcattttgttcatcgatgagatccacacagttgttggtgcaggtgcaactaatggggcaatggatgctggtaatctactaaagccaatgcttggtcgaggcgagctaagatgtataggtgcaacaacgcttgatgagtacaggaagtacatagagaaagatccagccttggaacgtaggtttcaacaggtttatgtcgatcaacccaccgttgaagacacggtttcaattctccgtggtttgagagaaaggtatgagcttcatcacggagttcgcatctcggacagcgctctagtggaagctgctattctctccgaccgttatatcagtggccggtttttacctgacaaagcaattgacttggtcgatgaagcagcagccaaactaaaaatggagatcacatcaaaacccacagctctcgacgagctcgaccgcgcagtgattaagctcgaaatggagagactatcactaaccaacgacacagacaaagcttccagagaaaggctgagccggatcgaaaccgagctattatcactaaaggagaagcaagcggagctaacacaacagtgggagcacgagaggtccgtcatgtcccgtctccagtccatcaaagaagagatcgacagagtaaacctcgagatccagcaagccgaacgcgagtacgatctaaaccgcgcagcagagctcaaatacgggagcttaaactctttgcagcgtcagctaaacgaagctgagaaggagcttgacgagtacttaagctctggcgagtcgatgtttagagaagaggtgttgggtagcgacatagctgagatcgtgagtaaatggactggcatacctgtctccaagctccaacagtcagagagagataaactcttacatttggaagaagagctgcataagcgtgtagtgggtcagaaccctgcggtgactgcagtagccgaagcgatccaacggtcgagagctggtctctctgatcctggccgtccgatagcttccttcatgttcatgggaccgacaggtgttggtaaaaccgagctggccaaggccctcgcgtcctacctcttcaacacggaggaagctctggtgagaatcgacatgagcgagtacatggagaaacacgccgtgtcgaggctcatcggagctcctcccggatacgtcgggtacgaggaaggagggcagttaacggagaccgttagaagaaggccttactcggtcatactctttgacgagattgagaaagctcacggggatgtgttcaatgtatttctccaaatcttggacgatgggagggttactgactctcagggacgtacggtgagtttcaccaatacggttattatcatgacatctaacgttggttcgcagtttatcctgaacaacactgatgatgatgcgaaggagttagcttatgagacaattaaacaaagggttatggatgctgcaagatcgatctttcgtcctgagtttattaacagggttgatgagtatatagtcttccagcctcttgaccgcgaccagatcaacatcattgtccggttacagcttgctcgtgtccagaagaggattgcggacaggaagatgaagatagagatcacggatgcggcggtggatcttcttgggagccttgggtacgatcctaactacggagctagacctgtgaagcgtgtgatacagcagaacattgagaatgagctcgcgaaaggtatcttgagaggagatttcaaggaagaagacggcattttgattgatacggaggtcacagcgttctccaatggtcagttacctcagcagaagctcattttcaagaagattgagtcggaaacagcggatgctggaaaagaagaagaagctttctcaaaatagactaccttttgaggctcaacaagtttcatactttttagtacagaacttctagtgagtcacttgtgacagaacacaatgttaaaacaatttttttttatgtcaatgtgagttatataagtgctgatgtctcaaaatcctgtatatgaatgaatctctagagatgcggtacacttggcagaattacacaaattgtcaaatttacagatgttttcacacatcaatgttacattgattcgaatttgttagtcgttttcgagaggaagttccattttcacttccccccaacaaagaatgtctccttttcaaatacgttttctttagcaaggccattgtctgcaaaaaaaaaaaaaaaagttttatgattgttgtcaggtgaaagaagctcgtcttgttgtataccagtaagagtaggttgggattttgaacgaaaccgaaccaaaaattttggttagaagttctgttttcattaaaaaaaacacacaaaccataccaaaaatctgaacagaaataacca

SEQ ID NO: 10443 - DNA, 2977 bp, Brassica napus
taaacacctcgccgtttcggcgaattcgtactaaaccgcctgtcgtctcacatcctcctatctgaacagtttgccgttttaaatttctccgaccaaatggcgacgactactacgtcggcgtttagtggcgtgatcggcgtaggatcggagtcccgaaaggtttcttctttctctcatctccaaccatctgtagcttttccggcgaagcccaattccttcaaatcactgaaactaaagcacagcgcgaggctcacgcggaggctcgagcatcgtcccttcgtcgtccgatgtgaagcttcatccaacggaaggctgacacagcaagagttcacagagatggcgtggcaatcgatagtttcgtcaccagacgtggctaaagagaataagcaacagattgtggagacagagcatttaatgaaagctctcttggagcagaagaacggtttagcgaggaggatcttctctaagattggtgtggataacactaaggttctagaagcgacagagaagttcattcaacgccaaccaaaggtgtatggagaatctgccggttcgatgttggggcgtgaccttgaaggtctgtttgagagagcaagaaagtataagaaagacttaggagactcttacgtctcagtggagcatttggttcttgcttttgcacaagacaagcggtttggtaaacagttgtttaaggattttcagatatctgagaagagtttgaaaactgctattgagtccattagagggaaacaatcagtcattgaccaagatccggaagggaagtatgaggcgttggagaagtatggtaaagacttgacagcaatggcgagagaaggaaagcttgatcctgtgattggaagagatgatgagatccgtagatgcattcagattctgtccaggagaacaaagaacaaccctgtgttgattggtgaacctggtgttggtaaaaccgcaatttcagaaggacttgctcagaggattgtgcaaggagatgtacctcaagctttgatgaatagaaagttgatatctctagacatgggtgcacttatagctggagcaaagtatagaggagagttcgaagatagactaaaggctgttctcaaggaagtcacagactcggaaggccaaatcattttgttcatcgatgagatccacacagttgttggtgcaggtgcaactaatggggcaatggatgctggtaatctgctgaagccaatgcttggtcgaggcgagctaagatgcataggtgcaacaacgcttgatgagtacaggaagtacatagagaaagatccagccttggaacgtaggtttcaacaggtttatgtcgatcaacctaccgttgaagacacgatttcaattctccgtggtttgcgggaaaggtatgagcttcatcatggagttcgcatctcggacagtgctctagtggaagctgctatcctctctgaccgttatatcagtggccggtttctacctgacaaagcaattgacttggtcgatgaagcagcagccaaactaaaaatggaaatcacctcaaaacccacagctctcgacgagcttgaccgagcagtgataaagctcgaaatggagaggctatcactaaccaacgacacagacaaagcttccagagaaaggctgagccgtatcgaaaccgagctattatcactaaaggagaagcaagccgagctaacacaacagtgggagcacgagaggtccgtcatgtcccgtctccagtccatcaaagaagaaatcgacagagtaaacctcgagatccagcaggcggagcgagagtacgatttaaaccgcgcggcagagctcaaatacggaagcttgaactcgctccagcggcagctaaacgaagctgagaaggagcttgacgaatacctaagctcgggcaagtctatgtttagagaagaggtgttgggaagcgacatagctgagattgtgagtaaatggactggcatacctgtctcgaagctccaacagtcagagagagataaactcttacatttggaagaagagttgcataagcgtgtagtgggtcagaaccctgcagtgactgcagtagccgaagcgatccaacggtcgagagctgggctatctgatcctggccgtccgatagcttccttcatgttcatgggcccgaccggtgtcggtaaaaccgagctggctaaggcccttgcgtcttacctcttcaacacggaggaagctcttgtgagaatcgacatgagcgagtatatggagaagcacgctgtttccagactcatcggtgctcctcccggatacgttggttacgaggaaggagggcagttaactgagaccgttagaagaaggccttactcggtgatcctcttcgacgagattgagaaggctcacggagacgtgttcaatgtgtttctccagatcctggacgatgggagggtcactgactctcagggacgtacggtgagtttcaccaatacggtgattatcatgacatcgaacgtcggctcgcagtttatcctgaacaacactgatgatgatgcgaaggagctcgcgtacgagacgattaaacagagagtgatggatgctgctagatcgatttttcgccccgagtttatgaacagggttgatgagtatatagttttccagcctcttgaccgcgaccagatcaacagtatcgtccggttacagcttgctcgtgtgcagaagaggattgcggacaggaagatgaagatagaggtcacagatgcggcggtggatcttcttgggagccttgggtatgatcctaactatggagctagacctgtgaagcgtgtgatacagcagaacattgagaacgagctggctaaaggtatcttgagaggagatttcaaggaagaagatggcattttgattgatacggaggtcactgcgttctccaatggtcagttacctcagcagaaactcattttcaagaagatcgagtcggaaacagcggatgctggaaaagaagaagaag

SEQ ID NO: 10444 - DNA, 3096 bp, Brassica napus
ttctcaagtaaacacctcgccgtttcggcgaattcttactaaaccgcctgttgtctcacatcctcctatctaaacagtttgccgtttttaatttctccgaccaaatggcgacgactgctacgtcggcgtttagtggtgtgatcggcgtaggatcggaatctcgaaaggtttctactttctctcatctccaaccttcagtggcttttccggctaagcccaattcattcaaatcactgaaactaaagcacagcgcgaggctcacacggaggctcgagcatcggtcgtttgtcgtccgatgtgaagcttcttccaacggaaggcttacacagcaagagttcacggagatggcgtggcaatcgatagtttcttcaccagacgtggctaaagagaataagcagcagattgtggagacagagcatttgatgaaagctcttttggagcagaagaacggtttagctcggaggatcttctctaagatcggtgtggataacactaaggttctagaagcgacagagaagttcattcaacgccaaccaaaggtgtatggagaatctgctggttcgatgttgggacgtgatcttgaaggtctgtttgagagagcaagaaagtataagaaagacttgggagactcttacgtctcggtggagcatttggttcttgctttcgctcaagacaagcggtttggtaaacagttgtttaaggattttcagatatctgagaagagtttgaaagctgctattgagtccattagagggaaacaatcagtcattgaccaagatccggaaggtaagtatgaggcgttggagaagtacggaaaagacttgacagcaatggcgagagaaggaaagcttgatcctgtgattggaagagatgatgagatccgtagatgtatacagattctgtccaggaggactaagaacaaccctgtgttgattggtgaacctggtgttggtaaaaccgcaatttcagaaggacttgctcagaggattgtgcaaggagatgtacctcaagcgttgatgaacagaaagttgatatctctagatatgggtgcgcttattgctggagcaaagtatagaggagaattcgaagatagactaaaggccgtacttaaagaagtcacagactcagaaggacaaatcattttgttcatcgatgagatccacacagttgttggtgcaggtgccacgaatggtgcaatggatgctggtaatctactaaagccgatgcttggtcgaggcgagctaagatgcataggtgcaacaacgcttgatgagtacaggaagtacatagagaaagatccagccttggaacgtaggtttcaacaggtttatgtcgatcaacccaccgttgaagacacggtttcaattctccgtggtttgagagaaaggtatgagcttcatcacggagttcgcatctcggacagcgctctagtggaagctgctattctctccgaccgttatatcagtggccggtttttacctgacaaagcaattgacttggtcgatgaagcagcagccaaactaaaaatggagatcacatcaaaacccacagctctcgacgagctcgaccgcgcagtgattaagctcgaaatggagagactatcactaaccaacgacacagacaaagcttccagagaaaggctgagccggatcgaaaccgagctattatcactaaaggagaagcaagcggagctaacacaacagtgggagcacgagaggtccgtcatgtcccgtctccagtccatcaaagaagagatcgacagagtaaacctcgagatccagcaagccgaacgcgagtacgatctaaaccgcgcagcagagctcaaatacgggagcttaaactctttgcagcgtcagctaaacgaagctgagaaggagcttgacgagtacttaagctctggcgagtcgatgtttagagaagaggtgttgggtagcgacatagctgagatcgtgagtaaatggactggcatacctgtctccaagctccaacagtcagagagagataaactcttacatttggaagaagagctgcataagcgtgtagtgggtcagaaccctgcggtgactgcagtagccgaagcgatccaacggtcgagagctggtctctctgatcctggccgtccgatagcttccttcatgttcatgggaccgacaggtgttggtaaaaccgagctggccaaggccctcgcgtcctacctcttcaacacggaggaagctctggtgagaatcgacatgagcgagtacatggagaaacacgccgtgtcgaggctcatcggagctcctcccggatacgtcgggtacgaggaaggagggcagttaacggagaccgttagaagaaggccttactcggtcatactctttgacgagattgagaaagctcacggggatgtgttcaatgtatttctccaaatcttggacgatgggagggttactgactctcagggacgtacggtgagtttcaccaatacggttattatcatgacatctaacgttggttcgcagtttatcctgaacaacactgatgatgatgcgaaggagttagcttatgagacaattaaacaaagggttatggatgctgcaagatcgatctttcgtcctgagtttattaacagggttgatgagtatatagtcttccagcctcttgaccgcgaccagatcaacatcattgtccggttacagcttgctcgtgtccagaagaggattgcggacaggaagatgaagatagagatcacggatgcggcggtggatcttcttgggagccttgggtacgatcctaactacggagctagacctgtgaagcgtgtgatacagcagaacattgagaatgagctcgcgaaaggtatcttgagaggagatttcaaggaagaagacggcattttgattgatacggaggtcacagcgttctccaatggtcagttacctcagcagaagctcattttcaagaagattgagtcggaaacagcggatgctggaaaagaagaagaagctttctcaaaatagactaccttttgaggctcaacaagtttcatactttttagtacagaacttctagtgagtcacttgtgacagaacacaatgttaaaacaattttttttat

SEQ ID NO: 10445 - DNA, 2955 bp, Panax ginseng
tctgttgtgaacctatcttcttcgaagtctaatacagttctcaaatcctcaagttattcagtttcctcaataagattgaatagaaacaataatgcgatgcggaagaattccaggtcctttgttgttcactgcgaagctggaaggattactcaagcagagtttacggaaatggcttggcaagccattgtttcttctccagaagtggcgaaagagaacaagcatcagatagtggagacagaacatttgatgaaggctctgttggagcagaagaatgggcttgctcgtcgtatcttttccaaggctggtgtagataatacccgtctccttgaagctactgataagttcatcaatctccagccaaaggttcttggtgagtctggtggttcgatgttagggagagacttggaagccctaatacaagcagccagggattacaagaaagagtacaatgattcattcgtgtcagttgagcatttggtacttggttttgcgcaagataaacgatttggaaaacaattgtttaaggattttcagatttcactaaaaaccttaaagaatgctgttgaagctataaggggaagccaaacagtaattgacaaagatcctgagggaaagtatgaagccctagagaaatatggcaaagatttgaccgccatggctagagaaggaaagcttgaccctgtgataggaagggatgatgaaatacgcagatgcatccagattctttccaggagaacaaagaacaatcctgtgctaattggtgagccaggtgttgggaaaactgcaatctctgaagggcttgcacagagaattgtgcaaggagatgtccctcaagctttgatgaaccgaaagttgatatccctggacatgggcgcactcattgctggggccaagtaccgcggagagtttgaagatagattaaaggctgtgctcaaggaggtaacagagtcagatgggcagattgtccttttcattgatgagatccataccgttgtgggggcaggtgcaaccaatggggcaatggatgctggcaatctcttgaagcccatgcttggacgtggagagttgcgatgtattggggcgaccaccttggatgaatatcgtaaatacatagaaaaagatcctgccctggagcgtcgtttccaacaagtttatgttgaccaacccacggttgaagataccatctctatattgcgtggacttcgtgaaagatatgagctacatcacggggttcgcatttctgacggtgcacttgtggaagctgcaattctctcagatcgttacatcagcgggcgcttcttacctgacaaagctattgacctagttgatgaagcagctgcaaaacttaagatggaaatcacctcaaaaccaacagcgcttgatgaaatcaaccgttcagtattgaaactagagatggagaggctatctcttacaaatgatacagataaagcttctaaagatagactaaatcgacttgaggcagagttagatctcttaaagaagagacaagccgaactgaatgagcagtgggagcatgaaaaatctgtcatgacacgcttacaatcgattaaagaagagattgacagggtaaatcttgagatccagcaggctgagagggagtacgatctcaatcgtgcagccgagttgaaatatgggagcttaaactctttgcagcgtcaactcgaaactgcagaaaaggaattggatgagtatatgaggtctgggaagtccatgcttagagaagaagtaactgggagtgatatcgctgagattgtgagtaaatggactggtattcctgtttccaagctacaacaatcggagagggagaagctgttacatttggaagaagagctacataaacgtgttgttggtcaagatcctgcagtgaaatctgtggctgaggctatccaacgatctcgagcaggtctctcagatcctcaccgtccaatagctagcttcatgttcatgggtcctacaggagttgggaaaacagaactagccaaggcccttgcaaattatatgttcaacacggaggaggcccttgtaaggatagatatgagtgagtacatggaaaagcatgcagtttcaaggttaataggagctccacctggttatgttgggtatgacgaaggaggtcagttgacagaaactgtccgcaggaggccatatgcagttattttgtttgatgagattgagaaagcccattctgacgtgttcaatgtgttccttcaaatactggatgatggtagagtgactgactcacagggtcgcactgtgagtttcaccaacactgtcatcattatgacttcaaatgtgggttcacaatacatacttaatacagacgatgatgcctcctcaaaggagacaacttatgaaactataaagcaaagggtaatggatgctgcaaggtcagttttccggcccgagttcatgaatcgggttgatgagtacatagtattccagcctcttgatcgtgaccagatcaacattatcgtcaggatacagctggaacgagtacaaaagagaatagcagatcggaagataaaactccaagtgaccgatgctgctgtcgaactcctcggaagtcttggatatgacccgagctatggtgccaggccagtgaagcgcgtgatccagcagcatgtggaaaatgagcttgccaagggcattttgagaggagagtttaaggacgaggacaccgtgttgatagacacggaggtcacagtattatccaatggccaacgtccccagcaaaggctagtttttagaaaattagattctggttcagatgttgccgcagaaaaaacacaaactttctcgcggactgtctgatgttacttgtactttatgtatattcttacggcaaaaaggggttccccattgtgattgatgacttttaggcacctaactttaaaaatatatatcatgatatagtagcctattatgttcctccta

SEQ ID NO: 10446 - DNA, 4064 bp, Brassica oleracea
cgaaaacacaagcaaaaagcgttaatctttcctcatttcttaagtaaacatctcgccgtttcagcgaattcgcgctaaactccctgttgtagtacatcatcctttctaaactgttcaccgtttttcaatttctccgagcaaatggcgacggctaagacgactgctacggcggcgtttagtagtatcgtcggcggcgtaggatcagactcccgaaaggtttcctctttctctcacctccaaccttccgtggcttttccggcgaagcccacttccttcaaatcactgaagctaaagcagagcgcgaggctcactcgaagacttcaacatcaaccgttcgtcgtccgatgcgaagcttcttctaacggaaggcttacacagcaagagttcacagagatggcgtggcaatcgatagtctcttcaccagacgtggctaaagagaacaagcagcagatcgtggagacggagcatctcatgaaagctcttttggagcagaagaacggtttagctcgaaggattttttcgaagatcggtgtggataacaccaaggttcttgaagctacggataagttcattcaacgccagccaaaggtgtatggagaagctgctggttcgatgcttggacgtgatttggaagggttgtttcagagggcgagacagtataagaaagacttgggggactcttatgtctctgttgagcatttggttcttgcttttgttgatgataagcggtttgggaagcagctgtttagggattttcagatatctgagaagagtttgaaaactgctattgagtccattagagggaaacaatcagtcattgaccaagatccggaaggcaagtatgaggcgttggagaagtatggtaaagatttgacagcgatggcgagagaaggaaagcttgatcctgtgattggaagagatgatgagatccgtagatgcattcagattctctcaaggaggactaagaataaccctgtgttgatcggtgaacctggtgttggtaaaaccgcaatctcagaaggacttgctcagaggattgtgcaaggagatgtacctcaagcattgatgaacagaaagttgatatctcttgatatgggggcacttattgctggagcaaagtatcgaggagagttcgaagatagactaaaggctgtacttaaggaggtcacagactcagaaggccaaactattctgttcatcgatgagatccacacagttgttggcgcaggtgcgactaatggggcaatggatgctggtaacctactaaaaccaatgctaggtcgaggcgagctacgctgtataggcgcaacaacgcttgacgaatacagaaagtatatagagaaagatccagccttggaacgcaggtttcaacaggtttacgttgatcaacctaccgtggaagacactgtttcgatcctccgcggtttgagagaaaggtacgaactccatcacggagttcgcatctcagacagtgctctagtggaagccgccatcctctctgaccgttacatcagtggccggttcctacctgacaaagcaattgacttggttgatgaagcagcagccaaactgaaaatggaaatcacatcgaaacccacagctctcgacgagctagaccgcgcggtgatcaagctcgagatggagaggctctcactcaccaacgacacagacaaagcttcaagagagaggctaaaccggatcgaaacggagttagtcttactaaaggagaagcaagcggagttaaccgagcagtgggagcacgagaggtccgtcatgtcccgtctccaatccatcaaagaggagatagaccgagtaagcctcgagatccagcaagcggagcgcgaatacgatctaaaccgcgcagcagagctcaaatacggaagcctaaactctttacagcgtcagttaaacgaagctgagaaggagcttaatgagtacttaagctctggcaagtctatgttcagagaagaggtgttaggcagcgacatagcagagatcgttagcaaatggactggcatccctgtgtcgaagcttcaacagtccgagagagataagcttctgcacttggaagaggagctgcatagacgagtaataggtcagaaccctgcagtcacggccgtagccgaagcgatccaacggtccagagccggcctatcggatccgggccgtccgatagcttccttcatgttcatgggaccgacgggagtcggcaaaaccgagctggccaaggccctcgcttcttacctcttcaacacggaggaagctctggtgaggatcgacatgagcgagtacatggagaaacacgcggtttccaggctcatcggagctcctcccggatacgtgggctacgaggaaggagggcagttgacggaagtggttaggagaaggccatactcggtcatactcttcgacgagattgagaaggctcatggagatgtgttcaacgtgtttctccagatcttggacgatgggagggttactgactctcagggacgtacggtgagtttcaccaatacggttattatcatgacctcgaacgttggctcgcagtatatcttgaacagcaacgcggatgatgaggggagtgagcttggttatgagacgattaagcagagagtgatggatgctgcgagatcgatctttcgtcctgagtttatgaatagggttgatgagtatattgttttccagcctcttgaccgtgagcagatcaacagcatcgtccggttacagctggctcgtgtgcagaagcggattgcggataggaaaatgaagatagagatcacagatgcggcggtggatcttctcggaagcctcgggtatgatccgaactacggagctagacctgtcaagcgtgtgatacagcagaacattgagaacgagctcgccaaaggtatcttgagaggagatttcaaggaagaagatgggattctgatcgatacagaggtcacagcgttctccaatggtcagttacctcagcaaaagctcacattcaaaaagattgcgtcagaaacggcagatgctgagaaggaggaagaagaagctttctcaaaacagagcaattgaaaaacgacaccttttggagcccaagaagtttcggactttatagtacatagcttctagtgagttggttgtgacagaacagaatgataacatttatctcaatgtgagatataaaccataagctaataagttattgtgctgatgtctcaaaatccatattctctgaaaatgcaatatattttagtaacgttatatagttttcctgtgaccacttatatattgggcctgatttattagagcatgattatcccatgtttttaatttggggtttgacatttttttattttttttttattttttttttatattttcgactaagaactgatttttgtcttttatttaagaaaaaaactaaaaaatggtttttagccaaagctaagaactctattctaagaatccgtgttaattgtggtcttagagcatcaataacccagttacttaatgggttgcttattgggttttggattaaagaaaaaaggaaaagaaaagaatcagagaagcagcgatgcttaattaagcctcagaagcagcgtgtcttattggacacgtgttgtccaaacaacgctctgcgttcctttttctctctcttgcgaaacggaaacgtctcgttctctctcactctcgacgactccgtcttctctctcgacgaaatcgacgcctcctcgacgccaagcgcagctcaaacccgacacagtgcccaagctccgtgaagctttacctgctctggccgactaactcatcggcgcgatgatgtctcctctgtggcgatcgtatgatccaaacctcatcgaagaacctaccgtctacaggtgaaataaaaatctactgaagatgtgcagacctctcaaccgagcggaacacactcggatctttcaattcaaataccgcctagatcaatcccattcggtggtgccggccgtatcccaaaaggttctctgaaacaagcgcatgtacatgtttctaacagatgttaaccaaacagatacagacttgtgagaaaactt

SEQ ID NO: 10447 - DNA, 3100 bp, Phalaenopsis aphrodite
cagggcttcctcgccggaaagagaccaataagtcgccgtcctcgcttcaaccgatggcgtacgcgctccattctcactatctctgtctaccaccacctctgccgaggagcctccgtcgaattaccttttcttctgccatcccactgtcggctaagtcgatgaaaaccctaaatccactgaactcggcggaaaccctagggaaatctggtttctttgtcgtgaaaagggcggggaggttctccactggccgcaataggcagcaaggtgtgcgatgcgatgccacttcgaaagatgggaggattactcagcaagagtttacggagatggcctggcaggggattgtttcatcgccggaggttgcgaaggagagtaagcatcaaattgtggagaccgagcatttgatgaaagcgttgttggagcagaagaatggtttagctcgccggattttctccaaggctggtgttgataacactcgccttcttgaagctacggatagttacattcagaggcaaccaaaggttcttggtgagtctgctggttctatgctaggaagggacttggaatctttaattcaaagagctagggagttcaagaaagaatatggagactcatttgtgtctgttgagcatttagtgcttggttttgtagaagacaaaagatttgggaaacaactcttaaaggacttcagagtttctctccaaatgctgaaatctgccattcaatctataagaggacgtcaaactgttattgaccaagaccccgagggtaaatacgaagccttggagaaatatggtaaggatttgacagccatggcacgcgaagggaagcttgatccagttattgggagggatgatgagataaggagatgcatacagatattgtctagaaggactaagaacaatcctgtattaatcggcgaacctggtgtagggaaaactgccatatctgaagggcttgcccagagaatagttgaaggagatgtaccccaagctttgatgaaccgcaggttaatatctcttgatatgggtgctctcatagctggggcaaagttccgaggtgagtttgaagatagactgaaagctgtcttgaaggaagtgacggactcagatggacaaacaatccttttcattgatgagatccatactgttgttggagcaggtgccacaaatggcgccatggatgctggaaacctattgaagccaatgttaggccgtggcgagttgcgttgtattggtgcaactacccttgatgaataccgcaaatatattgagaaggacccagctttggaacgccgcttccaacaagtttatgttgatcagcctacggttgaagacacgatctccatactccgtggactgcgcgaaaggtatgagctccatcatggagttcgcatcaatgatagtgcactggtggatgctgctgttctttcagatcgttatatcagtggtcggttcttgcctgataaagctattgatttagttgatgaggcagctgccaagttaaaaatggaaatcacatccaagccaactgctttggatgagatcaatcgttcggtaattaaattagagatggagcgtctctctctaactaatgatacagacaaagcttcaaaagagagactggctcgtcttgatgctgagctttcgctcttgaaaaagaggcaggctgagcttaccgaacagtgggagcacgagaaatcagtgatgacacgtattcaatccatcaaggaagagattgatagggtgaacatagaaattcaacaagcagagcgcgagtatgacttgaatcgtgcagccgaattgaaatatggaagcctgaatagtttgcagcgtcaacttcaggagactgaaaaggaattaaatgaatatcagagttcggggaaatcaatgctcagggaagaggttactggcaacgacatcgctgaaatagttagcaaatggacaggcattccggtttccaaattgcagcagtccgaaaaagaaaagctccttcatttggaggaagaactacacaaacgtgttgtcggtcaagatcccgctgttcaagcggttgcagaagctattcaaagatcgagagctggtctttctgatcctcaccgtccaattgcgagcttcatgttcatgggccccaccggagtcggcaagacagaacttgctaaagctctcgcttcgtacatgttcaacaccgaagaagctctcgtgagaatcgacatgagtgaatacatggaaaagcatgcagtttctcgtttgatcggagcgccgccgggctatgttggatacgaagaaggcgggcagctgacggaaactgttagaaggaggccttatgccgtcatattgttcgatgagattgagaaggcccattttgatgtgttcaatgtctttcttcagatactcgacgatggtagggtgactgattcacagggacgaagagtgagcttcacaaatacggtgataataatgacgtcgaatgtgggttcacaatacatattaaatgtgaatgacgaaataggttcaggtgtttctgcttatgagtccattaagcagagagtcatggaggcagcccgtgccatttttcgtccggagttcatgaatcgtgttgatgagtatattgttttccagcctttggatcaacaacaaattaatagcattgtgaggttgcagttggaacgagtccagaatcgacttgctgatcgaaaaatcaagattcaagtcaccgatgcagcggttattctgctaggtaggctcggatatgaccctaattatggtgccaggccagtgaagcgtgtgatccagcagaatgtggagaatgaactggccaagggtatcctcagaggagacttcagagatgaagaaattatagaagttgacacagagctcactgccttctctaatggccaacttccccagcaaaagctggttttcagaagcctgggagcaggttcttcctcagataagcaacaatcgactgagacccaagaggctgtattaccaagcagatgactttttattttttggaaagttctgctgttgcctgcaggtactgtattttgtaagaataattcagttgaaacacagtttgtattatgatcttcaaatacaat

SEQ ID NO: 10448 - DNA, 3320 bp, Papaver somniferum
tctttctcccacagttctttttaaggaacactctactttcctctaattacacgcaaagtccccacatttactccatatttacatacatacagagagtttcatttcagtgagtaaaccctttgaaggttttctttgatggagacaatcttctcaggtattcagttaagagttcctccttcatcaactaagaatagtaatggaagtatattgcttactcacccacaattgtctctgggttataatttaaaccctaaaagaacgacacttaaattatcaaaagcattggaaaaagatgatggttttattagtaataaagggtttaagagatttggtatcggtaatggttcttctacttctacttcaaggcgttcttcttcttttgttgttagatgtgaagctcctaaagatggaaagattacccagcaagaatttacagagatggcatggcaagctattgtttcgtcgccggaagtggcaaaagacagcaaacatcaaattgtagagactgagcatttgatgaaagccctactggagcagaaaaatggcctggctcgacgcatatttgccaaggtgggagttgataatacccgccttctggaagctactgataaattcatccaacggcaaccaaaggtttttggtgaatcagctggttctatgttagggagggatttggaagctctcattcagcgatccagggactacaagaaagagtacaatgattcctttgtatcagttgaacatttgttacttggttatgtacaagatcaacgttttgggaaacaattgtttaaggatttccagatttcgctcaagagtctgaaatctgcaattgaagctataaggggtagccagaaggttatggaccaagatcccgaagggaagtatgaagccttagagaagtatggaaaagatttgacagctatggcacgggcgggaaagcttgatccagtcataggaagagatgatgagatacgcagatgcatacagatcctatcaaggagaactaagaataatcctgttcttattggtgaacccggtgttgggaaaactgcaatatcagaagggcttgcccaaagaattgtgcaaggagatgttcctcaagctcttatgaaccgcaagttggtttcacttgacatgggtgcactaatagctggtgcgaaatttcgtggagaatttgaggatagattgaaagctgtactcagagaagtaacagaatcggacggccagacagtgctgttcattgatgagatccacacagttgttggggcaggtgctacgaatggtgccatggatgcagggaatctgttgaagcctatgcttggccgtggagaactgcgatgcataggtgcaacaacactcgatgaatatcgcaaatatattgagaaagatcctgccttggaacgtcgcttccagcaagtttatgttgatcaacctacagttgaagatacgatatctatattacgagggctgcgtgaaaggtacgagctacatcacggtgtccggatatctgacaatgcacttgttgaggctgctattctgtctgatcgctacatcagtggacgtttttgccggataaagctattgacctagttgatgaagcagcagctaaattgaaaatggaaattacttccaaacctactgccctagatgagatcaatcggaccgtgttaaagttggaaatggaacgcctctctctcgttaatgacacagacaaagcatcaaaagatagactaagtcgtcttgataccgagctatctatcttaaaggagaaacaaactgagctgactgagcaatgggagcatgaaaaaaatgtcatgacacgtattcaatccattaaagaggaggttgacagggtaaatctggagattcagcaagcagagagagagtatgacctcaatcgtgctgctgagttgaagtatggaagtctcaatgctttgcaacgccagcttgaagttgctgaacaagagttgagtgaatatcttaaatcagggaaatccatgttaagggaagaggttgccggaagtgacattgccgaaatagttagtaaatggactggaattcctgtttcaaagctgcagcaatcagagagacaaaaactattacatctagaggaagagttgcacaagcgtgttgtgggtcaaaacccagctgtgcaagcagtagctgaggccatccaacggtctcgagcaggtctttcagatcctcaccgccccattgccagtttcatgttcatgggtcctactggtgtgggcaagacggaactagctaagacccttgcttcctacatgttcaacactgaagagtccctcgtcagaattgacatgagtgagtacatggagaaacattcagtctcaagattgataggagcaccacctggctacgttgggtatgaagagggtgggcagctcacagagacagtacgaaggaggccctacgctgtaatcctgtttgacgaaatcgagaaggctcattctgacgtgttcaacgtattccttcagattttggatgatgggagggtcaccgactcacaaggtcgaaccataaacttcaacaacactgtcattattatgacttcaaacgtggggtcacagtacttgctcaacacagatgatgaaacttcatcaaagggttctgcatacgaaaccattaagcaaagggtgatggatgctgccaggtctgtctttcgtcctgaattcatgaaccgtgtggatgagtacatagtcttccagcccctcgaccgcgagcagataaacagtattgtgaaattacagttggaacgagtacagaagagaattgcagataaaaagatgaaaatcaaggtaacagaagctgcagtacaacttttaggaagtcttgggtatgaccccagctatggagccagaccagtgaagcgagtaatccaacaaaacgtggagaacgagcttgctaagggtatcttgaggggagatttcaaagacgaggacacaatcttaatagacacggaggtttccgtctcaaatggccaattgcctcaacagaagcttatctttagaagagtagactcctctgactcaaccgtatcttcaccttcaccggacgaccaaaaatcgttctccgaagccgtataatttccttttctagttttctctctaggaacatataaataagtctgtcacaaggtacagtaggtttctagtttgtacacagtttacttttactttcttgtagaaacaatagcatattcgattcggtaagaatttaatggttttatagaagcatggtgtgtcattttgtttcaaggatgaaaatatagatgtacatattattgtgcaaaaaaa

SEQ ID NO: 10449 - DNA, 3723 bp, Gossypium raimondii
ctctgaacaaatcaaatccccgacggactccttttttcctcactaatcgtcactaaaacaataacacactacgttactattttttgaaaaacaaacataaaagataaacgagaaactccgagaaaaaagccgcgagacaacaacaggaaaaggaagagacctattcacccttttcttttctttttcattttttcccttattctcacgcaaacccatcttcggttttttggtatttcattgtgatcacacttccctttctgaaaccttggaccgacaatggctgctgcttcttcttctgtggcgtcgtttagtggcgtcagtttatgcgctacacgttccttttctaataaaaacaatctcttttcgttacacccatgcatttctttgagcttcccttcaaaacccaactccttaaaatcgtttaaaccgcttcacttaaggaaaaatggggttctcgacaagttttccaggacttcttcaagaccttttgttgttcgttgtgaagcttcagcgggaaggattactcaacaagagttcacagaaatggcctggcaagctattgtttcttctccagatgtggctagagagaacaagcatcaaattgtggaaacagaacacttgatgaaggctctcttggagcagaagaatggtcttgctcgtaggatatttgctaaagtcggagttgacaatactcgccttcttgaagctactgacaagttcattcaacggcagccgaaggttttgggtgagtcagctggttcaatgttaggacgcgatttggaagttctaatccaacgtgctagggagtacaagaaggattatggggattcgtttgtttctgttgagcatttggttcttggatttacacaagatcaacgttttgggaagcagttgttcacagatttccagatatctgatcaatctttgaaatctgcagtggaatccattaggggacgtcagtcagttattgaccaagatcctgaaggaaaatatgaagcattggagaagtatgggaaagatttaacagcaatggcgagagaaggaaagcttgacccagtgataggaagagatgatgaaatacgcaggtgcatccagatcctctctaggagaaccaagaacaatcctgtgctgattggtgaaccaggtgtcggaaaaactgcaatctccgaggggcttgcccagagaattgtggcaggggatgttcctcaagctttgacagatcgtaagcttgtatcccttgacatgggtgcactcatagctggggctaaatatcggggagaatttgaggacagactaaaggcagtgcttaaggaagtaactgaatcagatggccaaattatcctcttcattgatgagattcacacggttgtgggggcaggtgccacaaatggtgcgatggatgcaggcaatcttctgaagcctatgcttggtcggggagaactgcgatgcatcggggcaacaacactggatgaatatcgtaaatacattgaaaaagatcctgctctggagcgtcgttttcagcaggtttatgttggtcagccatcagtagaagatacagtttctatactccggggacttcgtgagagatatgagctgcatcatggagtccgtgtttctgacagtgcacttgtggaagctgcaatcttgtctgaccgttatatcagtggtcgatttttacctgacaaagctattgacctagttgatgaagcagctgctaaattgaaaatggaaatcacttcaaaacccactgccctcgatgagattaatcgttctgtattgaagctggagatggagagactctctctcacaaatgatactgacaaagcttcgagagatagactgagccgccttgagtctgagttatccctcttaaagaagagacaggctgagttgactgagcaatgggagcatgagaagactgtcatgacacgcattcagtcaatcaaggaagaaattgacagggtaaatgtagagatccagcaggctgagcgggagtatgatctcaatcgtgctgctgagctgaaatacgggagcttgaactctttgcagcgtcaacttgctgatgctgaaaatgaattagatgaatacatgaaatccggaaaatccatgctgagagaagaagttacagggaatgatattgctgaagtcgttagtaaatggactggcataccagtttccaagcttcaacaatctgagaaggaaaaattattacatttggaggaagtattgcataaacgtgttgtgggtcaagatcctgcagttagatctgtagctgaggctattcaacgatctcgagctggtctctcggacccccgtcgtccaattgccagtttcatgtttatgggcccaactggtgtagggaaaactgaacttgcaaaggcccttgcgtcctacttgtttaatactgaagaagcccttgtccgagttgatatgagtgagtatatggaaaaacatgcagtttcaagacttataggtgctccacccggttatgtggggtatgaagaaggaggacagttgacagagattgttcgccggaggccatatgctgtaattctttttgatgagatagagaaagcccatggtgatgtgtttaatgttttccttcaaatattggatgatgggagagtcactgattctcagggtcggactgtgagctttaccaacactgttatcattatgacttcaaatgtgggttcacaatacattcttaactcagatgaggacactcctaaaaatatagcttatggaactatcaagcagagggtgatggaggctgcaagagcagtttttcgacctgagttcatgaatcgtgttgatgaatatatagtgttccagcctttggaccgcgaagaaataagcagtattgtgagattacagctggaacgtgtgcaaaagaggctttcagataagaaaataaaacttcagatcacggatgctgctgttcagcttcttggtaatcttggttacgatccaaactatggtgctagaccagtaaaaagagtgattcaacagaatgttgaaaatgaacttgccaagggcatcttgagaggggagttcaaagatgaggataccatcttggtagacaccgagcaaacggcagttccgaatggcccaatcccccagcaaaagctagtcttcaagagactcaatggtgatttggatactcaagcaataggtagtcaagaagctttatcaaagactgtctgagagttgctctttaaagtttttaccgaattaatataggttttacacaattttgagcaaaggaaatacctcagctcactttagaatctctcgcatattgtatatgacatcttttttaaagttttaccgacgattcagtgcgtcacaaataggtgctcgtggctctcaatattttctttgcttacctaactccactctggctccccaatgtcccagttccaagatgacaaatacaagaactcccataagtattcttcctgtgatatgaagtaaaatttcaaaggttggaatggataggaactgccaaatctaaagagtaatgggcagtgagccctgctgccagattgccatgccatagcatatgatgacagtatggataattgatgggcatgcacatggataatgaatttaattcatgataatctctaatatttcaaacaggcagagaacatgccagaaagggataaaattgatttttagcactatatcctacatttggtgtatgcagtataaggtatt

SEQ ID NO: 10450 - DNA, 3281 bp, Ananas comosus
ctctctcctctatctcctattgcatataaataaaggaaatatatttatttcctctttaccccctcaacaattcctctattcgtagcgagtccctcgccggaaccctaaacaaaacccccctcgcctccgccgatgtccaccgtgctcgcccccgccggggccggcgccgccgccctcgtccccgctccgtccccctctccgtctccttcgcgaggcgcggcgccgcgccgagagccgcgccgcctagggctctgagatggtccggagcgcgcggcctcggggggagcgatgcgctcttcgttaagaggtcggggaggtcccggaggggctcggaatcggtcgttgttagatgcgaagcgcccagggatgggaggattacccaacaagagttcaccgagatggcttggcaaggaattgtttcgtcacctgaggtggcgaaggagagcaagcaccagattgtggagacggaacatctgatgaaatccttgttggagcaaaagaacgggcttgctcgccgtatcttttccaaagccggagttgataataccaagcttctagatgctaccgagaggttcatccagcggcaacctaaagttttgggtgaatcggccggttctatgttaggacgggatttagaagctttgattcagcaagcccgggaatacaagaaggagtacggtgattcatttgtttcggttgagcatctagtacttgcttttgcagacgaccggcgttttgggaaacaactcttcaaggatttccaaattacccttcaaactctgaaatcttctatcgaggcaatacgaggacggcagaatgttattgaccaagatccagaaggcaaatatgaggccctggagaaatacgggaaggacttgacggctatggcacgtgaagggaagcttgatccggttatagggagagatgacgaaatacgcagatgcatacaaattctgtcgaggagaacaaaaaacaatcctgtattgattggtgaacctggtgttgggaaaactgcaatatcagaagggcttgcccagagaatagtgcaaggggatgttccgcaagctttgatgaatcgcaggctaatttccctcgacatgggtgctctcattgctggtgcaaaatatcgtggagaattcgaagatagattgaaagctgtgttaagagaagtgactgaatctgatgggcagataatccttttcatcgatgagattcacaccgtcgtgggagcaggggccacaaacggtgccatggacgcaggcaatctgctgaagccaatgctggggcggggtgagctgcgctgtattggtgcaacaacccttgatgagtatcgcaaatacatcgagaaagaccctgccttggagcggcgtttccagcaagtctttgttgatcaaccatcggtcgaggacacaatttcaatactgcgcggattgcgagagcgctacgagctccaccatggtgtccgcatctccgatagtgctctcgttgaggctgcgattctatctgaccgctatattagcgggcggtttttgcccgacaaagctattgatttggtcgatgaggcagctgctaaagtgaaaatggaaattacatctaaaccgactgctttggatgagattaatcgtgctgtattgaagctagagatggaacgactctctctcaagaatgatacagataaagcatcgaaagatagattaagtcgcctcgaagctgagttgacactgctcaaagagaagcaggcacaactaactgagcaatgggagaaggaaagatcaataatgatgagaattcagtctattaaggaagagatcgacagggtcaatttggaaattcagcaagcggaacgcgagtacgacctgaaccgtgctgctgaactcaagtatgggagcctcatcagcttgcaacgccagcttcaagaagctgaaaaggagctcgatgaatatcaaagctcgggcaagtccatgctccgcgaagaagtcactggaaacgacattgccgaaattgtgagcaaatggactggaatccctgtttccaagttacaacaatctgagagagagaaactacttcatttggaagaagagctgcacaaacgcgtagtaggtcaagacccagcggtcaaagcagtggccgatgcgatccaacggtcgagagcgggcttatcggatcctaaccgccctatcgcaagcttcatgttcatgggtccaactggtgtcgggaaaaccgagctggcgaaggccctggcttcttacatgttcaataccgaggaagcgctagttcgaatagacatgagcgagtacatggagaagcacacggtttctagactaatcggggccccgcccggttacgtagggtatgaagaaggcggccaactcaccgagacggttcgccgacggccgtatgccgtcattctcttcgacgagatcgagaaggcccattccgatgtgttcaatattttcctgcagatattggatgatggtcgggttaccgattcccaaggtcggaaagtgagcttcactaatacggttataatcatgacatcgaatgtgggatcgcaatacatactcaacatgaacgatgaggtcgaatcgaaggaaaacacttacgagattattaagagtagggtgatggaggccgcgagatcgattttccggccagagtttatgaatcggatcgacgaatacatcgtcttccagcctctggaccgcgagcaaataaatatgattgtaaggttacagctggagagggttcaacaaagactcgcggaccggaagatcacaatccaagtcaccgacgcggccttggagctcctgggaagcctcggctacgaccccaactatggcgcgaggcccgtcaagcgcgtgattcagcagcacgttgagaacgagctcgcgaaaggaatcttgaggggagagttcaaagacgaggacaccatctcagtggacaccgaggttacggcgttttccaacggccagctcccgcagcagaagctcgtcttccggaagctgaatccggagtcctcttcgggccgcccggcttccgagggtgaaaaggcattccagccgagccgttgaggggtttcttcgacttcttttttcagctatttcgccgtaaaatagtcttttacaatgtcatggcgtagtgatgctgtactaagccaaaaataactaaccaaatgcttctccctcttaagcatatggtatggtacaaaaggaaaatatatgtatacaatgtggatttttggctacttttgtcttttattgtaaatgtaaatgcaatttttt

SEQ ID NO: 10451 - DNA, 3103 bp, Amaranthus tuberculatus
atcttgctaaaaagtgctgaaatgcaggctgcatgctgaggcagcaaatagcaacccaaaaccccacaatcttcttctgttaaatcttcactcaaagcataatcacacctctcgaacttccctaaatcagtcctcaatcttatccggatttcgctcatggctactgcgacgacatcgtttcctggaacctatcttcgtgttccacccccccccccccccccccccccccccccccccccccccccccccccccccccccgtagtgtctaatggcgtcaattcaagaaaacccaattcgctagaatcattgaaatcgagtaggaattcctctaatgtttgcttatctacgagttttgggcactataggaagagttctaagtctggttcttttgttgttcgatgtaatgctgcagctggaaagattacacaacaagaattcacagaaatggcctggcaagcaattgtttcttctccagaagtggcaaaagaaaataaacaccaaatagtggagaccgagcatttgatgaaagccctcttagagcagaaaagtggacttgctcgtcgcattttttctaaagccggggttgacaatacccgtttgcttgaagcaactgataagtttatacagcggcaaccaaaggttctgggtgaatctgctggttcaatgttggggcgagattttgaaggcctaattcaaaaagccagggaatacaagaaagagtacaaagactcatttgtgtctgtggagcatttggttcttgcttttgcacaagataaaagattcgggaaacaattgttcaatgattttcggctttctgagaaattattaaaatctaccatacaagctgtaaggggacgccaatcagtcatcgaccaagaccccgagggaaaatatgaagctctggagaagtatggaaaagatttgactgccatggcaagggaaggaaaattggatcctgtaataggacgagatgatgagatacgtagaagtatccaaattctatcacgaagaacaaaaaacaatcctgttcttattggtgaacctggtgtaggtaaaactgcaattgccgaagggcttgctcaaagaatcgttgagggggatgtacctcaagctttggtgaaccgaaagttattttctcttgacatgggagcattgatagctggagctaaatatcgaggagaatttgaggaccgccttaaggctgtactgaaggaagtgactgaggccgagggtcagactatcctttttattgatgagattcacacagtagttggagcaggtgccacaaatggtgcaatggatgccggtaatcttttgaaacctatgcttggtcgtggagagttgcgatgtattggtgctactacactcgatgaatatcgtaaatacattgagaaggatccagcgttggagagacgtttccaacaggtttatgttaaccaaccaagtgttgaagatactgtctcaatacttcgtgggttacgtgagagatatgagttgcatcatggagttagaatatcggatagtgcccttgtggaggctgccatactttcagatcgctacattagtggacgttttttacctgacaaagccattgacttagttgatgaagctgctgctaaactaaagatggagataacatcaaaacctattgcccttgatgagattaaccggtctgtactgaagcttgagatggaaagactctcacttacaaatgatactgacaaagcatcaaaagagagacttaatcggcttgatacagagctttcccttttgaaggaaaagcaagccgaattgactgagcagtgggagcatgagaaaagtgtgatgacacgtttacagtctatcaaagaggagattgacagggtgaatattgagatccagcaggcagagcgagagtacgatcttaatcgtgctgctgaacttaaatatggcagcctgaactctctgcaacgacaattggaaagtgcagaaaaagagctggatgagtacatgaaatctgggaagtctatgttacgtgaagaagtgactgggagcgatattgctgaaatagtcagcaagtggacaggaattcctgtttcgaagctacaacaatcagaaagagaaaaactattgcatttggatgaagagctacataaacgtgtagtgggccaagatcctgcagttagggctgtagctgaggctattcaacgttctagagctgggctttcggatccacatcgtcctattgctagtttcatgttcatgggccccacaggtgtgggaaagacagaactggcaaaggccttggcagcttacctgttcgacaccgaggaggcccttgttagaattgatatgagtgaatacatggagaaatttgccgtctcgagacttataggtgctccacctggttatgtgggatatgaggagggaggccaattaacagaaatagtgagaaggaggccgtatgcagtgatcttatttgatgagatagagaaggcccataccgacgtttttaacgttttccttcaaattttagatgatggtagggtgacagactcacagggccgaacggtgagcttcaccaattctgtcatcattatgacttcaaatgtcgggtcacaatatattttgaatgctgacgatgaggctttatccaaggagaatagatatgaaattataaagcaaagagtgatggatgcagccagatcaatcttccgtcctgagttcatgaacagagttgatgaatacattgtcttccagcctcttgatcgtgaacagattagcagcatcgtgcaattacagctacaaagagttcagtccaggattgcagatcgtaagatgaagattcaagtgacgaatactgcagttcagcttcttggtagccttggatatgatcccaactatggtgctaggcctgttaagcgtgtaatacagcagcatcttgaaaatgagattgcaaaaggcatcttgaggggcgattataaggaagaggataccattcttgttgacacagaagtcacagcattttcaaatggccagcttccacagcagaagctggtattccgaaaactggagcctgaattctatccggctgctggagaagacaaacaaattgtttctccg

SEQ ID NO: 10452 - DNA, 3177 bp, Musa acuminata
cgagaaagaattcgcagcccattctcacaactctacctattaagtgccactgacctcttagcttttcccccaaaccacgggaacgccctcgccgcagacgaaccaagaagcgacgaacgccaaattccgccgcccatggccgccgtgttctgcgccccgcaccaccacctccccgtcctcccactgccgtcgaggaaatccgggatccgttccttctcgggctcgctcgccctccccagcccctccaagggccgtgcgtcggtgaggccccttagggtcttgaagtggtcggaaaccctcgggaggagcgatctcttcgtgtcgaagagggctgggcgggttgggaacaggtcgaggtcggttgtcgtcagatgcgaagcgaacaaggatgggaggattactcaacaagaatttactgagatgagttggcaagctattgtttcggcacctgaaattgcaaaagagagcaagcatcaaattgtagagactgaacacttgatgaaatcattactggagcagaaaaatgggcttgcccgtcgcatcttttccaaggcaggagttgataatactaagcttctagaagctactgatagattcatccagaggcaacctaaggttctgggtgagactgctggtagcatgttgggacgagatattgaaactttaattcagagggccagggaatacaagaaagagtatggtgactcttttgtgtcggttgagcatattgtacttagttatgcagatgatcggagatttggaagacaactttttaaggattttcaaatttcaataaatactctgaaatctgctgttcaagctataaggggacggcaaaatgttattgatcaagatcctgagggcaagtacgaagcactggagaaatatggaaaggatttgactgctatggcacgtgaagggaaacttgatccagtcataggaagggatgatgagataaggaggtgcatacagattttatcaaggagaacaaagaacaatcctgtattgataggtgaaccgggtgttggaaaaacggctatatcagaagggcttgcccaaagaatagtgcaaggggatgttcctcaggcattgatgaatcgcaggttaatttcccttgatatgggtgcactcattgctggggcgaagtataggggagaatttgaagatagactaaaagccgtattaagagaagtgactgattctgaaggccagatagtccttttcattgatgagatccacactgttgttggagcaggtgccacaaatggggccatggatgcaggcaatcttttgaaaccgatgcttgggcgtggagagttgcgctgcattggtgcaacaactcttgatgagtatcgcaaatacattgagaaggatccagccttggaacgtcggtttcagcaagtttatgtagatcagcctactgtggaagacacagtatccatattgcgtggattacgtgagagatatgagcttcaccatggtgtccgcatatctgatagtgcactcgtggaggctgccattctttctgatcgttatataagtggccgctttttgcctgacaaagctattgacttagttgatgaggcagctgccaagttaaaaatggagatcacatccaaaccgacggccttggatgaaatcaatcggtccgtgttgaaactagaaatggagcgactctcactgactaatgatacagacaaagcttcgaaagatagattgaaccgccttgaggctgaactgtcactcttgaaggagaagcaagctgaacttactgagcagtgggagcatgaaaaatcagtaatgacacgcattcaatccataaaagaagagattgacagggtgaatctagaaattcagcaagcagaacgtgagtatgatcttaaccgggctgctgaattgaagtatggaagccttaactctctacagcgtcaacttcaacaagcagaaaaggagctcactgaatatcaaaattcaggaaagtcaatgcttagagaagaggtaactggaaatgacattgcagaaatagtcagcaaatggacaggtattccggtgtccaagctgcaacagtctgagagggaaaagctgctgcacctggaagaagaactccacaagcgtgttgtaggtcaagaccctgcagtgagagctgtggcagaagctatccaacggtccagagctggtctctcagacccaaaccgtcccattgctagtttcatgttcatgggaccaacaggggttggcaagaccgaattggcaaaaacacttgcttcttatatgttcaacactgaagaagctttagtgagaatagatatgagcgagtacatggaaaagcatgcagtgtcaagattgattggggccccacctggttatgttggatacgaagagggaggacagctgactgagactgttcgcaggaggccatatgctgttattttgtttgatgagatagagaaggcgcattctgatgtgttcaatgttttcctgcagatactggatgatggtcgggtgactgattcacagggccggacagtgagttttaccaatacagtcatcattatgacatcaaacgtgggttctcagtacatcttgaatatgaacgatgaaaccgagtcaagggattcaacctatgagtcgatcaagcagagggtgatggatgctgctaggtccttatttcgccctgaattcatgaatcgagttgatgagtatattgttttccagcctctggaccgggagcagattaacagcattgtcaagttacagttggagagagtacagaagcgagttgccgaccggaagatcaagattgaggtcaccgatgcggcagtcgagtttctcggaaatctcggatacgatcccaactacggtgctaggccggtgaagcgtgttattcaacagaatgtggagaatgaactagcaaaaggtattctcagaggagacttcaaggatgaggacactgtgttagtggacacagaagtcactgttttctccaatggccagcgtcctcagcagaagttggtgttccgtaagctgctggacgcagattcttccgataagccttcctccgaagaccagaaggccttcttgcctagtcgttgaccgtgggtctcctcctccaagacaccatgcaatttggaggccagtctatcttttcataatcttgcaatggaggagaacacattg

SEQ ID NO: 10453 - DNA, 3160 bp, Aquilegia formosa
cttccttttattagaataaagattgaaactttattttaaatttctaacaatggagacaattcacactggtttacaatttcgaattccaccaatttcatcaaagagttgtagtgggaggagtgttttgtttgctcggtcacagttttcattgaatccaaagactgttattaaaccattaaaaacttctaaagctttgaatttgaagaagaatgatatgctttttactacttctagaggaggaggaggaattcaaagatttgggaagaagaagaattctgcttttgttgttcgatgtgaaactcaatctaatggaaggattacacaacaagagtttactgaaatggcttggcaaggaattgtttcgtcgccagaagtggcgaaagagaataaacatcaaattgtagagacagaacatttaatgaaagctttacttgagcaaaagaatgggcttgctcgacgaatctttacaaaggctggagttgataatactcgcttactagaagctacagataaattcattcaacgacaacctaaggttctaggtgaatcctctgggtccatgttagggagagatttggaagcattaattcagagagccagggatttcaagaaagaatatggcgattcgtttgtttcagtcgagcatttagtacttggttttgtgcaagatcagcgttttgggaaacaattatttaaggattttaaaatttcacttaaggccttaaaaactgccattgagtctgtaagaggaagacaaaaagtcattgaccaagatcctgagggtaagtacgaagcattggagaagtatggaaaagatttgacagccatggcacaggcaggaaagcttgatcctgttataggaagagatgatgagatacggagatgcatacagatcctctcaaggagaacaaagaacaatcctgtgctgattggtgagccaggtgttggaaaaactgcaatatcggaaggacatagaagggtgatttttttttttcgggatgttgattattacaggcttgctcagagaatcgtggaaggagatgtccctcaagctctgatgaaccggaagttgatatcccttgacatgggcgcactcattgctggagcaaaatatcgcggagaatttgaggataggttgaaagctgttctgaaggaagttactgattctgacgggcaaattatacttttcatcgatgagatccacaccgtagttggggcaggtgccactaacggtgcgatggatgctggcaatcttttgaagcctatgctaggtcgtggagagctgcgatgtattggtgcaacaacacttgatgaataccgtaaatatattgagaaagaccctgccctggagcgtcgtttccagcaagtttatgttgatcaacctacagttgaagatacagtttctatcttacgaggattgcgcgagagatatgaattacatcatggagttagcatttctgatggtgcacttgtggaggctgcaattctttcagatcggtacatcagtggccgctttttgccagacaaagctattgatctagttgatgaggcagctgctaaattgaaaatggaaattacttcaaaaccaactgctttggatgagatcaaccgttcagtattgaagatggagatggagcggctttctctgacaaacgacaccgacaaagcttcaaaagataggttggatcgccttgaagcagaactctctctcttaaagacaaagcagaaagagttgactgagcaatgggagcacgagaaatctgtcatgacacgcattcaatccatcaaagaagagattgacaggttaaatcttgagatccagcaagcagaacgcgagtatgaccttaatcgtgccgccgaactgaagtatggaagcgttatgactttgcaacgccagcttgtagatgcagaaaaggaattggatgaatatttgaagtctggaaagtccatgcttagagaagaagttacagggagcgacattgctgaaatagtcagcaagtggacgggtatccccgtttctaaactgcaacagtctgagagagagaagttgctacatttggaagaagaactacataaacgtgttgtgggtcaaaacccagcagtgacatccgtggcggaggccattcaacggtcacgagcaggactatctgatcctcataggcccattgctagcttcatgttcatgggtcctactggggttgggaagactgaactagcgaaagcgcttgcttcttacatgtttaacactgaagaagcccttgtgcggattgacatgagtgagtatatggagaaacatgcagtttcaagattgataggcgctccaccaggttatgtgggatacgaggaaggtggacagctcacagaggtagtccgcaggaggccttattctgtaatcttgtttgatgagattgaaaaggctcattctgatgtgtttaatgtattcctacaaatattggatgatggaagggtgacagactcacaaggccgtactgtgagctttaccaactctgtgttaattatgacttcaaatgtggggtcacaatacatacttaacacagatgatgaaagttcagcaaaggattatgagaccataaagaatagagtgatggaggccgcaagatcaattttccgtcctgaattcatgaacagggttgatgagtacatagttttccagcctcttgatcgcgaccagataaacagtatagtaagattacagttggaacgtgtacagaaaagaattggagatcggaagatgaaaatccaggtgacagaagcagctgttcagcttttaggaagccttggatatgaccctaactatggtgccaggccggtcaagcgagtgattcaacagaatgtggaaaatgaacttgccaagggtatcttaagaggggaattcaaagacgaggacactatcttaatagacacagaagtcagtgcattcgctaatggacagcttcctcaacaaaaattagtgtttaagaaagtgaattcggactcagaagccccagcggagaaagatgagaaagctttttcagagagttccatatagtgtagtcaatgtagatcatattaagaaaaagtttcagctttttttgtatactaaatctctttcagtatgttgaatagaaatctgaaatcaaaagaaagggcagtaaagatc

SEQ ID NO: 10454 - DNA, 3569 bp, Arabidopsis thaliana
gtcgtagtgggccaatctcgttatcaacggcccaaaattcgggaaactatatattaattattattttctgctatatttttggacggttcatattaattctacttcgaaaaatcctaagttttctgagagtgaacacgtgtcagaagaaggtctcagtagtaagtacatcccgatggttcacgaagactccggcgtcgtttagcaacttcttcttcttctttattagttttctacttcaccttttctcttggttctcgctaaaactacacgagaaagcaaaagcgtttctctttgctgatttcttaagtaaacatctcgccgttttggtggatttgtgctaaactacctgttgtatttgatcttcctttttcaattgcttgctgttcttaaatttccgagctaatggcgacggctacgacgactgctacggcggcgtttagtggtgtagtcagtgtaggaacggagactcgaaggatttattcgttttctcatcttcaaccttctgcggcttttccggcgaagcctagttccttcaaatctctcaaattaaagcagagcgcgaggctcacacggcggcttgatcatcggccgttcgttgtccgatgtgaagcttcttcttctaatggaaggcttacacagcaagaattcacagaaatggcgtggcaatcgatagtttcgtcaccagatgttgcaaaagagaataagcaacagattgtggagacagagcatctaatgaaagctcttttggagcagaagaatggtttagctcgtaggattttctctaagatcggtgtggataacacaaaggttctagaagcaacagagaagttcattcaacgccaaccaaaggtgtatggagatgctgctggttcgatgttggggcgtgatttggaagctctgttccagagagcaagacagtttaagaaagatttaaaggactcttatgtgtcagtggagcatttggttcttgcttttgctgatgataagcggtttgggaaacagttgtttaaggattttcagatatcagagaggagcttgaaatctgcaattgaatccattagagggaaacaatcagtcattgaccaagatccggaaggcaagtatgaggcgttggagaagtatggaaaagacttgacagcaatggcaagagagggaaaactagatcctgtgataggtagagatgacgagatccgaagatgcattcagattctctcaaggagaacaaagaacaaccctgtgttgatcggtgaaccaggtgttggtaaaactgcaatttcagaaggacttgctcagaggattgtgcaaggagatgtacctcaagcattgatgaacagaaagttgatatctcttgatatgggtgctctcattgctggagcaaagtatcggggagaattcgaagacagactaaaagctgtgcttaaggaagtcacagactcagaaggccaaatcattttgttcatcgatgagatccatacagttgttggtgcaggtgcgactaatggggccatggatgctggtaatctgctgaaaccgatgctgggccgaggcgagttacgttgtatcggtgcaaccacgcttgatgaatataggaaatacatagagaaagatccagccttggagcgtaggtttcaacaggtttatgttgatcaacctacggttgaagacacgatttctattctccgtggtttgcgggaaaggtatgaactacatcatggagttcgcatctcagatagtgctctagtggaagctgctatcctctcagaccgttacatcagtggccggtttctacccgataaagcaattgacttggtcgatgaagcggcagccaaattgaaaatggaaatcacttcgaaacctacagctcttgacgagcttgaccgttcggtaataaagcttgaaatggagaggctttcacttaccaatgatacagacaaagcttctagagagagattgaatcgaattgaaactgagttagtgctattaaaggagaaacaagctgagttaactgaacagtgggagcacgagaggtctgttatgtcccgtcttcagtcgattaaagaggagattgatcgagtaaacctcgagatccagcaggcggaacgtgaatacgatctcaaccgtgcagctgagctcaaatacggaagcttaaactcattgcagcgacagcttaatgaagcagagaaagagctgaacgagtacttaagctctgggaaatctatgttcagagaagaggttttgggtagcgatatcgccgagattgtgagtaaatggactggaatcccggtatcaaaacttcaacagtctgaacgagataagcttctacatttggaagaagaattgcataaaagagtagtcggtcaaaacccagcagtgactgcggtagctgaagcaatccaacgatcaagagctggtctttcggatccaggccgtcctatagctagtttcatgtttatgggaccaactggtgttggtaaaacagagctagccaaagcacttgcttcttatatgttcaacactgaagaagctttagtgagaattgacatgagtgaatacatggagaagcatgcggtgtctaggctcattggagctccacctggatatgttggttacgaagaaggaggacagttaacagaaacggttagaagaaggccttattcggtcattctatttgatgagattgagaaagctcatggagatgtcttcaatgtgtttctccaaatcttggacgatgggcgagtcacagattctcaaggacgtacagtgagtttcaccaataccgtcattattatgacctcaaatgttggttcgcagtttattctgaacaacacagatgatgatgctaatgagctctcttatgaaacgattaaagagagagtgatgaatgctgcaaggtcaatctttcgtcctgaattcatgaatagggttgatgagtatatagttttcaaacctcttgaccgcgagcagatcaaccgcattgtccggttacagctggcacgtgtgcagaagcgaattgcagacaggaaaatgaagataaacatcacggatgcagcagtcgatcttcttggaagcctagggtatgatccaaactatggagctagacctgttaagcgtgtgatacagcaaaacattgagaatgagcttgctaagggtatcttgagaggagatttcaaggaggaagatggcattttgatcgataccgaggtcacagcgttctccaatggccagttacctcagcaaaagctcacattcaagaagattgagtcagaaacagcagatgctgaacaagaagaagcagctttctcaaaatagagtagttgaaaatgcaaccttttggagcccaagaagattcagacttttcagtacagaacttctagtgagttacttgtcacaaaagactgataatatttatctcaatgtgagagtttatataaatcataagcttatgagtcattgtactgatgtctcaaaggtccagaggttatgaaaattgttgatcataatttgactgtatatgaatgttgaagaatctctgcagatacaataaatttagcagtagtacacaaatttac

SEQ ID NO: 10455 - DNA, 2902 bp, Gossypium hirsutum
ccgcttcacttaaggaaaaatggggttctcgacaagtttccaggacttcttcaagacctttttgttgttcgttgtgaagcttcagcgggaaggattactcaacaagagttcacagaaatggcctggcaagctattgtttcttctccagatgtggctagagagaacaagcatcaaattgtggaaacagaacacttgatgaaggctctcttggagcagaagaatggtcttgctcgtaggatatttgctaaagtcggagttgacaatactcgccttcttgaagctactgacaagttcatccaacggcagccgaaggttttgggtgagtcagctggttcaatgttaggacgcgatttggaagctctaatccaacgtgctaggcagtacaagaaggattatggggattcgtttgtttctgttgagcatttggttcttggatttacacaagatcaacgttttgggaagcagttgttcacagatttccagatatctgatcaatctttgaaatctgcagtggaatccattaggggacgtcagtcagttattgaccaagatcctgaaggaaaatatgaagcattggagaagtatgggaaagatttaacagcaatggcgagagaaggaaagcttgatccagtgataggaagagatgatgaaatacgcaggtgcatccagatcctctctaggagaaccaagaacaatcctgtgctgatcggtgaaccaggtgtcggaaaaactgcaatctctgaagggcttgcccagagaattgtggcaggggatgttcctcaagctttgacagatcgtaagcttatatcccttgacatgggtgcactcatagctggggctaaatatcggggagaatttgaggacagactaaaggcagtgcttaaggaagtaactgaatcagatggccaaattatcctcttcattgatgagattcacacggttgtgggggcaggtgccacaaatggtgcgatggatgcaggcaatcttctgaagcctatgcttggtcggggagaactgcgatgcatcggggcaacaacactggatgaatatcgtaaatacattgaaaaagatcctgctctggagcgtcgttttcagcaggtttatgttggtcagccatcagtggaagatacagtttctatactccggggacttcgtgagagatatgagctgcatcatggagtccgtgtttctgacagtgcacttgtggaagctgcaatcttgtctgaccgttatatcagtggtcgatttttacctgacaaagctattgacctagttgatgaagcagctgctaaattgaaaatggaaatcacttcaaaacccactgccctcgatgagattaatcgttctgtattgaagctggagatggagagactctctctcacaaatgatactgacaaagcttcgagagatagactgagccgccttgagtctgagttatccctcttaaagaagagacaggctgcgttgactgagcaatgggagcatgagaagactgtcatggcacgcattcagtcaatcaaggaagaaattgacagggtaaatgtggagatccagcaggctgagcgggagtatgatctcaatcgtgctgctgagctgaaatacgggagcttgaactctttgcagcgtcaacttgctgatgctgaaaatgaattagatgaatacatgaaatccggaaaatccatgctgagagaagaagttacagggaatgatattgctgaagtcgttagtaaatggactggcataccagtttccaagcttcaacaatctgagaaggaaaaattattacatttggaggaagtattgcataaacgtgttgtgggtcaagatcctgcagttagatctgtagctgaggctattcaacgatctcgagctggtctctcggacccccgtcgtccaattgccagtttcatgtttatgggcccaactggtgtagggaaaactgaacttgcaaaggcccttgcgtcctacttgtttaatactgaagaagcccttgtccgaattgatatgagtgagtatatggaaaaacatgcagtttcaagacttataggtgctccacccggttatgtggggtatgaagaaggaggacagctgacagagattgttcgccggaggccatatgctgtaattctttttgatgagatagagaaagcccatggtgatgtgtttaatgttttccttcaaatattggatgatgggagagtcactgattcccagggtcggactgtgagctttaccaacactgttatcattatgacttcaaatgtgggttcacaatacattcttaactcagatgaggacacacctaaaaatatagcttatggaactatcaagcagagggtgatggaggctgcaagagcagtttttcgacctgagttcatgaatcgtgttgatgaatatatagtgttccagcctttggaccgcgaagaaataagcagtattgtgagattacagctggaacgtgtgcaaaagaggatttcagataagaaaataaaacttcagatcacggatgctgctgttcagcttcttggtaatcttggttacgatccaaactatggtgctagaccagtaaaaagagtgattcaacagaatgttgaaaatgaacttgccaagggcatcttgagaggggagttcaaagatgaggataccatcttggtagacaccgagcaaacggcagttccaaatggcccaatcccccagcaaaagctagtcttcaagagactcaatggtgatttggatactcaagcaacaggtagtcaagaagctttatcaaagattgtctgagagttgctctttaaagtttttaccaaattaatataggttttacacaattttgagcaaaggaaatacctcagctcactttagaatctctcgcatattgtatacgacatcttttttaaagttt

SEQ ID NO: 10456 - DNA, 3384 bp, Eucalyptus grandis
gctaaattaggctgtgcatagatgaagagtgagctgctaaatggatgaatgtgtatatgtagcttctttggggtggtgtttgtaatatgtataatcagatttgtccacttgaacccaataaattattgattttgtagctctgtcaaatgacagatcacacagcaagaatttacagagatggcctggcaagggattgtttcctcaccagacattgcgaaagagaataaacatcagatagtggagactgagcacttgatgaaggctctgttggagcaaaagaatgggcttgcccggcggatcttctccaaggctgcagttgacaatacccgtcttctggaggctactgataagttcatccaacggcaaccaaaggtccttggcgagtcagctggctcaatgttaggacgtgatttagaagccttgatcagtcgagctagggaatttaagaagcagtatggggattcgtttgtctctgttgagcacttggttcttggttttgcacaggatcaacgatttggaaaacaattattcagggattttcaaataactgagcagaagttgaaatctgcggtagaagcagtaagaggacgacagtctgtaattgatcaagatccagagggaaagtacgaagctctggaaaaatatgggaaggatttgacagccatggcaagagctggaaagcttgatcctgtcataggaagagatgatgaaatacgcaggtgcattcaaattctttccaggagaacaaagaataaccctgtgctcattggtgagcctggcgttgggaagactgcaatatcagagggacttgcccagagaattgtgcaaggtgatgtaccacaggctttgatggatcgtaagcttatatcccttgatatgggtgccctgatagctggagcaaaatatcggggggaatttgaagataggctaaaagctgtactgaaggaagtaactgaatctgaaggccaaataatcctctttatagatgaaatacatacggtcgttggtgcaggtgctacaaatggtgcaatggatgctggtaacttattgaagccaatgcttggacgaggggaattgcgctgtattggtgcaacgacacttgatgagtaccgcaaatatatcgagaaggatccagctttggagcgccgtttccagcaagtgtatgtggatcaaccttcagttgagaacacaatatcaatacttcggggattgcgtgaaagatatgaactgcatcatggagtccgaatctctgacagcgcactggtagaagcagcaattctttctgaccgatatataagtggccgatttctacctgacaaagctattgatctagtggatgaagcagctgctaagcttaagatggaaattacttcaaaaccaactgctctcgatgagatcaatcgatcagtcttgaaactggagatggagaagctgtcactagcaaatgatacagacagggcttcaaaagataggttgagccgccttgaggcagagttggctctcctgaaggaaagacaagctcagcttactgagcaatgggagcatgaaaagtcagtcatgacacgtatacagtctatcaaagaggagattgacagagtaaatctcgaaatccagcaagctgagcgggaatatgacctcaatcgtgctgctgaattgaagtatgggagcttaattgcattgcagcgccaacttgaagatgcagaaaaagagctagatgagtatatgcgctctggaaaatctatgcttagagaagaagtaacgggaagtgatattgctgaaattgttagtaagtggactggtatcccagtctccaagctgcagcagtcagagagggagaagttattacatcttgaagaagaattgcataagcgtgttgtgggtcaagatcccgcagtgatatcagttgcagaagcgatccagcggtctcgagcaggattgtcagatcctcaccgacctatagctagttttatgttcatgggtcctacaggtgttgggaaaacagagttggcaaaggcccttgctgcttatttgttcaacactgaggaagcactggtacgaatcgacatgagtgagtatatggagaagcatgcagtttcaagattaataggtgctccacccggttatgtagggtatgaggaaggaggtcaattgacagaaacggttcgcagaagaccttatgctgtcattctcttcgatgagatagagaaagctcactctgatgtgtttaacgtatttcttcagattttagatgatgggagggtgactgattcacagggtcggactgtgagcttcactaacacggtcataattatgacttcaaatgtgggttcacagtacattctaaataccgatgatgacactatgcccaaggaaactgcttatgagaccatcaaacagagggtaatggatgctgcaaggtctatctttcgcccagagtttatgaatcgggtcgatgaatatatagttttccagcctctggaccgtgagcagattaatagcattgtgaaattacagttggagcgtgtacagaagagaatcgcagatcggaaaataaaactagtagtgacggatggagccatccaactgctagggagtcttggctatgatccaaactatggtgcaaggccagtcaagcgggtgattcagcagcacgttgaaaatgaactagccaagggcatattgaggggggacttcaaggacgaagacaccatcgtagtagacacagaagttacagcatttgccaatggtcaacttcctcagcagaagttggtgtttaggaaacaggatggcgactcagatatggccgccacaggagaccgagaagccatctcgccttctgcctgatggttttgagtaattattcccctatttaaggttctggatcagttcttttcttatacagcaacatatataggtctcacaccttttcttttctcttcttttacggcgggaacgacgcggcttatgccggtgaacgttttgtaacttatacatgctccacatgaagtgtataatgtgagaataatccttcaagagttcacatagaaaagcacatgatctttgctctccaagattcgcggttgcagaccattttgagcgtggtgcacgtcctggcttcttttgcagacgcctgccggacgatgaaatacttgtactccgtatctatcgtcgccttacctttatgactgggcacttgtttatccaccggcaacttggacatgcacgaagttgttagtgaggaccaacgcattgtggagaacaattacggtactggaaactcggctcgagcctggcggagcttattactacctgttggttgccggctgataacatcccgcctcttttttgttcggttgcaaatccaatttaattgcgaatgcaagg

SEQ ID NO: 10457 - DNA, 3001 bp, Nicotiana benthamiana
attggtacgtaatggcagattactcagcaagaatttactgaaatggcatggcaagcaattgtttcatcgccagaaatagcgaaggagaacaagcatcaaatagtagagactgagcacttgatgaaggcactgttggagcagaagaatggactggctcgtcgtatattctccaaggcaggtgtagataatacccggcttttagaggctaccgacaaatttattcagcgccaaccaaaggttcttggtgagtcagctggttctatgttaggccgggatttggaaggtctgatacagagagccagagagttcaagaaagagtacaatgattcctttgtgtcagttgaacatttggtgcttggcttcgcacaagataaacgatttgggaagcaattgtttagtgatttccagataacccagaagacactgaaagatgccatccaatccataagggggcgacaaaatgttattgatcaagatcctgaggggaagtatgaagcactagaaaaatatggaaaagatctaactgctatggcaagagcaggaaagcttgacccagttataggcagagatgatgagattcgtagatgcatacaaattctctccaggagaacaaagaataacccagtattaattggtgagcctggagttgggaaaactgcaatctctgaagggcttgcgcagagaattgtgcaaggagatgtacctcaagctttaatgaatcgacggttgatatctcttgatatgggtgcgctgatagctggtgcaaaataccgtggcgaatttgaagacagattaaaggctgtgcttaaggaagtgacagactctgaagggcagatcatccttttcattgatgagatacatactgttgttggggcaggtgccactaatggtgcaatggatgctggaaatctcttgaaaccgatgctcggtcgaggagaattacggtgtattggtgcaactaccttggatgaataccgtaaatatatcgagaaagatcctgctctcgagcgtcgttttcagcaagtttatgttgaccagcctacagttgaaaataccatctctatacttcgtggactgcgtgaaagatatgagctgcatcacggggtccgcatttcagacactgcacttgttgatgctgcagtactctccgaccgttatattagtggacgctttctacctgacaaagcaattgatctagttgatgaagcagctgcaagactgaaaatggagattacctcaaaacctactgccctggatgagatcaatcgtgctgttttgaagttggagatggagaggctatctctaactaatgatacagataaagcatcaaaagatcggttaaaccgccttgaggctgaattgtctcttttaaaggagaaacaagcagagctgactgagcagtgggagcatgaaaaaactgtcatgactcgcatacagtcggttaaggaagagattgacagggtaaatcttgagatccagcaagcagagcgggaatatgatcttaaccgtgctgcggaactgaagtatgggagtcagaactccttgcagcgtcaacttgcagctgcagaaaaagaactagatgagtatatgaagtctggaaaatcaatgctcagagaagaagtgactgggaatgatattgcggagatcgtcagtaagtggactggaattcctgtttctaagttacaacagtcagagcgggaaaagctgctgcatttggaggaagagctacacaaacgtgttgtcggtcaagatccagcagtgagagcagtagcagaggcaatccagcgctcgcgtgccggactttcggatcctcatcgtcctattgccagctttatgttcatgggtcccactggagttggaaagacggagctagctaaggcgcttgctacctatttgttcaatactgaagaagcacttgtgcgcattgatatgagtgaatacatggagaagcatgcagtttcaagattgataggagctccacctggttatgtcgggtatgaggaaggagggcagttgacagagattgttcgcaggagaccatatgcagtcattttgtttgatgagattgaaaaagcccatgcagatgtatttaatgtcttcctccaaatcttggatgatggtagggtgactgactcacaaggacgcactgtgagtttcactaatactgtcatcatcatgacatcgaatgttggttcacaatatatcctcaatacggatgatgatgatttacctaaggaaacaacttatcaaacaataaagcaaagggtgatggaggctgcgcgtgcagtattccgtcctgaattcatgaatcgggttgatgaatatatagtattccagcctcttgatcgccaccaaatctgtagcattgtgcgattacagcttgagagagtacaacagagattagctgatcgcaaaatgaagattcaagtgagcgatgctgctattcaactgcttgggaatcttggttatgatcccaactatggagcacggccagtgaagcgggtgatccagcaaaatattgagaatgaattggccaaaggaatcttaagaggagatttcaaggatgaggacactgttttaatagacactgaggtcacagcattctccaatggacaacttccccagcagaagctagtgtttagaagatcaggatctggttcagattctccagcagagaacgaaaaagctttctctcagaaactatgaggctgcgcataagtatcttacactcggaaactagacgatgcacactacgatctgcttgcttgtattatagattttggatataggtctttcacggctttgaatagctaatacatatacttgaataatattgagtttttgtcttttatataacatcttagcttgaagaaatttgagggcggtgcacccgtgctttgtgcaatcttggctaaagagtggaggttgacttcaaaagtgagataataggttatatgtattaatttcaagatgaattaacaaatgaggaagttaccatgtc

SEQ ID NO: 10458 - DNA, 3129 bp, Manihot esculenta
gtgtttgtttttctattttgttttctttgatttcttctggctgctgctccggcaatggcagcgacaactacggcgtcgtttagtggagttagtctccgtcctccttattcacgtcagagcaataggagtgggttgttttcgcagtctttaagcttcactgcaaaacggaattctctcaagtcgcttttattgaagaggagtggctttggttatgagaagatttcgagaactcaaaggtccttcatcgtcaggtgtgatgcttcttctactggaaagatttctcagcaagattttacagagatggcatggcaaggaattgtttcttctccagacgtggccaaagagaacaagcatcagattgtggagacggagcacttgatgaaagctctattggagcagaagaatggacttgctcgccggatcttttcaaaaattggggttgataatactcgtcttttggaagctactgataagtttatccaacggcaacccaaggttcttggtgaatctgctggttcaatgttaggacgtgatttggaggctttgatccagcgagccagggaatacaagaaagactatggtgattcatttgtttctgttgagcatttggtccttgcgttcactcaggatcgacggtttgggaggcagttgtttagggattttcagatatctctgcagacactgaaatctgcagtggaatcaataaggggccgtcaatcagtcatagaccaagatcctgaagggaagtatgaagctctagagaaatatggaaaagatttgacagccatggcaaaagcaggaaagcttgacccagttattggaagggatgatgagattcgtagatgtattcagatactctctagaagaactaaaaacaaccctgtgctgattggtgaaccaggtgttgggaaaactgcaatttctgaagggctggctcagagaatagtgcaaggggatgtacctcaagctctgatgaataggaagctaatatcacttgacatgggttcactcattgctggggctaaatatcggggagaatttgaagatagactgaaggctgtacttaaggaagttacagagtcagatggtcagattattcttttcattgatgagatccacacggttgttggggcaggtgctacgaatggtgcaatggatgcgggcaatctgttgaagccaatgcttggccgtggagagttaaggtgtattggtgcaacaacactggatgaatatcgaaaatacattgagaaggatccagccttggaacgtcgtttccagcaagtttatgtagatcaaccttcagttgaagatacaatttccattcttcgtggactacgtgaacgatatgagctgcatcatggagttcgcatttctgacagtgctcttgtggaagctgcaattctttctgatcgttacatcagtggaagatttttacctgacaaagctattgatctagttgatgaagcagctgcaaagctgaaaatggagatcacttcaaaacctactgcccttgatgaaattgaccgttcagtattaaaattggagatggagaaactctctcttgcaaatgatacagatagagcttcaaaagatcggttgaatcgtcttgaggctgagttgtcagtgttaaagaagaaacaagaagagctgacggagcaatgggaacacgagaagacagtcatgacacgaattcaatcaattaaggaagagatagacagggtaaatcttgagattcagcaggctgagcgtgagtatgatcttaatcgtgctgctgaactgaagtatggtagcctgaactctttgcaacgccagcttgaagttgctgagaaagagttggatgagtatatgagatctggaaagtccatgctgagagaagaagttactggagatgatattgctgaagttgtcagcaagtggactggtatccctgtttccaagctcaaacaatcagaaaaagagaagcttctacatttggaggaagagctgcataagcgtgtggtgggtcaggatcctgcagtgaaatcagtagctgaggcaattcagagatctcgtgctggtctctcagatcctcggcgtccaatagctagcttcatgttcatgggtcccactggtgttggaaaaacagaattagctaaagctctggcttcttatatgttcaataccgaagaggcccttgtgcgaattgacatgagtgaatacatggaaaagcatgcagtttcaaggttgataggtgcccctcctggttatgtgggatatgaggaaggtggacagttgacagagacagttcgcaggagaccatatgccgttattctctttgatgagatagagaaggcccatgctgatgtgttcaatgtcttccttcagatcttagatgatggaagggtgacagattcacagggccgcactgttagtttcactaatactgtcataatcatgacttccaatgtgggttcacaatacatactcgacacagatgatgacatgccaaaggaggtagcttatgaaactatcaagaagagggtgttggaagctgcaagatcaatctttcgacctgagttcatgaatagggttgatgaatacatagttttccagccgctggatcgcaatcagataaacagtattgtcagattacagttagaacgtgtgcagcagaggatttcagataggaagatgaaactgcaggtgacagatacagctgtggagcttttagggagtcttggatatgaccccaactacggagctaggccagttaagcgggtgattcaacagtatgttgaaaatgaacttgccaaaggtatattaagaggggaatttaaggatgaggacactgtatttatagacacagaggttacagcattttccaatggccagcttccccagcaaaagctagtcttccagcggcttgaaattgatgcaaatgcttcagctgccgaaagccaagctgtttcacaggctctttgaaacgtcttttagtttatgcaaattataacgctggtataaacaggttctctgcttacgatactaagcaggatactagaggaactttgtcttgtacagtgtcacccgcagcaaatataaagccacaaggaatgttgctactttttggaagtattttattggttgacttgc

SEQ ID NO: 10459 - DNA, 3248 bp, Amborella trichopoda
aagaagatcaatggcttcagcagctgctggtttcgcctttaatcaacaaattccccaaatttctctctctaacctctctcttaggcacaagaacaaccaatcattttgttctcggagttcattaaagataccccattgccctttgagcagtagaagggcgctctctacattgaaaacaggagtcacccaccacagaaactccctcttttctactagaaatgtggagagattcaaaagaaattctcgctttgttgttcgatgcgaggccccaaaggatggaaggattactcagcaagaatttacagagatggcatggcaagctattgtttcatcacctgaagtggcgaaggagagtaagcaacaaattgtagagactgaacacttgatgaaagcactgcttgagcaaaagaatggccttgctcgccgtatcttctcgaaggctggagttgataacactcgactccttgaagccacggagagtttcattcagagacaacccaaggttctgggtgagacctctggatctatgttagggcgtgaccttgaagccctgattcagagatctagagactacaagaaagaatatggtgattcttttgtctctgtggaacacttagtgcttgcctttgctcaagaccaacgatttgggaagcaattatataaagaatttcaaatttttctcaagacccttacttctgccatacaatctataaggggtcgacagacagttattgatcaagatcctgagggaaagtacgaagccttagataaatatggggtggatttgactgctatggctaaagaaggaaagctcgatccggttataggaagggacgatgaaatccgtagatgcatacaaattctttcaaggagaaccaagaacaatcctgttctgattggggaaccaggtgttgggaaaaccgcaatagctgaggggcttgcgcaaagaattgttcaaggggatgttcctcaagctctgatgaaccgcaagttgatatctttggacatgggtgcgcttatagctggagccaaatttaggggagagtttgaggataggctcaaagccgtactgaaggaagtgactcaatcagatgggcagataattctcttcattgatgaaattcacacagttgttggagcaggtgctacaaatggagccatggatgctggaaatttgttaaagccgatgcttggtcgtggagaattacgatgtattggagcaaccactcttgatgaataccgaaaatatatcgagaaagatccagccttggagcgccgttttcaacaagtttatgttgatcagccctcagttgaagatacaatttctatcctccgtggattaagagaaaggtatgagctacaccatggggtccgcatctctgatggtgctctagtagaggctgcaattcttgcagaccgttatataagtgggcgatttttgcctgacaaagcaattgatctagttgacgaggcagctgcaaagctcaagatggagataacctcgaaaccgactgcattggatgaaataaaccgctccgtgttaaagcttgaaatggagcgtctctctcttactaatgacactgacagagcttcgaaagatagattggcgcgccttgaggcagagcttactctcctgaaggcaaagcaagaagagctaacccaacaatgggagcatgagaaatccgtaatgactcgcattcagtctattaaagaagagattgatagggtaaaccttgaaattcaacaagcagagcgtgactatgacctcaatcgagcagccgagctaaaatatggaagcctcatgtcattgcaacaccaattagaagtcgctgaaaaggagttagatgagtaccaaagctctggtaaatctatgttaagagaagaagtcacagctgatgacatagcggagatagttagcaaatggacgggcataccagtctcaaaacttcaacaatcagagcgtgaaaagcttctctacttagaagaagagctccacaagagggtcgtagggcaaaacgaggctgtccgagctgtggccgaagcaattcaacgttcaagagctggtctctcggacccgcatcgcccaatcgccagtttcatgttcatgggtcctacaggtgttggtaaaactgagctagccaaagccttggcttcatatttgttcaacactgaagaagccttagtgagaatagacatgagtgagtatatggaaaggcacacagtttctcgattaattggagctccaccaggttacgtgggttatgaggaaggtgggcaattaactgaggttgttaggcgaaggccttatgcggttattcttttcgatgaaattgagaaggcccatagtgatgtttttaatatttttcttcaaattttggatgatgggagggttaccgattcacaaggtagaaaagtgagctttacaaatacagtaattattatgacttcaaatgtgggttctcaatatatattgaatgcggatgatgagccattctctggggactcggcttatgaggttatcaagaggagagtgatggaggctgcgaggtcgatctttaagcctgagtttatgaatcgggttgatgagtttatagttttcaggccattggatcgcgagcagatcaacaaaattgtgagattgcagttggagcgtgtgcaagagcggctaaatgatcgaaagataacattaaaagtgagcgactcggctgttgagctcttgggaagcctcggatatgaccccaactatggggcaaggcctgtaaagagagttattcagcaatacgtcgagactgaattggcaaaacgtatactaagaggagaattcaaagatgaagacaagatcttagttgacactgaaatcacatctctctctaatgggcagctccctcaacaaaagttggtctttaagagggtgaccccagattcagattcttcttctgtggtgggccaaagaactctttcaaccagcctgtgaaatgggtagcctctctctcttccccccctagaaaccaaacacattctcaaccagcctattagggaaggcttctccccccattctcacatataagggacaattgaactcttgctccctttctcaacttaaaaatcaaaaaaagagagtgggtgtctccacccatcttgagatatgtataatctcctgttatgaaattctctctcaatatacatatgaccatatttgtatcatatggttttcttcagtgaatacaagttttggttttgatacgtaa

SEQ ID NO: 10460 - DNA, 3045 bp, Brassica napus
cgctgaaactaaagcagagcgcgaggctcactcgaagacttcaacatcaaccgttcgtcgtccgatgcgaagcttcttctaatggaaggcttacacagcaagagttcacagagatggcgtggcagtcgatagtctcttcaccagacgtggctaaagagaacaagcagcagatcgtggagacggagcatctcatgaaagctcttttggagcagaagaacggtttagctcgcaggattttttcgaagatcggtgtggataacaccaaggttcttgaagctacggataagttcattcaacgccagccaaaggtgtatggagaagctgctggttcgatgcttggacgtgatttggaagggttgtttcagagggcgagacagtataagaaagacttaggggactcttatgtctctgttgagcatttggttcttgcttttgttgatgataagcggtttgggaagcagctgtttagggattttcagatatctgagaagagtttgaaaactgctattgagtccattagagggaaacaatcagtcattgaccaagatccggaaggcaagtatgaggcgttggagaagtatggtaaagatttgacagcgatggcgagagaaggaaagcttgatcctgtgattggaagagatgatgagatccgtagatgcattcagattctctcaaggaggactaagaataaccctgtgttgatcggtgaacctggtgttggtaaaactgcaatctcagaagggcttgctcagaggattgtgcaaggagatgtgcctcaagcattgatgaacagaaagttgatatctcttgatatgggggcacttattgctggagcaaagtatcgaggagaattcgaagatagactaaaggctgtacttaaggaggtcacagactcagaaggccaaaccatcttattcatcgatgagatccacacagttgttggcgcaggtgcgactaatggggcaatggatgctggtaacctactaaaaccaatgctaggtcgaggcgagctacgctgtataggcgcaacaacgcttgacgaatacagaaagtatatagagaaagatccagccttggaacgcaggtttcaacaggtttacgttgatcaacctaccgtggaagacactgtttcgatcctccgcggtttgagagaaaggtacgaactccatcacggagttcgcatctcagacagtgctctagtggaagccgccatcctctctgaccgttacatcagcggccggttcctacctgacaaagcaatcgacttggttgatgaagcagcagccaaactaaaaatggaaatcacttcaaaacccactgctctcgacgagctcgaccgtgcggtgatcaagctcgaaatggagagactctcactcaccaacgacacagacaaagcttcaagagagagactaaaccgaatcgaaacggagttagtcttactaaaggagaagcaagcggagttaaccgagcagtgggagcacgagaggtccgtcatgtcccgtctccaatccatcaaagaggagatagaccgagtaagcctcgagatccagcaagcggagcgcgaatacgatctaaaccgcgcagcagagctcaaatacggaagcctaaactctttacagcgtcagttaaacgaagctgagaaggagcttaatgagtacttaagctctggcaagtctatgttcagagaagaggtgttaggcagcgacatagcagagatcgttagcaaatggactggcatccctgtgtcgaagcttcaacagtccgatagagataagcttctacacttggaagaggagctgcatagacgagtaataggtcagaaccctgcagtcacggccgtagccgaagcgattcaacggtccagagccggcctatcggatccgggccgtccgatagcttccttcatgttcatgggaccgacgggagtcggcaaaaccgagctggccaaggccctcgcttcttacctcttcaacacggaggaagctctggtgaggatcgacatgagcgagtacatggagaaacacgcggtttccaggctcatcggagctcctcccggatacgtgggctacgaggaaggagggcagttgacggaagtggttaggagaaggccatactcggtcatactcttcgacgagattgagaaggctcatggagatgtgttcaacgtgtttctccagatcttggacgatgggagggttactgactctcagggacgtacggtgagtttcaccaatacggttattatcatgacctcgaacgttggctcgcagtatatcttgaacagcaacgcggatgatgaggggagtgagcttggttatgagacgattaagcagagagtgatggatgctgcgagatcgatctttcgtcctgagtttatgaatagggttgatgagtatattgttttccagcctcttgaccgtgagcagatcaacagcatcgtccggttacagctggctcgtgtgcagaagcggattgcggataggaaaatgaagatagagatcacagatgcggcggtggatcttctcggaagcctcgggtatgatccgaactacggagctagacctgtcaagcgtgtgatacagcagaacattgagaacgagctcgccaaaggtatcttgagaggagatttcaaggaagaagatgggattctgatcgatacagaggtcacagcgttctccaatggtcagttacctcagcaaaagctcacattcaaaaagattacgtcagaaacggcagatgctgagaaggaggaagaagaagctttctcaaaacagagcaattgaaaaacgacaccttttggagcccaagaagtttcggactttatagtacatagcttctagtgagttggttgtgacagaacagaatgataacatttatctcaatgtgagatataaaccataagctaataagttattgtgctgatgtctcaaaatccatattctctgaaaatgcaatatatagtaacgttatatagttctcctgtgacctcttatatagttgggcttgtatttattagagcatgaattaatccatgtacttttaaaa

SEQ ID NO: 10461 - DNA, 3544 bp, Solanum phureja
cactctctctatccgctgcaacttctcgttttttcttcctttcttttttctcttctcgtttttcttcattcttctggaacgttgagataacagaatagtatattttgttcacaatatgtctactgtgacgtcattttccggcgtacagttttgcgttccttcttcttcttccaattcttcaagcagagtagctttattttcatcgcattcagcgccgtacctgaacttctcaggaaaatcgcgagttcttgacaagtgtaattcgttgaaactgaagaggaaggatgtgttcttcactagaaaaactgagaaactctcccagggttcaaggcttaccatacgttgtgatgcttcaagtggaaggatcactcagcaagattttacggaaatggcatggcaagcaattgttgcatcgccagaaatagcgaaagagaacaagcatcaaatagtagagactgaacacttgatgaaggcactgttggagcaaaagaatgggctggctcgtcgtatattctccaaggcgggtgtagataatacccgccttttagaggctactgataagtttattagacaacaaccaaaggttattggtgagacagctggttctatgttaggccgagagttggaaggtttgatgcagagagccagggagtacaagaaagagtatggtgattcctttgtgtcagttgagcatttggtgcttggcttcgttcaagataaacgatttgggaagcaactgtttaatgatttccagatttccctgaagacattgaaaactgccattgaatccataaggggacgccaaaatgttattgatcaaggtaatgagttctttctataattggtggactacttgcatatgtggatcttgtcaataagtttaacaacaaccttactttcccaacacatgctcatctgcaatatatcctcataacttttccatttctcaaaatatcttgtttatcactcttgcagatcctgaagggaagtatgaatcactagaaaaatatggaaaagatctgaccgctatggctagagcggggaagcttgacccagttataggaagagatgatgagatacgtagatgcatacaaatcctctccaggagaacaaagaataacccagtgttaattggtgagcctggagttgggaaaactgcaatctctgaagggcttgctcagagaattgtgcaaggagatgtacctcaggctttgatgaatcgaaagttgatatctcttgatatgggtgcgctcatagccggtgcaaaatatcgcggtgaatttgaagacagattgaaggctgtgcttaaggaagtgacagaatccgaaggacagatcatcctttttattgatgagatacatactgttgttggtgcaggtgccactaatggtgcaatggatgctgggaatctcttgaaaccaatgcttggtcgaggagaattacgatgtattggtgcaaccaccttggatgaataccgtaaatatattgagaaagatcctgccctggagcgtcgtttccagcaagtttatgttgaccagcctacagttgaagacactgtctccatacttcgcggattacgtgaaagatatgagctgcatcatggggttcgcatttcagacacggcgcttgttgacgcagctattctttcggaccgttatattagtggacgttttctacctgacaaagctattgacctagttgatgaagctgctgcaaaactgaaaatggagatcacctcaaaacctacagcccttgatgagatcaatcgtgcagttttgaagttggagatggagaggctatctctaactaatgatacagatagagcatcgaaagatcggttaaaccgtcttgaggctgaattgtctcttttgaaggagaggcaagctgagctgactgagcagtgggagcatgaaaaaagtgtcatgactcgcttacagtccattaaggaagagattgacagggtaaatcttgagatccagcaagcagagcgggaatatgatcttaatcgtgctgctgaacttaagtacgggagtctaaacaccttgcagcgtcaacttgaagctgcagaaaaagaactgagtgattatatgaagtctggaaaatcgatgctcagagaagaagtgactgggaatgatattgcagagatcgtcagtaagtggactgggattcctgtttctaagttacaacagtcggagagggaaaagctgttgcatttagaggaagagttgcacaaacgtgttgttggtcaagatccagcagtaagagcagtagcagaggcaatccagcgctcgcgtgctggactttcagatcctcaccgtcctattgcaagctttatgttcatgggtcccactggagttgggaagacggagctagctaaggcccttgctaactatttgttcaatactgaagaagcacttgtgcgcatcgatatgagtgaatacatggagaagcatgcagtttcaagattgataggagctccccctggttatgtcgggtatgaagaaggggggcagttgaccgagattgttcgcaggagaccgtatgcagttatattgtttgatgaaatagagaaggcccattcggatgtatttaatgtgttccttcaaatcttagatgatggtagggtgactgactcacaaggacgtacagtgagtttcaccaatactgtcatcatcatgacatcaaatgttggttcgcaatatatcctaaatacagatgatgatgataattcatcaaaggaagcgacttatcaaacaataaagcgaagggtgatggatgctgcacgtgcagttttccgccctgagttcatgaatcgggttgatgaatatatagtattccagcctcttgatcgtgaccaaatcagtagcattgtgcgattacagcttgagagagtgcagcagagattagctgatcgcaaaatgaagattgaagtgagcgaagctgctattcaactgcttggaagtcttggttatgaccccaactatggtgcacggccagtgaagcgggtgatccagcagaatgttgagaacgaattggccaaaggaatattaagaggagaattcaaggatgaggacactattttagtagacacagaggtcagcgcattctccaatggacaacttcctcagcagaagctagtgtttaaaagacaagaatcttgttcagattctccagcagagaaccaagaagctttctctcagaaactatgagactgcacctcaatatattgttgttcagatacgtactatgagttcgagcatctaaatagtatctagattttggatatacatactgcacggctttgaatagcaaatacctacacagttgaaggagttctgttttcatatagtaataaatcgcatactagcctgtagatagttgtcggttgttcacccacgctttgtgcaatcttttagctatatatatgaatggaggtcgacttctaaacatgagataaaaggggaaggaacatgggggaggggattacaaagtggagaatcaaacatcaagtgaaagttcaaagtaataaaccaactgggctatt

SEQ ID NO: 10462 - DNA, 2843 bp, Cichorium intybus
gaacaaacatcagattgtggagactgaacatttgatgaaagccctgttggaacagaagaatgggctagccagacgaatcttctccaaggctggtgtggataacacccgcctgcttgaagccactgataagtacattcaacgccaaccaaaggttattggtgaatcagctggctcgatgttagggagggatttagaagccctaatgcagagagctagagattacaagaaagaatatggtgactcttttgtgtctgttgagcatttagtgcttggttttgtgcaagataaccgatttggaaaacaactgttcaaagatttccaaatttcattaaaaaccttaaagaacgcaatagaatccatcagaggtcgacaaacagtcatagaccaagatcctgaagggaaatatgaatctttagagaagtacggtaaagatctgaccgctatggctagggcaggaaaacttgaccccgtaataggaagagatgatgaaatacgcagatgcattcaaattctatcaagaagaactaaaaacaaccctgttctcattggtgaaccaggtgttggtaagactgctatttctgaaggacttgctcagagaatagtgcaaggtgatgtacctcaagctctaatgaaccgaaagttaatatcccttgacatgggtgcacttattgctggagcaaaataccgcggagaatttgaagatcgactcaaggcagtgctgaaagaggtcacagaatcagacggacagatcattcttttcattgatgagattcatactgttgttggggcaggggctacaaatggtgcaatggatgcaggcaatctgttgaaaccaatgctgggtcgtggagagttgcgatgcattggtgcaacaacattggacgagtaccgtaaatatatcgaaaaagatcccgctttagaacgccgctttcaacaagtctatgttgaccaaccgactgtagaagatacggtttctatcctccgtggactgcgcgaaagatacgagctccatcacggtgtacgcatttcagatagcgcgcttgttgaagccgcaattctctcggatcgctacatcagtggtcgctttttaccagataaagcgattgatctggtggatgaagcagctgcgaaactgaagatggagatcacttcaaagccaactgcacttgatgagattaatcgttcggttttgaaattggaaatggagaggctatcgctcactagtgacacagataaagcctcgaaagatcggttgagtcgactcgaggctgagttggctctgttgaaagagagacaagctgagttgaatcaacaatgggagcatgaaaaaggtgtcatgacaaatatgcagtctattaaagaggagattgacagggtgaatttagagatacaacaagcggaacgcgagtacgatttgaaccgggctgctgagttaaaatacgggagtttgaactctttgttacgtcaacttgaaactgctgaaaaggaattagtggaatacatgagttccgggaaatcgatgcttagggaagaagttacaggtgatgacatagctgaaattgtaagcaaatggaccgggattccactttccaaactcaaacaatccgagcgggaaaaactcctacacttggaggaagagttgcacaaacgggtcgtgggccaggatccggctgtgacagctgttgccgaggccatccaacggtcgagagccggtttatcagatcctcaccgtccaatagcgagcttcatgttcatgggacccactggagttggaaaaaccgagctagcaaaagcacttgcttcttacctgttcaacactgaagaagctcttgtacggatcgacatgagcgagtacatggaaaaacacgcggtttcgcgattaatcggcgcgccacctggatatgttgggtacgaggaaggcgggcagttgaccgagacagtacggaggcgaccttacgcggttattctttttgacgaaatcgaaaaagctcatgcggatgttttcaatgtgtttctccagattttagatgacggaagggtgaccgattcgcaaggtcggaccgttagtttcactaatacagtcatcatcatgacatcaaacgtcgggtcccagtacatactagacacggatgatgactcaatatcgaaagaacgcacttacgagactataaaaaatagagtgatggatgcagccaggtcgatcttccgtcccgagtttatgaaccgggttgacgagtatatagtcttccaaccgcttgaccgttcacaaatcaacagaattgttcggttacagttggaacgcgtacagaagaggatagcggatcggaaattaaagataaatgtaagtgaagctgcggttgagcttttggggagtcttgggtatgacccgaactatggtgctagacccgtgaagcgggtgatccaacaacatgtggaaaatgagcttgccaagggaattttgagaggtgactttaaggatgaagacacgatatcagtggacacggaagttacggcgttttcaaacggtcaactcccgcaacagaagttggtgttcaagagagtggacacgtcaccgggtgatacacctaaggatcaagaagctttctcacaaactttctagaggtttatgattttgcatatgtagatgatgatacataagtttatacggaacatcatggtttaccattagcgacaacatatttttatctagcatgtttaataaatgcttatgctatggggagtctttttgccacttatgaatatcaaaaatcctatctatttgatctcatagattccaagtctagagaatcagtaatctattactttgcaagtgtttgttgatc

SEQ ID NO: 10463 - DNA, 2760 bp, Papaver somniferum
gtatttggtagtcgtaagtggttcttctacttctacttacaggcgtttcttctttcttttgttgttagtatgtgaagctcctaaagataggaaagattacccaaacaagaatttacaggagatggcatggcaagctattgtttcatcgccagaagtggcaaaagacaacaaacatcaaattgtagagactgagcatttgatgaaagccctgctggagcagaaaaatggcctggctcgacgcatttttgccaaggtgggagttgataatacccgccttctggaagctactgataaattcatccaacgacaaccaaaggtttttggtgaatcagctggttctatgttagggagggatttggaagctctcattcagcggtccagggactacaagaaagagtacaatgattcctttgtttcagttgagcatttgttacttggttatgtgcaagatcaacgttttgggaaacaattgttcaaggatttccaaatttcgctcaagagtctgaaatctgcaattgaagccataaggggtagccagaaggttatggaccaagatcctgaagggaagtatgaagccttagagaagtatggaaaagatttgacagctatggcacgggcgggaaagcttgatccagtcataggaagggatgatgagatacgtagatgcatacagatcctgtcaaggagaactaagaataatcctgtacttattggtgaacccggtgttgggaaaactgcaatatcagaagggcttgcccagagaattgtacaaggagatgttcctcaagctcttatgaaccgcaagttggtttcgcttgacatgggtgcactaatagccggtgcgaaatttcgtggagaatttgaggatagattgaaagctgtactcagagaagtaactgaatcggacggccagacagtgctgttcattgatgagatccacacagttgttggggcaggtgccacaaatggtgccatggatgcaggaaatctgttgaagcctatgcttggtcgtggagaactgcgatgcataggtgcaacaacactcgatgaatatcgcaaatatattgaaaaagatcctgccttggaacgtcgcttccagcaagtttatgttgatcaacctacagttgaagatacaatatctatattacgagggctgcgtgaaaggtacgagctacatcacggtgtccggatatctgacaatgcacttgttgaggctgctattctgtctgatcgctatatcagtggacgttttttgccggataaagctattgacctagttgatgaggcagcagctaaattgaaaatggaaattacttccaaacctactgccctggatgagatcaatcggaccgtgttaaagttggaaatggaacgtctctctcttgtgaatgacacagacaaagcatcaaaagatagattaagtcgtcttgataccgagctatctatcttaaaggagaaacaaactgaactgactgagcagtgggagcatgaaaaaaatgtcatgacacgcattcaatccattaaagaggaggttgacagggtaaatctggagattcagcaagcagagagagagtatgacctcaatcgtgctgctgagttgaagtatggaagtctcaatgctttgcaacgccagcttgaagttgctgaacaagagttgagtgaatatcttaaatcagggaaatccatgttgagggaagaggttgccggaagtgacatagctgaaatagttagcaattggactggaattcctgtttcaaagctgcagcagtcagagagacaaaaactattacatctagaggaagagttgcataaacgtgttgtgggtcaagacccagctgtgcaagcagtagctgaggccatccaacggtctcgagcaggtctttcagatcctcaccgccccattgccagtttcatgttcatgggtcctactggtgtgggcaagacggaactagctaaaacccttgcttcctacatgttcaacactgaagagtccctcgtcagaattgacatgagtgagtacatggagaaacattctgtctcaagattgataggagcaccacctggctacgttgggtatgaagagggtgggcagctcacagagacagtacgaaggaggccgtacgctgtaatcctgtttgacgaaattgagaaggctcattctgatgtgtttaacgtattccttcagattttggatgatgggagggtcactgactcacagggtcgaaccataaacttcaacaacactgtcatcattatgacttcaaacgtggggtctcagtatttgctcaacacagatgatgatgaaacttcaatgggttttgcatatgaaaccattaagcaaagggtgatggatgctgccaggtccgtctttcgtcctgaattcatgaatcgtgtggatgagtacatagtcttccagccccttgaccgcgagcagatcaacagtattgtgaaattacagttggaacgagtacaaaagagaattgcagataaaaagatgaaaatcaaggtaacagaagctgcagtacaacttttaggaagtcttgggtatgaccccagctatggagccagaccagtgaagcgagtaatccaacaaaatgtggagaacgagcttgccaagggtatcttgaggggagacttcaaagacgaggacacaattttaatagacacggaggtttccgtctcaaatggccaattgcctcaacagaagcttatctttagaagagtagactcctctgactcaaacatatcttcaccagacga

SEQ ID NO: 10464 - DNA, 2597 bp, Fagus grandifolia
agcttcatgcaatatcattttggaaaacacagccaattacaaagagagtgatccttatcctcctcgtattatttaatttattttatatataaaagggagtcacaatcttcattaccgagagcgaattactttgtttttggctgcttctgttttccaacaaaggacaatcggaggatctttgaatttcatagtgaaatcgctctgagtctctctcagattagattttgggggcttcggttagggttttctgtttctttcaatctaggaaatggcgggcgttgatcatctagcgagcgagagaagcaaagctcggttcgatgtgggtgagatgaagatcgtctgggctggctctcgccacaccttcgaagtctccgatcgcatttctcgcctcgtcgccagcgatccggtctttcgaaaggataacagagccatgctaggtagaaaggagttatttaaaaatactctgagaaaagcgagtcatgcgtggaaacggatccttgagcttcgactttctgaggaagaggcatccaggttaaggtttttgttggatgagcctgcttttacagatcttcactggggcatgtttgtaccagctattaaagggcaaggcactgacgagcagcaacaaaagtggttgccgttggcatacaagatgcaaataattggttgctatgcacaaactgaacttggtcatgggtctaatgttcaagggcttgaaacaactgcaacatttgatccccaaacagacgagttcattattcatagtcctactttgacttcaagcaaatggtggcctggtggattgggtaaagtttccacacatgctgttgtttatgctcgtcttatcactgatggcaaagactacggtgtgaatggtttcattgtccagctgcggagtttggatgatcacttacctcttccgggcataaccattggtgatattggaatgaaatttggaaatggagcatacaacagcatggacaatggtgtattaaaatttgatcatgttcgcatcccaaggggtcaaatgttgatgagggtttcacaggttacaagggaaggcaaatttgttcaatccgatgttccgcggcagcttgtttatggtaccatggtatatgtgcgacaaacaattgtagctgacgcttcctgtgctttatcacgggcagtttgtattgctactaggtatagtgctgttcgtagacaatttggttcgaataacgatggtgttgagacccaggtgattgattacaaaactcaacagagtaggctctttcctttgctggcttcagcttatgctttcagatttgttggcgagtggttaaaatggctctatacggatgtgacccaaaggttgtcagccaatgatttctcaacattacctgaggctcatgcatgcactgcgggtttgaagtctttgactacatctgcaactgctgatgggattgaagcatgtcggaaattatgtggtggccatggttacctttgtagcagtgggttaccagagctatttgcagtttacgtccctgcctgtacatatgaaggagacaatgttgttctgcttttacaggttgcaagatttcttatgaagactgtttctcagcttgggtctgggaagaagcctgttgggaccacagcttatatggggagagtggaacagttgatgcaatcccgctgtgacgttcaaagagctgaggattggttaaagcccagcgtcatacttgaggcatttgaagctaggtctgctagaatgtctgttgcctgtgctcaaaaccttgccaagtttgaaaatcaggaagagggctttgcggaactgtcagctaccttagctgaggcagcagttgctcattgccaattaattgttgtttccaagttcattgagaaactgcaacaagacatacctggaaagggagtgaaagaacagttagagatcctctgcaacatatatgctttgtttcttcttcacaatcatctaggtgatttcctctccactggaagcatcacttccaagcaaggttcacttgcaaatgatcagctaagatctctgtattcccaggctcgtccgaatgcagttgcccttgttgatgcatttaactacactgaccactaccttggctcggttctcggacgatatgatggtaatgtgtatccaaaactctatgaggaggcatggaaggatcctttgaatgactcagttgtgcctgatggctaccatgaatatatccggccactcctgaagcaacagctccacaatgcaaggctttgaagaatatataacaattatgcagatgaatccacacatttgaacatttatattctattattgcagattttattattgttaataaagctactaagatgatgccccaccagaagggggggattgttggcgggaatatccggagcagccctttgtatcacataaggtggcattctggtcgataagttaatcatgatttggctcccaaaaaaaactaaagaaaaatgataacggatgtgtggtaaaagcactgtttgatgcctcatcacatatttgtgttgacccttttgtggttctggttcttgtagtttatgatacttcttgtttcactgcttaaatt

SEQ ID NO: 10465 - DNA, 2328 bp, Castanea mollissima
gtttgtaggaaatggcgagagttgatcagctagcgagcgagaggagcaaagctcagttcgatgtggatgagatgaagatcgtctgggctggctctcgccacaccttcgagatttccgatcgaatttctcgcctcgtcgccagcgatccggcctttcgaaaggataacagggctatgcttggtagaaaagagttatttaaaaatactctgagaaaagcagctcatgcatggaaacggatcattgagcttcgtctcactgacgaagaggcatccaggttaaggttttatgtggacgaacctgcttttacagatcttcactggggcatgtttataccagctattaaagggcaaggcaccgacgagcagcaacagaagtggttgccattggcatacaagatgcaaattattggttgctatgcacaaactgaacttggtcatggttccaatgttcaagggcttgaaacaactgcaacatttgatccccaaacagacgagttcattattcatagtcctacattgacttcaagcaaatggtggcctggtggattgggtaaagtttccacacatgctgttgtttatgcacgacttatcactgatggcaaagactacggtgtgaatggtttcattgttcagttgaggagtatggatgatcactcacctcttccgggcataaccattggtgatattggaatgaaatttggaaatggagcatacaacaccatggacaatggtgtattacaatttgatcatgttcgcatcccaagggatcaaatgttgatgagggtttcacaggttacaagggaagggaaatttgttcaatccaatgttccgcggcagcttgtttatggtaccatggtatatgtgcgacaaacaattgtatctgatgcttcctgtgctttatcacgggcagtttgtattgctactcggtatagtgctgttcgtagacaatttggttcgaataacgatggtgttgagactcaggtgattgattacaaaacacaacagaatagactctttcctttgctggcttctgcttatgcgttcagatttgttggtgagtggctaaaatggctttatacggatgtgacccaaagattgcaagccaatgatttctcaacattacccgaggctcatgcatgtactgcgggtttgaagtctttgactacttctgcaactgctgatgcaattgaagaatgccggaaattatgtggtggccatggttacctttgtagcagtgggctaccagagttatttgcagtttacgtccctgcctgtacatatgaaggagacaacgttgttctacttttacaggttgcaagatttcttatgaagactgtttctcagcttgggtctgggaagaagcctgttgggacaacagcttatatggggagagtggaacatttgatgcaatccagctgtgatgctcgaaaagctgaggattggttaaagcccagtgtaatactggaggcatttgaagctaggtctgctagaatgtctgttgcctgtgctcaaaaccttgccaagtttgcaaatccagaagagggctttgctgaactctctgctgacttaactgaggcatctgttgctcattgccaattaattgttgtttccaagttcattgagaaactgcagcaagacatacctggaaagggggtgaaagaacagttagagattctatgcaacatatatgctttgtctcttcttcacaaatatcaaggtgatttcctctccactggcagcatcacttccaagcaagcttctcttgcaaatgatcaactaagatctctgtattcccaggttcgtccgaatgcagttgcccttgttgatgcatttaattacactgaccactaccttggttcagttcttggacgatacgatggtaatgtgtatccaaaactctatgaggaggcatggaaggatcctttgaatgactcagttgtgcctgatggctaccatgaatatatccggccactgttgaagcaacagctccgcaatgcaaggctttgaagaatatgtaacaattatgcagataattccttacaatccaacataataatattggggttttattattgttaataaagcgatgatccctcaccagaaggggttgcgttgaagaatatatgacaataaacatttatggtctatttactgtgggtttttattattgttaataggaagatcctacaccaaaagaaaaattttctgaaaaattttctaggatcgttttataagacttccctctcacaacgtgtgggttccacatgtgagagatgtctcatgaatctcatgagcagccatttgtatcacataacatggtcatagattc

SEQ ID NO: 10466 - DNA, 2659 bp, Quercus alba
gtcgtttattctcagaataaacgacgtcgtctaaagttgatgggttttgttcttctgattcttcgtggtcttcgttggttatctttttagccccacacaaaaaacaccaatcaaaggcgcattcaaagaaagaaagaaagaaatttgtagtgaaattgatttctctctctctctttctctgtgagattagataattggtgtttcgcttccgttagggcttttgttgagtgtttgtaggaaatggcgagagttgatcagctagcgagcgagaggagcaaagctcagttcgatgtcgatgagatgaagatcgtctgggctggctctcgccacgccttcgagatttccgatcgaatttctcgcctcgtcgccagcgatccggcctttcgaaaggataacagggctatgcttggtagaaaggagttattcaaaaatactctgagaaaagcagctcatgcgtggaaacggataattgagcttcgtctcactgacgaagaggcatccaggttaaggttttatgtggacgaacctgctttcacagatcttcactggggcatgtttataccagctattaaagggcaaggcactgacgagcagcaacagaagtggttgccattggcatacaagatgcaaattattggttgctacgcacaaactgaacttggtcatggttccaatattcaagggcttgaaacaactgcaacatttgatccccaaacagacgagttcattattcacagtcctacattgacttcaagcaaatggtggcctggtggattgggtaaagtttccacacatgctgttgtttatgcacgactaatcactgatggcaaagactacggtgtgaatggtttcattgttcagttgcggagtttggatgatcactcacctcttccgggcataaccgttggtgatattggaatgaaatttggaaatggagcatacaacaccatggacaatggtgtattacaatttgatcatgttcgcatcccgagggatcaaatgttgatgagggtttcacaggttacaagggatttgttcaatccaatgttccgcggcagcttgtttatggtaccatggtatatgtgcgacaaacaattgtatctgatgcttcctgtgctttatcacgggcagtttgtattgctactcggtatagtgctgttcgtagacaatttggttcaaataacgatggtgttgagactcaggtgattgattacaaaacacaacagaatagactctttcctttgctggcttctgcttatgcattcagatttgttggtgagtggttaaaatggctttatacggatgtgacccaaagattgcaagccaatgatttctcaacattacccgaggctcatgcatgtactgcgggtttgaagtctttgactacttctgcaactgctgatgcaattgaagaatgccggaaattatgtggtggccatggttacctttgtagcagtgggctaccagagttatttgcagtttacgtccctgcctgtacatatgaaggagacaacgttgttctacttttacaggttgcaagatttcttatgaagactgtttctcagcttgggtctgggaagaagcctgttgggacaacaggttatatggggagagtggaacatttgatgcaatcccgctgcgatgctcaacgagctgaggattggttaaagcccagtgtaatactggaggcatttgaagctaggtctgctagaatgtctgttgcctgtgctcaaaaccttgccaagtttgcaaatcaagaagagggctttgctgaactctccgctaacttaaccgaggcatctgttgctcattgccaattaattgttgtttccaagttcattgagaaactgcaacaagacatacctggaaagggggtgaaagaacagttagagattctatgcaacatatatgctttgtctcttcttcacaaacatcaaggtgatttcctctccactggcagcatcacttccaagcaagcttctcttgcaaatgatcaactaagatctctgtattcccaggttcgtccgaatgcagttgcccttgttgatgcatttaattacactgaccactaccttggttcggttctgggacgatacgatggtaatgtgtatccaaaactctatgaggaggcatggaaggatcctttgaatgactcagttgtgcctgatggctaccatgaatatatccggccactgttgaagcaacagctccgcaatgcaaggctttgaagaatatgtaacaattatgcagataattccttacaatccaacataataattttggggctttattaatgttaataaagcgatgatccctcaccagaaggggttgcgttgaagaatatatgacaataaacatttatggtctatttactgtgggtttttattattgttaataggaagatcctacaccaaaagaaaatttttctaggatcgttttataagacttccctctcacaacgtgtggattccacatgtgagagatgtctcatgaatctcatgagcagccatttgtatcacataacatggtcatagattctatcatatgctctcttttttctttttctttttttgttaaaattctatcatatgctctagcaaaaaaagatattatatgctctaattttgatcctccatgggaaatctctcccatcttatct

SEQ ID NO: 10467 - DNA, 2329 bp, Castanea mollissima
tgagattagataattggggtttcgcatcggatagggcttttgttgagcgtttgtaggaaatggcgagagttgatcagctagcgagcgagaggagcaaagctcagttcgatgtggatgagatgaagatcgtctgggctggctctcgccacaccttcgagatttccgatcgaatttctcgcctcgtcgccagcgatccggcctttcgaaaggataacagggctatgcttggtagaaaagagttatttaaaaatactctgagaaaagcagctcatgcatggaaacggatcattgagcttcgtctcactgacgaagaggcatccaggttaaggttttatgtggacgaacctgcttttacagatcttcactggggcatgtttataccagctattaaagggcaaggcactgacgagcagcaacagaagtggttgccattggcatacaagatgcaaattattggttgctatgcacaaactgaacttggtcatggttccaatgttcaagggcttgaaacaactgcaacatttgatccccaaacagacgagttcattattcatagtcctacattgacttcaagcaaatggtggcctggtggattgggtaaagtttccacacatgctgttgtttatgcacgacttatcactgatggcaaagactacggtgtgaatggtttcattgttcagttgaggagtatggatgatcactcacctcttccgggcataaccattggtgatattggaatgaaatttggaaatggagcatacaacaccatggacaatggtgtattacaatttgatcatgttcgcatcccaagggatcaaatgttgatgagggtttcacaggttacaagggaagggaaatttgttcaatccaatgttccacggcagcttgtttatggtaccatggtatatgtgcgacaaacaattgtatctgatgcttcctgtgctttatcacgggcagtttgtattgctactcggtatagtgctgttcgtagacaatttggttcgaataacgatggtgttgagactcaggtgattgattacaaaacacaacagaatagactctttcctttgctggcttctgcttatgcgttcagatttgttggtgagtggctaaaatggctttatacggatgtgacccaaagattgcaagccaatgatttctcaacattacccgaggctcatgcatgtactgcgggtttgaagtctttgactacttctgcaactgctgatgcaattgaagaatgccggaaattatgtggtggccatggttacctttgtagcagtgggctaccagagttatttgcagtttacgtccctgcctgtacatatgaaggagacaacgttgttctacttttacaggttgcaagatttcttatgaagactgtttctcagcttgggtctgggaagaagcctgttgggacaacagcttatatggggagagtggaacatttgatgcaatccagctgtgatgctcgaaaagctgaggattggttaaagcccagtgtaatactggaggcatttgaagctaggtctgctagaatgtctgttgcctgtgctcaaaaccttgccaagtttgcaaatccagaagagggctttgctgaactctctgctgacttaactgaggcatctgttgctcattgccagttaattgttgtttccaagttcattgagaaactgcagcaagacatacctggaaagggggtgaaagaacagttagagattctatgcaacatatatgctttgtctcttcttcacagatatcaaggtgatttcctctccactggcagcatcacttccaagcaagcttctcttgcaaatgatcaactaagatctctgtattcccaggttcgtccgaatgcagttgcccttgttgatgcatttaattacactgaccactaccttggttcggttcttggacgatacgatggtaatgtgtatccaaaactctatgaggaggcatggaaggatcctttgaatgactcagttgtgcctgatggctaccatgaatatatccggccactgttgaagcaacagctccgcaatgcaaggctttgaagaatatgtaacaattatgcagataattccttacaatccaacataataatattggggttttattattgttaataaagcgatgatccctcacgagaaggggttgcgttgaagaatatatgacaataaacatttatggtctatttactgtgggtttttattattgttaataggaagatcctacaccaaaagaaaaaatttctgaaaaattttctaggatcgtttgataagacttccctctcacaacgtgtgggttccacatgtgagagatgtctcat

SEQ ID NO: 10468 - DNA, 2531 bp, Citrus clementina
attcaatgtcaaaagaagcccaaataagcacgtgctgtgaaatgtgaatatcgcatcgaaaaaggggaaaaggaaatgaaaacgtgtatgagcaacggcagcaagtcagcaaccttatcaattcataattaactggtggtccctttcctataaataagctctgggtggttagttaaacgccattcggaacaaataagctataacagaagaggagctttccttttgcaagttgtaatcgatcaataattatatatatttattttttatctgaatcaaatcgatcgatcatggacggggttgatcagcttgctcctgagaggaagaaggcacagttcgatgtcgacgagatgaagatcgtgtgggccggctcccgccacgccttccaagtctccgatcggattgctcgcctcgtcgcctccgatcctgcctttcgcaaggataacagggctatgctaagtaggaaggagttgtttaaaaacacactgagaaaggcagcttatgcatggaaacggatcattgagcttcgtcttagtgaagaagaagcatctatgttaaggtcttctgtggatgaacctgcttttacggatctccattggggaatgtttgtaccagctattaaaggacagggcaccgatgagcagcatcagaagtggttaccattagcatataagatggaaataattggctgctatgcgcaaactgagcttggtcacggctccaatgttcaggggcttgaaaccactgcaacttttgatccccagacagatgaatttgtcgttcatagtcctacgcttacttcgagcaagtggtggcccggtggattgggtaaagtttctacgcatgctgttgtttatgcacgtcttattactgatggtcaggaccatggagtaaatggtttcattgtacagctccgaagcttggaagatcactcacctcttcccggcataaccattggtgatattggaatgaagtttggaaatggagcgtataacaccatggacaatggtgttttgagatttgaacatgtgcgcatccctaggaatcaaatgttgatgcgggtttcacaggtaacaagggaagggaagtatgtgcaatctaatgtaccgaggcagttgctttatggcacaatggtgtatgtacgacaaacaatagtagctgatgcttcctgtgccttatcacgggctgtttgcattgctacaaggtatagtgctgtccgtagacaatttggttcaaagaatggtggccccgagacccaggtgattgattacaaaactcagcaaaatagactcttcccattgctggcgtccgcctatgctttcaggtttgttggtgagtggttgaaatggctttatacggatgtgacccaaagattgcaagccaatgatttctcgacgttgcctgaggctcatgcatgtactgcaggattgaagtctctgactactactgccactgctgatgggattgaagaatgtcgaaaattatgtggtggccacggttacttatgtagtagcggcttgccagagttatttgcagtttatgtgcctgcctgtacatatgaaggagacaatattgtgctgctcttacaggttgcaaggtttctcatgaagaccgtatctcagctgggatccggaaatatgcctgttgggacaacaacttatatgggacgggcagaacaattgatgcaatgtcattgtggcgtccaaaaagctgaagattggttaaatccttctgccatactggaggcctttgaagcaagggctattaggatgtctgtggcctgtgctcaaaacctgagcaagtttacaaatcaagaagagggttttgcggaactggcagctgatttagttgaggcagctgttgctcattgccagctaattgttgtttccaagtttattgagaaattgcagcaggacataccaggaaagggggtgaaaccaattttggagatcttatgcaacatctatgctttgcatcttgttcacaaacatctaggtgatttcgtctccactggctgcattactgccaagcaagcttccctagctaatgaacagctaagatctttatattcccaggtccgacctaatgctattgcactcgtcgatgcgtttaattacaccgaccactatcttggctcggtccttggacggtatgatggaaatgtgtacccgaaactctacgaggaagcatggaaggatcctctaaatgactcagttgtgcctgatggctaccatgaatacatcaggcctcttctgaaacaacagcttcgaaatgcaagactctaaagaatatgatgaaagggtgtggtgcatacccaagtaattcaaatcgtatacactttttatcctatcaataatttttgccaataaaattaacatattgaccacccacaatagaataatatgggtctgtggatactatcaagttgatccatcagatcgttgacgaattcggggttatttgttagacttcacgttatggaagaagattcttcatttgtagatggataaaatgtttgtaatacgatttgctta

SEQ ID NO: 10469 - DNA, 2295 bp, Vaccinium corymbosum
tacaggtatatctcctcgcatatatctatatctatattggtgaactagggttggatctgaaggggtaaaacaaggaagaagaaatggaacgagttgatcacttggctcacgagaggaacaagtccgagttcgatgtcgacgctatgaagatcgtctgggccggttctcctcacgccttcgaagtctccgatcgcatttccaagctcgtagccagcgatcctggcttccggaaagataatagaactatgcttagcagaaaggatttgttcaaaaatactcttagaaaagcagcttatgcatggaaaacaatcgttgacctccatctatctgaagaagaggcggctaaattgaggttttatgtggatgaacctgcttacactgatctccactggggaatgtttgtacctgctataaaaggacaaggcactgatgagcagcagcaaaaatggttgccgttggcatataagatgcaaattattggctgctatgcacaaactgaacttggacatggctctaatgtacaaggactagaaaccacagcaactttcgatccccaaacggatgagtttattattcatagtcctacattgacctctagcaaatggtggcctggtggactgggtaaagtggctacgcatgctattgcttatgcccgccttatagttgggggtcgggactatggtgtaaatggttttattgtccaattacggagtttggaagatcactctcctcttcccggcataactgttggtgatattggaatgaaatttggtaatggagcatacaacacgatggacaatggggtcttacaattcgatcatgtgcgtatccccagagatcagatgttgatgagggtttcacaggtcacacgtgaagggaaatataagccgtcagatgttcccaggcagctagtttatggtactatggtatatgtgcgacaaactatagtagcagatgcttcctgtgctttatcacgtgcagtgtgtattgctacgcggtatagtgctgttcgtagacagtttggatcacagaatggtggaccagagactcaggtgattgattacaaaactcagcaaagtaggctctttcctttgctggcgtctgcttatgctttccgatttattggtgaatggttgaagtggttatatacggatgtgacccaaagattgcaagctaatgatttttcaacattgcctgaggctcatgcgtgcactgccgggttgaagtctttgactactactgctacagctgatggcattgaagagtgccgtaaattatgtggcggccacggatacctttgcagcagtggccttccagaactatttgccgtttacgtccctgcctgtacatatgaaggagacaatactgtgctgcttctacaggttgcaaggtttctcatgaagactgtttctcagctgggggtcaagaaaccagtgggtacaataggttatatgactcgagttgatcatttaatgcaatgccgttgcggtgttcaaagagctgaggattggttaaatcctagtgcactattggaagcatttgaggcaagagctgctagaatgtctgttgcctgtgctcaaaatttaagcaactttgacaatccagaagaaggatttgcggaactctcagctgatttggtggaggcagcagttgcacactgccaattaataatagtttccaagttcattgagaaactgcaacaagaaatccccggaaaaggagtcaaacaacagttagaggtgctctgtaacatttacgcgctcttccttcttcacaagcatcaaggtgattttctctcaactggctgcatcaccccaaaacatgcttcgcttgcaaatgatcagctcagatctctgtattcccaggttcgtccaaatgctatcgctcttgtcgatgcatttaactacactgaccacttccttggctcgatcctcggatgctatgacgggaacgtgtatccgaaactctatgaggctgcgtggaaagatcctctaaacgactctgttgtgcctgatggctaccaccaatacatacggcctttactcaagcaacagatccgtactgccagactctaagagaactctggcgatgaatatgacggtaaaatgctcattatgtttcgtagcgctaataaaggctcacctgtttggtgcccctccagatagccaaggtttgaactaggctatagtattgtgaggaattttttctatgtaacttaatgaacatgtactttcggacaagttagagatcgtttgataaatttcgttggtactatttacttttcataatttctta

SEQ ID NO: 10470 - DNA, 2490 bp, Actinidia deliciosa
ccctgatcacgcagtgaacccgaatcccagccgaaaggccccaaacgctatcgagaaacacaaaccgttgggatttggaatccttatcgttagctgtccaaactctctctctctcctcttatatatacatctatacgtatattttcatacaccgacatatatcgttcgattagggttttgtgttcaagttcgatctgaagaagaaagaagcaatggagggagtggatcacttggccaacgagaggaataaggcccaattcgatgtcgattcgatgaagatcgtgtgggccggctctcgtcacgccttcgaagtctccgatcgcatatctaagctcgtcgcaagcgatcctgccttccggaaggataacagggctatgcttgaaagaaaggagttgttcaaaaatactcttagaaaaaccgctcatgcatggaaaacgatcattgatctccgtctctctgaagaagaggcatctaggttaagattttatattgatgaaccagcttacactgatcttcactggggaatgtttatacctgctataaaaggacaaggcactgacgagcagcaacagaaatggttaccattggcacataagatgcagattatcggctgctatgcacaaactgaacttggccatggctccaatgtccaaggtcttgaaaccactgcaacatttgatccccaaacggatgagtttgtcattcatagtccaacactgacttcaagtaaatggtggcctggtggcctgggtaaagtgtccacgcatgctgttgcttacgctcgtcttataacagatggtcaggaccacggagtgcatggttttattgtccaattacgaagcttggaagatcactcacctcttccaggcataactgtgggcgatattggaatgaaatttggaaatggagcgtacaacaccatggacaatggtgtcttaagattcgatcatgtgcgtatccctagagatcaaatgctgatgagagtttcacaggttacgcgagaagggaaatatatgcagtcgaatgtaccccgccagctagtttatggtactatggtatatgtcaggcaaactattgttgccgatgcttcctgtgccttatcaaaggcagtttgtattgctacgaggtatagtgctgttcgtagacagtttggatcacataatggtggaccagagacccaggtcattgattacaaaactcagcaaagtaggctctttcctttgctggcttctgcttacgctttcagatttgttggcgagtggttaaagtggttgtatacggatgtgacccaaagattgcaagccaacgatttctcgacattgcctgaggctcatgcgtgcacagccgggttgaagtctttgactacttctgctactgctgatggaattgaagagtgccgaaaattgtgtggaggtcatggctacctctgcaccagtggtcttcctgaattatttgcagtttatgtccctgcctgtacatatgaaggagataacattgtgctgttgctacaggttgcaaggtttctcatgaagactgtttctcagcttgggtctggcaagcaccccgtgggtacgattgcttatatgaaacgagttgagcatctgatgcaatgtcgttgcaatgtccaaagagctgaggattggttaaagcctagtgtggtattggaagcatttgaggccagagctacaagaatgtccgttgcctgtgctcaaaatttaagcaagtttgcaaatccagaagaaggctttgcggaactctcggctgacttggtggatgcagcagttgctcactgccaattaattgtagtttctaagttcatcgcgaaattgcaacaagacattcccggaaagggggtcaaagaacagttggacgctctctgttacgtctatgccctcttcctccttcacaagcatcaacgcgattttctctcgactggctgcatcacccccaagcaggcttctctcgcaaatgatcagctccgatctttgtattccaaggttcgtccaaatgcaattgctctcgttgattcctttaactacaccgaccacttccttggctcgatcctcgggtgctacgatggaaatgtatatccgaaactctacgacgcggcatggaaggatcctctcaacgaatcagtcgtgcctaacggctaccatgaatacatcaagcctgttctgaagcaacagattcgtactgctagactctgaacagaccatgttgctatatttgagaatttaaataatctttatgttgtgtaatgttaataaaaatgcctatttcgtgcccctccagatatgtatttgcgtgacattagtaatgtattttgttggactaatgtgaggcagaaggataagattttgttggttgatacagcgtcataaattgtaagagctcgtcttctctccagtccgggttgaaactggatggtgtagtcccgaaaaagggttgccgtgcttataaatcaatgtccagatttttctaaaaaaaaaa

SEQ ID NO: 10471 - DNA, 2222 bp, Vinca minor
caaatcaatgaactttgttgctctttgatccttatcggtattttcttctatccgaggagaaatctctaagatttaattattgtattcgctttgtgatttttgaggtttttgtctggaaagaatattgggaaacatggcggcggaaatcgattacttgggcgatgaaaggaagaaggcagaattcgatgtggatgcaatgaagatcgtttgggctggctctcttcacaactttcaactctctgatcggatttctaagctcgtcgctagtgatcccggctttgcaaaggatgggagaactatgctgccaaggaaggaattattcaagaatactcttagaaaagcagcttatgcatggaagagaattaatgaacttcgtctatctgaggaagaggcatctaaactgcggttttacgtggatgaacctgctttcactgatcttcactggggaatgtttgtgcctttcataaaaggacagggcactgatgaacagcagaaaaaatggttgtctttggcctataagatgcaaataataggctgttacgctcaaactgaactaggtcatggctctaatgtgcaaggcctggaaaccactgcaatgtttgaccctcagacagatgaatttgtgattcatagccctacattgacttcaagcaaatggtggcctggtggtttgggtaaagtatcaacgcatgcagttgcctttgctcgtcttataactgatggaaaagattacggagttcacggttttattgtccagatacggagtttggatgatcataacccgcttccaggtgtaactgttggtgatattggaatcaaatttggtaatggagcgtacaacaccatggacaatggagtactaagatttgatcatgtgcgcattccaagaaatcaattgttgatgaggttttcacaagttacaagagatggaaaatataaacaatcagatgtgcctcgccagttggtttatggaacaatggtttacgttcgtcaaacaattgtccaagatgcatcatctgccttgtcacgagctgtttgcattgcaacaaggtatagtgctgttcgtcgacaatttggttcacaaaatggtggaccagaaatccaggtgatcgattataaaactcagcaaagtaggctctttcctctgctggcttctgcttatgcctttagatttgttggtgagtggctcaactggttatacacggatgtgacaaagagacttcaagcaaatgacttctcaacattgccggaggctcatgcctgcactgcagggttaaagtccttgactacctcttttaccgctgatgctattgaagaatgcagaaaattatgtggtggccatggctatctttgtagcagtgggcttccagaattgtttgctgtttatgtccctgcttgcacatatgaaggagacaacactgtgatgctgctacaggttgccaggtttctgatgaagaccgtttctcagactgtttcccagctggggtccgggaaacagctagtgggaacaattgcttacatgggtagacttgaacatctcatgcagtgtcgttgtaatgtgcaaaatgccgaggattggttgaatcctagtgcagtggtggaggcatttgaggcgagagctgttagaatgtctgtttcttgtgcgaaaaggttgacccagtttactaaccaagaagaaggctttgccgaaatatcagctgatttggttgaggcagcagttgctcactgtcaattaattgtggtctccaagttcatcgagaaactgcaacaagacattcctggaaagggtgtcaaggaacagctaaaagcactttgtgggatttattacctattcatccttcacaagcaccagggcgattttctcgccaccaactgcatcaccccaaaccaggcttcactggctaatgatcttctgaggtcattgtattcacagatccgtcccaatgccatcgcgcttgttgatgcatttaactacactgatcacttccttggttcaattcttgggcgctacgatggaaatgtatatccgaaactttacgaggctgcatggaaggatccgttgaacgactccgttgtaactgatggctatcatgaatacatccggccgctcctgaagcagcagcttcgtactgctaaactgtgaagattataggtaataatactgttggtaccctttcagtggtaaataaatttatcctactagaatgattatgaaattatat

SEQ ID NO: 10472 - DNA, 2486 bp, Trifolium pratense
cttcctcttctttcttttcgattattattattcgaaagagaagaggattgtgttgttgttaggataatttgaattatggaaggtgtagatcatttggcttttgaaagaaacaaagctgaattcgatgtggatgcgatgaagatcgtttgggctggttcttctcatgcttttgaagtttctgatcgaatgtctcgccttgttgcaagcgatccggcatttagaaaggatcatagacccatgcttggtaggaaggagttatttaagagcactttgaagaaagcagcttatgcatggaaaaggattattgagcttcgtcttagcgaggaagaagcttctatgcttagatcctttgtggacgaacctgcttttactgatcttcattggggaatgtttattcctgctatcaaaggacaaggaactgatgaacagcagcaaaagtggctacctttggcacaaaagatgcaaataattggttgctatgcccaaactgaacttggccatggatctaatgttcaggggttagaaacaacggcaacatttgatcccaaaacagacgaatttgttattcatagtcccacattgacttccagcaaatggtggcctggtggattgggaaaagtgtctacacatgctgttgtttatgcccgactaattactgatggtcaagatcatggagtgcatggcttcattgtccagctgcgtagcctcgatgatcacttacctcttcctggcataactgttggcgatattggaatgaaatttggaaatggagcatataacactatggacaatggagttctgaggtttgaacatgtaagaattccaagggatcaaatgttaatgagagtttcacggattacaagggaaggaaaatatgtacaatccaatgttccaagacaattagtttacggtactatggtatatgtgagacaaacaattgtctctgatgcgtccacggctatgtcgagagctgtttgcattgctacaagatatagtgctgttcgaagacagtttggggcaagtaatggaggtcttgaatcacaggtgatagattataaaacacaacaagctaggctcttccctttgctagcctctgcttatgctttcagatttgttggtgagtggttgaaatggctttacacggacgtgatgaaaagattgcaagccaatgacttttcaacattgcctgaggctcatgcatgcactgcggggttgaaatccttgactacctcagcaacttctgatggaattgaagaatgccgcaaattatgtggtggccatggttacctttgcaccagtggtctccctgagttatttgcagtctatgttcctacctgcacgtatgaaggagacaacattgtgctgcttttacaggttgcgaggtatctcatgaagattatttctcagttgggatctggaaaaaagcctgttggtacaacagcttatatgggacgagtgcaacaactgatggaatctcggtctgatgttcaaaaagcggaggattggttgaatcctaatgcagtgctgggagcatttgaagctagggctgctaggaagtcagttgcctgtgctaaaaatctcagcaagtttagcaatcctgaagagggtttccaagaactctcaaatgatctagttgaggcagctcgcgctcattgccagttgattgttgtttccaaatttattgagaagttgcagcaagatataccaggaaagggagtgaaacagcaattacaaattctttgtagcatttatgctttgtttcatcttcataagcatttgggtgattttctttctactggttgcatcactcccaaacagggttcactggccaatgaccagctcaggtccttgtattcacaggttcgtcctaatgcaattgcgctcgttgatgcgtttaactacactgatcactacctcagttcaattcttggctgctatgatggaaatgtgtatccaaagctatatgaggcggcatggaaggatccattgaatgattcagttgtgccagatggctttcaagagtatattcgaccaatgctgaagcaacaacttcgtaatgccagactctaaacaagtttataagtggaccttcgaccaagaggaagttatgtacactttcaataaagacgagtaatgaagttctatggaaggaaaaataaaaatgttttattgcatacaagtagaagttcccaagcaagttcgtttccttggtgactctggctgcacggctattcactagaagagcttgcagtttggtgcatgtctgtattctttagtataggctaaatttcatagggaaaaaagcccaagtagacttttgattatatagagttgtcctatgacgaatttatttaatgtttctttttatatcttcttacccttctctcattctaccctacagaaaatgttagaaacagtgtattgcacaaatttatgtgtattccatatcatttggtttagttgaaatgtgaagtatattggagaat

SEQ ID NO: 10473 - DNA, 2330 bp, Tropaeolum majus
atccatattcattcaccatttccccaactgcctagaaattgaagtttctccttctggttgaatcaatctgtgcgcggaaaaagagagattgtttctgctctttggattcgatctggttaattgaatcgaaagaagaaaggatggacggagttgattacttggctgatgaaaggagcaagtcagagttcgatgtggaggagatgaagatcgtttgggctggttcccgccatgttttcgaagtctcggatcggatggctcgtcttgtcgctagcgatccgattttccggaaggacaatagggttgacttaggcagaaaggaattatttaaaaacactatgagaaaagctgctcatgcatggaagcggatcattgagcttcgtctttctgaggaagaagcatctaaattacggcattttgtggatcaacctgcttacaccgaccttcattggggaatgtttgtaccagctatcaagggccaaggtacagacgagcagcaacggaagtggttgccattggcatataagatgcagataataggatgttatgcacaaactgaacttggccatggttccaatgtgcaaggccttgaaacaactgcaacatttgatccggagactgatgaatttgtcattcacagtcctacactaacttcaagtaaatggtggcccggtggattgggaaaagtgtcgacgcatgctgtcgtttatgcacgccttgtacttgatggcaaagaaaatggagtgcatggtttcattgtgcagctacgtagcttggatgatcactcacctcttccaggaattactgtgggtgatattggaatgaaatttggaaatggggcatataattccatggataatggtgtactcagatttgaccatgtgcgcatccccagagatcaaatgttgatgcgggtttcacaagttacccggcaagggaaatatcagcaatctgatgttccccggcagctggtttatggtacgatggtgtatgttcgtaaaacaattgtagttgacgcatctaatgctctatcacgggcagtttgtattgccacaaggtatagtgctgtgcgtagacaatttggctccaagaatggtggtgctgagacccaggtgattgattataaaactcaacagagtagactcttcccattgctagcttctgcctacgctttcaggtttgttggtgagtggctgtcatggctatatacggatgtgacccaaagattgcaagccaatgatttctcaacattgcccgaggctcatgcatgtacggcagggttgaagtctctgactacttctgccacagcggatggtattgaagaatgccggaaattatgtggtgggcatggttacctgtgtagcagtgggctccctgagttgtttgctgtttatgttcctgcctgtacatacgaaggagacaatgttgtgctgcaattacaggttgcaaggtttctcatgaagactgttgctcaattgggatctggaaggaagcctgttgggacgacagcctatatgggacgagcagagcatcttttgcaatgtccctgtgatgttcaaaacgctgaggattggttgaagcccaaaatagtagtggaggcatttgaagcaagggctattagaatgtctgttgcctgtgcgaaaaagctcagcaagtttgcaaatcaagaagatggtttcttggaactttcagctgatttagttgaggctgcaattgctcactgccaattaattgttgtttccaagtttatcgagaaacttcagcaggacatacccggtaagggggtcaaacgacaactagaagtactttgctacgtttacgctctctacactctccacaaacatcaaggcgatttcctcgcgaccagctccattactcccaagcaaagttctctagccaatgaacaactaagatccttatactctcaggtccgaccaaatgctatcacccttgttgacgcatttaattacaccgaccacttccttggctcaattctcggtcgatacgatggaaatgtgtatccaaaactttacgagcaagcttggaaggaacctctgaatgactcggatgttcctgatggttatcaggaatatgttcgaccattgctgaagcagcagttacgctcagcaaggctctgaatggatctgacccgaaaaactcggattcgcacctctattcttcactgggtaagataaaattataaactataaaataaaactgtattgtaggtttggcgtttttggcagccagtttgtcgcgaaagtgactcctaatttatggctgataactattattattattagtgatattattattatttatgaactccatta

SEQ ID NO: 10474 - DNA, 2523 bp, Medicago truncatula
ttcaattctaatgaaaagtcgatactccacaaagtaatgaattaaatttggaccaaagtttgaaaagaaaaaatcaaacgtggaatatgtgttagttaatctcattgtcatcatcatcatcactcatcactatacaaaaggaagtagaacaaacacactatcctcctcgttcttcattcttcaaattcaaaccaagaccaaattaagtgttccattcttcaaaccatggaaggtgttgatcatttagctttcgaaaggaacaaagctgaattcgatgtgaacgagatgaaaatcgtttgggctggttctcgtcaagaattcgaactttccgatcgaatttctcgtcttgttgcttccgatccggcattccgaaaggataacagaacctcgcttgatagaaaggagttatttaagaacactttgagaaaaacagcttatgcatggaaaaggatcattgagctccgtcttaatgaacaagaagcttccaagcttagatcctttgtagacgagcctgcttttacagatcttcattggggaatgtttgtgcctgctatcaaaggacaaggaactgatgagcagcaggaaaaatggttacctctagcttataagatgcaaataattggttgctatgcccaaactgaacttggtcatggatccaatgttcaagggctagaaacaactgcaacatttgatcccaaaacagacgagttcattattcacagccccacattgacttccagcaaatggtggcctggtgggttgggtaaaatatccacacatgctattgtttatgcccgtcttattactgaaggtcaagaccaaggagtgcatggtttcattgtccagctgcggagcttggatgatcacttgcctctgccaggtataactgtcggagatattggaatgaaatttggaaatgcagcatataacaccatggataatggagttctgagatttgaccacgtacgaattccaaggaatcaaatgttaatgagggtttcacaggtcactagagaaggaaaatatgtacaatccaatgttccaagacagttaatttatggaactatggtatatgtgaggcaggcaattgtagctgatgcatcaactgctttgtcacgagcagtttgtattgctaccagatacagtgctgttcgaagacagtttggatctcaaaagggaggtcctgaaacacaggtgattgattacaaaacacagcaggctagactcttcccattgctagcttctgcatatgctttcagatttgttagtgagtggctgaaatggctttacacggatgtgactcaaagattacaagctaatgatttttcaacattgcccgaggcccatgcttgcactgcagggttgaaatccttgactacttctgcaactgctgatggaattgaagaatgccgtaaactatgtggtggtcatggttatctttgtagcagtggtctacctgagttatttgcagtttatgttcctgcctgcacatatgaaggagacaatactgtgctgctcttacaggtggcaaggtatcttgtgaagactatttctcagttgggctctggaaagaaacctgttggtaccacagcttatttgggtcgagtggaacagctgatgcaatatcaatctgatgttaaaagagctgaggattggttgaagcctaatgtagtgattgaagcatttgaagctagggctgccaggatgtctgtcgctgttgctcaaaatattagcaagttctctaatcccgaagagggttttcaagaactatcagttgatttagttgaggcagcagctgctcattgccagttaattgttgtttccaaatttatagagaagttgcagcaaaatattcctggaaagggagtgaaacagcagttagaagttctgtgcagcatttatgctttatttcttcttcataagcatctgggcgattttctttccaccggctccattactgaagaacaaggatcacttgccaatgagcaattgaggtccttgtattcacaggttcgtcctaatgcaatcacgcttgttgatgcatttaactacactgatcacttgcttggttcggttcttggacgatatgatggaaatgtgtatcctaagttgtatgaagaggcttggaaagatcctttgaatgattcagttgttccggatggctttaaggagtttgttcaaccaatgcttaggcagcaacttcataatgctagactctagagtcttttataattgcgctggtggtactatttttattgaaaatggtcaataaagttgcatggaaggataaataaatgtagatgaatacatactaggggaactttgatataatcagttaatttccatggttaataacattcatgagaggaagtagcaaattcggtgtatctggaatggaactagaacatcattattgatttatgtataattttttttggtgaattttttttttttttgctgcttgtgacatgtactgcatttctaggcataacaacatcacaggcttatgggttgtgattgctt

SEQ ID NO: 10475 - DNA, 3321 bp, Cicer arietinum
atagattgcatacagcatacctaatgtactttgaatctttaccaaagcatagctatattatagttaatctttacttttaatgtacttaattgacgtaagaaaagtattagtactacaattaagatctaagaagaaaaaagaagcagcacgatccgttgggtattttgtaatgtgaaaacaaaagtacaaaaatagacactgaaaggcgtatctatccactttatttatcgatatctgaatcattgtattatttatagttttctatatatatagtgaagagaatagtacaatagacgctaattgctggcttgattacatttggttgttgttgcagagaataagcaaatctcgtagttctcattcttcttcttctttttctttctttttaattattccatacagaatagtattgtgttagggtttgcaaaaatggaaggtgaagatcacttggctttcgaaaggaacaaagctcaattcgatgtcgacgcgatgaagatcgtttgggctggttcttctcacgcttttgaagtcactgatagaatgtctcgccttgttgccagcgatccggcatttagaaaggataatagacccatgcttggtaggaaggagttatttaagagcactttgaagaaagcagcttatgcatggaaaaggattattgagcttcgtcttactgaggaggaagctggcaagctaagatcctttgtggacgaaccagcttttactgatcttcattggggaatgtttattcctgctatcaaaggacaaggaaccgaggaacagcagcaaaagtggcttcctttggcacataagatgcaaataattggttgctatgcccaaactgaacttggccatggatctaatgttcaagggttagaaacaacagcaacatttgaccccaaaacagacgaatttgttattcatagccccacattgacttcaagcaaatggtggcctggtgggttgggtaaagtgtcaacacacgctgttgtttatgcccgactaattactgatggtaaagatcacggagtgcatggcttcattgtccagctgcggagcctggatgatcacttacctcttcctggtataactattggcgatattggaatgaaatttggaaatggagcatataacactatggacaatggggttctgaggtttgaacatgtacgaattccaaggaatcaaatgttaatgagggtttcacaaattacaagggaaggaaaatatgtacaatccaatgtcccgagacaattagtttacggtactatggtatatgtgagacagacaattgtatctgatgcgtcaactgctttgtcgagagctgtttgcattgctacaaggtatagtgctgttcgaagacagtttggggcaaataatggaggtcttgaaacacaggtgatagattataaaacacaacaagctaggctcttcccattactagcctctgcatatgctttcagatttgttggtgagtggttgaaatggctttacacggatgttatgaaaagattgcaagccaacgatttttcgacattgcctgaggctcatgcatgcactgcggggttgaagtccttgaccacctcagcaactgctgatggaattgaagaatgccgcaaactatgtggtggccatggttatctttgtagcagtggtctcccggagttatttgctgtctatgttcctacctgcacatatgaaggagacaacattgtgctgcttttacaggttgcaaggcatctcgtgaagattgtttcaaagttgggttctggaaaaaagcctgttggtacagcagcttatatgggacgagtggaacaactgatggaatttcggtctgatgttcagaaagcggaggattggttgaatcctaatgcagtgctggcagcatttgaagctagggctgctaggaagtcggttgcctgtgctaaaaatcttagcaagtttacgaatcctgaagagggtttccaagaactctcagctgatctagctgaggcagctgttgctcattgccagttgatcgttgtttccaaatttattgagaagttgcagcaagatatacctggaaagggagtgaaacagcaattagaaattctttgtagtatttatgctttgtttcatcttcataagcatttgggtgattttctttcaactggctgcatcactcccaaacagggttcacttgccaatgaccagctcaggtccttgtattcacaggttcgtcctaatgcaattgcacttgttgattcgtttaactacacggatcattacctcagttcagttcttggccgttatgatggaaatgtgtatccaaagctatatgaggaggcatggaaggatccattgaatgattcagttgtgccagatggctttgaagagtatgttcgaccgatgttaaagcaacaacttcgtaatgctagactctaaataagttttataactggactgctgaccagggtccaggaggaagttatgtacacttccaataaagacgggtaatgaagttgtagggaaggaaaaataaaaatgttttattacatacatgtagaaatttcaagaactcttcaagaaagttcgtttccttggtgtctggctattcacgagaagagcatgcaatttggggaaatgtcaaagataatttatttatctaattattcagtagtagaggctaatgtcttaggcaaaagcccaggacttttgattatatatagaattgcactacgcaggacttagtgtcccttaaagaaaatgcttagaaataatgtattgctaaattttacatgtgtattccatatcatttggtttagtgaaatgtgaagactgaagagttatactaattggaatttggaatagtcacttttgaattcattggacacttcattcatctaatgcttttcatggagtgttagaacatgtttgccccgtttttctggaagtaggtttaatgttcacttgctttttcttctggaaacgtgggttagtggtgttaaagtgacaagaattgtaaggggttatgtcttctagatgacggtggatttgctggaaaatactttggactttagaagttatttgctcatactcagttcgtgcatgccaaggcggtgccgaagttgggaggggatagttggagtggtgggtcattactgaattggtctaaaggaacaaataggggatagatggagtggtgggtcgtcactgaattagtctaaatgaacaaataaatttcttgtttgaatgattgtggactgttggacttgagttttaaagagagagaaaacatcatctgaatgcactatggggatgaagatgcatatgtcaaaaata

SEQ ID NO: 10476 - DNA, 2521 bp, Phaseolus vulgaris
gaaatatccatttccattaggattaaagatcaaacacaacatttataccaaacatgcgtgtcggccaacacaaagccttgttttcatcgaagagtcaaccttatcacgttttcttatttgtgttttttgtccgttgaaaacgtggtataaaaacaacacaaacaatttatcttcattcattcttaggacggaacactgaattaaaagttgcgctgtggtgttggaaaccagatttcagagagacattgtttgggttggggaaaatggatggtgttgatcacttggctttcgagaggaacaaggcgcagttcgatgtggaagagatgaagatcgtttgggctggttctcgtgaagactttgagctttctgatcggatttctcgccttgttgctagcgatccggtgtttagaaaggatgacagaaccgtgcttgatagaaaagaattatttaaaaacaccttgaggaaagcagctcatgcatggaaaagggtaatcgagctccgtctcagtgaacaggaagcttataagctcagatcttttgtggatcaacctgcatttacggatcttcattggggaatgtttgtgcctgctatcaaaggatcgggcactgatgagcagcagcagaagtggttacctctagcttataggatgcaaataattggttgctatgcccaaactgaacttggtcatggatccaatgttcaaggactagaaacaactgcaacatttgatcccaaaacagacgagtttgttatccatagccccacattgacttccagcaaatggtggcctggtggattgggtaaagtatccactcatgctgttgtttatgcccgtttaattattgatggtcaagactatggagtgcatgggttcattgtccagctgcggagcttggataaccacttacctcttccaggcattactgttggtgatattggcatgaaatttggaaatgcagcatataacaccatggacaatggagttctaacatttgaccatgtacgaattccaaggagtcaaatgttaatgagggtttcacaggttaccagagaaggaaaatatgtacactccaatgttccaaaacaactagtttatggcactatggtaaacgtgagacaaaaaattgtagctgatgcatcagttgctttgtctcgagcagtttgcattgctacaagatatagtgctgttcgaagacagtttggatcgcataatggaggtctagaaacacaggtgattgattacaaaacacagcagtctaggctcttccctttgctggcttctgcttatgctttcagatttgttggtgagtggctgctatggctttatacagatgtgacagaaagattgaaagctaatgatttttcaacattgcctgaggctcatgcatgcactgctggattgaaatccttgactactaccgccactgctgatggaattgaagaatgccgcaagttatgtggtggtcatggttacctttgtagcagtggtctccctgagttatttgctgtttatgttcctgcttgcacttatgaaggtgacaatattgtgctgcttttacaggtgtcaaggcatctcatgaagacggtttctcaactgggcactggaaataagcctgttggtactacagcttatatggctcgaatggaacaactgatgcaataccactcagatgttaaaaaggctgaggattggttgaaacctaatgttgtgttggaagcatttgaagccagggctgctaggatgtgtgttgcatgtgctcaaaatcttagcaagttctctaatcctgaagagggttttcaagaactcgcagctgatttagttgaggcggctgttgctcattgccagctcattgttgtttccaaatttattgagaagttgcagcaagatatacctggaaagggagtgaaagagatattagaagttctttgcagcgtttatgctttgtttctacttcataagcatctgggtgattttatttcgactggctgcattgacccaaaacaaggatcacttgccagtgagcagctgagaaacttgtattcacaggttcgtcctaatgcagttgcgcttgttgatgcatataattacactgatcactacctgggttcaattcttggacgttacgatggaaatgtgtatcctaagttgtacgaggaggcatggaaggatcctttgaatgattcagttgttcctgatggctttaaagagtatgttcaacccatgctcaagcaacaactacgcaatgctagactctagttccatctaagaaatttatccttgaagctctaaataagtctcactaagcttcgtggaacgataaataaaattgcgcgttcatatttgttagctgactgtttcttcctgcacctccataggttcttctgacaccccatacacaacatgaaaagacctttttaaccttcttgtgtcaccctataaaatagctttcggattatgtaattcatacctgcatttaaaagagacttccggattatgtaatctgaaagctaaaaaagact

SEQ ID NO: 10477 - DNA, 2341 bp, Glycine max
gttatcacgttttcttcttttggcacgttgaaaacacaacttaaccacataaagcatccactattctattctaattgctgttactgtaacacaacacaatcttcattcatcactgaaaccaaagccacaagctgcgacatcagaaagacattggcgagaatggaagacagtattgaccacttggctttcgagaggaacaaggcgcagttcgatgttgacgagatgaagatcgtttgggcgggttctcgtcaagactttgagctttccgatcggatttctcgccttgttgccagcgatccggccttcagaaaggatgacagaaccacgcttggtaggaaggagttgtttaaaaacaccttgagaaaagcagcttatgcatggaaaaggatcaacgagctccgtcttaatgaacaggaagcttataagctcagatcctttgtggatcaacctgcttttacggatcttcattggggaatgtttgtgcctgctatccaaggacaaggcactgacgaacagcagcagaagtggttgcctctagcttataggatgcaaataatcggttgctatgcccaaactgaacttggtcatgggtccaatgttcaagggctagaaacaactgcaacatttgatcccaaaacagacgaatttgttatccataaccccacattgacttccagcaaatggtggcccggtggattgggtaaaatatccacccatgctgttgtttatgcccgtctaattattggtggtgaagaccatggagtgcatggtttcattgtccagctgcggagcttggatgatcacttgcctctttcaggcataactattggtgatattgggatgaaatttggaaatgcagcatataacaccatggacaatggagttctaagatttgaccatgtacgaattccaaggaatcaaatgttaatgagggtttcacaggttaccagagaaggaaaatatgtacactccaatgttccaagacaattagtttatggtactatggtaaatgtgagacaaaaaattgtagctgatgcatcggttgctttgtctcgagcagtttgcattgctacaagatatagtgctgttagaagacagtttggatcacataatggaggtctagaaacacaggtgattgattacaaaacacagcaggctaggctcttcccattgctggcttctgcttatgctttcagatttgtgggcgagtggctgaaatggctttatatggatgtgacgaaaagattgcaagctaatgatttttcaacattacctgaggctcatgcatgcactgctgggttgaaatccttgactactacggcaactgctgatggaattgaagaatgccgtaaactatgtggcggtcatggttacctttgtagcagtggtctccctgagttatttgctgtttatgttcctgcctgcacgtatgaaggagacaatattgtgcttcttttacaggtggcaaggtatctcatgaagactgtttctcagctgggctctggaaataagcctgttggtactacagcttatatggctcgagtggaacaactgatgcaatatcactctgatgttaaaaaggctgaggactggttgaagcctaatgtagtgttggaagcatttgaagctagggctgctaggatgtcagttgcttgtgctcaaaatcttagcaagttcactaatcctgaggagggttttcaagaactagctgctgatttagttgatgcggcagttgctcattgccagttaatcgttgtttccaaatttattgagaagttgcagcaagatatccctggaaagggagtaaaaaagcaattagaagttctttgcagcatttatgctttgtttctacttcataagcatctgggtgattttctttccactggctgcattaacccaaaacaaggatcacttgccagtgagcagctgagaaacttgtattcacaggttcgtcctaatgcaattgcgcttgttgatgcatttaactacactgatcactaccttggttcaattcttggacgttacgatggaaatgtgtatccgaagttgtacgaggaggcatggaaggatcctttgaatgattcagttgttcctgatggctttaaagagtatattcaaccgatgcttaagcagcaactacgtaatgctaggctgtagttaattttgtggcaatgatgcttttggcatctaagaaatttacccagactattctgatttacaactcttaataaagttgtgtttgccagctagtaattaccatcgcaattaggtgtatctggaactggaactggaacaaactcatttatttattacattaacgatacttgatgtctaatttcgt

SEQ ID NO: 10478 - DNA, 2583 bp, Trifolium pratense
cttcctcttctttcttttcgattattattattcgaaagagaagaggattgtgttgttgttaggataatttgaattatggaaggtgtagatcatttggcttttgaaagaaacaaagctgaattcgatgtggatgcgatgaagatcgtttgggctggttcttctcatgcttttgaagtttctgatcgaatgtctcgccttgttgctagcgatccggcatttagaaaggatcatagacccatgcttggtaggaaggagttatttaagagcactttgaagaaagcagcttatgcatggaaaaggattattgagcttcgtcttagcgaggaggaagcttctatgcttagatcatttgtcgacgaacctgcttttacggatcttcattggggaatgtttattcctgctatcaaaggacaaggaactgatgaacagcagcaaaagtggctacctttggcacaaaagatgcaaataattggttgctatgcccaaactgaacttggccatggatctaatgttcaagggttagaaactacagcaacatttgatcccaaaacagacgaatttgttattcatagccccacattgacttccagcaaatggtggcctggtggattgggtaaagtgtcaacacatgctgttgtttatgcccgactaattactgatggcaaagatcatggagtgcatggcttcattgtccagctgcgtagcctggatgatcacttacctcttcctggcataactgttggcgatattggaatgaaatttggaaatggagcatataacactatggacaatggggttctgaggtttgaacatgtacgtattccaagggatcaaatgttaatgagagtttcacggattacaagggaaggaaaatatgtacaatccaatgttccgagacaattagtttatggtactatggtatatgtgagacaaacaattgtctctgatgcgtccactgctatgtcgagagctgtttgcattgctacaagatatagtgctgttcgaagacaatttggggcaagtaatggaggtcttgaatcacaggtgatagattataaaacacaacaagctaggctcttccctttgctagcctctgcttatgctttcagatttgttggtgagtggttgaaatggctttacacggacgggatgaaaagattacaagccaatgatttttcaacattgcgtgaggctcatgcatgtaccgcgggattgaagtccttgacgacctcagcaactgctgatggaattcaagaatgccgcaaattatgtggtggccatggtgacgtttgcggggggggtcgccgtgagttatttgcagtctatgttcctacctgcacgtatgaaggagacaacattgtgctgcttttacaggttgcaaggtatctcatgaagattatttctcagttgggatctggaaaaaagcctgttggtacaacagcttatatgggacgagtgcaacaactgatggaatctcggtctgatgttcaaaaagcggaggattggttgaatcctaatgcagtgctgggagcatttgaagctagggctgctaggaagtcagttgcctgtgctaaaaatctcagcaagtttagcaatcctgaagagggtttccaagaactctcaaatgatctagttgaggcagctcgcgctcattgccagttgattgttgtttccaaatttattgagaagttgcagcaagatataccaggaaagggagtgaaacagcaattacaaattctttgtagcatttatgctttgtttcatcttcataagcatttgggtgattttctttctactggttgcatcactcccaaacagggttcactggccaatgaccagctcaggtccttgtattcacaggttcgtcctaatgcaattgcgctcgttgatgcgtttaactacactgatcactacctcagttcaattcttggctgctatgatggaaatgtgtatccaaagctatatgaggcggcatggaaggatccattgaatgattcagttgtgccagatggctttcaagagtatattcgaccgatgttgaagcaacaacttcgtaatgccagactctaaataagttttaaatggaccgtcgaccaagaagaagttatgtacacaaagttatgtacactttcaataaagacgagtaatgaagttgtatgaaaggaaaaataaaaatgttttattacatacaggtagaagttcccaagcaagttcgtttccttggtgactctggctgcatggctattcacgagaagagcttgcagtttgatgtatgtctgtattctttagtagaggctaaattcataggtaaaagcccaagtagacttttgattatatatagaggctaaattcataggtaaattcctatgaaaaattcatttaatgatactttttttgtatcttctgacccttctctcatcctaccctaaagtaaagaaaatgttagaaacaattcattgcacaaatttatgtgtattccatatcatttgttttagtgaaatgtgaaataaggcataaaggggctaattaatattgcaattttatttgctgagatgagaagcagaaggaatatgtactaactat

SEQ ID NO: 10479 - DNA, 2574 bp, Trigonella foenum-graecum
ccaaggaatcaaatgttcaaacctcagaaccccattgtctatctgtgcagagaataagcaaatcttgtagttctcattccttcttctcaaccaatatacatacatacaccactttcatttcgaaacagagtagaactgtgttattgttaggaggatttgaacaatggaaggtgaagatcacttagcttttgaaaggaacaaagctgaattcgatgtggactctatgaagatcgtttgggctggttctgctcacgctcttgaagtttctgatcgaatgtctcgcctcgttgccagcgatccggcatttagaaaggatcatagacccatgcttggtaggaaggatttatttaagagcactttgaagaaagcagcttatgcatggaaaaggattattgagcttcgtcttaccgaggaggaagcttccatgcttagatcctttgtggatgagcctgcttttactgatcttcattggggaatgttcattcctgctatcaaaggacaaggaactgaggaacagcagcaaaagtggctgcctttggcacaaaggatgcaaataattggttgctatgcccaaactgaacttggccatggatctaatgttcaagggctagaaacaacggcaacatttgataccaaaacagacgaatttattattcatagcccaacattgacttccagcaaatggtggcctggtggattgggtaaagtgtcaacacatgctgttgtttatgcccgactaattactgatggtcgagatcatggagtgcatggcttcattgtccaactgcggagccttgatgatcacttacctcttcctggcataactgttggcgatattggaatgaaatttggaaatggagcatataacactatggacaatggggttctgaggtttgaacatgtacggattccaaggaatcaaatgttaatgagggtttcacaggttacaaaggaaggaaaatatgtacaatccaatgttccgagacaattagtttatggtactatggtatatgtgagacaaacaatcgtctctgacgcgtcgactgctttgtcgagggctgtttgcattgctgcaagatatagtgctgttcgaagacagtttgggggaaataatggtcttgaatcacaggtgctagattataaaacacaacaagctaggctcttccctttgctagcctctgcttatgcgttcagatttgttggtgagtggttgaaatggctttacacggatgtgatgaaaagattgcaagccaatgatttttcaacattgcccgaggctcatgcatgcactgcggggttgaagtccttgaccacctcagcaacttctgatggaattgaagaatgccgcaaactatgtggtggacatggttacctttgtagcagtggtctccctgagttatttgcagtctatgttcctacctgcacatacgaaggagacaacattgtgctgcttttacaggttgcaagacatctcatgaaggtgatttctcagttgggatctggaaaaaagcctgtcggcacaacagcttatatgggtcgagtggaacaactgatggaatctcggtctgatgttcaaaaagcggaggattggttgaatcctaatgccgtgctgagagcatttgaagctagggctgctaggatgtcggttgcctgtgctaaaaatcttagcaagttttccaatactgaagagggtttccaagaactcttagctgatctagttgatgcagcccgcgctcattgccagttgattgttgtttccaaatttatagagaagttgcagcaagatatacccggaaagggagtgaaacagcaattagaaattctttgcagcatctatgctttgtttcatcttcataagcatttgggtgattttctttcaactggctgcatcactcccaaacagggttcacttgccaatgaccagctcaggtccttgtattcacaggtccgtcctaatgcaattgcgcttgttgatgcgtttaactacactgatcactacctcggttcagttcttggccgctacgatggaaatgtgtatccaaagctatatgaggaggcatggaaggatccattgaatgattcagtggtgccagatggctttcaggagtatattcgaccgatgttaaagcagcaacttcgtaatgctagactctaaataaatttatataataaattggaccatcgaccaggaggaagttatgtacactttcaataaagacgagtaatgaagtttttttttgaaagaacgagtaatgaagttgtatggaagggaaaataaaattgttttattagatacaggtagaagttcccaagcaagttcactgacaagagcttgcaatttggtgcatttcgagcgtcttatatcacagtattctttagtggaggctgatttcatcgattatatagagttgtcctatgcagtacttattaaattttgcttttttttctatctttttactcttctctcatcctaccctaagtgctagaagcaatgtattgcacaaaatttacatttattccttatcatttggtttagtgaaatctgaagagttataaaaattggagatatggaat

SEQ ID NO: 10480 - DNA, 2551 bp, Medicago truncatula
catttgtctactcgtgcaaagaataagcaaatctcgtagttctcattacttcttattctcaaacaccacttttctttcttctttctttcttcttattcaaaacagaatagaactgttacgttttgaagaacaatggaaggtgaagatcacttagctttcgaaaggaacaaagctgaattcgatgtggacgcaatgaaaatcgtttgggcaggttccgctcatgctcttgaagtttctgatcgaatgtctcgcctcgttgccagtgatccggcatttagaaaggatcatagacccatgcttggtaggaaagagttatttaagagcactttgaagaaagcagcttatgcatggaaaaggattattgagcttcgtcttactgaggaggaagcttctatgcttagatcctttgtggatgagcctgcttttaccgatcttcattggggaatgtttattcctgctatcaaaggacaaggaaccgaggaacagcagcaaaagtggctgcctttggcacaaaggatgcaaataattggttgctatgcccaaaccgaacttggtcatggatctaatgttcaagggctagaaacaacggcaacatttgatcccaaaacagacgagtttgtcattcatagccccacattgacttccagcaaatggtggcctggtggattgggtaaagtgtcaacacatgctgttgtttatgcccgactaattactgatggtcgagatcatggagtgcatggcttcattgtccagctgcggagtctcgatgatcacttacctcttcctggcataactgttggcgatattggaatgaaatttggaaatggagcatataacactatggacaatggggttctgaggtttgaacatgtacggattccaagggatcaaatgttaatgagggtttcacaggttactagggaaggaaaatatgtacaatccaatgttccgagacaattagtttacggtactatggtatatgtgagacaaacaattgtctctgatgcgtcgactgctatgtcgagagctgtttgcattgctgcaagatacagtgctgttcgaagacagtttgggggaaataatggaagtcttgaatcacaggtgatagattataaaacacaacaagctaggctcttccctttgctagcctctgcttatgctttcagatttgttggggagtggttgaaatggctttacacggatgtgatgaaaagattgcaagccaatgatttttcaacattgcccgaggcccatgcatgcactgctgggttgaagtccttgaccacctcagcaacttctgatggaattgaagaatgccgcaaactatgtggtggacatggttacctttgtagcagtggtctccccgagttatttgcagtctatgttcctacctgcacatatgaaggagacaacattgtgctgctgttacaggttgcaaggcatctcatgaaggttatttctcggttgggatctggaaaaaagcctgttggtacaacagcttatatgggacgagtggaacaactgttggaagcccggtctgatgttcagaaagcggaggattggttgaatcctaatacagtgctgagagcatttgaagctagggctgctaggatgtcggttgcctgtgctaaaaatcttaccaagttttccaatcctgaagagggtttccaagaactcttagctgatctagttgatgcagcccgcgctcattgccagttgatcgttgtttccaaatttatagagaagttgcagcaagatatacctggaaagggagtgaaacggcaattagaaattctgtgtaacatttatgctttgtttcatcttcataagcatttgggtgattttctttcaactggctgcatcactcccaaacagggttcacttgccaatgaccagctcaggtccttgtattcacaggttcgccctaatgcaattgcgcttgttgatgcatttaactacaccgatcactacctcagttcagttcttggtcgatatgatggaaatgtgtatccaaagctatatgaggaggcatggaaggatccattgaatgattcagttgtgccagatggctttcaagagtatattcgaccaatgttaaagcagcaacttcgtaatgctagactttaaataaatttataattggaccgtcgacctggaggaagttatgtacgagaagttatgtacactttcaataaagaagagtaatgaagttttatggaagggaaaataaaattatttttattacatacaggtagaagttcccaagcaagttcgtttgcttgatagctctggttgactactcacggcaagagcttgcaatttggtgcatgtcgagcatcttatatcacagtattctttagtggaggataatttcataggcaaaagccaaagatgactttcgattatatagagttgtcttatgcaggacttatttaatgttgcttttttatcttcttactcttctcttatcctaccctaaatgctagaatgtattgcaaaaatttacgtgtattccttgtcatttggtttagtgaaatctgaagagttataa

SEQ ID NO: 10481 - DNA, 2833 bp, Glycine max
aataatcataccaagaaaaataaaagattaaaagtttattttactcatttaattaaatggagagatttttttttatatatttttcgtttatactttagttccttcaacaacattttttcaatttatttatttttttctattttctcttctttatttcactcttaattcaaataaaatatgaaaaaaagtatacagatgatgaaaatgaacgtgaaaggaaaagtagtgagaaatgaatcacgtgtggaagatgagaggaggaaaagaaaagaagaaagaaatatgaaatatgaaatattcagttccgattccaatgttatcacgttttcttcttttggcacgttgaaaacacaacttaaccacataaagcatccactattctattctaattgctgttactgtaacacaacacaatcttcattcatcactgaaaccaaagccacaagctgcgacatcagaaagacattggcgagaatggaagacagtattgaccacttggctttcgagaggaacaaggcgcagttcgatgttgacgagatgaagatcgtttgggcgggttctcgtcaagactttgagctttccgatcggatttctcgccttgttgccagcgatccggccttcagaaaggatgacagaaccacgcttggtaggaaggagttgtttaaaaacaccttgagaaaagcagcttatgcatggaaaaggatcaacgagctccgtcttaatgaacaggaagcttataagctcagatcctttgtggatcaacctgcttttacggatcttcattggggaatgtttgtgcctgctatccaaggacaaggcactgacgaacagcagcagaagtggttgcctctagcttataggatgcaaataatcggttgctatgcccaaactgaacttggtcatgggtccaatgttcaagggctagaaacaactgcaacatttgatcccaaaacagacgaatttgttatccataaccccacattgacttccagcaaatggtggcccggtggattgggtaaaatatccacccatgctgttgtttatgcccgtctaattattggtggtgaagaccatggagtgcatggtttcattgtccagctgcggagcttggatgatcacttgcctctttcaggcataactattggtgatattgggatgaaatttggaaatgcagcatataacaccatggacaatggagttctaagatttgaccatgtacgaattccaaggaatcaaatgttaatgagggtttcacaggttaccagagaaggaaaatatgtacactccaatgttccaagacaattagtttatggtactatggtaaatgtgagacaaaaaattgtagctgatgcatcggttgctttgtctcgagcagtttgcattgctacaagatatagtgctgttagaagacagtttggatcacataatggaggtctagaaacacaggtgattgattacaaaacacagcaggctaggctcttcccattgctggcttctgcttatgctttcagatttgtgggcgagtggctgaaatggctttatatggatgtgacgaaaagattgcaagctaatgatttttcaacattacctgaggctcatgcatgcactgctgggttgaaatccttgactactacggcaactgctgatggaattgaagaatgccgtaaactatgtggcggtcatggttacctttgtagcagtggtctccctgagttatttgctgtttatgttcctgcctgcacgtatgaaggagacaatattgtgcttcttttacaggtggcaaggtatctcatgaagactgtttctcagctgggctctggaaataagcctgttggtactacagcttatatggctcgagtggaacaactgatgcaatatcactctgatgttaaaaaggctgaggactggttgaagcctaatgtagtgttggaagcatttgaagctagggctgctaggatgtcagttgcttgtgctcaaaatcttagcaagttcactaatcctgaggagggttttcaagaactagctgctgatttagttgatgcggcagttgctcattgccagttaatcgttgtttccaaatttattgagaagttgcagcaagatatccctggaaagggagtaaaaaagcaattagaagttctttgcagcatttatgctttgtttctacttcataagcatctgggtgattttctttccactggctgcattaacccaaaacaaggatcacttgccagtgagcagctgagaaacttgtattcacaggttcgtcctaatgcaattgcgcttgttgatgcatttaactacactgatcactaccttggttcaattcttggacgttacgatggaaatgtgtatccgaagttgtacgaggaggcatggaaggatcctttgaatgattcagttgttcctgatggctttaaagagtatattcaaccgatgcttaagcagcaactacgtaatgctaggctgtagttaattttgtggcaatgatgcttttggcatctaagaaatttacccagactattctgatttacaactcttaataaagttgtgtttgccagctagtaattaccatcgcaattaggtgtatctggaactggaactggaacaaactcatttatttattacattaacgatacttgatgtctaatttcgtgtctattatttctgggcatttctaatttttaatgtgggttttcttcacactaactcttatttccaattttccaacaaggtactataaaaattccgttacttctgatggacatacgactggtcagattttgtatatttaagcgtagttcatcaatgtattagcagaattttccttttc

SEQ ID NO: 10482 - DNA, 2231 bp, Glycine max
aatcatcattcatcaaatcactgaaaccaaagccacaagctgcgacatcagaagaatggaagacggtgttgaccacttggctttcgagaggaacaaggcgcagttcgatgttgaggacatgaaaatcatttgggccggttctcgtcaagactttgagctttcggatcgaatttctcgccttgttgccagcgatccggcgttcagaaaggatgatagaaccacgcttgataggaaggagttgtttaaaaacaccttgagaaaagcagcttatgcatggaaaaggatcaacgagctccgtcttaatgaacaggaagcttataagctcagatcttttgtggatcaacctgcatttacggatcttcattggggaatgtttgtgcctgctatccaaggacaaggcactgacgaacagcagcagaagtggttgcctctagcttataggatgcaaataattggttgctatgcccaaactgaactgggtcatgggtccaatgttcaagggctagaaacaactgcaacgtttgatcccaaaacagacgaatttgttatccatagccccacattgacttccagcaaatggtggcctggtggattgggtaaaatatccacccatgctgttgcttatgcccgtctaattattggtggtgaagaccatggagtgcatggtttcatcgtccagctgcggagcttggatgatcacttgcctcttccaggcataactattggtgatattgggatgaaatttggaaatgcagcttataacaccatggacaatggagttctaagatttgaccatgtacgaattccaaggaatcaaatgttaatgagggtttcacaggttaccagagaaggaaaatatgtaagctcaaatgttccaagacaattagtttatggtactatggtaaatgtgagacagaaaatcgtagctgatgcatcagttgctttgtctcgagcagtttgcattgctacaagatatagtgctgttagaagacagtttggatcacataatggaggtctagaaacacaggtgattgattacaaaacacagcaggctaggctcttccctttgctggcttctgcttatgctttcagatttgtgggtgggtggctgaaatggctttatatggatgtgacggaaagattgcaagctaatgatttttcaacattgcctgaggctcatgcatgcactgctggattgaaatccttgactactacagcaactgctgatggaattgaagaatgccgtaaactatgtggtggtcatggttacctttgtagcagtggtctccctgagttatttgctgtttatgttcctgcctgcacgtatgaaggagacaatgttgtgcttctgttacaggtggcaaggcatctcatgaagactgtttctcagctgggctctggaaataagcccgttggtactacagcttatatggctcgagtggaacaactgatgcaatatcactctgatgttgaaaaggctgaggattggttgaagcctaatgtagtgttggaagcatttgaagctagggcttctaggatgtcagttgcttgtgctcaaaatcttagcaagtttgctaaccctgaagagggttttcaagaactagctgctgatttagttgatgccgcggttgctcattgccagttaattgttgtttccaaatttattgagaagttgcagcaagatatacctggaaagggagtgaaaaagcaattagaagttctttgcagcatttatgctttgtttctacttcataaacatctgggtgattttctttccactggctgcattaacccaaaacaaggatcacttgcaagtgagcagctgagaaacttatattcacaggtccgtcctaatgcaattgcgcttgttgatgcatttaactacactgatcactaccttggttcaattcttggacgttacgatggaaatgtgtatccgaagttgtacgaggaggcatggaaggatcctttgaatgattcagttgttcctgatggctttaaagagtatattcaaccgatgcttaagcaacaactacgtaatgctaggctctagttcattttgtggctatgatgctctctttgcatccaagaaacttatccactattctaatgcaagtatgcaactgttaataaagttgtgtggaacgataaataaaattgcttgagtacatacgaatgggaatttgttacccagctaatttccatcgcaattaggtgtatctggaaccgga

SEQ ID NO: 10483 - DNA, 2444 bp, Lupinus angustifolius
acatttggcgtttcgtgcacacaaaattcacatcaaagtgtttaagcaacttactttcattcatttcctcaacagccaaaagtttcaagtttcaacaaacagaaacacaatcactttgtttttgagtttttttcagattcgaaaatggaaggaggcgtagatcacttggcaccagagaggaacaaatcggagttcgatgttgatgcgatgaagatcgtgtgggctggttcttctcatgttctagaagtttctgaaaggatggctcgccttgttgcctccgatccggtatttagaaaggataatcgatccatgcttggtaggaaggagttatttaagaacactttgaggaaagcaacttatgcatggaaaaggattattgagctccgtcttaatgaagaggaagcttccatgcttagatcctttgtggacgaacctgcttttacagatcttcattggggaatgtttatacctgctatcaaaggacaaggcacagaggaacagcagcggaagtggttgcctttagctcagaagatgcaaataattggttgctatgcccaaacagaacttggccatggatccaacgttcaagggctagaaacaacagcaacatttgatcccaaaacagacgagtttgttattcatagccccacattgacttccagcaagtggtggcctggtggattgggtaaagtgtccacacatgctattgtttatgcccgcctaataactgatggtcatgatcatggagtgaatggcttcattgtccagcttcggagcttggatgaccacctacctcttccaggtataactgttggtgatattggaatgaaatttggaaatggagcatataataccatggataatggggttctaagatttgacaatgtacgaattccaagggatcaaatgttaatgagggtttcacaggttacaagagaaggaaaacttgtacagtccaatgttccacgacaattagtatatggtactatggtctatgtgagacaaacaattgtagctgatgcatcagttgctttgtcacgagcagtttgcattgctacaagatacagtgctgttcgaagacagtttgggtcgcataatggaggtcctgaaacacaggtgattgattacaaaacacagcaagctagactcttccctttgatagcctctgcatatgcttttagatttgttggtgaatggttgaaatggctttatatggatgtcatgcaaagattgcaagccagtgatttttcaacattgcccgaggctcatgcatgcactgcagggttgaagtccttgactacttcagcgactgctgatggaattgaagaatgccgtaaactatgtggtggccatggttacctttgtagtagtggtctccctgagttatttgcagtatatgttcctacctgcacctatgaaggagacaacgttgtgctgcaattacaggttgcaaggcatctcatgaagaccatttctcagttgggctctggaaaaaagccgattggtacaacagcttatatcgggcgattggaacaattgatgcaatatcgttctgatgttcagaaagctgaagactggttgaaacctgatgtagtgctgggagcatttgaagctagggctgctaggaagtctgttgctgttgctcagaatcttagcaagttttccaaccctgaagagggtttccaggaactctcagccgatctagctgaggcagcagttgctcattgccagttaattgttgtttccaaatttattgagaagttgcagaaagatatacctggaaagggagtgaaacagcaattagaacgtctttgtagcatttatgctttgtttcttcttcataagcatcttggtgattttctttccactggttgcatcactcccaaacagggttatcttgccaatgagcagctgaggtccttgtattcccaggttcgtccaaatgcaattgcgcttgttgatgcgttcaactacactgatcactaccttggttcggttctcggccgctatgacggaaatgtgtatcaaatgttgtacgacgaggcatggaaggatccattgaatgattcagtggtacctgatggctaccaagagcatattcgaccaatgctgaagcaacaacttcgtaatgccaggctctaaaattattttataactggcctgctaataccctaattatgcaacactatttctattgaaaaggcgttaataaagttgtatggatagaaaaataagcagattttattacattctactataaattctgtaacaaatttaattccatgatgtctattcatgagaagagcttgtaatttggtgcgtctggtctggaacatcacaagttgaataattggttatcatagtttaatctccactgcattgtgtgcctttgctccagaatctatatacttacgaatttaatttattacacatcatttagtttg

SEQ ID NO: 10484 - DNA, 2385 bp, Glycine max
caatagaaagcgctggtaaaagagtcaacgttatcacgttttcttttcttctttgctttttcttcttttgccactttgaaaacataaacatagaccaacgggaatatccgctattctagttgctgcttctgtctgtaacacaatacaatcatcattcatcaaatcactgaaaccaaagccacaagctgcgacatcagaagaatggaagacggtgttgaccacttggctttcgagaggaacaaggcgcagttcgatgttgaggacatgaaaatcatttgggccggttctcgtcaagactttgagctttcggatcgaatttctcgccttgttgccagcgatccggcgttcagaaaggatgatagaaccacgcttgataggaaggagttgtttaaaaacaccttgagaaaagcagcttatgcatggaaaaggatcaacgagctccgtcttaatgaacaggaagcttataagctcagatcttttgtggatcaacctgcatttacggatcttcattggggaatgtttgtgcctgctatccaaggacaaggcactgacgaacagcagcagaagtggttgcctctagcttataggatgcaaataattggttgctatgcccaaactgaactgggtcatgggtccaatgttcaagggctagaaacaactgcaacgtttgatcccaaaacagacgaatttgttatccatagccccacattgacttccagcaaatggtggcctggtggattgggtaaaatatccacccatgctgttgcttatgcccgtctaattattggtggtgaagaccatggagtgcatggtttcatcgtccagctgcggagcttggatgatcacttgcctcttccaggcataactattggtgatattgggatgaaatttggaaatgcagcttataacaccatggacaatggagttctaagatttgaccatgtacgaattccaaggaatcaaatgttaatgagggtttcacaggttaccagagaaggaaaatatgtaagctcaaatgttccaagacaattagtttatggtactatggtaaatgtgagacagaaaatcgtagctgatgcatcagttgctttgtctcgagcagtttgcattgctacaagatatagtgctgttagaagacagtttggatcacataatggaggtctagaaacacaggtgattgattacaaaacacagcaggctaggctcttccctttgctggcttctgcttatgctttcagatttgtgggtgggtggctgaaatggctttatatggatgtgacggaaagattgcaagctaatgatttttcaacattgcctgaggctcatgcatgcactgctggattgaaatccttgactactacagcaactgctgatggaattgaagaatgccgtaaactatgtggtggtcatggttacctttgtagcagtggtctccctgagttatttgctgtttatgttcctgcctgcacgtatgaaggagacaatgttgtgcttctgttacaggtggcaaggcatctcatgaagactgtttctcagctgggctctggaaataagcccgttggtactacagcttatatggctcgagtggaacaactgatgcaatatcactctgatgttgaaaaggctgaggattggttgaagcctaatgtagtgttggaagcatttgaagctagggcttctaggatgtcagttgcttgtgctcaaaatcttagcaagtttgctaaccctgaagagggttttcaagaactagctgctgatttagttgatgccgcggttgctcattgccagttaattgttgtttccaaatttattgagaagttgcagcaagatatacctggaaagggagtgaaaaagcaattagaagttctttgcagcatttatgctttgtttctacttcataaacatctgggtgattttctttccactggctgcattaacccaaaacaaggatcacttgcaagtgagcagctgagaaacttatattcacaggtccgtcctaatgcaattgcgcttgttgatgcatttaactacactgatcactaccttggttcaattcttggacgttacgatggaaatgtgtatccgaagttgtacgaggaggcatggaaggatcctttgaatgattcagttgttcctgatggctttaaagagtatattcaaccgatgcttaagcaacaactacgtaatgctaggctctagttcattttgtggctatgatgctctctttgcatccaagaaacttatccactattctaatgcaagtatgcaactgttaataaagttgtgtttgttacccagctaatttccatcgcaattaggtgtatctggaaccggaaaaactcatttatttattacattaacgatccttgatgtctaatttcgtgt

SEQ ID NO: 10485 - DNA, 2160 bp, Manihot esculenta
gcattacatgcttttgctcctttctgacattcagaagcccgactacatcgcagcaaacatcacatttgaggtcggtagtttcattgaccaactatggacggcgtcgatcacttggctcacgagaggaataaggcgcaattcgatgtcgacgagatgaagatcgtctgggctggttcccgccacgccttccatgtctccgatcgcatggctcgtctggtcgcaagcgatccagtttttcgaaaggataatagagctatgctaagccggaaggaattgtttaaaaacactctgaagaaagcagctcatgcatggaaacgtatcattgagctccgcctttctgaagaagaggctggtaagttgaggttttatgtggatgaacctgcatttacggatcttcactggggaatgtttgttccagcaattaaaggacaaggcactgatgagcagcaacagaaatggctacctttggcatataagatgcaaataattggatgctatgcacaaactgaacttggtcatggctccaatgttcaagggcttgaaactactgcaacatttgatccagagacagatgaatttattattcacagtcctacactaacttcaagcaaatggtggcctggtggattgggtaaaatttccacacatgctgttgtttatgcacgtcttataactgatggtcaagaacatggagtacatggctttatcgtccaacttcgcagtttggatgatcacatgcctcttccaggcataacagttggtgatattggaatgaaatttgggagtggagcatataataccatggacaatggtgttttaagatttgatcatgtgcgcatcccaaggaaccaaatgttgatgcgagtaatgcaggttacaagggaagggaaatgtgtgcaatccaatgtcccacggcaattgatttatggcactatggtattcgtgcggcagacaattgtagctgatgcatcctctgctttatcacgggcagtttgtattgctacaagatatagtgccgtccgcagacaatttggttctcaggatggtggcattgagacccaggtgatcgactacaaaactcagcaaaatagactcttccctttgttggcttctgcatatgctttcagatttgttggtgaatggttgaaatggctttatacggatgtgacccagaggttgcaagccaatgatttctcaacattgcctgaagctcatgcatgtactgctggtttgaagtcattgactacttcagcaactgctgatgctattgaagaatgtaggaaactatgtggtggacatggttacctttcctccagtgggcttcctgagttgtttgctgtttatgttccagcctgtacatatgaaggagacaacgttgtgctgcttttacaggttgcaaggtttctcatgaaaactgtttctcagctgggttctggaaagaggcctattggaacaacagcttacatggcacaggcagaggatcttttgcagtgccgttgtagagttcaaaaggcggaggattggttaaaacctagtattttattggaggcatttgaagccagggctgttaggatatgtgttgcccgtgctgaaagccttagcaagtttccaaatcctgaagagggttttgctgaactctctgctgatcttgttgaggctgcaattgctcattgccagttgattgtcgtgtccaagttcattgagaaattgcagcaagatataccagggaaaggagtgaaacagcaattgcagattctttgcaatatttatgctttgaacctccttcacaaacatctgggtgattttctatctaccggatgcatcacacccgagcaagcttcacttgcaaatgatcagctcagatctttatattcccagatccgaccaaatgccattgcactcgttgacgcatttaactacactgatcactaccttggttcggttcttggttgttatgatggaaacgtatatccgaaactctatgaagaagcatggaaggatccgttaaatgattcggttgtgcctgatggctttcatgaatatgttcgcccaatgctgaagcagcagctccgtaatgccagactctgaagagtgtagagtaatgctatattgttgcgagtaatagtgctactaaagctgcccaaaaggatcaccagaaag

SEQ ID NO: 10486 - DNA, 2514 bp, Tripterygium wilfordii
aagagagcgagcggcgataaaaactcacgtgtgcacacctcacaaagatcagcacgcagacaatcaaacacaactaccacacttgtttctctcgatctatatttgaagcggatatcgagttcgattcggtcgattcttcgacaatggatggcgttgtggatcagctggcggatgagaggaataaggcgcaatttgatgtggaggagatgaagatcgtatgggctggctcacgccacgtcttcgaactctccgatcgtatagctcgtcttgttgccagcgatccggtatttagaaaagataacagagctactctaagcaggaaggacttgtttaaaaacactcttagaaaagcagctcatgcttggaaaaggatcattgagcttcgtctttctgaagaggaggcttctaaattaagattttatgttgatgaagctgcttttacggatcttcattggggaatgtttgtgccagctatcaaggggcaagctactgaggaacagcagcagaagtggctgccattggcatataagatgcaaataattggttgctatgcacaaactgagcttggtcatggctccaatgttcaagggcttgaaaccactgcaacttttgatcctcagactgatgaatttgtcattcatagtcccaccttgacttcatctaaatggtgacctggtggtctgggtaaagtttccacacatgctattgtctatgcgcgccttataactgatggtcaagaacatggagtccatggtttcattgtccagctacggagcttggatgatcacttacctcttccgggcataacaattggcgatattggtatgaaatttggaaatggggcttataacactatggataatggcgttttaagatttgatcatgttcgcatcccaagggatcaaatgttgatgcgggttttgcaggtgacaaggaatggaaaatgtgtacgatccaatgtcccacgtcagttgatctatggtaccatggtgtttgtgcgtcaaacaattgtgtctgatgcttcctgtgctttgtctcgtgctgtttgcattgctacgagatacagtgctgttcgtagacaatttggttcacagaatggtggtgttgagacccaggtgattgactacaaaactcagcagaatagactattccctttgctcgctgctgcctacgctttcaggtttgttggtgagtggttgaaatggctatatacggatgtgactcaaagactgcaagccaatgacttctcaacattgcccgaagctcatgcatgtacagcgggtttgaagtccttgaccactactttcactgctgatgcaattgaagaatgtcgaaaattatgtggtggccatggttacctgtgtagtagtgggcttcctgagttgtttgcagtttatgtgccagcctgtacgtatgaaggagacaatgttgtgctgcttttacaggtggcgaggtttctcatgaagactgtttcccagttggggtctgaaaagaagcccgttgggacaacggcttatatgggacgggtagaacacttgatgcaatgtcgctgcagtgtgcagaaggctgaggattggttaaatcctaatacaatactagaggcttttgaagccagggctgccaggatgtctgttgccgttgcacaaaaacttgcacagtttgcaaatccagaagagggttttttggaactctcacctaatttggttgaggcttcggtcgctcattgccaattaatcgttgtctccaaattcattgaaaaattgcagcaggacataccggggaagggagtgaaagagcttttggggatgctgtgcaatatttatgctttgaatattcttcacaaacatctgggtgattttctatctactggttccattactcccaagcaaggttcgcttgcaaatgatcagcttagatcattatattcccaggtccgtccaaatgcaattgcacttgtcgatgcatttaactacactgatcactaccttggctctgttcttgggcgatatgacggaaatgtttatcctaaactttatgaggaagcgtggaaagatcctctgaatgactctgttgtacctgatggctaccatgaatatattcggccgctgctgaagaaccaactccgtaatgcaaggctctgaaatgcaggccgatgctgtttggttctgattacttaaatttgttgagtattttgttaaataaagtgctaggaaggcgatccccctgactgggcgtgtcgtgattgaatgacgctactagcaattaccttcacataaaagtgttccattctgattagggtctggggattctgaggattggaatatttctctcagcataaatgtgattgaacatggaactcgtctttaacattttctctattttgttacgtcagtatcctttctatcctgtatagtgtcaatctatccatggagatattgctagctataaatgaagattatccttggttattcggtcggtttttgatcgattcgtaccaaatattttttgaaaaat

SEQ ID NO: 10487 - DNA, 2178 bp, Glycine max
acagagtacaagatttaaacacgcgaacaccgtgtttgaaaatcgaacataagagaagagggcgcaatcgttagggtttccaagatggaaggcatggttgatcacctggctttcgagcggaacaattcgcagttcgatgtcgacgagatgaagatcgtttgggccggttctcgtcacgcttttgaagtatctgacaaaatggctcgcctcgttgccagcgatccggcattcagaaaggatgatagagttgtgcttgataggaaggctttatttaagaacactttgaggaaagcagcttatgcatggaaaaggattattgagctccgtctcagtgaagaggaagctgctatgctcagatcctttgtggaccaacctgcttttacggatctacattggggaatgtttgttcctgctatcaaaggacaaggaactgaggaacagcagaagaagtggttgcctttggctcataagatgcaaataattggttgttatgcccaaactgaacttggccatggatctaatgttcaagggcttgaaacaactgcaacctttgatcccagaacagacgagtttgtaattcatagccccacattgacttcaagcaaatggtggcctggtggattgggtaaagtgtcaacacatgccgtggtttatgcccgactaattactgatggccaagatcatggagtgcatggtttcattgtccagctgcggagcctggatgatcacttacctcttccaggcataactgttggtgatattggaatgaaatttggaaatggagcatataactccatggataatgggatgctaaggtttgaccatgtacggattccaagaaatcaaatgttaatgagggtttcacaggtaacaagggaaggaaaatatgtacaatccagtgttccacgacaattagtctatggtactatggtatatgtaagacaaacaattgtatctgatgcgtcagttgctttgtcgcgagcagtttgcattgctacaagatatagtgctgttcgaagacagtttgggtcaaaagagggaggtcttgagacacaggtgattgattataaaacgcagcaagctaggctcttccctttgttagcttctgcctatgccttcagatttgttggtgaatggttgaaatggctttatatggatgtgatgaaaagattgcaagccagtgatttttcaaccttacctgaggctcatgcgtgcactgcagggttgaagtccttgactacttcagcaactgctgatggaattgaggaatgccgcaaactatgtggtggccatggttacctttgcagcagtggtctccctgagttatttgcagtctacattcctacctgcacatatgaaggagacaacactgtgctgcttttacaggtggctaggcatctcatcaagactatttctcagttgggctccagaaacaagcctgttggtacaacatcttacattggacgagtggaacagcttatgcaatatcgttctgatgttcagaaagtggaggattggctgaagcctaatgcagtgttgggagcatttgaagctagggctgctaagaaggtggttgcttgtgctcaaaatctcagcaagtttaccaatcccgaagaaggtttccaagaactctcagtcgatctagttgaggcagctgttgctcattgccagttaattgttgtttccaaatttattgagaagttgcagcaagatatccctggaaagggagtgaaacagcaattagaacttctttgtagcatttacgctttgtttcttcttcacaagcatttgggtgattttcttgcaactggctgcatcactcccaaacagggttcccttgcaaatgagctgctgaggtccttgtattcacaggttcgtcctaatgcaattgcacttgttgatgcgtttaactacactgatcactaccttggttcggttcttggtcgctatgatggagatgtgtatccaaagctgtacgaggaggcatggaaggatccattgaatgattcagttgtgccagatggcttccaagaatatattcgaccaatgctaaagcaacaacttcgtaatgctagactctaaattacttttttataactgcactgttgatactggagaaagttatgtattgctttcaatttaaaagacagtaataaagttctacgaaagggaaacaaa

SEQ ID NO: 10488 - DNA, 2344 bp, Glycine max
ggaagaggtgctagcaattacatttggcggttggggcagataaaaagcagagtgggatcagcaaatccatgtttcattcactcttctaaccaaacccgaaaacagagtacaagatttaaacacgcgaacaccgtgtttgaaaatcgaacataagagaagagggcgcaatcgttagggtttccaagatggaaggcatggttgatcacctggctttcgagcggaacaattcgcagttcgatgtcgacgagatgaagatcgtttgggccggttctcgtcacgcttttgaagtatctgacaaaatggctcgcctcgttgccagcgatccggcattcagaaaggatgatagagttgtgcttgataggaaggctttatttaagaacactttgaggaaagcagcttatgcatggaaaaggattattgagctccgtctcagtgaagaggaagctgctatgctcagatcctttgtggaccaacctgcttttacggatctacattggggaatgtttgttcctgctatcaaaggacaaggaactgaggaacagcagaagaagtggttgcctttggctcataagatgcaaataattggttgttatgcccaaactgaacttggccatggatctaatgttcaagggcttgaaacaactgcaacctttgatcccagaacagacgagtttgtaattcatagccccacattgacttcaagcaaatggtggcctggtggattgggtaaagtgtcaacacatgccgtggtttatgcccgactaattactgatggccaagatcatggagtgcatggtttcattgtccagctgcggagcctggatgatcacttacctcttccaggcataactgttggtgatattggaatgaaatttggaaatggagcatataactccatggataatgggatgctaaggtttgaccatgtacggattccaagaaatcaaatgttaatgagggtttcacaggtaacaagggaaggaaaatatgtacaatccagtgttccacgacaattagtctatggtactatggtatatgtaagacaaacaattgtatctgatgcgtcagttgctttgtcgcgagcagtttgcattgctacaagatatagtgctgttcgaagacagtttgggtcaaaagagggaggtcttgagacacaggtgattgattataaaacgcagcaagctaggctcttccctttgttagcttctgcctatgccttcagatttgttggtgaatggttgaaatggctttatatggatgtgatgaaaagattgcaagccagtgatttttcaaccttacctgaggctcatgcgtgcactgcagggttgaagtccttgactacttcagcaactgctgatggaattgaggaatgccgcaaactatgtggtggccatggttacctttgcagcagtggtctccctgagttatttgcagtctacattcctacctgcacatatgaaggagacaacactgtgctgcttttacaggtggctaggcatctcatcaagactatttctcagttgggctccagaaacaagcctgttggtacaacatcttacattggacgagtggaacagcttatgcaatatcgttctgatgttcagaaagtggaggattggctgaagcctaatgcagtgttgggagcatttgaagctagggctgctaagaaggtggttgcttgtgctcaaaatctcagcaagtttaccaatcccgaagaaggtttccaagaactctcagtcgatctagttgaggcagctgttgctcattgccagttaattgttgtttccaaatttattgagaagttgcagcaagatatccctggaaagggagtgaaacagcaattagaacttctttgtagcatttacgctttgtttcttcttcacaagcatttgggtgattttcttgcaactggctgcatcactcccaaacagggttcccttgcaaatgagctgctgaggtccttgtattcacaggttcgtcctaatgcaattgcacttgttgatgcgtttaactacactgatcactaccttggttcggttcttggtcgctatgatggagatgtgtatccaaagctgtacgaggaggcatggaaggatccattgaatgattcagttgtgccagatggcttccaagaatatattcgaccaatgctaaagcaacaacttcgtaatgctagactctaaattacttttttataactgcactgttgatactggagaaagttatgtattgctttcaatttaaaagacagtaataaagttctacgaaagggaaacaaatttgacatcaactttgacaaaattgattatgaatagaattgattttggttaaagttgattttaaa

SEQ ID NO: 10489 - DNA, 2199 bp, Manihot esculenta
ttatttggattccaacgatggagggcgtcgattacttggctcacgagaggaacaaggcgcagtttgatgtcgacgagatgaagatcgtctgggcgggttcccgccacgccttcgacgtctccgatcgcatggctcgtctcgtcgctagcgatccggtgtttcaaaaggataacagagcaatgctaagcaggaaggtgttgtttaaaaacactttgaggaaagcagctcatgcatggaaacgtatcattgagcttcgcctttctgaagaagaggccaatcagttgaggtcttatgtggatgaacctgcttttacagatcttcattggggaatgtttgttccagcaattaaaggacaaggcactgaggatcagcaacagaagtggctacctttggcacacaagatgcaaataatcggctgctatgcacaaacagaacttggccatggctccaatgttcaagggcttgaaactactgcaacatttgatcccgcgacagatgaatttgtcattcatagtcctacactaacttcaagcaaatggtggcctggtggattgggtaaagtttccacacatgctgttgtttatgcacgtcttataactggtggtcaagagcatggagtacatggctttattgtccaacttcggagtttggatgatcacatgcctcttccaggcataacagtaggtgatattggaatgaaatttgggagtggggcatataataccatggataatggtgttttaagatttgatcatgtgcgaatcccaaggaaccaaatgttgatgcgagtaatgcaggttacaagggaagggaaatgtgtgcaatctaatgttccacggcaactaatttatggcactatggtgtacgttcggcagacaattgtatctgatgcttcttctgcattatcacgggcagtttgtattgctacaaggtatagtgctgttcgcagacaatttggttctcaggatggtggtattgagacccaggtgattgattacaaaactcagcaaagtagactcttcccgttgcttgcttctgcatatgctttcagatttgttggtgaatggttgaaatggctctatctggatgtaacccagaggttgcaagccagtgatttctcaacgttgcctgaagctcatgcatgtactgctggtttgaagtctttgaccacttctgcaaccgctgatgccattgaagaatgtaggaaactttgtgggggacatggttaccttacctccagcgggcttcctgagttgtttgctgtttacgttccagcctgtacatatgaaggagacaatgttgtgctgcttttacaggttgctaggtttctcatgaagactgtttctcagctgggttctggaaagaagcctgtgggaacaacagcttacatggcgcgtgcagaggaccttttgcagtgtcattgtattgttcaaagggctgaggattggtcaaagcctagtgtaatattggaggcatttgaagccagagcttttaggatgtgtgttgcccgtgctcaaagccttagcaagtttccgaatcctgaagagggttttgcggaactgtcagctgatcttgctgaggctgcaattgctcattgccagttgattgttgtttcgaagtttattgaaaaattggaacaagacattccagggaaaggagtgaaacagcagttggagattctttgtaatatttatgctttgaacctccttcacaaacatctgggagattttctatcaactggatgcatcacacccaagcaagcttcacttgcaaatgatcatctcagatctttatattcccaggtccgtccaaatgcaattgcacttgttgacgcatttaactacactgatcactaccttgggtcggttcttggtcgctatgatggaaatgtgtatcaaaaactctatgaagcagcatggaaggatcctctaaatgactcggtcgtgcctgatggctaccaggaatatattcgaccaatgctaaagcaacagctccgtaatgcaagactctgatgattatagaaatggatctcttattatgagcaataacatgctaataaagctgccccaaagtccaagggtggaattttcattatcgtagaaaccatggaccaattatttttgtatatctggacaattagtatgttatttatgaattgatttgctgttttatgatatttatacaatcttcctttgtccc

SEQ ID NO: 10490 - DNA, 2523 bp, Cicer arietinum
gaccaatactcgagtagtctacgatatcataaatattcatatttgagaaaacgttgaaaacagaaagaaagaatgggaaatacacgataaataaattggcatcgtcatcacactttacaaaaggaggttcaacacaacacactttctctattctttaaatacttcaaaataaaaaatcagagctcacatagttcctgtcgcaaccaaaacagaaaagagaaatggcaggcgttgatcatttggatttcgagaggaacaaagcgcaattcgatgtggcagacatgaagatcgtttgggctggttctcgtcaagaattcgagctttccgatcgaatttctcgcctcgttgctagcgatccggaattccgaaaggataacagaaccagtcttgacaggaaggagttatttaaaaacacgttgagaaaaacagctcatgcatggaaaaggatcaacgagcttggtcttaatgaacaggaagctactaagtttagatcttttgtggatgagcctgcttttactgatcttcattggggaatgtttgtgcctgctatcaaaggtcaaggcactgatgagcaacaagaaaagtggttgcctctagcttataagatgcaaattattggttgctatgcccaaactgaacttggtcatggatccaatgttcaagggctagaaacaactgcaacatttgatcccaaaacagatgagttcattattcacagtcccacattgacttccagcaaatggtggcctggtgggttgggtaaaatatcgacacatgctgttgtttatgcacgtcttattactgacggtcaataccatggagtgcatggtttcattgtccagctgcggagcttgaacgatcacttgcctcttccaggcataactgttggagatattggaatgaaattcggaaatgcagcatataacagcatggataatggagttctaaggtttgacaacgtacgaattccaaggaatcaaatgttaatgagggtttcacaggtcacaagagaaggaaaatttgtacaatccaatgttccaagacaattagtttacggtactatggtatttgtgagacaggcaattgtagctgatgcatcaactgctttgtcacgagcagtttgcattgctacaagatatagcgctgttcgaagacagtttggatctcataatggaggtctggaaacacaggtgattgattacaaaacacaacaggctagactctttccattgctagcttctgcttatgcttttagatttgttggtgaatggctgaaatggctttacacggatgtaactcaaagattacaagccaatgatttttcaacattgcccgaggcccatgcatgcactgcagggttgaaatccttgactacttccgcaactgctgatggcattgaagaatgccgtaagctatgcggcggtcatggttatctttgtagcagtggtcttcccgagttatttgcagtttatgttcctgcctgcacatatgaaggagacaacactgtgatgcttttacaggtggcaaggtttcttatgaagactatttctcagttggcatctggaaataaacctgttggtaccacagcttatttgggtcgagtggaacaattgatacaatatcgctctgatgttaaaacagctgaggattggttgaagcctaatgtagtgattggagcatttgaagctagggctgccaggatgtctgttgctgttgctcaaaatcttagcaagtttgctaatcctgaagagggatttcaagaactctcagctgatttagttgaggcagcagctgctcattgtcagttaatcgttgtttccaaatttatagagaagttgcagcaagatatacctggaaagggagtgaaacagcagttagaagttctttgcagcatttatgctttatatcttcttcataagcatctgggagattttctttccactggctgtatcaatcaaaaacaaggatcactcgcgaatgacctattgaggtccttgtattctcaggttcgtcctaatgcgattgcgcttgttgatgcatttaattacaccgatcacttgcttggttcggttctcgggcgctatgatggaaatgtttatcctaagttgtatgaagaagcttggaaagatcctttgaacgattcagttgttcctgatggctttaaagagtatgttcaaccaattctcaggcaacaaatacgtaatgctagactctagagtagtattttataattcggctggtagtactatttttattgaaaattgtcaataaagttgcatggatggataaataaatgtagatgaatacatacgagaggaattttgatcataagtttattttcatggttaatagcattcatgagaataagtaacaattcggtgtatctggcatggaactagaaaaaaatcattatttatttattgatacttgattccttatgtttcattgatattgtttcttgtggcatttacattaagcctaacatcacaggcttttatgctcacacctacacttatttccaac

SEQ ID NO: 10491 - DNA, 2453 bp, Aquilegia formosa
tatatagatagatagagatcgcaattcgtaactctaaactaattctttcttcttgttcgtgtgtttgttattgttattgattgattgtttcgattgatcgagagataatggaggtaatagatcagttagctccagaaagaagcaaatctcaatttgatgttgatgcaatgaagattgtttgggctggttctcaacatgcttttgatatttctgatcgaatggctcgacttgttgctagcgatcctgcttttcgcaaggattacagagtcacccttggtcgaaaggaattgtttaaaaacactcttagaaaagcagctcatgcttggaagcgaatcattgagcttcgtttaactgaggaagaagcatccaagctaaggacatttgtcgatgaacctgcttttacggatctgcattggggtatgtttgtacctgctattaaaggacaaggtacagaggagcagcaacagaagtggttacccttggcatataagatgcaaataattggctgctacgcacaaacagaacttggccatggttccaatgtgcaaggactggaaaccacagcgacatttgatcccgcaaccgatgagtttgttattcatagtcctaccttgacttcaagcaagtggtggccaggtggtctgggtaaagtttcaacacacgcagttgtttatgcccgtcttattacagatggcaaggactatggcgtgcacggtttcattgtccagctccgtagcttagatgatcattcagctcttccaggaattacagttggtgatattggaatgaagtttggaaatggagcatacaacaccatggataatggtgtcctccattttgatcatgttcgtattccaagggaacaaatgttgatgcgggtttctcaggttacaagggagggaaaatttaagcaatcagatgtaccccgacaacttctttacgggacaatggtgtacgtgcgccaaacaattgtggctgatgcttcttctgctctatcccgtgcagtttgtattgccacgagatatagctgtgttcgaagacaatttggttcacaggatggtgggcctgagacccaggtcattgattacaagactcagcagagcaggctcttcccattgctggctactgcctatgcttacagatttgttggtgagtggctgaactggttgtacacagatgtgacccagagattgcaagcaaatgacttttccacattacctgaggctcatgcatgcactgctggcttgaagtccttgaccacttcctttacagctgatgggattgaagaatgtcggaaactttgtggtgggcatggttacctatgtagcagtgggcttcccgagctatttgccgtttatgtccctgcctgcacatatgagggagataatactgttctacttttacaggttgcgaggtttctaatgaaaactgtttctcagctggggtctgataaaaaacctgttggaacaacgtcttatatgggacgaatagaacatttaatgcagtgtcgctgtgatgttcaaagagctgaggattggtcaaagcctggtgtaatattggaagtatttgaagcaagagctgctaggatgaatgttgcctgtgctcaaaacgtaagcaaaatgccaaacccagaagaaggtttttccgaactatcatctgatttagtggaggcagctgttgctcactgccaattaattgtcgtttccaaattcatggagaagctacaacaagacatagctggaaagggggtaaaggaacagttacaattgctctgcagcatctatgccctatccttagttcataagcatcagggtgatttcctttccactggaaccatcacagcgaagcaagcctcgcttgtaaatgctcagctcagatctttcaatgctcagctccgtccgaatgcagttgcactagttgatgcatttaactacactgaccactaccttggctctgtcctcggtcgctacgatgggaatgtttatccaaaactttatgaggaggcatggaaggatccactcaacgactcagttgtgcctgatggctatcatgaatacatttaccctatgctcaagcaacaactccgcaccgcaagactctgaactttgccttttgtaacctgctgtttatgcaccctcagttattgtgaataaattttttctcgggtaggttaaactgaataaaatagtcataatgcagcccacaagaatgacatggttcttgtgtacaaccattttctctgtagcagactaagtaggatggctgattgatttatacaggcataagttgtgtaagagcaacattattttcagggagaaatagggaggcgccattaatatttcataaaatattttatatagttttgttgtgtaaaatgtctatcttgaagcacattgttctgctgcaacttatgcactactttaaggattgaattgagacccgagttctaatag

SEQ ID NO: 10492 - DNA, 2330 bp, Papaver somniferum
gacttcttctccttctcttccataacaacaacactacctaaaaaagatgccagctccattattagttattgctacaaaaacacatgcttatctcgatatttattaggattttaggagagtctgaggataaggctggtatttctaaattttgatttgccgatcatatctcagtacaaatacacaacaggttgttagttttttgttcaaattagtctggttttaaaattcattttttctcttgaaacttttagatcgaggaagatggaggaattagattacttagctaatgaaagacaatcagctgaatttgatgttgaagctatgaagattgtttgggctggttcccaacaatcctttgaaatttctgaccggatgtctcgtcttgtagctagtgatcctgccttccgcaaagacaatagaacaatgttgccccgtaaggaattattcaaaaacactttgagaaaggcagctcatgcgtggaaacggatcattgagctctgcctttctgaggcagaggcagccaagttgagattttttgttgatgaacctgcttttaccgatcttcattggggcatgtttgtacctgctataaaaggacaaggcacccaggaacagcaagataagtggttaccgctggcgtataggatgcaaataattggatgctatgcacagacagaactcggccatggctctaatgttcaaggacttgagacaaccgctacatttgattcagaaactgacgagtttgtcctacacagtcctaccttaacttcaagtaaatggtggcctggtggactggggaaagtttcaactcatgctgttgtgtacgcccgtcttctgattaacggaaaagactatggggtgaatggttttatcgttcaactgcggagcttggatgatcatttacctcttccaggcatcactgtaggggatattggaatgaaatttggaagtggagcatacaacactatggataatggtgttctacagtttgaccatgtgagaatacctaggactcaaatgttgatgcgggtttctcaagttacgagggaaggaaaatatgtgcaatctgatgtgccgcggcagcttgtgtatgggactatggtgtatgtgcgccaaactattgtagcagatgcttcttgtgctttatcacgagcagtatgtatagctacaaggtatagtgctgttcggagacaatttggttcacaggatggaggacccgagacccaggtgatcgattacaagactcagcaaagcagactcttccctttgctggctacagcatttgcttacaggtttgttggtgagtggttaagctggttatatacggacgtgactcagagattgcaagccaatgatttctccacattgcctgaggctcatgcatgcactgctggtttaaagtctttgactacttccacaactgcggatgcaattgaagaatgtcgaaaactatgtggtggtcatggttacctatccagcagtggactgcctgagttatttgctgtatatattcctgcttgtacctatgaaggagataacaccgttctgcttttacaggttgcaaggtttctcatgaagactgtttctcagctgggttctaataaaaaacctgttggaacgacggcttatatgggaagaattgagcacctaatgcagtgtcaatgcaatgctcaaagagctgaggattggttgaagcctagtgttgtgattgaggcttttgaagcaagggctgctaggatgtctgttgcatgtgctaaaaatataagcaaaatgccaagtccagaagcaggctttgccgagctctctccggatctagcggaagctgctgttgctcactgccagttgattgttgtttccaaattcattgagaagttgcaacaagacatagctggaaaaggggtgaaagaacaactcgaggttctctgcagcatatatgctctctcccttcttcacaagcaccagggtgatttcctttccactggaagcattaccccgaagcaagcttcacttgcaaatgatcagctcagatcactttatgctcaggctcgcccaaatgctgttgcactagttgattcattcaactacacggaccatttcctcggctcggttcttggacgttatgatgggaacgtgtacccaaaactgtatgaggaggcatggaaggacccactcaatgacaccgttgttcctgatggttatcatgaatacatccgtccattactgaaaaaccaacttcgaactgcaaggctctgaagtcacaagttgcaaataagcaaccatacccctagaagtttagtgattggttaagtgccaacatatttgaaaaa

SEQ ID NO: 10493 - DNA, 2442 bp, Theobroma cacao
ttcatatgcaattcggctattccaagactcctagttcttgttgctctttttgctctgtttgtttccatttttttgcataaccaaagccaaaatacaatttcggaatttagatttgaatcgagaggaaaatggaggcactggattaccacgcgggggagaggagcaaggcggagttcgatgtggaagagatgaagatcgtttgggcagggtctcgtcacgcctatgaaatctctgatcggattgctcgtctcgtggctagcgatccggtctttcgaaaggataacagaactatgctaagtaggaaggacttgtttaaagatactttgaaaaaggctgctcatgcatggaagcggataattgagcttcgtctctctgaagaagaggcctctagaatgaggttttttgtggatcagcctgctttcacagatcttcactggggaatgtttatacctgctattaaaggacaaggtacagaggagcagcaacagaagtggctcccagtggcatataagatgcaaataattggatgctatgcacaaactgaacttggtcatgggtccaatgtccaagggcttgagaccactgcaacatttgatcctcagactgacgaatttgtcattcatagtcccacattgacttcaagcaaatggtggcctggtggattgggtaaagcatccacacatgctgtggtttatgctcgtcttataacagatggacaagaccatggagtgcatggttttattgttcagctacggagcttggatgatcacctacctcttccaggcataacagttggtgatattggaatgaaatttggaagtggggcatataacagcatggacaatggtgttctgagatttgatcatgtgcgcattccaagggatcaaatgttgatgcgggtttcacaggttacaagagaagggaaatatatgcactctgatgttcctcgccagctggtttacggtactatggtctatgtccgacaacaaattgtattagatgcttcttgtgctttatcaagggcagtttgtattgcaacaaggtatagtgctgttcgtagacaatttggttcgcagaatggtggtccagagactcaggtgattaactataaaactcagcaaagtagactcttccctttgcttgcttctgcctatgctttcagatttgttggtgagtggctgaactggctgtacactgatgtgacccaaagattgcaagccaatgatttctccacgttatctgaggctcatgcatgtactgcagggttaaagtctcttactactactgcaactgcggatgctattgaagaatgccgaaaattatgtggtggccatggttacctttctagcagtgggcttcctgagttatttgcagtttatgtccctgcctgtacatatgaaggagacaatattgtgctgcttttacaggttgcaaggtttttaatgaagaccgttgcccagctgggttctgaaaagaagcctgttggaactacagcttatatgggacgagcagaatacctcatgcaatgccattgtgatgttcaaagggctgaggattggctaaagcctagtgtaatagtggaggcatttgaagcgagggctgctaggatgtctgttgcctgtgctaaaagccttagcaaattttcaaatccagaagagggttttgctgaactctcagctgatttggttgaggctgcagttgctcattgtcagttaattgtagtttccaagttcattgagaaattgcaacgagacataccaggaaagggagtgaaaagacagatggaaatcctctgtaatgtatatgctttgtctattttacacaaacatcttggtgatttcgtctccactggctgcattactcccaagcaaggtgcactagcaaatgaacagctcagattgttgtacacgcaggtccgcccaaatgctattgcccttgttgatgcattcaattacactgaccactaccttagctcggttcttggccgctacgatggaaatgtatatgcaaaactctacgaggaggcatggaaggatcctttgaatgatacggttgtgccagatggttaccatgagtacattcggccaattttgaagcaacagcttcgtactgcaaggctctaaagaaaacaaatcccaccatgctgttgattcaacatcctgaactgcatattaggttatgaatgaataaagtgccaacctattcaacctgaaagaggaaggtcagtttcactggtctatagacatctatttacatctcttagattatggctgattagtggttctttatcgacataaaatcttttcttcatatgtacttggaacaaaggatatattttgctcttatcaagtaatttccctgatccctcattatgtatttatgtactctatatgtattcaaacgcagcttgcctaatcctcaaattagtaagtttcgtaattg

SEQ ID NO: 10494 - DNA, 2474 bp, Cajanus cajan
atagccaaaagcggtattgcttggaaaacgagagttcatttcagaaacacactctgagggtttggtttggtgtggcgaagatggaagatggcgttgaccacttggctttcgagaggagcaaggcgcaattcgatgtggacgagatgaaaatcgtttgggcaggttctcgccaagagtttgagctctccgatcggatttctcgccttgtcgccagcgatcctgcgttcagaaaggatgacagaatcacgcttgatagaaaggagttatttaagaacactttgagaaaagcagcttatgcatggaagaggataactgagctccgtcttaatgaacaagaggcttataagctcaggtccttcgtggatcaacctgcatttacggatcttcattggggaatgtttgtgcctgctatccaaggacaaggcactgaggagcagcagcagaagtggttgcctctagcttataagatgcaaataattggttgctatgcccaaactgaacttggtcatggatccaatgttcaagggctagaaacaactgcaacatttgatcccaaaacagacgagtttattatccatagccccacattgacttccagcaaatggtggcctggtggattgggaaaaatatccacgcatggtgttgtttatgcccgtttaattattgatggtcaagaccatggggtgcacggtttcattgtccagctgaggagcttggatgatcactatcctcttccaggcataactattggtgatattgggatgaaatttggaaatggagcgtataacaccatggataatggacttctgagatttgatcatgtacgaattccaaggaatcaaatgttgatgagggtttcacaggtgaccagagaaggaaaatttgtgcactctgatgttccaagacaattagtttatggtactatggtaaatgtgagacaaaagattgtgtctgatgcatcggttgctttgtctcgagcagtttgcattgctacaagatatagtgctgttcgaagacagtttggatcacataatggaggtctagaaacacaagtgattgattacaaaacgcagcaggctaggctcttccctttgctggcttctgcttatgctttcagatttgctggtgagtggctgaaatggctttacagggacgtgacggaaagattgcaagctaatgatttttcaacattgcctgaggctcatgcatgcaccgcagggttgaaatccttgactactacggcaactgctgatgcaattgaagaatgtcgtaaattatgcggtggtcatggttatctttgtagcagtggtctccctgagttatttgcagtttatgttcctgcctgcacgtacgaaggagacaatactgtgttgcttctacaggtggcaaggcatctcatgaagactatttctcagctgggctctggacgtaagcctgttggtactacagcttacatgggtcgattggaccaactgacgcaatatcactctgatgttaaaaaagctgaggattggctgaagccaaatgtagtgttggaagcttttgaagccagggctgctaggatgtctgttgcttgtgctcaaaatcttagcaagttcgctaatcctgaagagggttttcaagaactcttggctgatttagctgaggcggcagttgctcattgccagttaattgttgtttccaaatttattgagaagttgcagcaagatatacctggaaagggagtgagacagcaattagaagttctttgcagcatttatgctttgtctctacttcacaagcatctgggtgattttctttccactggctgcataaacccaaaacaaggatcactcgccagtgagcaactgagatacttgtattcacaggttcgtcccaacgcaattgcgcttgttgatgcattcaattacaccgatcactaccttggttcaattcttgggcgttacgatggaaatgtgtatccgaagttgtacgaggaggcatggaaggatcctctgaatgattcagttgttcctgatggctttaaagagtatgttcaaccgatgcttaagcaacaactacgtaatgctagactatagttaattttgtggccatgctcctgtatctaacaaattaatccacgctattctgatttacaagcgtcaataaagttgtgtggaaggataaaaaagtgtcattcgaatggaaatttgttagccacattatttccatctttgacattattaaggaagtcataattgggtgtacctggaatggaactcgaacatcttatttatctacattttttttttattttctgtgttaaattagacttttggtctcttatcttttttatttttatttttatttttatttttttatttgtaattttgatttttatttaaaaataaagacatttagtctttattttagagtataggattttgatttccttatcaaattgatatatattaattgttaaattttaacattca

SEQ ID NO: 10495 - DNA, 2103 bp, Ricinus communis
ctgctctctctccttctgaaagaaaagaaaaagaaaataaatccaggagcttagaatttggtaatttgaccatccaccaaaatggaaggcgtcgatcacttggccgaagagaggaacaaggcgcaatttgatgtcgacgagatgaaaatcgtctgggctggttcccgccatgccttcgacgtcgccgatcgcatggctcgtctcgtcgccagcgatccggcatttagaaaggataacagagcgatgctaagtagaaaggaattgtttaaaaacactctaaggaaagcagctcatgcttggaaacgtatcattgaacttcgtctttctgaagaagaagcaagtaagctaaggacttttgtcgatgaaccagcctatactgatcttcactggggtatgtttgttccagcaattaaaggacaaggtacggaagagcaacaaaagaagtggcttcctttggcgcataagatgcaaattattggctgctatgcacaaactgaacttggtcatggttccaatgttcaaggcctggaaaccactgcaacttttgatcttgagaccgatgaatttgtcattcatagtcctacattgacttcgagcaaatggtggcctggtggattgggtaaagtttccacacatgctgttgtttatgcacgactaataacagaaggtcgtgaacatggagtgcatggctttatcgtccagcttcggagtttggatgatcacatgcctcttcccggcataactgttggtgatattggaatgaaatttgggagtggcgcatataataccatggacaatggtgttctaagatttgatcatgttcgcatcccaaggaaccaaatgttgatgcgggttatgcaggttacaagggaagggaaatgtgtgcaatccaaggttccacggcaattaatttatggcactatggtgtatgtgcggcagacaattgtagctgatgcttccgctgctttatcacgggcagtttgtattgctacacggtatagtgctgttcggagacaatttggttcaaatgatggtggtgttgagactcaggtgattgattacaaaactcagcaaagcagactctttcctttgctggcatctgcatatgctttcagattcgttggtgaatggttgaaatggctttatacggatgtgacccaaaggctgcaagccaatgatttctcaacattacctgaggctcatgcgtgtactgctggtttgaagtccttgactacttctttcactgctgatgccattgaagaatgtaggaaactttgtggtggacatggttatcttactgcgagtggccttccagagttgtttgcagtttatgttcctgcctgtacatatgaaggagacaatgttgtgctgcttttacaggttgcaaggtttctcatgaagactgtttctcagctgggttctggaaagaagcctgttggaacaacagcttatatggcacgggtagaacatcttttgcagtgtcgttgtggtgctcaaaaggctgaggattggctaaagcctaatgtgatattggaggcatttgaagccagggctgctaggatgtgtgtcacccgtgctcaaagccttagccactatccaaatcctgaagagggttttgcagaactgtcagctgatctagttgaggcagccgtcgctcattgccaattgattgttgtttccaagttcattgagaaattgcagcaagagataccagggaaaggtgtgaaacaacagttgcagattctttgctacatgtatgctttgaaccttcttcataaacatcagggtgattttctctccactggatgcatcacacccaagcaagcttcacttgcaaatgaccaactgagatctttatattcccaggtccgtcccaatgcaattgcacttgttgatgcatttaactacactgatcactaccttggttcggttcttggttgctatgatggaaatgtttatccaaaactctacgaagaagcatggaaggatcctctaaatgattcagttattcctgatggctacaatgaatatgttcgccctatgctgaagcaacagctacgtaatgcaagactctgaagaatacgtgtttgatctatatgctct

SEQ ID NO: 10496 - DNA, 2923 bp, Populus trichocarpa
attatgtgtatgcaagctgctaccccccaccaaaccaaaccaaaccaacttaattcccttcccttcccttcccttttatagcttcaacaaactccatccctatcgatctatttaccagaagaacatccaagtccagccctctccctttctctttgctattttgtagagtctggtagttttaacaaaagaaaatgaaaggagtggatcacttggctcacgagaggaacaagactgagttcgatgtggatgcgatgaagatcgtgtgggctggttctcgccacgcctttgaactctcagaccgcatggctcgtctggtcgcctccgatccggcgtttcaaaaggatggcagaactcggctagggaggaaggaattgttcaaaaacactttgagaaaagcagctcatgcatggaaacgtatccttgagcttcgccttactgaagaagaggctgggtggctaaggagttttgtggatgaaccttcttttacggatcttcattggggaatgtttatacctgctattaaaggacaaggcactgatgagcagcaacagaagtggttgccattggcatataagatgcagataattggctgctatgcacaaactgaacttggtcacggatccaatgttcaagggcttgaaacaactgcaaccttcgatcctgagacggatgagtttgtcattcatagtcctacattaacttcatccaaatggtggcctggaggattgggtaaagtttccacacatgctattgtttatgcacgccttataaccaatggtcaagaacatggagtgcatggttttattgtccagcttagaagcctggatgatcacatgcctattccaggcataaccattggtgatattggaatgaaatttggaaatggggcatataacaccatggataatggtgttttgacatttgatcacatacgcatcccaaggaaccagatgctaatgagagtgctgcaggtcacaagggaagggaaatgtgtgcaatccaatgttccacggcagttgatttatggcaccatggtgttcgtgcggcaaacaattgtagctgatgcttctactgcgttatctagggcagtttgtattgctacaaggtatagcgctgttcgcagacaatttggttcacaggatggtggtatggagactcaggtgattgattacaaaactcagcaaagtagactctttcctttgctggcttctgcttatgcattcagattcgttggtgaatggttgaaatggctttatacggatgtgacccagaggttgcaagctaatgatttttctatattacccgaggctcatgcatgtactgcgggtttgaaatctttgactactactgccactgctgatgctattgaagaatgtaggaaactttgtggtggccatggttatctttgtgccagtgggcttcctgaattgtttgcagtatatgtccctgcctgtacatatgaaggagacaatgttgtgctccttttacaggttgcaaggtttcttatgaaaactgtttctcagcttggttctggaaaaaagcctgttggaacaacagcttatttgggacgagtccaggatcttttacagtgttgttgtgatgttcaaacggctgaggattggttaaagcctagtgtagtgctggaggcatttgaagccaggtctgccaggatgtgtgttgcccgtgctcaaaatcttagcaaatttgaaaatcctgaagatggttttgctgaactctccgctgatctagttgaggcttctgttgctcattgccaattaattgttgtttccaagttcattgacaaattacagcaagatataccaggaaagggggtgaatcgacagttgcagaatctatgctacatctatgctttaaaccttcttcacaaatatctgggtgatttcctctccactggctgcattaccccgaagcaggcttcactcgcaaatgatcagctgagatctttgtattcccagatccgtcccaatgcaattgcacttgtcgacgcatttaattacactgatcactaccttggttcggttctcggccgctatgatggaaatgtgtatcccaaactttatgaagaagcgtggaaggatcctctgaatgactcggttgtgcctgatggctaccatgaatatgttcaccctatgctgaagcaacagctccgtaatgcaagactctgaaaagtgagtgctgtgctgttggctccatacgctttgaagttatgaataataaagctaataaggttacttagaccgtaaccaccaggaaggtcaaggttgggctttattttcttagttagaagctattgtatttgtatcatccaacagaaaatatggttggtatgtttatttttctcggctcctagttgtgacaaatgagccgtggatattagcaagatttgttgatcttgtcatcatttatcatcccgcctcattttttccttggcctcttcttccctcttttaaattttaaaattacgattcatcactcccccatcagaaagtatagttaatttccgtttacagatcaagcaaatctggtcaagctttcctctttcctttgtatttgctgctctcattgctgtagtggttgagggagaatggtgcgtggacgacttgatttacacttgtttctctcaatcgtgtgttgtagaccggaattcaaactgctggatgaatgggcttaatgaatgaaaacataacttgatgaaaattttgcgttttcgtcgaagtaggatttcacgactgcagctcgtcccaggtctagagaggatgcaagttcctcgcataaaaaagaaagaattagcggccttctgccttctttggtttggactaccaaattgaggagtagtccatgagagaaatcgctgaacattttattgaaagctgccccattatttattgagaacattttactg

SEQ ID NO: 10497 - DNA, 2244 bp, Cleome gynandra
ttgaaatctgccctcaattctctttgccagaatctacgtgatagaatcggtgaatcatggacggaggagtcgatcagcttgccgacgagaggaacaaggctgagttcggtgtcgacgacatgaagatcgtctgggcaggttctcgccatgcgtacgaggtttctgatcggatatcccgccttgtggccagcgatccgttgttccggaaggacgatagagcagtgatgagtaggaaggagttgtttaagaacacattgaggaaagcagcccatgcgtggaagaggatcgtcgagcttcgtctctccgaggaagaggctgctagactgaggttcttcgtcgatcacccctcttttcttgatctacattggggaatgtttgtgccagccatcaagggtcagggcacagaggagcagcagaagaaatggttggcgctggccaataggatgcagatcattgggtgctatgcgcaaactgagctgggccacggctccaatgttcaaggcttggagaccaccgccacttttgatcctcagacggatgagtttgtcattcacagcccaactctgacttcatccaaatggtggcctggtggcctcggaaaagtttctacacatgctgttgtttatgcccgtctcataaccaatggtcaagactatggcgtccacggattcatcgtgcaactacgcagtctggatgatcattctcctcttcctggcatcacggttggtgatatcggcacaaagtttggaaatggagcatataattcaatggacaatggctttcttacgtttgatcacgtgcgaattccgagggatcaaatgctcatgaggctatacaaaagtgacaagggaaggaaagtacgtagcgtcggatgttccaagacaactggtttacggcacaatggtgtatgtgagacaaacaatcgtggccgatgcttccaatgcgctgtctcgggcagtctgtatagctacaaggtacagtgctgtccggaggcagtttgggtcgcagaatggtggtctggagacacaggttatcgattataaaacacagcagaataggctgttcccgttgctggcatctgcatacgcctttcgatttgtgggggagtggctgaaatggctgtacacggatgtaactcaaaagctgcaggccaacgatttctcgatattgccagaggctcatgcgtgcactgccggattgaagtctctcacaacctctgccactgcggatggaatcgaagaatgccgtaagttatgtggtggacatggttatttggtctgcagcggactccccgaactcttcgctgtctatgtgcctgcctgcacgtacgaaggagataacgttgtgctgcttttacaggtggcgagatttctgatgaagacggtctcccagctgggttcaggaaagcctcccgtggggactacggcttatatggctcgggctcaacacctcttgcagtgtcgctctgccgtccaaacggctgaggattggctaaaccctagtgtggtcctggaggctttcgaagcgagatccatccgaatggccgtcgcttgtgccaaacatttgaccaagtttgataatcccgaacaaggattcgcagagctctcgggtgatttggttgaagttgcggttgcgcactgccagttaatcgtggtatcaaagttcatcgagaaactgcaacaagagattgcgggagagggcgtgaagaaacaactcgagaacctctgttatgtctacgccctccaccttctgcacaaacacctcggggatttcgtgggcaacggctgcatcacagccaagcaagcctccctggccaatgatcaactgagaagcttgtactcgcggcttcgtccaaacgcggtggcacttgtggatgccttcaactacacggaccattatctcgggtcggtgctgggccgctacgacggcaacgtctacccgaagctcatggaagaagcgtggaaggatcctttgaatgattctgtggtcccagacggctatcaagaatacgtacgacctctcctcaagcagcaactccgcaccgcccgcctctgaaccacaaatgttacaacttaataacgccctttcataccatcattcttctattattatcatatgatttaaatattatagttaattattttacctatctttttattaaatactatagtcaatcatatgatcttattaatacatacatctcaaaaactaatttcatatatatgggtctaaaatttgtatctt

SEQ ID NO: 10498 - DNA, 2435 bp, Papaver somniferum
atctcagtacaaatacactaaaggttgtttagtttttgttcaaattagtctggtttaaaattcattttttctcttgaaaattttagatcgaggaagatggaggaattagattacttagctaatgaaagaaaatcagctaaatttgatgttgaagctatgaagattgtttgggctggttcccaacaatcttttgaaatttctgaccggatgtctcgtattgttgctagtgatcctgccttccgcaaagacaatagaacaatgttgccccgtaaggaattattcaaaaacactttgagaaaggcagctcatgcgtggaaacggatcattgagctccgcctttctgaggcagaggcagccaagttgagattttttgttgatgaacctgcttttaccgatcttcattggggcatgtttgtacctgctataaaaggacaaggctcccaggaacagcaagataagtggttaccgctggcgtataggatgcaaataattggatgctatgcacagacagaactcggccatggctctaatgttcaaggacttgagacaaccgctacatttgattcagaaactgacgagtttgtcctacacagtcctaccttaacttcaagtaaatggtggcctggtggactggggaaagtttcaactcatgctgttgtgtacgcccgtcttctaattaacggaaaagactatggggtgaatggttttatcgttcaactacggagcttggatgatcatttacctcttccaggcatcactgtaggggatattggaatgaaatttggaagtggagcatacaacactatggataatggtgttctacagtttgaccatgtgagaatacctaggactcaaatgttgatgcgggtttctcaagttacgagggaaggaaaatatgtgcaatctgatgtgccgcggcagcttgtctatgggactatggtttatgtgcgccaaactattgtagcagatgcttcttgtgctttatcacgagcagtatgtatagctacaaggtacagtgctgttcggagacaatttggttcacaggatggagggcccgagacccaggtgatcgattacaagactcagcaaagcagactctttcctttgctggctacagcatttgcttacaggtttgttggtgagtggttaagctggttatatacggacgtgactcagagattgcaagccaatgatttctccacattgcctgaggctcatgcatgcactgctggtttaaagtctttgactacttccacaactgcggatgcaattgaagaatgtcgaaaactatgtggtggtcatggttacctatccagcagtggactgcccgagttatttgctgtatatattcctgcttgtacctatgaaggagataacaccgttctgcttttacaggttgcaaggtttctcatgaagactgtttctcagctgggttctaataaaaaacctgttggaacgacggcttatatgggaagaattgagcacctaatgcagtgtcaatgcaatgctcaaagagccgaggattggttgaagcctagtgttgtgattgaggcttttgaagcgagggctgctaggatgtctgttgcatgtgctaaaaatataagcaaaatgccaagcccagaagcaggctttgccgagctctctccggatctagcggaagctgctattgctcactgccagttgattgttgtttccaaattcattgagaagttgcaacaagacatagctggaaaagggtgaaagaacaactcgaggttctctgcagcatatatgctctctcccttcttcacaagcaccagggtgatttcctttccaccggaagcattaccccgaagcaagcttcacttgcaaatgatcagctcagatcactttatgctcaggctcgcccaaatgctgttgcactagttgattcattcaactacacggaccatttcctcggctcggttcttggacgttatgatgggaacgtgtacccaaaactgtatgaagaggcatggaaggacccactcaatgacacagttgttcctgatggttatcatgaatacatccgtccattactgaaaaaccaacttcgaactgcaaggctctgaagtcacaagttgcaagtaagcaaccacatattgaaaaaacatagaagtttagtgattggttaagtgcgaacatattgaaaaaacacaatgcttcaaaaaagaaaaatatatgaaaaaataaatagtgattggctatattgtaatttttttaatatggagaaagcaatgctatgtgctgctaagaatagagagagtgctatgagtcagatttaagttagcaaaggttttgaatgtgttgatcaattggaacttgtctatcctctttagactcaacaggaagagaagcaatttataagttggatcttttttagacctgtgtttcaaatgttacctattttttttttt

SEQ ID NO: 10499 - DNA, 2552 bp, Trifolium pratense
acacaacacacagacactatcttcattctctattgttgaaacttcaaagttcaaaccatttatttggtgttgaaatttcagaactgcagaaaacagagtttgttagttcacacttcacagttccattctcaatcaaaagaatatggaaggcgttgatcatttagctttcgagaggaaaaaagcacaattcgatgtaaacgatatgaagattgtttgggctggttctcgtcaagaatttgaactttccgatcggatttctcgtcttgttgctagcgatccggtattccaaaaggataacagaaccgcgcttgatagaaaggagttatttaagaacactttgagaaaagcagctcatgcatggaaaaggatcatcgagcttcgtcttaatgaacaggaagcttctaagcttagatcctttgtggatcagcctgcttttacggatcttcattggggaatgtttgtgcctgctatcaaaggacaaggaacggatgagcagcaggaaaagtggttgcctctggctaataatatgcaaataattggttgttatgcccaaaccgaacttggtcatggatccaatgttcaagggctagaaacaactgcaacatttgatccaaaaacagacgagttcattattcacagccccacattgacttccagcaaatggtggcctggtgggttgggtaaaatatccacgcatgctattgtttatgcccgtcttattactgatggtcaagaccatggagtgcacggtttcattgtccagctccggagcttggatgatcacttgcctcttcccggcataactgttggagatattggaatgaaatttggaaatgcagcatataactccatggataatggagttctacgttttgaccatgtacggattccaaggaatcaaatgttaatgagggtttcacaggttaccagagaaggaaaatttgtacattccggtgttccaagacagttaatttatggaactatggtatatgtgaggcaggcaattgtagctgatgcatcaattgcgttgtcacgagcagtttgtattgcgaccaggtatagtgctgttcgaagacagtttggatctcaaaagggaggtcctgaaacacaggtgattgattacaaaacacagcaggctagactcttcccattgctagcttctgcatacgctttcagatttgttagtgagtggctgaaatggctttacacggatgtgactcaaaaattacaagccaatgatttttcaacattgcccgaggcccatgcatgcactgcagggttgaaatccttgactacttccgcaactgctgatggaattgaagaatgccgtaaactttgtggcggtcatggttatctttgtagcagtggtctacctgagttgtttgcagtttatgttcctgcatgcacatatgaaggagacaatactgtcctacttttacaggtagcaaggtatcttatcaagactataactcagttgggttccggaaataaacctgttggtaccacggcttattttgctcgcgtggaacaattgatgcaatatcaatctgatgttaaaagagccgaggattggttgaagcctaatgtagtgattgaagcatttgaagctagggctgccaggatgtctgttgctgttgctcaaaatctcagcaagttcactgatcctgaagagggttttcaagaactctcagctgatttagttgaggcagcagctgctcattgccagttaattgttgtttccaaatttatagagaagctgcagcaagatatacctggaaatggtgtaaaacagcaactagaagttctttgcagcgtttatgctttatttcttcttcataatcatctgggagattttctttccactggctgtatcactcaaaaacaaggatcacttgcaaatgagcagttgaggtccttgtattcacaggttcgtcctaatgcaattgcgcttgttgatgcgtttaattacactgatcacttgcttggttcggttcttgggcgctatgatggaaatgtgtaccctaagttgtatgaagaggcttggaaagatcctttgaacgattcagttgttcctgatggctttaaagatcatgttcaaccaatacttaggcaacaactacataatgctagactctagattactttataattgaggtagtggtactatttttattgaaaatcatcaataaagttgcatgaaatttggataaataattgtagatgaatgcataccagttgaactttgatgataggtttatttccatggtttttgaaaaagaaagtgtatttccatggttaataatattcatgagaggaagtagcaattaggtgtatctggaatggaaccagaacatcattatttagttatgcatacttgacgactgtttcatcgatattgtttttgtggcatgtacctttcttgggccacaagtccacaacacttgtttcaggctgcccatgtacccctgtgatagtgacaagtgttgcctgatggcaggacaacattgtcagatggttcatgtgcccctatcgagcagtaatcatatgtaatc

SEQ ID NO: 10500 - DNA, 2409 bp, Eutrema halophilum
gttctcccaactactctgcaattatatcggtaagagaagcatttggctctctttttggcacgctctgtattttctgggtttcctttttgtttttcttcgctctgagattttctcgggaaagtttttagtgttaagctattcgattctggtttccaaataatggaaggagttgatcaccttgccgatgagaggaacaaagccgagtttgatgtcgacgagatgaagatcgtctgggccggttcccgccacgcttttgaggtttccgatcgaatttctcgcctcgtcgccagcgatccggtcttcgagaaaagcgatagagctcggttgagtaggaaggagctgtttaagagcacgttgaaaaaatgtgctcacgcgtggaagaggattatcgagcttcgtctcactgaggaagaagcaggaagattgaggttctttgtcgatcagcctgcatttgtggatctgcactggggaatgtttgtgcctgctattaaggggcagggcacagaggagcagcagcagaagtggttgtcgctggccaataagatgcagattattgggtgttatgcacaaactgagcttggtcatggctctaatgttcaaggccttgagactacggccacatttgatcccaagacggatgagtttgtaattcacagtccaactcagacttcatccaaatggtggcctggtggcttgggaaaagtttctacacatgctgttgtttacgctcgtctcataactgacggcaaagactatggtgtccatggatttattgtgcaactgcgcagcttagaagatcattctcctcttccgaatataattgttggtgatattgggacaaagatgggaaatggagcatacaactcaatggacaacggttttcttatgtttgatcaagttcgcattccgagagatcaaatgctcatgaggcttgcaaaagttacgagggaaggaaaatatgttccatcggatgttccaaagcagctgatgtatggtactatggtgtttgtacgacaaacaattgtggcagatgcatccaatgcactgtctagagcagtttgcatagctacaaggtacagcgcagtgcggaggcagtttggcgcacggaatggtggcattgagacgcaggtgattgattacaaaactcagcagaacaggctatttcctctgctggcatcagcatatgcatttcgatttgttggggagtggctaaaatggctgtacacggatgtaactgaaaggctgcaggccagtgatttcgcaacattgcctgaggctcatgcatgcacagcaggattgaagtctctcaccaccacagccactgcggatggcattgaagaatgtcgtaagttatgtggtggacatggctacttgtggtgcagtgggctccccgagctgtttgctgtatatgttcctgcctgcacatatgaaggagacaacgttgtgctacaattacaggttgctagatttctcatgaagacagtctcccagctgggatctgggaaggctcctgttggcacaactgcttatatggcccgtgcagaacatcttttgcaatgtcgttctggtgttcaaaaggctgaggattggttaaaccctggtgcggtcctggaagcttttgaagcaagggctctgagaatggctgttacttgtgcaaaaaatcttagcaagtttgagaatcaagaacaaggattctcagagctcttggctgaattggttgaggccgcaattgctcattgccagttgattgttgtttccaagttcattgcgaaacttgagcaagacataggaggcaaaggagtgaagaaacagctgaacaatctatgttacatttacgctctctatatccttcacaaacacctcggcgatttcctctccacaaactccatcactcccaaacaagcctctctcgccaacgaccagctccgttccttatactctcaggttcgtcctaatgcggtggcgctcgtggacgccttcaactacactgaccattacttgaactcggtgctgggccgttacgacggtaatgtttacccgaagctctttgaggaagcatggaaagatccattgaacgactctgtggttcctgatgggtaccatgaatacattcgacctttgctcaagcagcaacttcgtaccgcaaggctctgaagagtttgtttctgctttgatactcagatatgtttaaatcaaacatttgacttttgcttttttcttatatcctacttctcgttccgttatttctttgaataaattcgccagtttataagatggcgatacccttatttgttgtatgtagcaatcttaaagctgatatatacactgtcgtcatttggcggaattttaggactatttttagtagtatatgcgatattaagaaattgatcgtttctactttctactatg

SEQ ID NO: 10501 - DNA, 2158 bp, Trifolium pratense
aaaaactgagttagttcacacttcacagttccgttcagatttcgaatcaaaatggaaggcgttgatcatttggctttcgagagaaacaaggcacaattcgatgtgaacgatatgaagatcgtttgggctggttctcgtcaagaatttgaactttccgatcggatttctcgtcttgttgctagcgatccggtattccaaaaggataacagaaccgcgcttgatagaaaggagttatttaagaacactttgagaaaagcagctcatgcttggaaaagggtcatcgagcttcgtcttaatgaacaggaagcttctaagcttagatcctttgtggatcagcctgcttttacggatcttcattggggaatgtttgtgcctgctatcaaaggacaaggaacagatgagcagcaggaaaagtggttgcctctggctaataatatgcaaataattggttgttatgcccaaaccgaacttggtcatggatccaatgttcaaggcctagaaacaactgcaacatttgatccaaaaacagacgagttcattattcatagccccacattgacttccagcaaatggtggcctggtgggttgggtaaaatatccacgcatgctattgtttatgcccgtcttattactgatggtcaagaccatggagtgcacggtttcattgtccagctccggagcttggatgatcacttgcctcttccaggcataactgttggagatattggaatgaaatttggaaatgcggcatataactccatggataatggagttctacgttttgaccacgtacgaattccaaggaatcaaatgttaatgagggtttcacaggtcaccagagaaggaaaatttgtacattccggtgttccgagacagttaatttatggaactatggtatatgtgaggcaagcaattgtagctgatgcatcaattgcattgtcacgagcagtttgtatagctaccagatatagtgctgttcgaagacagtttggatctcaaaaaggaggtcctgaaacacaggtgattgattacaaaacacagcaggctagactcttcccattgctagcttctgcatatgctttcagatttgttagtgagtggctgaaatggctttacactgatgtgactcaaaaattacaagctaatgatttttcaacattgcccgaggcccatgcatgcactgcagggttgaaatccttgactacttccgcaactgctaatggaattgaagaatgccgtaaactttgtggcggtcatggttatctttgtagcagtggtctacctgagttgtttgcagtgtatgttcctgcctgcacatatgaaggagacaatactgtcctacttttacaggtggcaaggtatcttatcaagactatatctcagttgggttctggaaataaacctgttggtaccacagcttatttggctcgcgtggaacaattgatacaatatcaatctgatgttaaaagagctgaggattggttgaagcctaatgtagtgattgaagcatttgaagctagggctgccaggatgtctgttgctgttgctcaaaatctcagcaagttcactgatcctgaagagggttttcaagaactctcagctgatttagttgaggcagcagctgcacattgccagttaattgttgtttccaaatttatagagaagctgcagcaagatatacctggaaatggtgtaaaacagcaactagaagttctttgcagcgtttatgctttatttcttcttcataatcatctaggagattttctttccactggctgtatcactcaaaaacaaggatcacttgcaaacgagcagttgaggtccctgtattcacaggttcgtcctaatgcaattgcgcttgttgatgcgtttaattacactgatcacttgcttggttcggttcttgggcgctatgatggaaatgtgtaccctaagttgtatgaagaggcttggaaagatcctttgaacgattcagttgttcctgatggctttaaagaacatgttcaaccaatacttaggcaacaactacgtaacgctcgactctagattattttataattggggtagtggtactatttttattgaaaatcgtcaataaagttgcatgaaatttggataaataaatgtagatgaatacacaccggttgaactttgatga

SEQ ID NO: 10502 - DNA, 1947 bp, Trifolium pratense
gaaggtgtagatcatttggcttttgaaaggaacaaggctgaattcgatgttgatgcgatgaagatcgtttgggctggttcttctcatgcttttgaagtttctgatcgaatgtctcgccttgttgcaagcgatccggcatttagaaaggatcatagacccatgcttggtaggaaggagttatttaagagcactttgaagaaagcagcttatgcatggaaaaggattattgagcttcgtcttagtgaggaggaagcttctatgcttagatcctttgtggatgaacctgcttttactgatcttcattggggaatgtttattcctgctatcaaaggacaaggaactgatgaacagcagcaaaagtggctacctttggcacaaaagatgcaaataattggttgctatgcccaaactgaacttggccatggatctaatgttcaagggttagaaacaacggcaacatttgatcccaaaacagatgaatttgttattcatagtcccacattgacttccagcaaatggtggcctggtggcgactaattactgatggtcaagatcatggagtgcatggctttattgtccaactgcgtagcctcgatgatcacttacctcttcctggcataactattggaatgaaatttggaaatggagcatataacactatggacaatggggttctgaggtttgaacatgtacgtattccaagggatcaaatgttaatgagggtttcacggattacaaaggaaggaaaatatgtacaatccaatgttccgagacaattagtttatggtactatggtatatgtgagacaaacaatcgtctctgatgcgtccacggctatgtcgagagctgtttgcattgctacaagatatagtgctgttcgaagacagtttggggcaagtaatggaggtcttgaatcacaggtgatagattataaaacacaacaagctaggctcttccctttgctagcctctgcttatgctttcagatttgttggtgagtggttgaaatggctttacacggatgtgatgaaaagattgcaagccaatgatttttcaacattgcctgaggctcatgcatgcaccgcgggattgaagtccttgactacctcagcaactgctgatggaattgaagaatgccgcaaattatgtggtggccatggttacctttgcagcagtggtcttcctgagttatttgcagtctatgttcctacctgcacatatgaaggagacaacattgttctgcttttacaggttgcaaggtatctcatgaagattatttctcagttgggatctggaaaaaagcctgttggtacaacagcttatatgggacgagtggaacaactgatggaatctcggtgtgatgttcagaaagcggaggattggttgaatcctaatgccgtgctgggagcatttgaagctagggctgctaggaagtcagttgcctgcgctaaaaatctcagcaagtttaccaatcctgaagagggtttccaagaactctcaaatgatcttgttgaggcagctcgcgctcattgccagttgattgttgtttctaaatttattgagaagttgcagcaagatatacctggaaagggagtgaaacagcaattagaaattctatgtagcatttatgctttgtttcatcttcataagcatttgggtgattttctttctactggttgcatcactcccaaacagggttcgctggccaatgaccagctcaggtccttgtattcacaggttcgtcctaatgcaattgcgcttgttgatgcgtttaactacactgatcactacctcagttcaattcttggctgctatgatggaaatgtgtatccaaagctatatgaggcggcatggaaggatccattgaatgattcagttgtgccagatggctttcaagagtatattcgaccaatgctgaagcaacaacttcgtaatgccagactctaaa

SEQ ID NO: 10503 - DNA, 2356 bp, Phaseolus vulgaris
atgacatttggctggccaataaagtgcaacgatatcggtaaatgtctcatttatatcacttacactccataccaaacacgagctaagtaggttggtttcggaagcgatttcaacaaacgcgaacaccgtgatttggattagaagagaccaagttagggtttagcatcgggagagagaagaagaagaagatggaaggcgtcgttgatcacttggctttcgagcggaacaagacgcaattcgatgtcgaagagatgaagatcatttgggctggttctcgccacgctcttgaagtctccgataaaatggctcgcctcgttgccagcgatccggcattcagaaaggatgataggcccaggcttggtaggaaggagttatttaagaacactttgaaaaaaacagtttatgcgtggaaaaggattatagagctccgtcttagtgaagaggaagcttctaagctcagatcttttgtggaccaacctgcttttacggatctacattggggaatgtttattcctgctatcaaaggacaaggaacagaggaacagcagcaaaaatggttacctttggctcaaaagatgcaaataattggttgctatgcccaaactgaactgggccatggatctaatgttcaagggctagaaacaactgcaacctttgatcccaaaacagacgagtttgtaattcatagccccacattgacttccagcaaatggtggcctggtggactgggtaaagtgtcaacgcatgctattgtttatgcccgactaattactgatggtcaagatcatggagtgcatggtttcattgtccagctgcgaagcttggatgatcacttacctcttccaggcataactgtgggggatattggaatgaaatttggaaatggagcatataattccatggacaatggggttttaaggtttgaccatgtacgaattccaagaaatcaaatgttaatgagggtttcacaggtaactcgggaaggaaaatatgcacaatccagtgtcccacgacaattagtttatggtactatggtatatgtaagacaaacaattgtatctgatgcatcattagctatgtcacgggcagtttgcattgctacaagatatagtgctgttcgaaggcagtttgggtcaaaacaaggaagtcttgagacacaggtgattgattataaaacgcagcaagctaggctcttccctttgttagcttcagcctatgctttcagatttgttggtgaatggttgaaatggctttatatggatgtgatgaaacgattgcaagccaatgatttttcaacattacctgaggctcatgcatgcactgcagggttgaagtccttgactacttcagcaaccgcagatggaattgaagaatgtcgcaaactatgtggtggccatggttacctttgtagtagtggtctccctgagttatttgcagtctatattcctacctgcacttatgaaggagacaacattgtgctgctgttacaggtggcaaggcatctcatcaagagtatttctcagttgcgctctggaaaaaagcctgttggtaccacatcttatattggacgagtggagcagctgatgctctatcgttctgatgttcagaaagaggaggattggttgaagcctaatgcagtgctgggagcattcgaagctagggctgctaagaagtctgttgcttgtgctcaaaatcttagcaagtttaccaatcctgaagaaggtttccaagaactctcagtcgatctagttgaggcagctgttgctcattgccagttaattgttgtttccaaatttattgagaagttgcagaaagatattcctggaaagggagtgaaacatcaattagaacttctttgtagcatttatgctttgtctcttcttcataagcatttgggtgattttctttcaactggctgcatcactcccacacagggttcccttgcaaatgatatgctgaggtccttgtattcacagcttcgtcctaatgcaattggactagttgacgcgtttaactacactgatcactaccttggttcggttcttgggcgttatgatggagatgtgtacccaaagctgtacgaggaggcatggaaggatccattgaatgattcagttgtgccggacggctttcaagaatatattcgaccaatgctgaagcaacaacttcgaaatgctagactctgaaacattttgtaactctactctcaccagacaaactcttgtattttacacttaagttaaacacgataataaattttataaatggaaaattaaatagacaccaataaaattgtcatcgtagatatatacttttaatttttttattttttgtggattaagtatgtctatagccc

SEQ ID NO: 10504 - DNA, 2848 bp, Papaver somniferum
aagaggagagtctgaggataaggctggtatttctaaatttgatttgccgatcatatctcagtacaaatacacaacaggttgttagttttgttcaaattagtctggtttaaaattcattttctcttgaaacttttagatcgaggaagatggaggaattagattacttagctaatgaaagacaatcagctgaatttgatgttgaagctatgaagattgtttgggctggttcccaacaatcttttgaaatttctgaccggatgtctcgtcttgttgctagtgatcctgccttccgcaaagacaatagaacaatgttgccccggaaggagttgttcaaaaatactttgagaaaggcagctcatgcgtggaaacggatcattgagctccgcctttctgaggcagaggcagccaagttgagattttttgtcgatgaacctgcttttaccgatcttcattggggaatgtttgtacctgctataaaggacaaggcactcaggaacagcaagataagtggttaccgctggcgtataggatgcaaataattggatgctatgcacagacagaactcggccatggctctaatgttcaaggacttgagacaaccgctacatttgattcagaaactgacgagtttgtcctacacagtcctaccttaacttcaagtaaatggtggcctggtggactggggaaagtttcaactcatgctattgtgtacgcccgtcttctgattaacggaaaagactatggggtgaatggttttatcgttcaactacggagcttggatgatcatttaccccttccaggcatcactgtaggggatattggaatgaaatttggaagtggagcatacaacactatggataatggtgttctacagtttgaccatgtgagaatcctaggatcaaatgttgatgcgggtttctcaagttacgagggaaggaaaatatgtgcaatctgatgtgccgcggcagcttgtgtatgggactatggtgtatgtgcgccaaactattgtagcagatgcttcttgtgctttatcacgagcagtatgtatagctacaaggtatagtgctgttcggagacaatttggttcacaggatggaggacccgagacccaggtgatcgattacaagactcagcaaagcagactcttcccttgctggctacagcatttgcttacaggtttgttggtgagtggttaagctggttatatacggacgtgactcagagattgcaagccaatgatttctccacattgcctgaggctcatgcatgcactgctggtttaaagtctttgactacttccacaactgcggatgcaattgaagaatgtcgaaaactatgtggtggtcatggttacctatccagcagtggactgcctgagttatttgctgtatatattcctgcttgtacctatgaaggagataacaccgttctgcttttacaggttgcaaggtttctcatgaagactgtttctcagctgggttctaataaaaaacctagctggaacaacggcttatatgggaagaattgagcacctaatgcagtgtcaatgcaatgctcgaagagctgaggattggttgaagcctagtgttgtgattgaggcttttgaagcaagggctgctaggatgtctgttgcatgtgctaaaaatataagcaaaatgccaagtccagaagcaggctttgctgagctctctccggatctagcggaagctgctgttgctcactgccagttgattgttgtttccaaattcattgagaagttgcaacaagacatacctggaaaaggggtgaaagaacaacttgagattctctgtagcatatatgctctctcccttcttcacaagcaccagggagatttcctttccactggaagcattaccccgaagcaagcttcacttgcaaatgatcagctcagatctctttatgctcaggctcgcccaaatgctgttgcactagttgattcattcaactacacggaccatttccttggctcggttcttggacgttatgatgggaacgtgtacccaaaactgtatgaagaggcatggaaggacccactcaatgacaccgttgttcctgatggttatcatgaatacatccgtccattactgaaaaaccaacttcgaactgcaaggctctgaagtcacaagttgcaaataagcaaccatacccctagaagtttagtgattggttaagtgccaacatatttgaaaaaacaaaatgcttcacaaaaaaaaaatatatattaaaataaatagtgattggctatattgtaatttttttaatatggataaagcaatgggatgtgctgctaaggatagagagagtgctatgagtcagattcaatgggatgtgctgctaagaatagagagagtgctacgagtcagattcaagttagcaaaggtttttaatgtgttgatcaattggaccttgtctatcctctttagactcgacaggaagagaagcaatttataagttggatcttttttagacctgtgtttcaaatgttaccctatctttttttttttttgaagcatagtgttacctatcagtaaagatgtcctctctttttttttcttctttctagcaagtacagtagaatttggttgttcatttttcccattttatccccatacgctttgtaattgattgctagcttaagtaagttatggggcttcatcctttatatgcagtagttctttttttcttgatttctacctggtgtcaggttaagaagaggtgcattcttttcttgtatgcagaaaaaagaaatgatattttctctttttttgacccgcaagacttaataatttagtaatgctcacagcagacattataggaaaaaaaaaaa

SEQ ID NO: 10505 - DNA, 2420 bp, Cajanus cajan
gaggaacaaacgctggtgtttacatttggcagttggggcagataaaaagcagagcaatcagcaaagcttcgatgaacattattcactcctgaaaccaaacccgaactgagtagtttagtttcatcacacgcattgagaacatcgcgagagagaaaaaaagaagaagaagaagaagaagatggaaggcgtggttgatcacttggcgttcgagaggaacaaggcgcaattcgacgtcgaagagatgaagatcgtttgggcgggttctcgtcaggctcttgaaatctctgacaaaatggctcgcctcgttgccagtgatcctgtgttcaaaaaggataatagagctatgcttgataggaaggagttgtttaagaacacattgaggaaaacagcttatgcgtggaaaaggataattgagcttcgtctcagtgaacaggaagctgctatgcttagattctttgtggaccaacctgcttttacggatctgcattggggaatgtttgttcctgctattaaaggacaaggaactgaggaacaacaacaaaagtggttgcctttggcttataagatgcaaataattggttgctatgcccaaactgaactgggacatggatctaatgttcaagggctagaaacaactgcaaggtttgatcctaaaacagacgagtttgtaattcacagccccacattgacttccagcaaatggtggcctggtggattgggtaaagtgtcaacacatggtattgtttatgcccgactaattactgatggtcgagattacggagtgcatggattcattgtccagctgcgtagcttggatgatcatttacctcttccgggcataactgttggtgatattggaatgaaatttggaaatggagcatataactccatggataatggtgttttaaggtttgaccatgttcgaattccaagaaatcaaatgttaatgagagtttcacaggtaacaagggaaggaaaatatgtgcaatccaatgttccacgacaattagtttatggtactatggtatttgtaagacaaacaattgtatctgatgcatcaacagctatgtcgcgagcagtttgcattgctacaagatatagtgctgttcgaagacagtttgggtcaaataatggaggtattgaaacacaggtgattgattataaaacgcagcaagctaggctcttctctttgttagcttctgcctatgccttcagatttgttggcgaatggttgaaatggctttatatggatgtgatgaaaagattgcaagccaatgatttttcaacattacccgaggctcatgcatgcactgcagggttgaagtccttgactacttcagcaactgctgatggaattgaagaatgccgcaaattatgtggtggccatggttacctctgtagcagtggtctccctgagttatttgcagtgtatgttccaacctgcacatatgaaggagacaacactgtgctgcttttacaggtggcaagacatctcctgaagactatttcacagttgggctctggaaaaaagcctgtcggtacaacatcttatattggacgtgtggaacagctgatgcgatatcgttctaatgtacagaaaggggaggattggttgaatcctaatgcagtgctgggagcatttgaagctagggctgctaagaaggtggttctttgtgctcaaaatcttagcaggtttaccaatcctgaagaaggtttccaagaactctcggttgatctagttgaggcagctgttgctcattgccagttaattgttgtatccaaatttattgagaagttgcagcaagatattcctggaaagggagtgaaacagcaattagaagttctctgtagcatttatgctttgtctcttctttgtaagcatttgggtgagtttctttcaactggcagcatcaatccaaaacaggcttcccttgcaaatgatcaactgaggtccttgtattcacaggttcgtcctaatgcagttgcacttgttgatgcgtttaactacaccgatcacttccttggttcggttcttgggcgttatgatggagatgtgtatccaaagctgtacgaggaggcatggaaggatccattgaatgattcagttgtgccagatggctatcaagaatatgttcgaccaatgctaaagcaacaacttcgtaatgcaagactctaaatttttttattactgcgctgctgatgcgggagaaagttatgcatactttcaatttaaagacggtaatgaagttgtaaggaattaatggaagtaaaaaaataaattgacattgataaagttatgtaatgtttgttatagttatgttttcattatttttatgttgatacaaatattttaatgtcaataaccctgtccagaaatgagaagtaaatgagtataattattgattaaaattaatataaaa

SEQ ID NO: 10506 - DNA, 2259 bp, Humulus lupulus
cgttagaacaaaaattattgggaagcggaacacggttgggtggtggtattatggtaatcaatatcaagctcagctgtttatgactcgtcggccgctataaatatcgacgactgtctattcagctttcttcgccctcgctcttccttctcaccggtctctgtatcacccagtcattgttgtttcagctttttcgatttcgcttctgaatttcgtttcgtttggggtttggttttgcttttctaaattgttggaaaatggagggcgtagatcatctggcgcatgagaggagcaaggctcagttcgatgttgatgagttaaagatcgtctgggctggttctcgccatgaattcgaagtctccgataggattgctcgtctcgtcgcttctgatccggtctttcgaaaggataatagaactatgctggccaggaaagacttgttcaaaaatacattgaggaaagcggctcatgcatggaagcggatcattgagcttcgcctcactgaggaagaggcaaaaaaattgcggtttttcgtggacgagccttcttttacagatcttcattggggaatgtttgtgccagctattcaaggacaaggcactgacgagcagcaggataaatggttgcctttggcatacaagatgcaaataattggttgttatgctcaaactgaacttggtcatggttctaatgttcaagggcttgaaaccactgccacttttgatcctcaggcagatgagttcatcatcaatagtcctacacttacttcaagcaaatggtggcctggaggattgggtaaaatttccacacatgctgttgtttatgcgcgtctaattaccgacggccaggaccatggagtgcatggtttcattgtccagcttcgaagtttggatgaccatttgcctcttccaggcataactgttggtgatattggaatgaaatttggtagtggagcatacaacagtatggacaatggggtattaagatttgatcatgtgcgcatcccaagggatcaaatgttgatgagggtttctcaggtcacaagagaagggaaatatgtgcaatccaatgttccgcgacagctagtttatggtacaatggtatttgtgcggaaagctattgtacttgatgcttcatgtgctctatcacgggcagtttgtatagctacaaggtacagtgctgttcgtagacaatttggttcgcaaaacgatggtgtcgagacccaggtgattgattacaaaacacagcaaaataggctcttccctctattggcctctgcctatgctttcagatttgttggtgaatggttaagctggctatatactgatgtgacccaaaggttgcaagccaaagatttctctacattgcctgaggctcatgcatgcactgcagggttgaagtcattgactacgtctgccactgctgatgctattgaagaatgtagaaaattgtgtggtggtcatggttacctgtctagcagtgggcttcctgagctatttgcagtttatgttcctgcctgtacatatgaaggagacaatgttgtgctacatctacaggttgcaaggtttctcatgaagactgtttctcagttggtgtctgggaaaaagcctattggtactacattttatttgggacgtgttgaacatctcatgcaatctcaaccaaaagtgcaaaaagctgaggattggttgcagcctaatgtggtggtggaggtatttgaagcaagagccaccaggatgtctgttgcctgtgctcagaaccttaacaagtttccaaatcaggaagagggcttttcggaactctcagctgatttagttgaggcatcagttgctcattgccaattaattgtcgtttcgaagttcattgagaaattacaacaagacattcctggaaaaggagtgaaggaacagttgcagagtctttgttacatttatgctctgtccctcatccacaaacatcttggtgattttgttgtgactggctgcattacacccaagcaagcctcactcgcaaatgaacaacttcgttctctatattccaaggtccgccccaacgctgttgcccttgttgacgcattcaattacactgaccactttcttagctcagttcttggccgctacgatggtaatgtgtatcaaaacctctatgatgaggcatggaaagatcctctgaatgaatcggttgtgcctgatggctaccaggaatacataaggccccttctgaagcagcagctgcgtaatgcaaggctctgaagatgattgg

SEQ ID NO: 10507 - DNA, 2429 bp, Fragaria vesca
atgaacattgggaaacacaaagccaaatggtctcagcttatctatctatatacatgatccagtagacctccttatagaaaccattattataaatactgtgatccttcacccacaccttccctatttattattcacctcaactctttcttacaaaaccacagagttcttgtgtcctttgtcaattcttagtctgtggtttttcttttctggtgaacaagaatggagggtgtggatcatttggctcacgaaaggagcaaggcccagttcgatgttgaccacatgaaggtcgtctgggccggctcccgccacaccctggaggtctccgatcggattgctcgcctcgtcgcctccgatccggtgtttaaaaaggatgataggactaggctaagtaggaaggacttgtttaaagacactctgagaaaagcagctcatgtctggaagcggatcaccgagcttaaacttactgaagaagaggcatccaagttgaggttttatgtcgatcaacctgcatatatggatcttcactggggaatgtttattccttttattaaaggatcaggtactgaggagcagcaaaagaaatggctgccattggcatacaagatgcaaattattggttgctatgcacagactgaacttggccatggctccaatgtccaagggcttgagaccactgcaaattttgatccaaagacagacgagtttgttattcatagccctacgctaacctcaagcaaatggtggcctggtggtttgggaaaagtttcaactcacgctgttgtttttgcccgtcttattactgatggtcaagaccatggagtgaatggtttcatcgtccaacttcggagcttggatgatcacttgccacttccaggcgtaactgttggtgatatcggaatgaaatttggaagtggagcatacaactccatggacaatggtgtcctaagatttgatcatgtgcgcatcccaagggaccacatgttgatgagagtctcacaagttacacgagaaggaaaagttgttcagtccaatgttccaagacaactactttatggaactatggtttttgttcgccaaacaattgtggctgatgcttcctctgcattgtcgcgggcagtatgtattgctactaggtacagtgctgttcgtcgacagtttggttcaaatgacggtggtgttgagacacaggtgattgattacaagactcaacaaagcagactattccccctgctggcttccgcctatgctttcagatttgttggtgagtggttgaaatggctatatacggatgtaacacaaaaactgcaagcaaatgatttttctacattgcctgaggctcatgcgtgcactgcgggtttaaagtcattgactacttctgcaactgctgatgccattgaagaatgccggaaattatgtggtggtcatggttacctttctagcagtgggctccctgagttgtttgctgtttatatcccggcgtgtacatatgaaggagacaatattgttctacttctacaggttgcaaggtttctcatgaagactgtttctcagctaccgtctggtaaaaaacccattggaacaacttcctacatgggccgcgcagaacatttgctccaatcttgttgtaatgttcagaaagctgaggattggttgaagcctagtgtaatactggaggcttttgaagcaagggctatgagaatgtctgttgcctgtgccaaagacctcagcaagttcacaaatccagaagagggctttgcggaactctcacctaatttggtcgatgcagcagttgctcattgccaattgattgttgtttcaaagttcattgagaaactgcaacaagacatacccgggaagggagtgaaagaacaattgcagatcctctgtaatgtatatgctttatttcttgttcacaaacatctgggtgatttcctctccactggaagtatcacagccaaacaaggttcactcgccaatgatcagcttagatctctatattcccaggtccgccccaatgccattgcccttgttgatgcatttaactacactgaccactaccttagctcaattcttggccgatatgatggtaatgtgtacccgaaactttacgaggaggcgtggaaagatcctttgaatgacacggttgtgccagagggatatcatgaatacatccaacctttgctgaagcaacagctccgaaattcaaggctatgattataaacaggctattatgattgtgttgttgccaataaagctagcagagctatttgtttcccaaaagaaattatacttatgccagggaaagactttcttacatattagaatgaaaattaaaagaactgggatgttgtaaaacggtatatggtagatcgttaataaagctattcattgttcatggcccctttattctgcaattctcacaaggttag

SEQ ID NO: 10508 - DNA, 2241 bp, Lotus japonicus
cattcctccttcgaaacaaaatggaaggaggcgttgaccacttggctttcgagaggaacaaggcgcagttcgatgttgacgacatgaagatcatctgggccggttctcgttccgaattcgagctctccgatcggatttctcgcctcgtcgccagcgatccggctttcagaaaggatgacagaaccacgcttggcagaaaggacctatttaagaacactttgagaaaaacagcttatgcatggaaaaggatccttgagctccgtcttaatgaaaaggaagctgccaagcttaggtcctttgtggatgaacctgcttttacggatcttcattggggaatgtttgtgccggctatcaaaggacaaggcacggatgagcagcagcaaaagtggttgcctctagcttacaagatgcaaattattggttgctatgcccaaactgaacttggtcatggatccaatgttcaagggctagaaacaactgcaacatttgatcccaaaacagatgaatttgttattcatagtcccactttaacttcctccaaatggtggcctggtggattgggtaagatatcaacgcatgctgttgtgtatgctcgtctaattactgatggtcaagagcaaggagtgcatggtttcattgtccagctgcggagcttggatgatcacttacctcttccaggcattactgttggtgatattggaatgaaatttgggagtggagcatataataccatggataacggggttctaagatttgaccatgttagaattccaaggaatcaaatgttaatgagggtctctcaggtaaccagagaaggaaaatatgtgcagtccaatgttccaagacaattagtttatggtaccatggtatatgtgagacaagcaattgtgtctgatgcatcgattgctttgtcacgagcagtttgtattgctacaagatatagtgctgttagaagacagtttggatcacataatggtggtcttgagtcgcaggtgattgattacaagacacagcaggctaggctcttccctttgctagcttctacttatgctttcaggtttgttagtgagtggctgagttggctttatacggatgtcacacaaagattacaagctggagatttttcaacattgcctgaggcacatgcatgcactgctggattgaaatcattgactacttcaatcgctgctgatggaattgaagaatgtcgtaaactatgtggtggtcatggttatcttaatagcagtggtcttcctgagctatttgcagtgtatgttcctgcttgcacttatgaaggagacaatactgtgctgcttttacaggtggcaaggcatcttgtgaagactatttctcagctgggctctggaaataagcctggtggtactacagcttatttggctcgagtggaacaattgatgcaatatcactctgatgttaaaaaagctgaggattggttgaagcctaatgtagtggtggcagcattcgaagctagggctgctaggatgtctgttgcttgtgctcaaaatcttagcaagttcactaatcctgaagagggttttcaagaacttacagctgatctagttgaggcagcaactgctcattgccagttaatcattgtttccaaatttattgataagttgcagaaagacatacctggaaagggtgtgaaacagcaattagaagttctttgcagcatttatgctttgtctcttcttcataagcatctgggagattttctttccgctggctgcataaatccactacaaggatcacttgccaatgagcagctgaggtccttgtattcccaggttcgtcctaatgcaattgcacttgttgatgcgtttaattacactgatcactaccttggttcggttcttgggcgctacgatggtaatgtgtatcccaagttgtatgaggaggcatggaaggatcctttgaatgactcagttattcctgatggcttccatcagtatgttcaaccaattcttaagcagcaactgcgtaatgcaagactatagatgattttacaattggactggcggcatctaataaatttctctaattattttgattttgaggcgtcaataaagttgtatggaaagataaataaaagtggatcagaggttttgttttgaggtctaaaagcatattttgaactcattgacaattgaggaaactaaaccttccctttaccatgaaatattttactacaagaataaactctgttattacttatcatca

SEQ ID NO: 10509 - DNA, 2241 bp, Brassica oleracea
atcggtagaggcacggcaccaaaagcatttggctctcttctcttttgttatttttctcgggaaaagttgtaggtaatattgataatcatggagggaattgatcacctagccgatgagaggaacaaggcggagttcgatgtcgacgagatgaagatcgtctgggccggttctcgccacgctttcgaggtttccgatcgaatcgcccgcctcgtcgccaccgatccggtattcgagaaaagcgatagagctaggctgagcaggaaggagctgttcaagagcacgttgaagaaatgtgctcacgcttggaagaggatcatcgagcttcgtctcactgaggaagaagcaggaaggttgaggttctttgttgatcagcctgcctttgttgatcttcactggggaatgtttgtgcctgctatcaaggggcagggtacagaggagcagcaagagaaatggttgtctctggccaataagatgcagattattgggtgttatgcacaaactgagcttggtcatggctctaatgttcaaggacttgagacaaccgccacttttgatcccaagacggatgagtttgtgatccacagcccaactcagacttcatccaaatggtggcctggtggcttgggaaaagtttctacacatgctgttgtttacgctcgtctcatcactgacggcaaagactatggtgtccatggattcattgtgcaactgcgtagcttagaagatcattctcctcttccgaatataattgttggtgatatcgggacgaagatgggtaatggagcatacaattctatggacaacggttttcttatgtttgatcaagttcgcattcccagagatcaaatgctcatgaggctggcaagagttacaagggaaggaaaatatgttccatcggatgttccaaagcagctaatgtatggtactatggtgtatgtgagacaaacaattgtggcagatgcttcgaatgcactatctagagctgtttgcatagctacaaggtacagcgcagtacggaggcagtttggcgcccagaatggtggcattgagactcaggtgattgattataaaactcagcaaaacaggctatttcctttgttggcatcggcatatgcattccgatttgttggggagtggcttaaatggctgtacacggatgtaactgcaagactgcaggccagtgatttctcaacattgcctgaggctcatgcatgcactgcaggattgaaatctctcaccaccacagccactgcggatggcattgaagaatgtcgtaagttatgtggtggacatggttacttgtggtgcagtgggctccctgagctgtttgctgtatatgttcctgcctgtacatatgaaggagacaacattgtgctacagttgcaggttgctagatttctcatgaagacagtgtcccagctgggatctggaaaggctcctgttggcacaactgcttatatggctcgggcacaacatcttttgcaatgccgttctggtgttcaaaaagctgaggattggttaaaccctgctgtggtagtggaagcttttgaagcaagggctctgcgaatggccgttgcttgtgccaaaaatctcagcaagtttgagaatcaagaacaaggattctcagagctattggccgagctggttgaggccgcaattgctcattgccaattgattgttgtttccaagttcatagctaagctagagcaagacataggaggcaaaggagtaaagaaacagctgaacaatctgtgttacatttacgctctccatatccttcataaacacctcggagatttcctctcaaccaactccatcactcccaaacaagcctctctcgccaatgaccagctccgttccttatactcacaggtccgccctaatgcggttgcgcttgtggacgccttcaactacaccgaccattacttgaactcggtgctaggacgttatgacggtaatgtatacccgaagctctttgaggaagcatggaaggatccattgaacgactcggtggttcctgatgggtaccaggaatacattcgacccttgatcaagcagcagcttcgtaccgccaggctctgaagagtttgctttataacacattcttcttctcttttcagtattattgtcttgaataaatttgccggtttaaaaactggcgatacccttatttatgtgtagcaaatgtaatggctgacacatacgtcggagttttagtactatttttaaattataacataa

SEQ ID NO: 10510 - DNA, 2634 bp, Eucalyptus grandis
gtgtatgtatctgtatccatcacacaggttgatttgagaactgaaatcaagatcatcgtcgtcgtcgtcgtcgtcgtcatcgttctcgtcggtgctgcacggccgcatttgactcggcgtaacgaacgaagccggttgcgatctagggttgttgggggcgcggaggaagctcgagcctcggtcgtttgttttctttttcccgatcatggaaggcgtcggcgtcgatcacctggccgatgagcggcagaaggcgcggttcgacgtggaggagatgaaggtcgtctgggccggctctagccacgccgtcgaggtctccgatcgcatggcccgcctcgtcgccagcgatccggcctttcggaaggacaacaggactatgctgagcaggaaagacctattcaagaatactctcagaaaagctgcctatgcttggaggcgcattatggagcttcgacttactgaggaagaggcgtcaaggttgaggttctttattgatgaacctgcttatacagatcttcactggggaatgttcatccctgctattaaaggacaaggaactgaggagcagcaacagaagtggttgccgttggcatataagatgcaaataattggatgctatgcacagactgaacttggtcatggctcaaatgtccaaggtctcgaaactactgctacgtttgatccccagacggatgagttcatcgttgatagtcccacgctaacttctagcaagtggtggcctggtggacttggtaaagtttccacacatgctgttgcatatgcacgacttatcgttaagggtcaggaccatggagtgcatggtttcattgtccagcttcggagcttggatgaccatatgcctcttcctggcataactgttggtgatattggcatgaaatttgggagcggagcttataactccatggacaatggactccttagattcgatcatgtgcgaattccaagagatcaaatgcttaagggggttctgcaggttacaagggaagggaaggtcgtgcagtctaatgtgccacgacagctgatttatgggacaatggtgtatgtccgccaaactattgtagctgatgcttcctgtgctttgtcacgggcggtttgtattgctacaagatatagtgctgttcgtaggcaatttgggtcacagaatggtggtcctgagacccaggtgattgactataaaactcagcaaagcagacttttccccttgttggcttctgcctatgctttccgatttgttggtgaatggttgaaatggctatatacggatgtgactcaaaggttgcaagcaaatgatttttcaacattgccagaggctcatgcgtgcactgctggtttgaaatctttgacaacctctgcaactgctgatgcaatcgaagagtgtagaaaactatgtggtggtcatggttacctgagtagcagtggtcttcctgaactgtttgcagtttatattcctgcctgtacgtacgaaggagacaatactgtactgcttttacaggttgcgaggtttcttatgaagactgtttctcagttgggctctgggaaacagcctgttggctcaacagcatacatgagccgggcagaacatctcatgcaatgccgttgcagtgctcaaagagttgaggattggttgaagcccaatgtagttttggaggcatttgaagcaagggccttgaggatgtcggttgcctgtgcgcagaatcttggcaaattctcgaatccagaagaaggttttgcagaactgtctgctgatttggttgaggcagctactgctcattgccaattaattgtcgtttccaaattcatcgagaaattacagcaagatatacctggaaagggggtaaagcaacaattgcagacactttgcagcgtttatgcgctgcatcttctccacaagcatcagggagattttctgtccaccagttgcgtcactccaaaacaagttgccttggccaatgaacaactcagatctctttattctcaggttcgtccgaatgcaattgcacttgtcgatgcatttaactacaccgaccattaccttggctctgttcttggccgctatgatgggaacgtgtatccgaagctgtatgaggaagcgtggaaggatcctctaaatgactctgtcgtgcctgatggctaccatgagtacatccgccccgtgctaaaacaacagcttcgcaatgcaagactctaaagaacatggctctctggtccgactgcttgcgtttcataatatattgttagttgtgtagtttaagccaataaactcagctgcagtgagtgccaggaaggtggtagaacttggtatttaaacaaagcttctgtagcaggagtgatcgattatggtagataaagatgagtggtagcgaccaataatttgggacatcgagagatgcgtactcttatattctttctctagcatgaattgggactacaaataatgtgtaaagaagagtaattccttagcattgaacagatagtttcttgcattattttttttttattctactgttctatggcatttcttgacatgtaattttgaatatggtcggggaacaagctgaggaaatcatggtccatgtttcataggaaatagaacttgtggtatcgactcattcctgt

SEQ ID NO: 10511 - DNA, 2183 bp, Euonymus alatus
gaatccagtacacaggacttgtttctctcgatctatatttcaagcgcatatggggtccgattgggtcgaaacttcgacaatggatggcgttgtggatcacctggcgcacgagaggaacaaggcgcaattcgatgtggaggagatgaagatcgtttgggctggctcacgccacgtcttcgaagtctccgatcgtatggctcgtctcgttgccagcgatccggcatttaagaaagacaacagagctactctagacaggaaggcattgttcaaaaacacccttagaaaagcaacttatgcttggaaaaggatccttgagcttcgtcttactgaagaggaggcttctaagttaagatattacattgatgaatctgcttttactgatcttcattggggaatgtttgtgccagctatcaaggggcaagctacggaggagcagcagcagaagtggttgccgttggcatataagatgcaaataattggttgctatgcacaaactgagctgggtcatggatccaatgttcaagggcttgaaaccactgcaacttttgatccccagactgatgaatttgtcattcatagtcctaccttgacttcatctaaatggtggcctggtggtctgggtaaagtttccacacatgctgttgtttatgcgcgccttataactgatggtcaagaacacggggttcatggtttcattgtccagctccggagcttggatgatcacttgcctctcccgggcataacgattggtgatattggtatgaaatttggaaatggggcttataacactatggacaatggtgttttaagatttgatcatgttcgcatcccaagggatcaaatgttgatgcgggttatgcaagtgacaaggaaaggagaatgtgtgcaatccaatgtcccgcgtcagctaatctatggtaccatggtatttgtgcgtcaaacaattgtatctgatgcgtcttctgctttatcccgtgctgtttgtattgctacaagatacagtgctgttcgtagacaatttggttcacagaatggtggtattgagacccaggtgattgactacaaaactcagcagaatagactatttcctttgctggctgctgcctacgctttcaggtttgttgctgagtggttgaaattgttatatacggatgtgactcaaagactgcaagcaaatgattactcaacattgcctgaggctcatgcgtgtacagcgggtttgaagtcgttgactacttctttcactgctgatgcaattgaagaatgtcgaaaattatgtggtggtcatggttacctgtgtagcagtgggcttcctgagttgtttgcagtttatgtgccagcctgcacatacgaaggggacaatgttgtgatgcttttacaggtggcgaggtttctcatgaagactgtttcccagttggggtctgaaaagaagccgattgggacaacagcttatatgggacgggtagaacacttgatgcaatgtcgctccagtgttcagaaagctgaggattggttaaatcctaatacaatactggaggcatttgaagcgagggctgccaggatgtctgttgccgttgcacaaaaactcgcacagtttgcaaatccagaagagggttttctggaactctcacctaatttggttgaggcttcagttgctcattgccaattaatcgttgtttccaaattcattgaaaaattgcaacaggacataccagggaagggagtaaaagaacttttggagatgctgtgcaatatttatgctttgaatcttcttcacaaacatctgggtgattttctttctactggctccattacttccaagcaaggttcacttgcatacgatcagcttagatcattatattcccaggtccgtcctaatgcaattgcacttgtcgatgcatttaattacaccgatcactaccttagctctgttcttgggcgatatgatggaaatgtttatcctaaactttacgaggaagcgtggaaggatcctctgaatgactctgttgtagctgatggctaccatgaatatattaggccaatgttgaagaaccaactccgtaatgcaaggctctgaaacgcaggccgatgctgttttggttctgtaaaacctaaatttgttaagactgttttgttgaataaagtgttaagactttgggttgggattgtgatatttctcaaca

SEQ ID NO: 10512 - DNA, 2394 bp, Gossypium raimondii
atattcaactgaaatccggcacacagtatattcaatccaggctgatcctatattattaatcttttctttttgtttttccaaaatcaatatacttttttttttttgaaaatttgttctttttcaagctcgaattcgaatcgagaaaccaaaggaaggaaaaaaaaatggaggcgttggattaccatgcggaagagaggagaaaggcggagtttgatgtggaagagatgaaaatcgtttgggctggttctcgtcaagcttatgagatctccgatcgagttgctcgtctcgttgctagcgatccggtctttcgaaaggataatagaactatgctatctaggaaggacttgtttaaagatactttgcgaaaagctgctcatgcatggaagcggataattgagcttcgtctctctgaagaagaggcctctaaattaaggttttttgtcgatcagcctgttttcacagaccttcactggggaatgttcatacctgcaattaaaggacaaggaaatgaggagcagcaacagaagtggcttccaatggcatataagatgcaaattattggatgctatgcacaaactgagcttggtcatggctccaatgtccaagggctagagactactgcaacatttgatcctgagactgatgaatttgtcattcatagtcccacattgacttcaagcaaatggtggcctggtggactgggtaaagtatccacacatgctctggtttatgctcgtcttataacagatgggcaagaccatggagtgcatggttttattgtccagctgcgtagtttggacgatcacttacctcttcctggcataacagtgggtgatattggaatgaaatttggaagtggggcatataacagcatggataatggtgttctgagatttgatcatgttcgcattccaagggaccaaatgctaatgggtgtttcacaggttacaagagaagggaaatttatgcaatctgatgttcctcgccagctggtttatggtacgatggtatatgtccgacaaaaaattgtagctgatgcttcttgtgctttatcaagggcagtatgtattgcaacaaggtatagtgttgttcgtagacaatttggttcgcataatggtggcccggagacccaggtgattgactataaaactcagcaaagtagactcttccctttgcttgcttctgcctatgctttcagatttgttggtgagtggctgaaatggctatacactgacgtgacccaaagattgcaagccagtgatttctccacattacctgaggtccatgcatgtactgcagggttgaaatctgttactacttctgcaactgcagatgcaatcgaagaatgccggaaattatgtggtggtcatggttatctttctagcagtgggctccctgagttatttgcagtttatgtccctgcctgtacttatgaaggtgacaatgttgtgctacttttacaggttgcaaggtttctaatgaagaccgtttcccagctggggtctggaaagaaacctgtcgggacaatagcttacatgggacgatcagaacacctcttgcaatgccgttgtgaagttgaaagggctgaggattggctaaagcctaatgtaatattggaggcatttgaagcgagggctgctaggatgtcggtcacctgtgcaaaaaaccttaacaattttccaaatcaagaagagggttttgctcaactcgcaactgatttggccgaggctgcagtcgctcatgttcagttaattattgtttccaagttcattgagaaattgcaacaagacatacccggaaagggagtaaaaagacagttggagatcctatttaatgtatatgctttaagtctgttacacaaacatctcggtgactttgtcgcctccggctgcattaccccaaagcaaggtgcactagcaaatgaacagctgagattattgtactcccaggtccgtccaaatgctattgcacttgtcgatgcattcaactacactgaccactaccttggctccgttcttggtcgctatgatggaaatgtgtatccaaaactctacgaggaagcgtggaaagatcctctgaacgagactgtcgtacccgatggttaccacgagtatattcggccaatattgaagcaacatattcgcgttgcaagactctaaaaaaacaatcaaccatcttgctgttgaattgtatagtatgttatatgaatgaataaagtgcagagatactggtcattcgaaagagcaagtcaggtttacggctgtgcccaacagtgtacttagattatggcttgattatttaaatgggatactatcagttttagtcccttccaatttatcaagcatttcatttaagcttttcttaaacataattttacctcccgcaaaaatttta

SEQ ID NO: 10513 - DNA, 2302 bp, Brassica napus
caaataatattcatcaatttctctttctactattatctctctctcccaactactcagcaattaaatcggtagaggcacggcaccaaaagcatttggctctcttctcttttgttatttttctggggaaaagttgtaggtaatattgataatcatggagggaattgatcacctagccgatgagaggaacaaggcggagttcgatgtcgacgagatgaagatcgtctgggccggttctcgccacgctttcgaggtttccgatcgaatcgcccgcctcgtcgccaccgatccggtattcgagaaaagcgatagagctaggttgagcaggaaggagctgttcaagagcacgttgaagaaatgtgctcacgcttggaagaggatcatcgagcttcgtctcaccgaggaagaagcaggaaggttgaggttctttgttgatcagcctgcctttgttgatcttcactggggaatgtttgtgcctgctatcaaggggcagggtacagaggagcagcaagagaaatggttgtctctggccaataagatgcagattattgggtgttatgcacaaactgagcttggtcatggctctaatgttcaaggacttgagacaaccgccacttttgatcccaagacggatgagtttgtgatccacagcccaactcagacttcatccaaatggtggcctggtggcttgggaaaagtttctacccatgctgttgtttacgctcgtctcatcactgacggcaaagactatggtgtccatggattcattgtgcaactgcgtagcttagaagatcattctcctcttccgaatataattgttggtgatatcgggacgaagatgggtaatggagcatacaattctatggacaacggttttcttatgtttgatcaagttcgcattcccagaaatcaaatgctcatgaggctggcaaaagttacaagggaaggaaaatatgttccatcggatgttccaaagcagctaatgtatggtactatggtgtatgtgagacaaacaattgtggcagatgcttcgaatgcactatctagagctgtttgcatagctacaaggtacagcgcagtacggaggcagtttggcgcccagaatggtggcattgagactcaggtgattgattataaaactcagcaaaacaggctatttcctttgttggcatcggcatatgcattccgatttgtgggggagtggcttaaatggctgtacacggatgtaactgcaagactgcaggccagtgatttctcaacattgcctgaggctcatgcatgcactgcaggactgaaatctctcaccaccacagccactgcggatggcattgaagaatgtcgtaagttatgtggtggacatggttacttgtggtgcagtgggctccctgagctgtttgctgtatatgttcctgcctgtacatatgaaggagacaacattgtgctacagttgcaggttgctagatttctcatgaagacagtgtcccagctgggatctggaaaggctcctgttggcacaactgcttatatggctcgggcacaacatcttttgcaatgccgttctggtgttcaaaaagctgaggattggttaaaccctgctgtggtagtggaagcttttgaagcaagggctctgcgaatggccgttgcttgtgccaaaaatctcagcaagtttgagaatcaagaacaaggattctcagagctattggccgagctggttgaggccgcaattgctcattgccaattgattgttgtttccaagttcatagctaagctagagcaagacataggaggcaaaggagtaaagaaacagctgaacaatctgtgttacatttacgctctccatatccttcataaacacctcggagatttcctctcaaccaactccatcactcccaaacaagcctctctcgccaatgaccagctccgttccttatactcacaggtccgccctaatgcggttgcgcttgtggacgccttcaactacaccgaccattacttgaactcggtgctaggacgttatgacggtaatgtatacccgaagctctttgaggaagcatggaaggatccattgaacgactcggtggttcctgatgggtaccaggaatacattcgacccttgatcaagcagcagcttcgtaccgccaggctctgaagagtttgctttataacacattcttcttctcttttcagtattattgtcttgaataaattcgccggtttaaaaactggctatacccttatttatttgtagcaaatgtaatggctgacacatacggcggagttttagtactatttttaaattataaca

SEQ ID NO: 10514 - DNA, 2383 bp, Eutrema parvulum
ttctcccaactactctgcaattatatcggtagaggcatttggctctcttttgctagctctgttattttctgggtttttcttttttcttttcatcgcgagagaaaaaaaaatcatctttgagttttctcgggaaagtttgattctaatttctgaaccatggagggtgttgataaccttgccggtgagaggaacaaggcagagttcgatgtcgacgagatgaagatagtctgggccggttcccgccacgcttttgaggtttccgatcgaattgcccgcctcgtcgccagcgatccggtcttcgtgaaaagcgatagagctcgattgagtaggaaggagctgtttaagagcacgttgaagaaatgtgctcatgcgtggaagaggattatcgagcttcgtctcactgaggaagaagcaggaagattgaggttcttcgttgatcagcctgcctttgttgatcttcactggggaatgtttgtgcctgctattaaggggcagggcacagaggagcagcagcagaagtggttgtcgctggccaataagatgcagattattgggtgttatgcacaaactgagcttggtcatggctctaatgttcaaggccttgagactacggccacatttgatcccaagacggatgagtttgtaattcacagtccaactcagacttcatccaaatggtggcctggtggcttgggaaaagtttctacccatgctgttgtttacgctcgtctcataactgacggcaaagactatggtgtccatggattcatcgtgcaactgcgcagcttagaagatcattctcctcttcccaatataattgttggtgatattgggacgaagatgggaaatggagcatacaattcaatggacaacggttttcttatgtttgatcaagttcgcattccgagagatcaaatgctcatgaggctggcaaaagttacaagggagggaaaatatgttccatcggatgttccaaagcagctgatgtatggtactatggtgtttgtgagacaaacaattgtagcagatgcttccaatgcactgtctagagcagtttgcatagctacaaggtacagcgcagtgcggaggcagtttggcgcccggaatggtggcattgagacacaggtgattgattataaaactcagcagaacaggctatttcctctgctggcatcagcatatgcatttcgatttgttggggagtggctaaaatggctgtacacggatgtaactgaaaggctgcaggccagtgatttcgcaacattgcctgaggctcatgcatgcacagcaggattgaagtctctcaccaccacagccactgcggatggcattgaagaatgtcgtaagttatgtggtggacatggctacttgtggtgcagtgggctccccgagctctttgctgtatatgttcctgcctgcacatacgaaggagacaacattgtgctgcaattacaggttgctagatttctcatgaagacagtctcccagctgggatctggaaaggctcctgttggcacaactgcttatatggcttgtgcagaacatcttttgcaatgtcgttctggtgttcaaaaggctgaggattggctaaaccctggtgcggtactggaagcttttgaagcaagggctctgagaatggctgttgcttgtgccaaaaatctcagcaagtttgagaatcaagaacaaggattctcagagctattggccgagctggttgaggctgcaattgctcattgccaattgatcgttgtttccaagttcatagcgaaagtagagcaagacataggtggcaaaggagtgaagaaacagctgaataatctgtgttacatatacgctctctatatccttcacaagcaccttggtgatttcctctcaaccaactccatcactcccaaacaagcctctctcgccaacgatcagctccgttccttatactctcaggtacgtcctaatgcggttgcgcttgtggacgccttcaattacactgaccattacttgagctcggtgctggggcgttacgacggtaatgtgtacccgaagctctttgaggaagcatggaaggatccattgaacgactcggtggttcctgatgggtaccatgaatacattcgacctttgatcaagcagcaacttcgtactgcaaggctctgaagagtttggtttttgcttgagttctcaatatggttatataaacacattcttcttcgtcttctcgttctggtattgctttgaataaatttaccggtatacaaattgtcgttacccttatttatatgtagcaatgtaatagcttgacatacggtcatcaacatacggcggagtttcagtactcttcgtttttagtatcgaatgaagaagcattaataaaatgatcgtttctact

SEQ ID NO: 10515 - DNA, 2831 bp, Brassica napus
ttggatgaaaactgtaaattaatctgacggtagtcacacacattaacatatgtacaacttacttacaagtggatggatgctagagtagataagagagttattttattcggcactaaccatgatgccaacaaacatttgagccttaagatacttcaggctttttttatttcacttttattcattattagtacaatattactcggacatttccacgttgattgttacacaaaccatgacacatgcaacattattcaaataccacttagaatctgatcaaaaggtggtttgtaattgtcgtggcagaagtcgcataagcacttacctctattgccctccgaaacgcatgttccacctttagatcccttgtcctcacggcatcttgtatagcagaacggtggatatatcaaaggcgcacagaaggcgaaatccacatcaccaccgtattctaccaagcactcggtatcctgcgcttctatctctggcacttcaaagataaccaaaaagagcatgaaaaatacggtgaaggaagaaactaatttcgttgccatggccatcttctctttctctctttcaactactcagcaattaaatcggtagaggcacggcaccaaaagcatttggctctctcttctctttgttatttttctcgggaaagttttaggtaatcatggagggaattgatcacctagccgatgagaggaacaaggcggagttcgatgtcgacgagatgaagatcgtctgggccggttctcgccacgctttcgaggtttccgatcgaatcgcccgcctcgtcgccaccgatccggtattcgagaaaagcgatagagctaggctgagcaggaaggagctgttcaagagcacgttgaagaaatgtgctcacgcttggaagaggatcatcgagcttcgtctcactgaggaagaagcaggaaggttgaggttctttgttgatcagcctgcctttgttgatcttcactggggaatgtttgtgcctgctatcaaggggcagggtacagaggagcagcaacagaaatggttgtctctagccaataagatgcagattattgggtgttatgcacaaactgagcttggtcatggctctaatgttcaaggacttgagacaaccgccacttttgatcccaagacggatgagtttgtgatccacagcccaactcagacttcatccaaatggtggcctggtggcttgggaaaagtttctacacatgctgttgtttacgctcgtctcatcactgacggcaaagactatggtgtccatggattcattgtgcaactgcgtagcttagaagatcattctcctcttccgaatataattgttggtgatatcgggacgaagatgggtaatggagcatacaattctatggacaacggttttcttatgtttgatcaagttcgcattcccagagatcaaatgctcatgaggctggcaagagttacgagggaaggaaaatatgttccatcggatgtcccaaagcagctaatgtatggtactatggtgtatgtgagacaaacaattgtggcagatgcttcaaatgcactctctagagctgtttgcatagctacaaggtacagcgcagtgcggaggcagtttggcgcccggaatggtggcattgagactcaggtgattgattataaaactcagcaaaacaggctatttcctctgttggcatcggcatatgcattccgatttgttggggagtggcttaaatggctgtacacggatgtaactgcaagactgcaggccagtgatttctcaacattgcctgaggctcatgcatgcactgcaggattgaaatctctcaccaccacagccactgcggacggcattgaagaatgtcgtaagttatgtggtggacatggttacttgtggtgcagtgggctccctgagctgtttgctgtatatgttcctgcctgtacatatgaaggagacaacattgtgctacagttgcaggttgctagatttctcatgaagacagtgtcccagctgggatctggaaaggctcctgttggcacaactgcttatatggctcgggcacaacatcttttgcaatgccgttctggtgttcaaaaagctgaggattggttgaaccctgctgcggtagtggaagcttttgaagcaagggctctgagaatggccgttgcttgtgccaaaaatctcagcaagtttgagaatcaagaacaaggattctcagagctactggccgagctggttgaggcggcaattgctcattgccaattgattgttgtttccaagttcatagctaagctagagcaagacataggaggcaaaggagtaaagaaacagctgaacaatctgtgttacatttacgctctccatatccttcataaacacctcggagatttcctctcaaccaactccatcactcccaacaagcctctctcgccaatgaccagctccgttccttatactcacaggtccgccctaatgcggttgcgcttgtggacgccttcaactacaccgaccattacttgaactcggtgctaggacgttatgacggtaatgtatacccgaagctctttgaggaagcatggaaggatccattgaacgactcggtggttcctgatgggtaccaggaatacattcgacccttgatcaagcagcagcttcgtaccgccaggctctgaagagtttgctttataacacattcttcttctcttttcagtattattgtcttgaataaatttgccggtttaaaaactggcgatacccttatttatgtgtagcaaatgtaatggctgacacatacgtcggagttttagtactatttttaaattataaattaaacataagttat

SEQ ID NO: 10516 - DNA, 2467 bp, Gossypium hirsutum
aattcgaatcgagaaaccaaaagaaggaaaaaaaatggaggcgttggattaccatgcggaagagaggagaaaggcggagtttgatgtggaagagatgaagatcgtttgggctggttctcgtcaagcttatgagatctccgatcgagttgctcgtctcgttgctagcgatccggtctttcgaaaggataatagaactatgctatctaggaaggacttgtttaaagatactttgcgaaaagctgctcatgcatggaagcggataattgagcttcgtctctctgaagaagaggcctctaaattaaggttttttgtcgatcagcctgttttcacagaccttcactggggaatgttcatacctgcaattaaaggacaaggaaatgaggagcagcaacagaagtggcttccaatggcatataagatgcaaattattggatgctatgcacaaactgagcttggtcatggctccaatgtccaagggctagagactactgcaacatttgatcctgagactgatgaatttgtcattcatagtcccacattgacttcaagcaaatggtggcctggtggactgggtaaagtatccacacatgctctggtttatgctcgtcttattacagatggacaagaccatggagtgcatggttttattgtccagctgcgtagcttggacgatcacttacctcttcctggcataacagtgggagatattggaatgaaatttggaagtggggcatataacagcatggataatggtgttctgagatttgatcatgttcgcattccaagggaccaaatgctaatgggtgtttcacaggttacaagagaagggaaatttatgcaatctgatgttcctcgccagctggtttatggtacgatggtatatgtccgacaaaaaattgtagccgatgcttcttgtgctttatcaagggcagtatgtattgcaacaaggtatagtgctgttcgtagacaatttggttcgcataatggtggcccggagacccaggtgattgactataaaactcagcaaagtagactcttccctttgcttgcttctgcctatgctttcagatttgttggtgagtggctgaaatggctatacactgacgtgactcgaagattggaagccaatgatttctccacattacctgaggtccatgcatgtactgcagggttgaaatctgttactacttctgcaactgcagatgcaatcgaagaatgccggaaattatgtggtggtcatggttatctttctagcagtgggctccctgagttatttgcagtttatgtccctgcctgtacttatgaaggtgacaatgttgtgctacttttacaggttgcaaggtttctaatgaagaccgtttcccagctggggtctggaaagaagcctgtcgggacaatagcttacatgggacgatcagaacacctcttgcaatgccgttgtgaagttgaaagggctgaggattggctaaagcctaatgtaatattggaggcatttgaagcgagggctgctaggatgtcggtcacctgtgcaaaaaaccttaacaattttccaaatcaagaagagggttttgctcaactcgcaactgatttggctgaggctgcagtcgctcatgttcagttaattattgtttccaagttcattgagaaattgcaccaagacatacccggaaagggagtaaaaagacagttggagatcctatttaatgtatatgctttaagtctgttacacaaacatctcggtgactttgtcgcctccggctgcattaccccaaagcaaggtgcactagcaaatgaacagctgagattattgtactcccaggtccgtccaaatgctattgcacttgtcgatgcattcaactacactgaccattaccttggctccgttcttggtcgctatgatggaaatgtgtatccaaaactctatgaggaagcatggaaagatcctctgaacgagactgtcgtacccgatggttaccatgattatattcggccaatattgaagcaacatattcgcgttgcaagactctaaaaaaacaatcaaccatcttgctgttgaattgtatagtatgttatatgaatgaataaagtgcagagatactggtcattcgaaagagcaagtcaggtttacggctgtgcccaacaatgtacttagattatggcttgattatttaaatgggatactatcagttttagtcccttccaatttatcaagcatttcatttaagcttttcttaaacacaattttacctcccgcaaaaattttaaattttcattttagcctccgtaccgaattcctgccttatccctgtttccaggtaatacaaaacttcccacggctaaaatcctgtcgacatctggatattcactgctatgcctattgcatgtatgcattaatactcaaagttctaaaattaagattcttcaaaacgtcttaatattgatttatgcattaaaaatatcagtatat

SEQ ID NO: 10517 - DNA, 2633 bp, Brassica rapa
acgagatttggtctcactatccattgaataaaaattgttcttatacggaaaagaatctaatattgctcagtttttacgtgggtttctatttattgtcgatactgtgacacgactggatctgagataaacccgatattattcatctatttatttcataaaaaaaaactcaaatattatctctctctcttccaactactcagcaattaaatcggtagaggcacggcaccaaaagcatttggctctctcttctctttgttatttttctcgggaaagttttaggtaatcatggagggaattgatcacctagccgatgagaggaacaaggcggagttcgatgtcgacgagatgaagatcgtctgggccggttctcgccacgctttcgaggtttccgatcgaatcgcccgcctcgtcgccaccgatccggtattcgagaaaagcgatagagctaggctgagcaggaaggagctgttcaagagcacgttgaagaaatgtgctcacgcttggaagaggatcatcgagcttcgtctcactgaggaagaagcaggaaggttgaggttctttgttgatcagcctgcctttgttgatcttcactggggaatgtttgtgcctgctatcaaggggcagggtacagaggagcagcaacagaaatggttgtctctagccaataagatgcagattattgggtgttatgcacaaactgagcttggtcatggctctaatgttcaaggacttgagacaaccgccacttttgatcccaagacggatgagtttgtgatccacagcccaactcagacttcatccaaatggtggcctggtggcttgggaaaagtttctacacatgctgttgtttacgctcgtctcatcactgacggcaaagactatggtgtccatggattcattgtgcaactgcgtagcttagaagatcattctcctcttccgaatataattgttggtgatatcgggacgaagatgggtaatggagcatacaattctatggacaacggttttcttatgtttgatcaagttcgcattcccagagatcaaatgctcatgaggctggcaagagttacgagggaaggaaaatatgttccatcggatgtcccaaagcagctaatgtatggtactatggtgtatgtgagacaaacaattgtggcagatgcttcaaatgcactctctagagctgtttgcatagctacaaggtacagcgcagtgcggaggcagtttggcgcccggaatggtggcattgagactcaggtgattgattataaaactcagcaaaacaggctatttcctctgttggcatcggcatatgcattccgatttgttggggagtggcttaaatggctgtacacggatgtaactgcaagactgcaggccagtgatttctcaacattgcctgaggctcatgcatgcactgcaggattgaaatctctcaccaccacagccactgcggacggcattgaagaatgtcgtaagttatgtggtggacatggttacttgtggtgcagtgggctccctgagctgtttgctgtatatgttcctgcctgtacatatgaaggagacaacattgtgctacagttgcaggttgctagatttctcatgaagacagtgtcccagctgggatctggaaaggctcctgttggcacaactgcttatatggctcgggcacaacatcttttgcaatgccgttctggtgttcaaaaagctgaggattggttgaaccctgctgcggtagtggaagcttttgaagcaagggctctgagaatggccgttgcttgtgccaaaaatctcagcaagtttgagaatcaagaacaaggattctcagagctactggccgagctggttgaggcggcaattgctcattgccaattgattgttgtttccaagttcatagctaagctagagcaagacataggaggcaaaggagtaaagaaacagctgaacaatctgtgttacatttacgctctccatatccttcataaacacctcggagatttcctctcaaccaactccatcactcccaaacaagcctctctcgccaatgaccagctccgttccttatactcacaggtccgccctaatgcggttgcgcttgtggacgccttcaactacaccgaccattacttgaactcggtgctaggacgttatgacggtaatgtatacccgaagctctttgaggaagcatggaaggatccattgaacgactcggtggttcctaatgggtaccaggaatacattcgacccttgatcaagcagcagcttcgtaccgccaggctctgaagagtttgctttataacacattcttcttctcttttcagtattattgtcttgaataaatttgccggtttaaaaactggcgatacccttatttatgtgtagcaaatgtaatggctgacacatacgtcggagttttagtactatttttaaattataaattaaacataagttatgtctcgttgctaaaagtcttaatcctcaatacattaatccaacggcggtcaatgttacttttccgaagatttagaatctagaggagggttcagatcagtgatagagagaatagttagtttttactttgatgcagaacgtcatattctcactatactgagagacactccttgtacccactttac

SEQ ID NO: 10518 - DNA, 2383 bp, Lupinus angustifolius
aaattactatatcttcacgaagaatgattaatgaaggagctacaatttatcgtgtgattacacttggagattgttgcacacataaagcacatcaaaggtttggaaaatgggaggaggcgttgatcatttggcaccagagaggaacaaagcggagatcgatgttgattcgttgaaaatcgtgtgggctggttcttctcacgatctacaactttctgaaaggatggctcgcctcgttgccagtgacccggcattcagaaaggacaatagacccattcttggtaggaaggagttatttaagagcactctgaggaaagcaacttatgcatggaaaaggatttctgagctccgtcttaatgaagaggaagctttaaggcttagatcctttgtggacgaacctgcttttactgatcttcattggggaatgtttgtacctgctatcaaaggacaaggcactgatgaacagcagaaaaagtggttgcctttggctcataagatgcaaataattggttgctatgcccaaacagaacttggccatggatccaatgttcaagggctagaaacaacagcaacatttgatcccaaaacagacgagtttgttattcatagccccacgttaacttccagcaagtggtggcctggtggattgggtaaagtgtccacacatgctgttgtttatgcccgcctaattactgatggtcaagatcatggagtgaatggcttcattgtccagctacggagcttggacgatcacctacctcttcctggcataactattggtgatattggagcgaaatttggaaatggagcatataataccatggataatggggttctgaggtttaacaatgtacgaattccaagggatcaaatgttaatgaggatttcacaggttacacgagaaggaaaacttgtaaaatccagtgttccacggcaactagtatatggtactatggtatttgtgagacaagcaattgtagctgatgcatcagttgctttgtcacgagcagtttgcattgctacaagatatagtgctgttcgaagacagtttggttcgcataatggaggtcctgaaacacaggtgattgattacaaaacacagcaagctaggctcttccctttgctagcctctgcttatgcttttagatttgttggcgaatggttgaaatggctttatacggatgtcacgcaaagattgcaagccggtgatttttcaacattgcctgaggctcatgcatgcacagcagggttgaagtccttgactacttcagtgactgctgatggaattgaagaatgccgtaaactatgtggtggccatggttacctttgtagtagtggtctccctgagttatttgcagtctatgttccttcctgcacctatgaaggagacaatgttgtgctgcaattacaggttgcgagacatctcatcaagactatttctcagttgggctctggaaaaaagcccattggtacaacagcttatttgggacgattggaacaattgctgcaatatcgttctgatgttgagaaagctgaagactggttgaagcctaatgtggtgctgggagcatttgaagctagggctgctaagaagtctgttgccgtagctcagaatcttagcaagttttccaaccctgaagatggtttccaggaactctcagccgatctagttgaggcagcagttgctcattgccagctaattgttgtttccaaatttattgagaagttgcagaaagatataccaggaaaaggggtgaaacagcaattggaacatctttctagcatttatgctctgtttcttcttcataagaatctgggtgattttctttcaaccggcagcatcactcccaaacagggtcatcttgccaacgagcagctgaggtccttgtattctcaggttcgtccaaatgcaattgcacttgttgatgcgttcaaccacactgatcactatcttggttctgttcttgggcgctatgatggaaatgtgtatccacagttgtacgaggaggcttggaaggatccattgaatgattcagtggtgcctgatggctatcaagagtatattcgaccactgctgaagcaacaacttcgtaatgctaggctctaaaagtatttcataattggcctattgatgcctaagtaagttatgtacactatttctatttaaagctggtaataaagttgcacggatggaaaattaatcagtcttgttacattcattgttacatccatgtataagttttctagcaagcttaatcacatgatgactatttatgagacgagcttctaatttgttgaatctggtctggaacatcatttgttacctcattggttagtggggctaatatcatagtttaatctcccttgcattttgtgcttttgctcc

SEQ ID NO: 10519 - DNA, 2533 bp, Prunus persica
gtggtttttctatttttattgagaagaaaaagaaaaagaaatccgaaaagtcatgtaatctattggcacgtatccgaaaaggaagtagtcaaaatttcgaacatgaacattgggatgcacaacgccaaatgttaagcttatcaagagaccctccttttccgcttctttattaaaaataaaataataaattatatatatttagataccatatataaaacccagggagatatatattaatcccagaatcccaaccacttcttacaaaaccagagacagcacgaagctgactgttcgtagcttctcaagttttcaatttcccatcgtgtttgtttactggggcttttgctttctctgaaaatggagggcgttgatcatttagcgcacgagcggagcaaggcgcagttcgatgtggatcagatgaaggtcgtctgggtcggttctcgccatgccttgcaagtctccgatcgaattgctcgcctcgtagctagcgatccggtattaagaaaggatgatagaactatgatgactagaaaggagttgttcaaaaacacattgagaaaagcagctcatggatggaaacggatcaatgagcttcgactttctgaagaagaagcatcctggtttaggcattatgttgatcaaccagcatatacggatcttcactggggaatgtttgtgccttttattaaaggatctggtactgaggaacagcaaaagaaatggttgccgttggcatataagatgcaaattattggttgctatgcacagactgaacttggtcatggctccaatgttcaagggcttgagaccactgcaacttttgatccaaagactgacgagtttgttcttaatagtcctacactcacttcaagcaaatggtggcctggtggtttgggaaaagctgctacacatgctgttgcttttgcccgtcttattactgatggaaaagaccatggagtaaatggtttcattgtccaacttcggaacttggatgatcacttacctcttccaggcataacagttggtgatatcggcatgaaatttggaaatggagcatacaactccatggacaatggtgtcctgagatttgataatgtccgcataccaagggatcaaatgttgatgagggtcgcacaagttacaagagaaggaaaatatgtccaatccaatgttccccgacagctactttatggaacaatggtttttgtgcggcaaacaattgtagctgatgcttccactgctctatcacgggcagtatgtattgccactaggtatagtgctgttcgtcgacaatttggttcagaaaatggtggtgttgagacacaggtgatcgattacaagactcagcaaagtaggctcttccctttgctggcttccgcatatgctttcagatttgttggtgagtggttgaaatggctatatacggatgtaacacaaaagttgcaagcaaatgatttctccacgttgcctgaagctcatgcatgcactgcgggtctgaagtcactgactacttctgcaactgctgatgccattgaagaatgtcggaaattatgtggtgggcatggttatttatctaacagtgggcttcctgagttatttgctgtttatgtcccggcatgtacatatgaaggagacaatattgttctactactacaggttgcaaggtttctcatgaagactgtttctcagctgccgtctggtaaaaagcctgtcggaaccacatcttatatgggccgtgcggaacatttgatccaatgtcgttgtaatgttcagaaagttgaagattggttgaaacccagtgtgatacttgaggcatttgaagcaagggcgattaggatgtcaattgcctgtgcccaagaccttagcaagttttcaaatcaagaagaaggctttgcagaactctcgtctaatttagctgaggcagcagttgctcattgccaattgattgtcgtctccaagttcattgagaaactccaacaagacattccagggaagggagtgaaagaacagcttcagaacctctgcaacatatatgctttgtatattattcataaacatttgggtgatttcctctccactggcagcatcacagccaagcaagcttcgctcgccaatgatcaacttagatctctatattccaagctccgccccaatgccattgcccttgttgatgcatttaattatactgatcactatcttggctcagttcttggccgctatgacggtgatgtttacccgaatctttatgcggaggcatggaaggatcctcttaatgaatcagttgtgcccgatggctatcgcgaatatatccagcctttgctgaaaaaccaactccgaaatgctagactatgatttttactgtggtgtcagaggattcaatccatgctaataaagctaccagttacttgctgttcacattgtattgtcatatttatgcaactacaatgactagttccaggatatgggaaacaaaaggttttatattgttcttgataaatgtcgccagcagtattaataaaaaacattttaataa

SEQ ID NO: 10520 - DNA, 2156 bp, Brassica juncea
gaatcgatcaccttgccgatgagaggaacaaggcggagttcgacgtcgacgagatgaagatcgtctgggccggttctcgccacgctttcgaggtttccgatcgaatcgcccgcctcgtcgcctccgatccggtatttgagaaaagcgatagaggtcggttgagcaggaaggagctgttcaagagcacgttgaagaaatgtgctcacgcttggaagaggatcatcgagcttcgtctcactgaggaagaagcaggaaagttgaggttctttattgatcagcctgcctttgttgatcttcactggggaatgtttgtgcctgctatcaaggggcagggtacagaggagcagcaacagaaatggttgtctctagccaataagatgcagattattgggtgttatgcacaaactgagcttggtcatggctctaatgttcaaggacttgagacaaccgccacttttgatcccaagacggatgagtttgtgatccacagcccaactcagacttcatccaaatggtggcctggtggcttgggaaaagtttctacacatgctgttgtttacgctcgtctcatcactgacggcaaagactatggtgtccatggattcattgtgcaactgcgtagcttagaggatcattctcctcttccgaatataattgttggtgatatcgggacgaagatgggtaatggagcatacaattctatggacaacggttttcttatgtttgatcaagttcgcattcccagagatcaaatgctcatgaggctggcaagagttacgagggaaggaaaatatgttccatcggatgtcccaaagcagctaatgtatggtactatggtgtatgtgagacaaacaattgtggcagatgcgtcaaatgcactctctagagctgtttgcatagctacaaggtacagcgctgtgcggaggcagtttggcgcccggaatggtggcattgagactcaggtgattgattataaaactcagcaaaacaggctatttcctctgttggcatcggcatatgcattccgatttgttggggagtggcttaaatggctgtacacggatgtaactgcaagactgcaggccagtgatttctcaacattgcctgaggctcatgcatgcactgcaggattgaaatctctcaccaccacagccactgcggatggcattgaagaatgtcgtaagttatgtggtggacatggttacttgtggtgcagtgggctccctgagctgtttgctgtatatgttcctgcctgtacatatgaaggagacaacattgtgctacagttgcaggttgctagatttctcatgaagacagtgtcccagctgggatctggaaaggctcctgttggcacaactgcttatatggctcgggcacaacatcttttgcaatgccgttctggtgttcaaaaagctgaggattggttgaaccctgctgcggtagtggaagcttttgaagcaagggctctgagaatggccgttgcttgtgccaaaaatctcagcaagtttgagaatcaagaacaaggattctcagagctactggccgagctggttgaggcggcaattgctcattgccaattgattgttgtttccaagttcatagctaagctagagcaagacataggaggcaaaggagtaaagaaacagctgaacaatctgtgttacatttacgctctccatatccttcataaacacctcggagatttcctctcaaccaactccatcactcccaaacaagcctctctcgccaatgaccagctccgttccttatactcacaggtccgccctaatgcggttgcgcttgtggacgccttcaactacaccgaccattacttgaactcggtgctaggacgttatgacggtaatgtatacccgaagctctttgaggaagcatggaaggatccattgaacgactcggtggttcctgatgggtaccaggaatacattcgacccttgatcaagcagcagcttcgtaccgccaggctctgaagagtttgctttataacacattcttcttctcttttcagtattattgtcttgaataaatttgccggtttaaaaactggcgatacccttatttatgtgtagcaaatgtaatggctgacacatacgtcggagttttagtactatttttaaattataaattaaacataagtt

SEQ ID NO: 10521 - DNA, 2437 bp, Arabidopsis lyrata
tctccgaaataaaagcttaatttttctcccaactactctgcaattaaatcggtagagtgagacattggccatcgtttcctcgctctgttttctgggcttgtttttttccttcttcttagagatagaaaaaatcatctctgagagttttctcgggaaagttttttagtgtttagctactggattttgaatttacgaatcaatggaaggagttgatcaccttgccgatgagagaaacaaagcggagttcgacgtcgaggagatgaagatcgtctgggctggttcccgccacgcttttgaggtttccgatcgaattgcccgcctcgttgccagcgatccggtatttgagaaaagcaatagagctcggttgagtaggaaggagctgtttaagagcacgttgcgaaaatgtgctcatgcgtttaagaggattatcgagcttcgtctcaatgaggaagaagcaggaagattgaggcactttatcgatcagcctgcttatgtggatctgcattggggaatgtttgtgcctgctattaaggggcagggcacagaggagcagcagaagaagtggttgtcgctggcgagtaagatgcagattattgggtgttatgcacagactgagcttggtcatggctcaaatgttcaaggactggagacaaccgccacatttgatcccaagactgatgagtttgtaattcatactccaactcagactgcatccaaatggtggcctggtggtttgggaaaagtttctacccatgctgttgtttacgctcgtctcataactaacggaaaggactatggtatccatggtttcattgtgcaactgcgcagcttagaagaccattctcctcttccgaatataactgttggtgatatcgggacgaagatgggaaatggagcatataattcaatggacaacgggtttcttatgtttgatcatgttcgtattcctagagatcaaatgctcatgaggctgtcaaaagttacaagggaaggaaaatatgttccatcggatgttccaaagcagctggtatatggtactatggtgtatgtgagacaagcaattgtagcagatgcttcaattgcactatctcgagcagtttgcatagctacaaggtacagcgcagtgcggaggcagtttggcgcacataatggtggcattgagacacaggtgattgattataaaactcagcagaaccggctatttcctctgctagcatctgcatatgcatttcgatttgttggagagtggctaaaatggctgtacacggatgtaactgaaagacttgcggctagtgatttcgcaactttgcctgaggctcatgcatgcactgcagggttgaagtctctcaccaccacagccactgcggatgccattgaagaatgtcgtaagttatgtggtggacacggctacttgtggtgcagtgggctccccgagctgtttgctgtatatgttcctgcctgcacatacgaaggagacaatgttgtgctgcaattacaggttgctcgattcctcatgaagacagtcgcccagctgggatctggaaaggtacctgttggcacaactgcttatatgggccgggcagcacatcttttgcaatgtcgctctggtgttcaaaaggctgaggattggttaaaccctgatgcggtactggaagcttttgaagcaagggctctgagaatggctgttacttgtgccaaaaatctcagcaagtttgagaatcaggaacaaggatttcaagagctcttggctgatttggttgaggccgctattgctcattgccaattgattgttgtttccaagttcatagcgaaactagagcaagacataggaggcaaaggagtgaagaaacagctgaataatctgtgttacatttacgcgctttatctccttcacaaatatctcggtgatttcctctccactaactccatcactcccaaacaagcctctcttgctaacgaccagctccgttccttatactctcaggtccgtcctaatgcggttgcacttgtggacgccttcaattacacagaccattacttgaactcggtgctgggccgttatgacggtaatgtgtacccaaagctctttgaggaagcgtggaaggatccattgaacgactctgtggttcctgatgggtaccatgaataccttcgacctgtgcttaagcagcaacttcgtaccgctaggctctgaagagttttcttacttgatactcgatatggttaatcacatttgacttgcttcttcttcttcttctcgctttgaataaagttgcggtttaaaaactggtgatgcccttatttatatgtagcaatgtaatagttaatgtaaggtcgtcttatggctgaatgttagtactatttttcgtattcaatgcaacattaataaattgatcgtttctactctgagaaggatacatatttgtaatcttcgtat

SEQ ID NO: 10522 - DNA, 2513 bp, Chelidonium majus
gaggtgaagttaaacggaagcttgataagagctttggatacgttacgaattttgtggcgaagtatgaattgggtaaggaggttggacgaggtcattttgggcatacttgctctgttaaagtacataacagagattaaaggtcaacaagtagccgtgaagatcatctccaagtctaaggaagttgattatctagctcatgaaaggaatactgctcaatttgatgttgaatccatgaagatcgtttgggctggttcccagcatgctcttgaagtctcggatcgaattgctcgacttgttgctagtgatcctgccttccgcaaggacaatagaaccatgttaagtcggaaggagttgtttaaaaacactctgagaaaagcagctcatgcatggaaaaggatcattgagctccatctttccgaggaagaggcgtccaagttaagattttatgtggacgaacctgcttttactgatcttcattggggaatgtttgtacctgctataaaaggacaaggcactaaggagcagctagagaagtggctaccgctggcgtataagatgcaaattattggctgctatgcacagacggaacttggtcatggctccaatgttcaaggactagaaacaactgcaacatttgatcccaaatctgacgagtttgtcatcaacagccctacattaacttctagcaaatggtggcctggtggactgggtaaagtttcaactcatgcaatcgtgtatgcccgtcttctaatagatggtcaagaccatggggtgcacggttttatcgtacagctgcggagcttggatgatcatttacctcttccaggcatcacagtaggtgatattggaatgaaatttggaagcggagcatataacactatggataatggagttctacggtttgatcatgtgcgtattccgaggagtcaaatgttgatgcgggtttctcaagttacgagggatggaaaatatttgcaatctgatgtgccgcgacaacttgtatatgggactatggtatatgtgcgccaaacaattgtggcggatgcttcttgtgctttatcacgagcagtctgcattgctacgaggtatagtgccgttcgaagacaatttggttcgcaggacggtgggcctgagacccaggttatcgattacaagactcagcaaagcagactgttcccgttgctcgctacagcttatgcttacaggtttgttggtgagtggctaaaatggttgtatacagatgtgactgagagactgcaagccaacgatttctccacattgcccgaggctcatgcatgcactgctggtttgaagtctttgactacttccactactgcggatgcaattgaagaatgtcgaaaactttgtggtggtcatggttacctgaacagcagtgggctacctgagttgtttgctgtatatgttcctgcctgtacttatgaaggagataataccgttctgcttttacaggttgcgaggtttctcatgaagactgtttctctgctgggttctggaaaacaacctgttggaacgattgcttatatggggcgagcggaacatttgatgcagtatcggtgtgatgttcaaagagctgaggattggttaaagcccagtgtagtactggaggcatttgaagcaagggccatgaggatgtctgtcgcgtgtgctcaaaatataagcaaaatggcaaacccagaagcaggctttgcggaactgtctgctgatctagtggaggctgcagttgctcactgccaattgattgttgtttccaaattcatcgagaagttggaacaagatatacctggaaaaggagtaaaagaacaacttgaagtgctctgcagcatatacgctctctccctgcttcacaagcaccagggagattttctctcgactggaagcataacaccgaagcaagcctcacttgcaaatgatcagctcagatctctatatgcccaggcccgtcccaatgcaattgcacttgtcgattcatttaactacactgactattatctgggctcggttcttggtcgctatgatggtaacgtgtatccaaaactttatgaggaggcgtggaaggacccactcaacgactctgtagtgcctgatggctatcatgaatacatccgtcctctgctgaagcaacaactccgaagtgcaagactctgaaggcgcatttaagcaaacgatcatatacgttctagtaatcttagaatcatttaatatagatatggataaagcaactggatacctctataagaagagggcgaatcaggtttagatgctatagtttgtagcaattgtcatattagcaaaaaaaacttttgacagtatttcgttcttatcttcttaaacttctgcgaaaataaaatttggtgcgtcattcaacattgtaattaaaatggcgtgatattaaaaccatcatgcccattatgggaaattcatcccttctgcagattctgaggctcacatttatcattattattaaaaaataaaatctggcttctgcatttacc

SEQ ID NO: 10523 - DNA, 2626 bp, Prunus mume
gtggtttttctctttttattgagaagaaaaaaagaaaaaaaaatccgaaaagtcatgtaatcaggtattggcacggatccgaaaaggaagtagtcaaatttcgaacatgaacattgggatgcacaacgacaaatgttaagcttatcaagagaccctgcttttccgcttctgtattaaaaacaaaataataaattatatagatttagataccgtttataaaactcagggagatacatatcgatcccagtatcccaaccacttctttctctcttacaaaaccagagagagcacgaagctgactgttcgtagcttctcaagttttcaattcccatagtctttgtttgctggggcttttgctttctctgaaaatggagggcgttgatcatttagcgcacgagcggagcaaggcgcagttcgatgtggatcagatgaaggttgtctgggtcggttctcgccacgccttgcaagtctccgatcgaattgctcgcctcgtagctagcgatccggtattaagaaaggataatagaactatgatgactagaaaggagttgttcaaaaacacattgagaaaagcagctcatggatggaaacggatcaatgagcttcgactttctgaagaagaagcatcctggtttaggcattatgttgatcaaccagcatatacggatcttcactggggaatgtttgtgccttttattaaaggatctggtactgaggagcagcaaaagaagtggttgccgttggcatataagatgcaaattattggttgctatgcacagactgaacttggtcatggctccaatgttcaagggcttgagaccactgcaacttttgatccaaagactgatgagtttgttcttaatagtcctacactcacttcaagcaaatggtggcctggtggtttgggaaaagctgctacacatgctgttgcttttgcccgtcttattactgatggaaaagaccatggagtaaatggtttcattgtccaacttcggagcttggatgatcacttacctcttccaggcataacagttggtgatatcggcatgaaatttggaaatggagcatacaactccatggacaatggtgtcctgagatttgataatgtccgcataccaagagatcaaatgttgatgagggtcgcacaagttacaagagaaggaaaatatgtccaatccaatgttccacgacagctactttatggaacaatggtttatgtgcggcaaacaattgtatctgatgcttctactgctctatcacgggcagtatgtattgctactaggtatagtgctgttcgtcgacaatttggttcagaaaatggtggtgttgagacacaggtgattgattacaagactcaacaaagtaggctcttccctttgctggcttccgcctatgctttcagatttgttggtgagtggttgaaatggctatatacggatgtaacacaaaagttgcaagcaaatgatttcgccacattgcctgaagctcatgcatgcactgcgggtctgaagtcactgactacttctgcaactgctgatgccattgaagaatgtcggaaattatgtggtgggcatggttatttaactaacagtgggcttcctgagttatttgctgtttatgtcccggcatgtacatatgaaggagacaatgttgttctacttctacaggttgcaaggtttctcatgaagactgtttctcagctgccatctggtaaaaagcctgtgggaaccacatcttatatgggccgtgcggaacgtttgatccaatgtcgttgtaatgttcagaaagttgaagattggttgaaacccagtgtgatacttgaggcatttgaagcaagggcgattaggatgtcgattgcctgtgctcaagaccttagcaagttttcaaatcaagaagaaggctttgcggaactctcatctaatttagctgaggcagcagttgctcattgccaattgattgtcgtctccaagttcattgagaaactccaacaagacattccagggaagggagtgaaagaacagcttcagaacctctgcaacatatatgctttgtatattattcataaacatttgggtgatttcctctccactggcagcatcacggccgagcaagcttcgctcgccaatgagcaacttagatctctatattccaagctccgtcccaatgccattgcccttgttgatgcatttaattatactgatcactatcttggctcagttcttggccgctatgatggtgatgtttacccgaatctttatgctgaggcatggaaggatcctcttaatgaatcagttgtgcccgatggctattgggaatatatccagcctttgctgaagaaccaactccgaaatgctagactatgatttttaccgtggtgtcgaggattcaatccatgctaataaagctagcagttactcgctgttaacattgtattgtcatatttatgcaactacaatgactagttccaggatatgggaaacaaaaggttttatattgttcttgataaatgtcgccagcagtattgataaaaaacattttagtaagttttggtttatacttcaatttgacggcagttctcatattccacctcttataccacacccgggtagtgctgctatttgaacca

SEQ ID NO: 10524 - DNA, 2665 bp, Populus trichocarpa
gaaaagctctatatcatccaaatcttcgaatatccatgaatatatatatatatatatatatttatccatgtgcgcgggggctcctcaatctctacgactctaccaccgaatcaaacatatctgagctccttctctccctctctctttcctacttcgtagaatctggtagttttcgatttgtttgcaagaatttattgaatttcttagactagaattaaaaaaaaaacaaacaaaagaaaatggaaggagtggatatcctgcctcacgagaggagcaagaagcagttcgatgtggttctcgccacgcgtttgaagtctcagatcgcatggctcgtcttgtggcctccgatccggcatttcaaaaggataacaggagtcggttagggaggaaagaattgttcaaaaacactctgaggaaagcaacttatgcatggaaacgtatcattgagcttcgccttactgaagaagaggctggtaggctaaggtttttcgtggatgagcctgcttttactgatcttcattggggaatgtttgtacctgctattaaaggacaaggcactgaagagcagcaacagaagtggttgccattggcatataagatgcagataattggctgctatgcacaaactgaacttggtcatggatccaatgttcaagggcttgaaacaactgcaacctttgatcctgacaaggatgagtttgtcattcatagtcctacattgacatcaagcaaatggtggcctggaggactgggtaaagtttccacacacgctgttgtttatgcacgccttataaccaatggtgaagaacatggagtgcatggttttattgtccagcttaggagcctggacgatcacatgcctcttccaggcataaccattggtgatattggaatgaaatttggaaacggggcatataacaccatggataatggtgttttgacatttcatcatgttcgcatcccaaggaaccagatgttgatgagagtctttcaggttaccagggaagggaaatgtgtgcaatccaatgttccacggcagttgatttatggcactatggtgttcgtgcgacaaacaattgtagctgatgcgtcctctgctttgtctcgggcagtttgtattgctacaaggtatagtgctgttcgcagacagtttggttcacaggatggagtggagacccaggtgattgattacaaaacccagcaaaatagactctttcctttgctggcttctgcctatgcattcagatttgttggtgaatggctgaaatggctttatacggatgtgacccagaggttgcaagctaatgatttttctacattacctgaggctcatgcatgtaccgcaggcttgaagtctttgactaccaccgccactgctgatgctattgaagaatgtaggaaactgtgtggtggccatggttatctttgtgccagtgggcttcctgaattgtttgcagtatatgtccctgcctgtacatatgaaggagacaatgttgtgctccttttacaggttgcaaggtttctcgtgaagactgtttctcagcttggttctggaaaagagcctattggaacaacagcttatttgggacgagtccaggatcttatgcagtgtcgctgtgaagttcaaacagctgaggattggttaaagcctagtgtaatgctggaggcatttgaagccaggtctgccaggatgtgcgttgcccgtgctcaaaatcttagcaaatttgcaaatcctgaagatggttttgctgaactctctgctgatctagttgaggctgcggttgctcattgccaattaattgttgtttccaagttctttgacaaattgcagcaagatatacctggaaatggggtgaaacaacagttgcagaatctctgctacatctatgctttaaaccttcttcacaaacatctgggtgatttcctctctactggctgcattacccccaagcaagcttcactcgcaaatgatcagctgagatctttatattcccaggtccgacccaatgcaattgcacttgtcgatgcatttaattacactgatcactaccttgggtcggttctcggccgctatgatggaaatgtgtatcccaaactttatgaagaagcatggaaggatcctctgaatgactctgttttgcctgatggctacaatgagtatatccgccctctgctgaagcaacagctccacaacgcaagactctgaagagcacgatgctgtgctgttggctccatgtgctttgatgttatgaataataaaagcaaataaggttacctagaccataaccaccaggaagttaaaaggttgagctttagtttcttagaagctattgtatctgtaccatccaaactgaaaacctggttgatataattgttttttttttttcctcggctcccagttgtggcaaatgagccgtggataatatcgtctttcactacatcacataatttttcctgttcgtctttcactatatcacataatttttcctgtcatttctttaccctatgaaatattagtttcacgattcatcactccccctcagaaaagtaataaattttgatttcccttttggaactttgtaaatttaaagtctttaatctatgtcatatatgttgtagtatcatgggtatgaataatataattaatatgaacttatatagtaaa

SEQ ID NO: 10525 - DNA, 2295 bp, Daucus carota
ctttatgtcttgatatctcatcgtgatcacaccatattttttaatacccttttttgtatatttacattaaatacaattcagcagctttctttatatacatataacacacacagaaagaaacagagagtgttgtattgaaattgggcatctgggttttgtttgatttgaattaagagatgaagggtgttgattatttagctcacgagaggaataaagctgggtttgatgtggattctatgaagatcgtttggtatggctctcagcgtgattttgatatcaatgatcgcatggctaagcttgttgcttctgatcctgtttttagcaaagaaaacaggactatgcttcctagaaaggacttgtttaagaacacccttaaaaaggcggcttatggatggaagcggataagagaactcaatttaacttttgaagaggcaactaagttcaggacatatatcgatcaaccggcgtttactgatcttcattggggaatgttcatacctgctataagaggacaaggcactgatgaacaacataagaaatggttgccgcttgcacagaagatgcaaatcattgggtgttatgcacaaactgaacttggtcatggatctaatgtacaaggtcttgagaccactgccacgttcgatcccaaaactgatgaatttgtaatccatagtcctactctgacctctagcaaatggtggcctggtggtttggggaaagtatcaacgcatggtgtcgtttatgcccgtcttttgactgatggccaagaccatggtgtacatggtttcattgtccaattgcggagcttagaagaccacacacctcttccaggtgtaactattggtgatattggaatgaaatttggaaatggagcttacaactcaatggacaatggtgtgttaagttttgatcacgtacgaataccgcgagaccagatgttaatgcgagttttgcaggtttcaagggaagggaaatgtacacagtctgatgttcctcggcagctaatttatggaactatggtttatgtccggcagacaattgtatccgatgcctctgtggctttatctagggcggttactattgccacaaggtatagttgtgtgcgtagacaatttggatcgcaaaatggggggccagagactcaggtgattgattataaaacacagcagaataggctcttccctttgctggcttctgcctatgcctttagatttgctggtcagtggttaagttggttgtacaaggatgtgacagacaaattgcaagctaatgacttctcaacactcccagaagctcatgcatgcaccgcagggctcaagtctttgaccacaagtgccacagcagatgcaatcgaagaatgtcgaaaattatgtggaggtcatggctatctatgtaccagtggccttcctgaactatttgcagtttatgtacctgcttgtacatatgaaggagataatgttgtgctacttctgcaggttgcaaggttcctagtgaagactgtgtctcagctgagtagtggaaataagccagcaggaacagtagcttacatggggcgagctgaacacctgatgaaatgtcggtctagtgttgaaagagctgaagattggctaaaacctagttcaatactggaagcatttgagacgagggcatttagaatggctgttgcctgttctcagagcttgagtcagtttgcaaattccgaagaaggctttgcggaactatcagctgatttagcagaggcagcaattgctcactgccaattgattgtcatttccaagtttattgataaactgaaagaaccaattcctggaaaaggaattaaacaaatactagaggttctttgccaggtctatgcgctatctacacttcacaaacaccagggcgactttctcacaacggccagcattaccccaaagcaggcagcacttgcattcactcaattgagacatctgtattcccaggtccgaccaaatgctgttgcactcgttgattcattcaaccacacagaccactatcttggttcaattcttggacgttacgatgggaatgtatatccaaaactctacgatgcagcatggaaggagccgctgaacgatacagttgtgcctgatggttacaaggaatatatcaggcctttgctcaagaatcagctacatctggctaagctctgaaaggagaactacaatgctgattgcatcattatacaagaacattagttcacctaataaaaaaggtgcccctaattgatccctgactattgtgtcatggaagtctaatactttctagtttatacca

SEQ ID NO: 10526 - DNA, 2153 bp, Petroselinum crispum
ttttgttacctaaagtgctatataattgaatcttgatgtacaaatagacacacagagagagttgtattgaaactgggttgtgtttgatttgagttgagaaatggagggtgttgattatttagctgaagagagaaataaagctgggtttgatgtgaattgtatgaagattgtttggtatggctctcaacgtgattttgatatctctgatcgcatggctaagcttgttgcctctgatcctgttttttcaaaggaaaacaggactatgcttcctcgaaaggaattgtttaagaacactctgaaaaaagcggcttatggatggaagcggatcagagaactcaatctaacatttgaagagtcaactaagttcaggacttacattgatcaaccagcctttactgatcttcattggggaatgtttatacctgctataagaggacaaggcaccgatgaacaacacaagaaatggttgccccttgcacagaagatgcaaattattggctgctatgcacagactgaactaggtcatggatctaatgtacaaggtcttgagaccaccgccacatttgatcccaaaactgatgaatttgtaattcatagtcctactctgacatctagcaagtggtggcctggtggtttggggaaagtatccacacatggtatcgtttatgcccgtcttttgactgatggtcaagaccatggtgtacatggtttcattgtccaattgcggagcttagaagatcactcgcctcttccaggtgtaactattgctgatattggaatgaaatttggaaatggagcatacaactcaatggacaatggtttgttaagatttgatcacgtacgaataccgcgagatcagatgttgatgcgagttttgcaggtttcaagggaagggaaatgtacccaatcggatgttcctcggcagctaatttatggaactatggtgtatgtccggcagacaattgtatctgatgcctctgtggctttatcccgagcagttactatcgccactaggtatagttgtgtgcgtagacaatttggatcgcagaatggggggcccgagactcaggtgattgattataaaactcagcagcataggctctttcctttgctggcttctgcctatgcctttagatttgctggtcagtggttaagttggttgtacaaggatgtgacagacaaattgcaagccagtgacttctcaacgttgccagaagctcatgcatgcaccgctgggctcaagtctttgaccacaagtgccacggcagatgcaattgaagaatgtcgaaaattatgtggaggccatggttatctatgtagcagtggtcttcctgaattatttgcagtttatgtccctgcctgtacatatgaaggagacaatgttgtgctacttctgcaggttgcaaggtttctagtgaagactgtgtctcagctaaaaagcggaaacaagccagcaggaacagtagcttatatggggcgagctgaacacctgatgaaatgtcggtctagtgttgaaaaagctgaagattggctaaaacctagttcaatactggaagcatttgagacaagggcttttagaatggctgttgcctgttctcagagcttgagtcagtttgcaaatcacgaagaaggctttgcggaactatcagctgatttagcagaggcagcagttgctcactgccagttgattgtcgtttccaagtttattgataaactgaaagaacccattcctgggaaaggaattaagcaaatactagaggtgctttgccaggtctatgcgctatctacacttcacaagcaccagggcgagtttcttgcaactgccagcattacaccaaagcaaggagcgcttgcattcactcaattgagacatttgtattcccaggtccgaccaaatgctgttgcactcgttgattcattcaaccacacagaccactatcttggttcaattcttggacgttacgatgggaatgtatatccaaaactctatgacgcagcatggcaggagccgctcaatgataaagatgtgcctgatggttacaaggaatacatcaggcctttgctcaagaaccagctacatctggctaagctctgaaaggaaaacaacagagatgattgcatcatttatatgaaaacattagtcatgaacaaat

SEQ ID NO: 10527 - DNA, 2359 bp, Arabidopsis thaliana
gcaattaaatcggtagagtgaggcattgtccttctttttctccctctgttttttttttttttttttcctatcatctctgagagttttctcgagaaacttttgagtgtttagctactagattctgaattacgaatcatggaaggaattgatcacctcgccgatgagagaaacaaagcagagttcgacgttgaggatatgaagatcgtctgggctggttcccgccacgcttttgaggtttccgatcgaattgcccgccttgtcgccagcgatccggtatttgagaaaagcaatcgagctcggttgagtaggaaggagctgtttaagagtacgttgagaaaatgtgcccatgcgtttaaaaggattatcgagcttcgtctcaatgaggaagaagcaggaagattgaggcactttatcgaccagcctgcctatgtggatctgcactggggaatgtttgtgcctgctattaaggggcagggtacagaggagcagcagaagaagtggttgtcgctggccaataagatgcagattattgggtgttatgcacagactgagcttggtcatggctcaaatgttcaaggacttgagacaactgccacatttgatcccaagactgatgagtttgtaattcacactccaactcagactgcatccaaatggtggcctggtggtttgggaaaagtttctactcatgctgttgtttacgctcgtctcataactaacggaaaagactacggtatccatggattcatcgtgcaactgcgaagcttagaagatcattctcctcttccgaatataactgttggtgatatcgggacaaagatgggaaatggagcatataattcaatggacaacgggtttcttatgtttgatcatgttcgcattcctagagatcaaatgctcatgaggctgtcaaaagttacaagagaaggagaatatgttccatcggatgttccaaagcagctggtatatggtactatggtgtatgtgagacaaacaattgtggctgatgcttccaatgcactatctcgagcagtttgcatagctacaagatacagtgcagtgcggaggcaatttggcgcacataatggtggcattgagacacaggtgattgattataaaactcagcagaacaggctatttcctctgctagcatctgcatatgcatttcgatttgttggagagtggctaaaatggctgtacacggatgtaactgaaagactggcggctagtgatttcgcaactttgcctgaggctcatgcatgcactgcaggattgaagtctctcaccaccacagccactgcggatggcattgaagaatgtcgtaagttatgtggtggacatggatacttgtggtgcagtgggctccccgagctgtttgctgtatatgttcctgcctgcacatacgaaggagacaatgttgtgctgcaattacaggttgctcgattcctcatgaagacagtcgcccagctgggatctggaaaggttcctgttggcacaactgcttatatgggccgggcagcacatcttttgcaatgtcgttctggtgttcaaaaggctgaggattggttaaaccctgatgttgtactggaagctttcgaagctagggctctcagaatggctgttacgtgtgccaaaaatctcagcaagtttgagaatcaggaacaaggattccaagagctcttggctgatttggttgaggccgctattgctcattgccaattgattgttgtttccaagttcatagcgaaactggagcaagacataggtggcaaaggagtgaagaaacagctgaataatctgtgttacatttatgctctttatctcctccacaaacatctcggcgatttcctctccactaactgcatcactcccaaacaagcctctcttgctaacgaccagctccgttccttatacactcaggtccggcctaatgcggttgcacttgtggacgccttcaattacaccgaccattacttgaactcggttcttggccgttacgacggtaatgtgtacccaaagctctttgaggaagcgttgaaggatccattgaacgactcggtggttcctgatgggtaccaagaataccttcgacctgtgcttcagcagcaacttcgtaccgctaggctctgaagagttttctttgcttgatactcgatatggttaatcacattagacttgcttcgtccttcttcttcgtcttcttcttcttctcgctttgaataatttcgcagtttaaaaactggcgatgcccttatttatatgtagcaatgtaatagttaatgtacgatcgtcatatggcggaattttagtactatttttcgttttcaatgcaacattaatacaattgatcgtttctact

SEQ ID NO: 10528 - DNA, 2275 bp, Cocos nucifera
aaaaaagattggaattttcttttgggtctaagagagattggaagaggagggttggggacgatggaggaagtggatcacctggcgcacgagaggagcaaggcgcagttcgatgtggacgccatgaaggtcgtctgggccggctccaagcacgccctcgacgtctccgatcggatggcccgtctcgtcgccagcgatcccatatttcgcaaggataacagaacgatgcttgggcggaaggagttgtttaaaaacaccctgagaaaggctgcccacgcatggaagcgcgtccatgagctccgtcttactgaagaagaggcatcaatgttaagattatttttggatgaaccttcttatgtggatctgcattggggcatgtttgttcctgctataaaagggcaaggaaccgatgagcagcagaagaagtggttacctctggcctataaaatgcaaataattggctgctatgcacagactgaacttggtcatggttcaaatgtccaaggccttgaaacaactgcaacgtttgatcccaaaactgatgaatttatcattcatagtcctactctaacttcaagcaagtggtggccaggaggcttgggaaaagtttctacacatgcagttgtttatgctcatttgatcacggaaggaaaggaccacggcgtacatggtttcatagtccagttacggagtttggataatcactcacctcttcctgggattactattggtgatattggaacaaaatttggaaacggtgcatacaacacaatggataatggtgttctacgatttgaccatgtgcgcataccaagaagtcaaatgttgatgagggtttcacaggttacaagggagggaaagtttattgtatctgatgttccaaggcagctagtttatgggacgatggtgtatgtgcgtcagaccattgtgtcagatgcttctagagcattgtctcgagccgtctgtattgcagtaaggtatagtgctgtccgcaggcagtttggctcacaggatggtggccctgagacacaggttattgattacaaaacccagcaaagcaggctcttcccattgctggcttcagcttatgcttttagatttgtgggtgagtggctgaaatggctatatgcagatgtcactcagagactgcaagctaatgatttttcaacattgcccgaggcacatgcatgcactgctggtttgaaatctttgacgacctctgctacagctgatgggattgaagaatgccgaaaactatgtggcggccatggttatctctgtagcagtgggcttcctgagctgtttgctgtatatgttcctacatgcacttatgaaggagataatgttgttttacttttgcaggttgcaaggtttcttatgaagactgtttctcagcttgggtcaggaaaacagcctgtagggaccacagcatatatggggagagcgcaccacttaatgcaatacaaatgtgatgttcgtggagctgaagactggttgaagccttcagtcatattgcaagcatttgaagctagagctgttaggctggctgtaaattgtgcccaaaatataagcaaagcacccagcccagaagaaggtttttctgaactgtctgctgatttagttgaagctgcagttgctcactgccagttgattgttgtatcgaagttcatcaagaaggtgcaacaagacataccaggacttggagttaaagaacaactacagattctctgcaacatctatgcactctctgtgcttcacaagcatcttggcgagttccttgcaactgggtgcatcacaaccaggcaaggttctctggcaaatgatcagcttcggtatctatattcccagatacgtcctaatgctgttgcacttgttgatgcattcaactacaccgatcactacttggggtctgttcttggtcgctacgatgggaacgtgtatccaaaacttgaggaagaggcttggaaggacccactgaatgactcagttgtgcctgatggataccatgaatacattcagcccgtacttaagcaaaagtttaggttatcaaggctgtgaagccgcaatccaatcaactgaagttcttcatatgtctctttaagattcaaatgatagcgacagggggatgaactgctgatgtccaaatctggcaataaagtttcggaaataagaatcagcccttttgcggggggtatttgtattgtatctcaaaactttaggggcattaatatgagaatttgtttggagccacgatgtgtcccccttggaagaatttttt

SEQ ID NO: 10529 - DNA, 2205 bp, Zea mays
gcgagcctgaccgagacagacacacaccagagggagagggagacggagagaagggcgagcggcactagcaagcatggcggcggccgtcctagcgcccaagccgcctcctccgctgcctaccagggcctttccttcctcatccccctcgcggtttgcccctgccttcatctccccgcgtcatcccctgagaagattgctcctccgccccattccgtgcgcctcatcgccgtcttccgtcttgatgccgaacccggacctcgagactgagcctgcccacgatggagatggagatggagatgaggcgccgccggagtccaggccccgccgcatcgcccttttcgtcgagccgtctcccttcgcctacgtctccggctacaagaaccgcttccagaacttcatcaagtacctacgggagatgggcgacgaggtgattgtggtcaccacgcacgagggcgtgcctcaggaattccacggagccaagctaattggctcatggagcttcccttgcccctggtatcaaaaggttccgctgtcgctggccctcagtcctcgaatcatcgcagaagttgctagattcaagcctgacattattcacgcctcttcacctgggataatggtatttggcgcgcttatcatagcaaagttgctctgcgtccctctggtaatgtcataccacacccacgttccaatttatatacccagatatactttcagctggcttgtcaagcccatgtggctaataataaaattcttgcaccgagctgcagacctcacactggtaccatctgttgctatcggcagggatcttcaagctgctcgtgttacagcagccaataaaatacgcctttggaacaagggtgttgactcagaaagcttccatcctcgtttccgcaacatggaaatgcgttcaaggctaacgaatggtgaaccagaaaagccacttgtattttatgttggacgcttaggagttgagaaaagcttggattttcttaagagagtcatggaccgacttccaggagcaaggattgcatttattggagacggaccattcagagctgagctcgagcagatgttctcaggtatgccggtggtgttcacgggcacgttgcaaggggaggagctatcacaggcctatgccagtggggatgtgtttgtgatgccttccgagtcagagacactggggtttgtggtgctggaggccatgtcatcaggagttccggtagtcggggctcgcgccggaggaatacctgatatcatacctgaggatcaggaggggaggaccagctttttgtacacaccaggggatgtggatgactgtgttggcaagatcaagcggctcctgtcgagcgaggaactgagggaggccatggggagagctgccaggaaggagatggagaagtttgactggcgagcggcgacgaggaagatccgcaacgagcagtacagtgctgcaatctggttctggcgcaagaagagggcacaggtgctgcggcccctccaatgggtgctgcggctgctgaggcggacaatgccaggagctgccgatgccgcagcgaagcaatcctaggagaggggggctactatggttgatggtcctcttttttcccattccttgtattatctccgttttcgaatatttgtcgtccgctagttcatttttaactaaacagcgacaaataaaaaagaacgacgagagtataaaatgggctaaggaggccatggcagatgattggatatgtttcaggattagaggggaggaaggtcaagcttcaacattccaattcactgaagaatatataatgtacgtttaggactgttaggttgtaaatcgtcaaagtgtctatgtaatgcttcttcttggcatgctacactatatagtactaatattgatcctttaacaggaattggtgtgcagtcagacaatgataataatatatcttgctctgtctttctagtatcaaaggaggtgaaacgaataaaagggtgtttcaaaattgaactaggagagtggttgcaaataaccccccccccctccttttttttggaagcttgtagagatattttcataagctttaaatacttcatttgcatttataatgcattgatctatatttagaattttctcaatttttttagaaactcggacatttttcatggtatagaaaacatctgtttttaaaaaatacaaaagatgaaaccaccttt

SEQ ID NO: 10530 - DNA, 2354 bp, Setaria italica
tttcggttcatttctcgacaagtctgacatgcaaacacagacgcatatcatgtacaaaatggcatcttggacgcaacgcttgaactgttgagcagatgttgagcgactagcgaggagctcatggtgattggttggacgcggataaggctgctcgctgatggcatctgctaatcctggcaaaccgaatatgctctctgtcctcacctcaacctcaacgacaaacgctcagcagtactgtatcatcttcctccagccattttcctggattccattaccattccactggcgagtgtggtgtagcagcagccgagaatactagtagtgatcagtgaaccagaaccagagggtcttcagccagcgacacaacaaaggatggcggcggcgggcgccgtcgttcccaggccgcctcctcctcttcctataacggccttcccctcctcctcgtggccccgcctctccccgcggtatcccctaagattaagaagcatgctccgccgcccccttccgtgcgccgccgcatcctcctcctccgtcttgatgcccgatccggacctggagcctgagcccgcccacgaggacgagtccaggccccgccgcatcgccctcttcgtcgagccctcgcccttcgcctacgtctccggctacaagaaccgcttccagaacttcatcaagtacctccgggagatgggcgacgaggtgattgtggtcaccacgcacgagggcgtgcctcaagaattccacggagccaagctaatcggatcctggagcttcccttgcccctggtatcaaaaggttccgctctcgctggcgttgagccctcgaatcatcggagaagttgctagattcaagcctgacattattcatgcctcttcccctgggattatggtatttggtgcgctaattatcgcaaagctgctctgcgtccctcttgtaatgtcataccacacccatgtcccaatttatataccccgatatacattcagctggcttgtcaagcccatgtggctaattattaaattcttgcaccgagctgccgatctcacacttgtaccatcagttgctattggcagggatcttcaagctgcccgcgttacagcagccaataagatacgcctttggaacaagggtgttgattcagaaagcttccatcctcgcttccgaaataaggaaatgcgttcaaggctaactaatggagaaccagaaaaaccactaatattgtatgttggacgcttaggagtggagaaaagtttggattttcttaagagagtcatggaccgacttccaggatcaagaattgcgtttatcggagatggcccattcagggctgagcttgagcagatgttctcaggtatgcctgcagtgttcacgggtacgttgcaaggggaagagctatcgcaggcctatgccagtggggatgtgtttgtgatgccttcagagtcagagacgcttggctttgtggtgctcgaggccatgtcatcaggagttccggtagtcggcgctcgagctggaggaatacctgatattataccggaggaccaggaagggaagaccagctttctgtacacgccaggggatgttgatgactgcgttagcaagattgagcgtctcttgtcatgcgaggagttgcgagagacgatggggagggctgccaggaaggagatggagaagttcgactggcgagcggcgacgaggaagatccggaatgagcagtacagcgctgcgatctggttctggcgcaagaagagggcacagctgctgaggcccgttcagtgggtggtccggaagctggtgaggccgacaacgcctggggctgccgttgcgaagcaatcatagaagaatgttaaaaaaaaagcaatcatagaagaggaagcatttccgtaaaaaaaaacagagagagggagagaggaagcattctggacggtgcatctgcttctgtggtgttgacgattggatgtctgatgctcaacaattgatgggaaggaagctcgagcttccagtacaattgaatggatgatcactcaccattaggtttaggactggttgattgtaaatcgtacatacgcgtgtactacttcattcgcttgctacattgcatcctactattctgtctttggtagactactattctgtctttggtagaattggcagtccgtaaatgagatgcgttgccatgtcatagtaattacgaagagaagagacgaaatgagtttcatgaaactcgatttacacgatttccaacacatgaaactctttcacaccttccatggagagctactcttttcattccaaattgtaggtcgttttgatttttctaggtgcataatttttttatgcatatagatataatgtatgcc

SEQ ID NO: 10531 - DNA, 2187 bp, Panicum virgatum
atagcatctgctaatcccggcaaaacgaatatgctctttgagttttcgatgatccagctcctcctcttgttggattccatccccattcctctggcgctgtggtcttgtagctgcagccgagcgcgcatggccatggcggcggcgtagtggtgcgtcgtgcctacctgtgttggggggtgggcggctcactcaactactagcacttgagccagccaccacctgtcccctcccactcccaggccctgaacaccaagcatggcggccgccgccgtggtgcccaggccgcctccttctcttcctaccagggcctttccctcctcctcctccacctcctgctcttcccggcggtatcccctaagattaagaagaagcatgccccgcccccttgtgtgcgccgctgcatcgtcctccgtctggatgcccgatccggacctggagcctgagcccgcccgcgacgaccagcccgcgcccgagtccaggccccgccgcatcgccctcttcgtcgagccctcgcccttcgcctacgtctccggctacaagaaccgcttccagaacttcatcaagtacctccgggagatgggcgacgaggtgattgtggtcaccacgcacgagggcgtgcctcaagaattccacggagccaagctgattggatcctggagcttcccttgcccctggtatcaaaaggttccgctctcgctggcgctgagccctcgaatcatcggagaagttgctagattcaaacctgacattattcatgcctcttcccctgggattatggtatttggcgcgctaattatcgcaaagttgctctgcgtccctctagtaatgtcataccacacccatgttccaatttatataccaagatatacgttcagctggcttgtcaagcccatgtggctaatcattaaattcttgcaccgagctgcagatctcacactggtaccgtcggttgcgatcggcagggatcttcaagctgcccgtgttacagcagccaataagatacgcctttggaacaagggtgttgattcagaaagcttccatcctcgcttccgaaataaggaaatgcgttcaaggctgactaatggtgaaccagagaagccactaatattgtatgttggacgcttaggagtggagaaaagtttggattttcttaagagagtcatggatcgacttccaggatcaagaattgcgtttattggagatggcccattcagggctgagcttgagcagatgttctcaggtatgcctgcagtgttcacgggtacgttgcaaggggaagagctatcgcaggcatatgccagtggggatgtgtttgtgatgccttcggagtcagagacgctcgggtttgtggtgcttgaggccatgtcatcaggagttccggtagttggcgctcgagctggaggaatacctgatattataccagaagatcaggaggggaagaccagctttctgtacacaccaggggatgttgatgactgtgttagcaagatcgagcgtctcttgtcatgcgaggagttgcgagagatgatggggagggctgccaggaaggagatggagaagtttgactggcgagcagcgacgaggaagatccggaatgagcagtacagcgctgccatctggttctggcgcaagaagagggcacagctgctgaggcctgtccaatgggtggtccggaggctgttgaggccgacgatgcctggggctggcaacaccgtcgcgaagcaatcatagatgaagaggaagcattctggagcatattgggtcagtgcatctgcttctgcggtgtggattgattggatgcgtgatgctcaacaacattgaagggaaggaagctcaagtttagggttccagtacactgaagaatggatgatcagtcgttatttggtttaggactagtagattgtaaatcgtacatatgcgtgcactacttattctcttacgacgttgcatttgcatcctactatctattctttggtagaattggtattatgtctgtctccctacctgtttggaaacatgactacctctcagatccggccccggccctccgtacgcgtgtttgtgtgtgaaaacatgaatagtctcggtttgcggtcaacggatacgaggtgctcaattgtcaagtttggtgctagcactggactctaattaattaagaatgtaaaaggttcattttagcagcctcaa

SEQ ID NO: 10532 - DNA, 1744 bp, Echinochloa colona
gctgtgctgtgctgtgctggtgagcgattcaattcagtaaaagctagtggagtgaggagtggctagtgtggacggctccggcctgactgactgtgggagcatcccctcccgaagtccccagagccagcgacaccaccaaggaagataaggatggcggcggcggccgccgtcgtgcccaggccgcctccttcgcttcctaccagggccttcttcccctcccccgcatggcccctcctctcccggcgccaccccacaataacaagattaacaaccacggccgccgccgcatcgtcgtcctccgtcgtcatgcccgagcccgatccggacctggaccttgagcctgctgaccaatccaggccccgccgcatcgccctcttcgtcgagccctcgcccttcgcctacgtctccggctacaagaaccgcttccagaacttcatcaagtacctccgggagatgggcgacgaggtcattgtcgtcaccacgcacgagggcgtgcctcaagaattccacggagccaagctaatcggatcctggagcttcccttgcccctggtatcaaaaggttccactctccctggcgctgagccctcgaatcatcggagaagttgcgagattcaagcctgacattattcacgcctcttcccctgggattatggtatttggagctttaattatagcaaagctgctctgcgtccctctagtgatgtcataccatacccacgttccaatttatataccaagatatacattcagctggcttgtcaagcccatgtggctaattattagattcttgcaccgagctgcagatctcacactggtaccatcagttgctattggcagggatcttcaagctgcccgcgttacagcagccaataaaatacgcctttggaacaagggagttgattcagaaagcttccatcctcgcttccgaaataaggaaatgcgttcaaggctaacaaatggtgaaccagaaaagccactaatattttatgttggacgcttaggagttgagaaaagtttggattttcttaagagagtcatggaccggcttccaggatcaagaattgcatttattggagatggcccattcagggctgagcttgagcagatgttctcaggtatgcccgcagtgttcacgggtacgttgcaaggggaagaactatcacaggcctatgccagtggggatgtgtttgtgatgccttcagagtcagagacgcttggctttgtggtgcttgaggctatgtcatcaggagttccagtagtgggcgctcgagctggaggaataccggatattataccagaggatcaggaggggaagaccagctttctgtacacaccaggggatgttgatgactgtgttagcaagatcgagcgtctcttgtcatgtgaggagttgcgagagacgatggggagggctgccaggaaggagatggagaagtttgactggcgagcggcaaccaggaagatccggaacgagcagtacagcgctgcgatctggttctggcgcaagaagagggcgcagctgctgaggcccgtccagtgggttgtccggaggttgaggccgacaacacctggggctggcaacaccatagcgaagcaatcatagaagaaggcttctgtggtgtggactgtggaggattggatgtgggatgctcaacaattgaagggaagaaagctcaagcttcagtgttcccgtacacttaagaatggatgatcactcgacatttagggtttaggattggtag

SEQ ID NO: 10533 - DNA, 1960 bp, Pennisetum glaucum
aggccgcctcctcctcttcctataacggcctccccctcctcctcgacctcgtggccccgtctctccccgcggtatcccctaagattaagaagcaagctccgccgcccccttccgtgctccgccgcatcatcctccgtcttgatgcccgatcctgacctggagcctgagcccgcccacgagggtgagtccaggccccgccgcatcgccctcttcgtcgagccctcgcccttcgcctacgtctccggctacaagaaccgcttccagaacttcatcaagtacctccgggagatgggcgacgaggtgattgtgatcaccacgcacgagggcgtgcctcaagaattccacggagccaagctaatcgggtcctggagcttcccttgcccctggtaccaaaaggttccgctgtcgctggcgttgagccctcggatcatcggagaagttgctagattcaagcctgacattattcatgcctcttcccctgggattatggtatttggtgcgctaattatcgcaaagctgctctgcgtccctctagtgatgtcataccatacccatgtcccaatttatatacccagatatacattcagctggcttgtcaagcccatgtggctaattattaaattcttgcaccgagctgctgatctcacactcgtaccatcggttgctatcggcagggatcttcaagctgcccatgttacagcagctaataagatacgcctttggaacaagggtgttgattcagaaagcttccatcctcgcttccgaaataaggaaatgcgttcaaggctaactaatggtgaaccagaaaaaccactaatattgtatgttggacgcttaggagtggagaaaagtttggattttcttaagagagtcatggaccgacttccaggatcaagaattgcgttcatcggagatggcccattcaggcctgagcttgagcagatgttctcaggtatgcctgcagtgttcacaggtacgttgcaaggggaagagctatcgcaggcctatgccagtggggatgtgtttgtgatgccttcagaatcagagacgcttggctttgtggtgctcgaggccatgtcatcaggagttccggtagtcggcgctcgagctggaggaatacctgatattattcctgaggaccaggaagggaagaccagctttctgtacacgccaggggatgttgatgactgtgttagcaagattgagcgtctcttgtcatgcgaggagttgcgagagacgatggggagggctgccaggaaggagatggagaagttcgactggagagcggcgacgaggaagatccggaatgagcagtacagcgctgcgatctggttctggcgcaagaagagggcacagctgctgaggcccgttcaatgggtggtccggaagctggtgaggcctagaacgcctgtggctggaaacgccattgcgaagcaatcatagatagaagaatgttacagaaaaaagacattcgtagaagaggaagcatttccttcaaaaaaaagagaaaaaaagaggaagcactccggacggtccatctacttctgtgaggttgataattggatgcctgatgctcgacaatataattgatgggaatgaagcccgagcctccagtacactgaagaatggatgattgtatgtctgatgctcaacaattgattaggtctaggactgttagattgtagtagatcgtacatacgtgtacttgagttgcttattacattgcatcctactattctttctttggtagaattggcaatatgagcatgttgggttgggttctaaaatttgcccagccaatatttagtgcaaaccaaatctatgaatttctgtagcggtttgcactaaatggataaggtcactctcaataggagcttcattctccaatctccataaatgagatcatacacaagatgctatgcaggcaaatatattgacatgtcatagaaattatatgaag

SEQ ID NO: 10534 - DNA, 2188 bp, Triticum aestivum
ggcttgatgccttgatcaattcgattttgcattcgaatatgctcgtctcgtgtggttcgttcgaatatgccggtgcgacaaaggccaagggcaagtgggaaccactgactttcgtccactcccttctccagctccagctcttctttcttcgcctcgcgcgagtgagcgaatagcctcaatcgatcctattcgattcaaccaaagcaaagaaaggaataccggaagaggattaaattgccgcaaggacgaggcaaggatggcgagggcggcgcccatcctcgccgtgtccaagccgtctcctctccctctaatcgccccgtcgtcacgcccccgggctgggtcccttcacctgcatcgccgccgcctcctcccactctcgccgtcgtcgtcatgcagcaccagcaccagcgcctcttcctcctcctcctcgccggtcttgctgcgggatgacgagctggaccaccaggaggagcccccgcccgcttcggaggccgactcgcggccccgccgcatcgcgctcttcgtcgagccctcccccttcgcctacgtctccggctacaagaaccgcttccagaacttcatcaagtacctccgcgagatgggcgacgaggtcatcgtcatcaccacccacgagggcgtgcccgacgagttccacggcgccaagctcatcgggtcctggagcttcccttgcccctggtatcagaaggtcccgctctcgctcgccctcagccccagaatcattggagaagtcgctaggttcaagcccgacattatccacgcctcttcccctggaatcatggtattcggcgccctaatcatcgcaaagttgctatgcgtccctctagtgatgtcctaccacacccatgttccaatttatattccaaggtatacattcagctggcttgtcaagcccatgtggctagttataaaattcttgcaccgagctgcggatctcacactggtaccatcagtcgctattggcagggaccttcaagctgcccgtgttacagcagccaataagatacgcctttggaacaagggcgtggattcagaaagcttccatcctcgtttccgtaatcaggaaatgcggtcaaggctaacgaatggtgaaccagacaagccactgataatctatgttggacgcttaggagttgagaaaagcttggattttcataagcgagtcatggaccgacttccaggatcaagaattgcattcattggagatggcccattcaggcctgaacttgaagagatgttttcaggaatgcctgcagtgttcacagggacattgcaaggggaagaactgtcacaggcctatgccagtggggatgtgtttgtgatgccttctgagtcagagacgctgggttttgttgtgttggaggcaatgtcatccggagtcccggtggtcgctgctcgagctggaggcatacctgacattatacctgaggatcaggaaggaaagaccagctttctgtacacaccgggtgatgtggatgactgtgttgggaaggttgaactcctgctctcctgtgaagagttgagagagacaatggggaaggccgccaggaaggagatggagaaattcggctggaaggcggcgacgaggaagattcggaacgagcagtacagcgccgcaatttggttctggcgcaagaagagatcgcagctgctgagacctctccagtgggtgttccggaggctcttcaggcccgctcctgctcctgcccccgccataacaaatcagtcataggagattcgttgtattcaagccctagaatcaatcaaccattctgttgagtccatcagtttggtcaacccgaaagatagaaagattcatgggacacctaatgtgaatatgtaatgctcaattaaattggagccaacagaagtaactccagtttgctccggtggcaagttgtaaatgttatatactgcttgctattcgttgacaccagattttggcctacacaagacctcctttaacatgaaagttgtgggtctcatcgagacaaacaactttgcttgcgatctctagcagatcctgcaaccggcgtcccacagaactcctatgattgtgaatacccattaattatttttaaatttgagcaaatgagttgaagtttgacaagaaaacaacgtaatgagttacggctgtgtatatttgcatagaagctactcccttcgttcc

SEQ ID NO: 10535 - DNA, 1726 bp, Hordeum vulgare
atggcgagggcggcgcccatcctcgccgtgtccaagccgtctcctctccctctaatcgctccgtcgtcacgccaacgggctggctcccttcgcctgcatcgccgccacctcctcctcccattctcgccgtcgtcgtcatgcagcaccagcaccagtgcctcttcctcctcctcctcgtcgccggtcttgctgcgggacgacgagctggaccaccaggaggagcccccgcccgcttcggaagccgactcgcggccccgccgcatcgcgctcttcgttgagccctcccccttcgcctacgtctccggctacaagaaccgcttccagaacttcatcaagtacctccgcgagatgggcgacgaggtcatcgtcatcaccacccacgagggcgtccccgacgagttccacggcgccaagctcatcggatcctggagcttcccttgcccctggtatcagaaggtcccgctctcgcttgccctcagccccagaatcattggagaagtcgctaggttcaagcccgacattatccacgcctcttcccctggaatcatggtattcggcgccctaatcatcgcaaaattgctatgcgtccctctagtaatgtcctaccacacccatgttccaatttatattcccaggtatacattcagctggcttgtcaagcccatgtggctagttataaaattcttgcaccgagctgcggatctcacactggtaccatcagccgctattggcagggaccttaaagcagcccgtgttacagcagccaataagatacgcctttggaacaagggcgtggattcagaaagcttccatcctcgtttccgtaatcaggaaatgcggtcaatgctaacgaacggtgaaccagagaagccactgataatctatgttggacgcttaggagttgagaaaagcttggattttcataagagagtcatggaccgacttccaggagcaagaattgcattcattggagatggcccattcaggcctgaacttgaagagatgttttcaggaatgcctgcagtgttcacagggacattgcaaggggaagaactgtcacaggcctatgccagtggggatgtgtttgtgatgccttctgaatcagagacgctgggttttgttgtgttggaggcaatgtcatcgggagttccggtggtcgctgctcgagctggaggcatacctgacattattcctgaggaccaggaaggaaagaccagctttctgtacacaccgggtgatgtcgatgactgtgttgggaaggttgaacgcctgctctcctgtgaagagttgagagagacaatggggaaggccgccaggaaggagatggagaaatttggctggaaggcggcgacgaggaaaattcggaacgagcagtacagcgccgcgatttggttctggcgcaagaagagatcgcagctgctgagaccactccagtgggtgttccggaggctcttcaggtctgctcctgctcccgccgccgccataacaaatcagtcataggagattcgttgtattcaagtcatagaatcaatcaaccattctgttgagcccatcagtcttggaagatagaaagaatcctgggacacctaacgtgaatatgtaatgcttaattaaattggagccaacagaagtaactccagtttgctctggaggtaggctgtaaatgttatactgcttgctattcgttgacaccagattttggcttacacaagacgtctttataaca

SEQ ID NO: 10536 - DNA, 2019 bp, Secale cereale
atcaattcgattttgcattcgaatatgctcgtctcgtgtggttcgttcgaatatgccggtgcgtcaaaggccaagggcaagtgggaaccactgactttcgtccactcacctctccacccgctcttcttctttgttcgcctcgcgcgagtgagcgagtagcctcaatcgattcgattcgattcgattcaaccaaagcaaaggaataatcggaaggggattaaattgccgcaaggacgaggcaaggatggcgagggcgccgcccatcctcgccgtgtccaagccgtctcctctccctctaatcgccccgtcgtctcgcccccgggctggctcccttcgcctgcatcgccgccgcctcctcccattctcgccgtcgtcgtcatgcagcaccagcaccagcaccagcgcctcttcctcctcctcgtcgccggtcttgctgcgggacgacgagctggaccaccaggaggagcccccgcccgcttcggaggccgactcgcgaccccgccgcatcgcgctcttcgtcgagccctcccccttcgcctacgtctccggctacaagaaccgcttccagaacttcatcaagtacctccgcgagatgggcgacgaggtcatcgtcatcactacccacgagggcgtgcccgacgagttccacggcgccaagctcatcgggtcatggagcttcccttgcccctggtatcagaaggtcccgctctcgctcgccctcagccccagaatcattggagaagtcgctaggttcaagcccgacattatccacgcctcttcccctggaatcatggtattcggcgcccttatcatcgcaaagttgctatgcgtccctctagtaatgtcctaccacacccatgttccaatttatattcccaggtatacattcagttggcttgtcaagcccatgtggctagttataaaattcttgcaccgagctgcggatctcacactggtaccatcggtcgctattggcagggaccttcaagctgcccgtgttacagcagccaataagatacgcctttggaacaagggcgtggattctgaaagcttccatcctcgtttccgtaatcaggaaatgcggtcaaggctaacgaacggtgaaccagacaagccactgataatctatgttggacgcttaggagttgagaaaagcttggattttcataagagggtcatggaccgacttccaggttcaagaattgcattcattggagatggcccattcaggcctgaacttgaagagatgttttcaggaatgcctgcagtgttcacagggacattgcaaggggaagaactgtcacaggcctatgccagtggggatgtgtttgtgatgccttctgagtcagagacgctgggttttgttgtcttggaggcaatgtcatccggagtcccggtggtcgctgctcgagctggaggcatacctgacattatacctgaggatcaggaaggaaagaccagctttctgtacacaccgggtgatgtggatgactgtgttgggaaggttgaactcctgctctcctgtgaagagttgagagagacaatggggaaggccgccaggaaggagatggagaaattcggctggaaggcggcgacgaggaagattcggaacgagcagtacagcgccgcgatttggttctggcgcaagaagagatcgcagctgctgagacctctccagtgggtgttccggaggctcttcaggcctgctcctgctcctgcccccgccataacaaatcagtcataggagattcgttgtattcaagtcctagaatcaatcaaccatcctgttgagtccatcagtttggtcaacccgaaagatagaaagaatcatggggcacctaatgtgaatatgtaatgctcaattaaattggagccaacagaaataactccagtttgctccggtggtaggttgtaaatgttatatactgcttgctattcgttgacaccagatttcggcatacacaaggccgcctttaacatgaaagttgtgggtcttataaagacaaacaactttgattg

SEQ ID NO: 10537 - DNA, 2113 bp, Hordeum vulgare
cggggcccaaatgttccccgagatttggccttttcgatccctcaatcaaaccgcaaagagtggaagagcgatacagcgcgtgcgtgtgtgtagagatgcggtcgctcagtcatggcttgatgccttgatcaattcgatttggcattcgaatatgctcgtctcgtgtggtgcgttcgaaacttcgaatatgcgagtgcgtcaaaggccaaggccaaggccaagagggaacccctgacttgcgtccactcccctctccagctccaagctccagctctgctttcttcgcctcgccccagtgagcgagtaacctcaatcgattcgattcgattcaaccaaagcaaacgagtatcggaaaaggattaaattgctgcaaggacgaggcaaggatggcgagggcggcgcccatcctcgccgtgtccaagccgtctcctctccctctaatcgctccgtcgtcacgccaacgggctggctcccttcgcctgcatcgccgccacctcctcctcccattctcgccgtcgtcgtcatgcagcaccagcaccagtgcctcttcctcctcctcctcgtcgccggtcttgctgcgggacgacgagctggaccaccaggaggagcccccgcccgcttcggaagccgactcgcggccccgccgcatcgcgctcttcgttgagccctcccccttcgcctacgtctccggctacaagaaccgcttccagaacttcatcaagtacctccgcgagatgggcgacgaggtcatcgtcatcaccacccacgagggcgtccccgacgagttccacggcgccaagctcatcggatcctggagcttcccttgcccctggtatcagaaggtcccgctctcgcttgccctcagccccagaatcattggagaagtcgctaggttcaagcccgacattatccacgcctcttcccctggaatcatggtattcggcgccctaatcatcgcaaaattgctatgcgtccctctagtaatgtcctaccacacccatgttccaatttatattcccaggtatacattcagctggcttgtcaagcccatgtggctagttataaaattcttgcaccgagctgcggatctcacactggtaccatcagccgctattggcagggaccttaaagcagcccgtgttacagcagccaataagatacgcctttggaacaagggcgtggattcagaaagcttccatcctcgtttccgtaatcaggaaatgcggtcaatgctaacgaacggtgaaccagagaagccactgataatctatgttggacgcttaggagttgagaaaagcttggattttcataagagagtcatggaccgacttccaggagcaagaattgcattcattggagatggcccattcaggcctgaacttgaagagatgttttcaggaatgcctgcagtgttcacagggacattgcaaggggaagaactgtcacaggcctatgccagtggggatgtgtttgtgatgccttctgaatcagagacgctgggttttgttgtgttggaggcaatgtcatcgggagttccggtggtcgctgctcgagctggaggcatacctgacattattcctgaggaccaggaaggaaagaccagctttctgtacacaccgggtgatgtcgatgactgtgttgggaaggttgaacgcctgctctcctgtgaagagttgagagagacaatggggaaggccgccaggaaggagatggagaaatttggctggaaggcggcgacgaggaaaattcggaacgagcagtacagcgccgcgatttggttctggcgcaagaagagatcgcagctgctgagaccactccagtgggtgttccggaggctcttcaggtctgctcctgttcccgccgccgccataacaaatcagtcataggagattcgttgtattcaagtcatagaatcaatcaaccattctgttgagcccatcagtcttggaagatagaaagaatcctgggacacctaacgtgaatatgtaatgcttaattaaattggagccaacagaagtaactccagtttgctctggaggtaggctgtaaatgttatactgcttgctattcgttgacaccagattttggcttacacaagacgtctttataacat

SEQ ID NO: 10538 - DNA, 2183 bp, Brachypodium distachyon
aaataaaaggaaaataaaaattactcatttgttactcgcggattttgtgttctcttcggaatatgctcttcctgcgagccaagcatctgctactcgaggcattcgcatatgcttcctttcttccccaacaagcagccaaactcggaattttggcccgccgcctcttgcttgggctcttcttcttcctccttcttcacttccccttgcaagtgaatcaagtgagtaaggatcttgtccgaattcagattcaaggaatcaaggatggcggcggcgtccatcctggtcgtccccaagccgcatcttcctccgatttctccgagagagagccccaaggcggcgacgaccctcatccctctccgacgccgtctcccattcccctcatgtagatgcactagtgcctcctctgcttcctcggcccccgtcctgctgcgggacgacggcgacgagcctccgccgccgacctcggaggccgactcgcggccccgccgcatcgcgctcttcgtcgagccctcccccttcgcctacgtctccggctacaagaaccgcttccagaacttcatcaagtacctccgggagatgggcgacgaggtcatcgtcgtcaccacccacgagggcgtccccgccgagttccacggcgccaagctcgtcggctcctggagcttcccttgcccctggtacaacaaggtcccgctttccctcgccctcagccccaggatcattggggaggtcgccaggttcaagcccgacattatccacgcttcgtcccctggaatcatggtgtttggcgccctaatcatcgcaaagctgctctgcgttcctctagtaatgtcctaccacactcatgttccaatttatatacccagatatacattcagctggcttgtcaagcccatgtggctagttataaaatttttgcaccgagctgccgatctcacactggtaccatcagttgctatcggcagggatcttcaagctgcccgtgttacagcagccaataagatacggctttggaacaagggtgtggattcagaaagcttccatccccgtttccgtaatcaggaaatgcgttcaaggctaacaaatggtgaaccagacaagccactgataatctatgttggacgcttaggagttgagaagagcttggattttcataagagagtcatggacagacttccaggatcgagaattgcatttattggagatggaccattcaggcctgtacttgaagagatgttctcaggaatgccggcagtgttcacgggcacattacaaggggaggagctatcacaggcctacgcaagcggggacgtgttcgtgatgccttccgagtcagagacgctgggtttcgttgtgttggaggcaatgtcatccggagttccagtggtggctgctcgagctggagggatacctgacattatacctgaagatcaggaggggaagaccagctttctgtacacaccaggtgatgtggatgactgcgtcggcaaggtcgaacgcctcctatcctctgaagagttaagacagacaatggggaaggcggcgaggaaggagatggagaagttcgactggaaggcggcgacgaggaagatccggaacgagcagtacagcgcggcgatctggttctggcgtaagaagagatcgcagctgctgagacccgtccagtggctcttccggggtctcttcaggccagctcctgcgaaccagtcatagaagattcattgtattcagttaccagaatcaatcgctgagttgattccatcggttcagtcgaaagaaaaagaaggtagaaagaatcatgctcgagtaagttggaggtaaagacaagttaaccaagctaggtttgtccggtgatagattctattgttttggtcagtgctagtccggtgaattgtaagaaccaaaaggtacatcaaaagatcccatgcagtgcgtctgtaaaagttctcccactgtctgccttctttcatgctccctatcagctagtttacgtttttgcatcgtgtgaaaggtccatttgtgccaaatttagtcccaacaaacactatcgtgcaccatatgtaagagaagtacaagtaccaacttcataacatgaacaaagagtcgcaaacgagcaaaataccagctttgccgtttgtttgccaaagcaaaataaagtacagacaaataattacatttaccaacca

SEQ ID NO: 10539 - DNA, 1796 bp, Lolium multiflorum
tgcaccgccgccgccgcctcctcccatccgcgccaccatcaccatcatcctcatgcagcgccagcgccccctcctcgtcctcgtcctggccggtcctgctgcgggagcgggacgacgggctgtacgacgaggacgagccgccgccggcctcggaggccgactcgcggccgcgccgcatcgcgctcttcgtcgagccctcccccttcgcgtacgtctccgggtacaagaaccgcttccagaacttcatcaagcacctccgcgagatgggcgacgaggtcatcgtcgtcaccacccacgagggcgtgcccgacgagttccacggcgccaagctcgtcggctcctggagcttcccttgcccgtggtaccagaaggtcccgctctcgctcgccctcagccccaggatcatcggggaggtcgccaggttcaagccagacattatccacgcatcctcacctggaatcatggtgttcggcgccctgatcatagcaaagttgctctgtgtccctctagtaatgtcctaccacactcatgttccaatctatatacccagatatacattcagctggcttgtcaagcccatgtggctaattataaaattcctgcaccgagctgcggatctcacactggtaccatcagttgctattggcaaggaccttcaagctgcccgtgttacagcagccaacaagatacgcctgtggaacaagggtgtggattcagaaagcttccatcctcgttttcgtaaccaggaaatgcgttcaaggctaacgaacggtgaaccagacaagccactgataatctatgttggacgcctgggagttgagaaaagcttagattttcataagagagtcatggaccgacttccaggatcaagaattgcatttatcggagatggcccattcaggcctgaactcgaagagatgttttcaggaatgcctgcagttttcacggggacgttgcaaggggaagagctgtcacaggcctatgccagtggggatgtgtttgtgatgccttccgagtcagagacgcttggttttgttgtgctggaggcaatgtcgtccggagttccggtggtcgctgctcgagcgggtggtatacctgacattatacctgaggaccaggagggaaagaccagctttctgtacacgccaggggatgtggatgactgtgttggcaagattgaacgcctcctctcctgtgaagagttgagagaggcaatggggaaggccgccaggatggagatggagaagttcggctggaaggcggcgacgaggaagattcggaacgagcagtacagtgctgcgatttggttctggcgcaaaaagagatcacagctgctgagaccggtccagtgggtggtccggcgaatcttcaggcccgctcctgctaatgctccggccgttacggatcagtcataggagatccatcgtatcgaattcatagaatcaatcattgagttgattccttcagtttggtcagattgaatggtagaatgaatcaatgtgaatatgcaatgctcgagtaaattggaggcgagacaaggaaatccagttagctctgatggtagactgtaaatttttgtaagcctgtatgctttctgctgtattgggctattgacggtagtccggtgaattgcggtggcatatccctctggtgttcgaagtggacggttctgtaggaactgaattgtacatcaaaagttccagcgccgtgtgaaagttccgacgttgtttcactgtttctgtaaggatgatcttttacagaggcacgtatctaggctttatatataaagctgggcc

SEQ ID NO: 10540 - DNA, 2561 bp, Oryza sativa
tgaaaaaaattaagggagttgcccaattaatgtaagatataattgaaaaaaacatagtatacatgtaagccaattattgtaaaataataagtacaattgaaaactagtcgttttttttatttgctggaattaatccagagtaaattgaacgtacgttcccggcggggcatcatcagacgacggagcatctgcaagtgaagagaagcgaatatgctttttatgtgagttcaatttggaggaggtgaatgattctcccggatagctcgtcctagcctagcctcgccgccaccgcttcctcctccgtggcactggccggcgagctcccaagcagccgcccccctccttcccatcctctcctcaatccggccatcggcgcccttctcccacgccccctactccgggcgccgccctcccccaccgccggcgccgctctcctaatatggcggcatggaacacctccatcctcttgccgccgccgccgccgttgttgtcgcgtgctgccgtcgcgacgcccgcgctcaatccgtaccctctccgcctgcaccgccgccacccccaaaagcccctctgccttccatcggagtcgtaccctgcggataccgacgccgacgcctcgtcggcctccctcgactcgaggccccgccgcatcgccctcttcgtggagccctccccgttcgcatacgtctccggctacaagaaccgcttcctgaacttcatcaagtatcttcgggagatgggtgatgaggtcattgtgattaccacgcatgagggcgtacctcaagaattctacggagcaaagctaatcggatcatggagcttcccctgcccgtggtaccagaaggttccactttcactagccctaagtcctcggattatcggagaagttgctagatttaagcctgacatcattcacgcctcttcccctggaataatggtattcggtgccctaataattgcaaagttgctctgcgtccctctagtaatgtcgtaccacacccatgttccaatttatataccgagatatacattcagctggctggtgaagcctatgtggttgattataaaattcttgcaccgagctgcggatctcacactggtaccatcagttgctatcggcaaggatcttcaagctgcccgtgttacagcagccaataagatacgcctttggaacaagggtgttgattcagaaagcttccatccccgtttccgtaatgacgaaatgcgtgcaaggctaactaacggtgaaccagaaaaaccgcttatactgtatgttggtcgtttgggagttgagaaaagcttagactttcttaagagggtcatggaccgacttccaggatcaagaatcgcatttgttggtgatgggccattcagggctgaactccaactgatgttcacgggaatgcctgcagtgttcactggtacattacaaggagaagagctatcgcaggcctatgccagtggggatgtgtttgtgatgccttctgagtcagaaacgcttggttttgttgtgttggaggctatgtcatcaggagttcccgtagttgcagctcgtgctggaggaatacctgatattataccagaggatcaggagggtaagaccagctttctgtacacaccaggagatgttgatgactgtgttagcaagatcgaacgtctcttgacatgcgaagagttgagagagacaatgcggaaggctgccagaaaggagatggagaagtttgattggagagcagctacgaggaaaattcggaacgagcagtacagtgccgcgatttggttctggcgcaagaagagggcacagctattgagacccatccagtgggtgtcccggaggctgttcaggcctacacctgcaccttccaccatgaatcaatcataaattcatcatattcatgaatcatgatgctcgattctgtcagttggaagcaggtcgatcaaattttagtcagatatataaacttgttaatgtgcccctgtgatgtgagaatatgtaagctcaagcatatcggatgaaggaaggtgaggcgaagttcattgaacataatgtgtaaggcaccgttcaatatgctgtctttgcttgccttcaacacaagagtgttcctacaatactgacgaaatatcaacctgtgaatttgtgaatgataattatatgaaaagcaaagcataggtttttaggtggcgtttgtgcctccagccatatattgtaaatcgcagtggtattccaccttgcttgcttcattgttgattgttgtatttagggattgtaaacaccctctagtggatgtttgaatgggaggaactttgtaattgttaaattctacaggatattttttcatcactatagaatacacaaaaaaatgaaatcctattaaatcttctatttattttcataaccttcccgttccacttttgtgaacggttatccatctatgagctattatttttgccttccttcttaccattttgtttttgataaaaaaaaagataaataactaaagcgcttacaaacactggccaggtattatttgttgagaaaatccaagaaataatattgacaaatg

SEQ ID NO: 10541 - DNA, 2240 bp, Oryza sativa
tcccggcggggcatcatcagacgacggagcatctgcaagtgaagagaagcgaatatgctttttatgtgagttcaatttggaggaggtgaatgattctcccggatagctcgtccaagcctagcctcgccgccaccgcttcctcctccgtggcactggccggcgagctcccaagcagccgcccccctccttcccatcctctcctcaatccggccatcggcgcccttctcccacgccccctactccgggcgccgccctcccccaccgccggcgccgctctcctaatatggcggcatggaacacctccatcctcttgtcgccgccgccgccgttgttgtcgcgtgctgccgtcgcgacgcccgcgctcaatccgtaccctctccgcctgcaccgccgccacccccaaaagcccctctgccttccatcggagtcgtaccctgcggataccgacgccgacgcctcgtcggcctccctcgactcgaggccccgccgcatcgccctcttcgtggagccctccccgttcgcatacgtctccggctacaagaaccgcttccagaacttcatcaagtatcttcgggagatgggtgatgaggtcattgtgattaccacgcatgagggcgtacctcaagaattctacggagcaaagctaatcggatcatggagcttcccctgcccgtggtaccagaaggttccactttcactagccctaagtcctcggattatcggagaagttgctagatttaagcctgacatcattcacgcctcttcccctggaataatggtattcggtgccctaataattgcaaagttgctctgcgtccctctagtaatgtcgtaccacacccatgttccaatttatataccgagatatacattcagctggctggtgaagcctatgtggttgattataaaattcttgcaccgagctgcggatctcacactggtaccatcagttgctatcggcaaggatcttcaagctgcccgtgttacagcagccaataagatacgcctttggaacaagggtgttgattcagaaagcttccatccccgtttccgtaatgacgaaatgcgtgcaaggctaactaacggtgaaccagaaaaaccgcttatactgtatgttggtcgtttgggagttgagaaaagcttagactttcttaagagggtcatggacagacttccaggatcaagaatcgcatttgttggtgatgggccattcagggctgaactccaactgatgttcacgggaatgcctgcagtgttcactggtacattacaaggagaagagctatcgcaggcctatgccagtggggatgtgtttgtgatgccttctgagtcagaaacgcttggttttgttgtgttggaggctatgtcatcaggagttcccgtagttgcagctcgtgctggaggaatacctgatattataccagaggatcaggagggtaagaccagctttctgtacacaccaggagatgttgatgactgtgttagcaagatcgaacgtctcttgacatgcgaagagttgagagagacaatgcggaaggctgccagaaaggagatggagaagtttgattggagagcagctacgaggaaaattcggaacgagcagtacagtgccgcgatttggttctggcgcaagaagagggcacagctattgagacccatccagtgggtgtcccggaggctgttcaggcctacacctgcaccttccaccatgaatcaatcataaattcatcatattcatgaatcatgatgctcgattctgtcagttggaagcaggtcgatcaaattttagtcagatatataaacttgttaatgtgcccctgtgatgtgagaatatgtaagctcaagcatatcggatgaaggaaggtgaggcgaagttcattgaacataatgtgtaaggcaccgttcaatatgctgtctttgcttgccttcaacacaagagtgttcctacaatactgacgaaatatcaacctgtgaatttgtgaatgataattatatgaaaagcaaagcataggtttttaggtggcgtttgtgcctccagccatatattgtaaatcgcagtggtattccaccttgcttgcttcattgttgattgttgtatttagggattgtaaacaccctctagtggatgtttgaatgggaggaactttgtaattgttaaattctacaggatattttttcatcactatagaatacacaaaaaaatgaaatcctattaaatcttctatttattttcataacct

SEQ ID NO: 10542 - DNA, 2813 bp, Echinacea purpurea
gcaccaccaccactaaactccaccatggtgtcttcccatctgacacccattttatacttcacattgttacttgttacatgttcatgtgtatgttctaaacctagtcccaaaccaccgaccaagatcggtgatggttaccggctggtgtcgcttgaagagtcgccggacggtggacttgtgggtcatcttcaggttaacaagaaaaataagatttatgggccggatatccctcatttgcagctgtacatcaagcatgaaaccgacgaccgtttgcgggtacacataaccgacgcacaaaaccaacgatgggaagtaccatacaacctcctaccaagagcccaaccaccaaaaccatctcaacaacccaccctcggatcgacaaaaaacccgataaccgtctccgagttctcgggcggagaactaatcttcagctacatctcaaacccattctcattcgccgttagaagaaaatccaacggcgaaaccatcttcaactcctcaaccgattcatccacaccgtacaactctctagtcttcaaggaccagtacttagaaatatcaacaactttacccaaaaccgcgtcgttgtatggtctgggtgagaacacacaaccacacgggattaaactctacccgaatgacccgtacacgttgtggacaacggatcaatcggctataaatttaaacatggatctatacgggtcccacccggtttacatggatttgaggaacacgaatggggacccgtatgcccatggggtgttactgttgaatagtaacggtatggatgttttttacacggggagttcgttgacgtataaggtgattgggggtgttttggacttttacttctttgcgggacccacgccgttagcggttgtggatcaatacacgcagctgattggtcggccggctcctatgccttactggtccctcggatttcaccaatgtcggtggggttaccataatctatcagttgtggaagacgtggtggaaaattacaaaaaagccaacatccctctagacgttatttggaacgatgatgatcatatggatggtcacaaggacttcactcttaaccccaacgcgtacccgagacccaaactacttaactttttggaacgaatacacgctcgcgggatgaagtacattgtcattatcgaccctggtatcggggtaaacacgtcttacgggacctaccaacgtgggctcgcgaaagacgtgtttattaagtacgaggggaagccttacttggctcaagtgtggcccggggcggttaactttccagattttctcaaccccgccactgttgcgtggtggggagatgaagtccggaggtttcacgagctcgttcctgttgatgggctatggatcgacatgaatgaggcttcgaatttttgttcgggtttgtgcacgattcccgaggggagaatatgtccaaacgggactgggcccggttggatatgttgtttggattgtaagaatataacaaagacaaaatgggatgatcctccgtataagattaacgcgtccgggacgcatgtaccgatcgggtacaagaccattgctacgagtgcggttcattataatggtgttcgagagtatgatgctcatagcctttacgggttttctcatgccattgcgactcacaaggcgcttcaggggcttcaagggaagcgcccatttatcttgtcccgatccacatttgttggatcgggacattacactgctcactggaccggtgacaaccaaggtacttggaatgatattaagtactccatatatactatgttgaattttgggctttttggtgttcctatggttgggtcggatatttgcgggttttacccgcaaccaaccgaagaactatgcaaccgttggatagaattgggtgctttttacccgttttcaagagaccatgcaaactactattctccaagacaagagctttaccaatgggaaacggttgcaacatcggctcgtaatgctttaggtatgcggtacaagctgcttccatacttgtacactttgacttacgaggcgcacaccactggggcacccatcgctcgccctctctttttctcattcccaaatatccaagaactgtatggattgagcacacagttcttgcttggtgagagtctaatggtctcaccagttcttgaccagggtcgaaccaacgtgtcagccgtgttccctcctggaacatggtatagtttgttcgaccccagtcaagcaatagtttccaaaggaacccaaactttcaccctggatgctcccttgcacgtgatcaatgtccacttataccaaaacactattctcccaatgcaaaggggaggaatgatatccaaagatgcaagaatgacaccttttacccttctagtcactttcccagcgggggccacagatgccaaggcgaaagggaaacttttccttgacaatgatgagcttcccgagatgcagctcgggaatggtcagtcgacttatgttgagtttagcgcgtcagcgtctaaagacatggtaaaagtgtggtcggatgtgcaagagagtaagtttgcccttgacaaaggttgggttatcgagaaaataagtgtgatgggattaagtggcgtcggaggtgcatttagcgtcgaggtcgagggtaatatggacattttggacgcgtcgaatgtggagttggcgcaaaccgagcataagtttatatatggagtggaggacatgaagagcgtgatggtggaagttggagggttaaacataccaattggtaaaaagtttacaatgtcatggaaaatgggagttagttcttaaaaggc

SEQ ID NO: 10543 - DNA, 2897 bp, Arnica chamissonis
cttctcatctgacaccctatttttctaccttacattattactttgtcatatcttcatggctaccgtccaaactccacgtcccgcaccactaccacccaccaagatcggcaatggctaccgtctcgtctcccttcaagagtcgtccgacggcggactcgtcggccaccttcaggtcaaccggaaaaacaacatttacggcccagatatccctcatttgcagttgtacatcaagcatgaaacggacgaccgattaagggtacacatcagcgatgcacagaagcaacgatgggaagtaccgtacaatctcttaccccgagaccaacctccgacggcgtcgcagcaaaccctccgccggtcaacgaaaaaccccatcaccgtctcggaattctccggcggcgagctaatattcagctacatctccaatccattctcgttcgccgtcagaagaaaatccaacggtcagacaatcttcaactcctcctccgacgaatccacaccgtacaattcgttagtcttcaaagaccagtatttagagatctcaacgactctgccaaaagacgcgtcattgtacgggctgggggagaactcgcagcctcacgggataaaactgtacccgaacgacccgtacacgctgtggacgacggatcaatcggcgattaatttgaatatggatctatacgggtcacacccggtgtatatggatctgaggaatgtgggtgggcaagcgtatgcccatggagttctgctgttaaacagtaacgggatggatgtgttttacagagggaattcattgacgtacaaggtgattgggggtgttttggacctttacttcttcgccggaccttcgccgctagcggtggtggaccagtacactcagctcattggtcggccggcaccgatgccatactggtccctcggatttcaccaatgtagatggggataccacaatctatctgtggtggaagacgtagtggaaaattaccaaaaagccaacatccctctcgacgttatttggaacgacgatgatcacatggatggccacaaagacttcactctcaaccccaacgcttaccctcgccccaaactacttgatttcctgcaaagaatacacgcccgtggcatgaaatacatcgtcattatcgaccccggcatcggtgtaaacgcgtcttacgggacctaccaacgaggcatcgcaaaagacgtgtttattaaatacgagggcaagccttatttggctcaagtctggcccggggcggtcaactttccggatttccttaaccccgccactgtttcatggtggggagatgaagtcaggaggtttcatgagctcgttcctgtcgatgggttatggatcgacatgaacgaggtttcaaatttttgttctggtttgtgcacgattccccaagggaagcagtgtccaaccggaaccggacctggttggatatgttgtttggattgcaagaatataacaaatactaaatgggatgatcctccttataagattaatgcatcggggacgcatgttcctatcgggtacaagactatagctacgagtgcggttcattataatggtgttctagagtatgatgctcatagcatttacgggttttcgcatgccattgcgactcacaaggcgcttcaggcgcttgaagggaagcggccgtttatcttgtcccgatccacatttgttggatcgggtcattacactgctcattggaccggtgacaaccaaggtacatggaatgacattaagtactcgatatataccatgctaaattttgggctttttggtgtccctatggttgggtcggatatatgcgggttttacccgcaaccaacggaagaactatgcaaccgttggatcgaattgggcgctttttacccgttttcaagagaccatgcaaattactattctccaagacaagagctttaccaatgggaaactgtagctatatcggctcgtaatgctttaggtatgcggtacaagctgcttccatacttgtacacattgacttacgaggcacacaccaccggtgcacccatcgcccgcccgctctttttttcattcccaaacatcccagaactgtatggattgagcacacagttcttgcttggtgagagtctaatggtctcacctgttcttgatcagggtcgaaccaacgtatcagccgtgttccctccgggaacatggtacagtctgttcgacccaagtcaagcaatcatttcaaaagaaacccaaactttcaccctggatgctcctttgcacgtgatcaacgtccatctataccagaacactattcttcctatgcaaaggggaggattgatatccaaagatgcaagaatgacaccttttacccttttagtcaccttcccggccgaggacaccgatgccaaagcgaaaggaaagcttttccttgatgacgacgagcttcccgagatgcagctcgggaacggtcagtcgacttacgtcgagtttagcgcgacgaagtctaaacaaatggtgaaagtgtggtctgatgtggaggagagtaagtttgctcttgaaaagggttgggtcatcgagaaaattagtgtgcttggtttaagtggtgttggaggcgagtttgcggtcgaggtcgagggtagtttggacattttagacgcgtcaaaagtggagttggttgaaaccgagcataagtttataaacggaggggagacgaagagtgtgatggtggaggttggagggttaaatataccagttggtaaagtttttacaatgtcgtggaaaatgggaattagttagttcttgaggggcttgttttgcaatttactagttcttttgtaccgtttagaatgttgtgtagttgctagggactttgacgagaatagtgaagggggaccaaaaatcaaacgcttcc

SEQ ID NO: 10544 - DNA, 3250 bp, Lactuca sativa
aatacaaaccctaattccaacttaccacaatcaaagcttgtcttgatgtattgcgtgggaccaaatactcacatgatctttagcataccaccattatcttatcactaccctaaacccttccctccattctgcctatatatatacacctctctgtagccttctcaacagcaccaccacccccaaacaccaacaatggtgtcttcttctccggcacaggccatctttcaccttacactgttacttatcatatcttcatgtatacctccttccttttcccaaagcactccggcaacgacatcaccacccaccaagattggcaatggctacactctggtatcccttcaagagtcgcctgacggtggtctcgtcggccgtcttcaagtcaaccggagaaactacatctatggcgctgacatccctttcttgcagttgtacatcaagcatgaaaccgacgaccggttgagggtgcacataagcgatgcacagcagcaacgatgggaagtgccgtacgatatcttaccaagagaccgacctccgacgccgtcgacacaaaccatcggccggtcaaggaaaaacccaatcaccgtctccgaattctccggcggcgagttaatcttcagctgcatctccaacccattctcgttcgccgtgagaaggaaatcaaacggcgagacgctattcaactccacttccgaccaatcttcaccctacaactccttggtgttcaaagatcaatacttagagatctcaacctcgcttccaaaagacgcgtcgttgtatggtttaggagagaacacgcagccacacgggatcaaactcaaccctaacgagccatacacgttgtggacgacggatcaatcggcgattaacctgaatatggatttgtatgggtcacatccgatgtacatggatttgaggaatgtgggtggagaagcttatgcacacggagttctgttgttgaacagtaatggaatggatgtactttacagagggaactcattgacgtataaagtgattgggggtattttcgacttttacttcttctcgggaccttcgccgcttgcggtggtggatcagtacactcagctcgttggccgaccggcgcctatgccatactggtcccttggatttcatcaatgtagatggggttaccacaatttatcagtggtggaagatgtggttgaaaattacaacaaagctaacattccactcgacgttatttggaacgacgatgatcacatggatggccacaaagacttcaccctcaaccccaccgcttacccacaaccgaaactccaagatttcttgcagagaatccacgctcgtggtatgaaatacatcgtcattatagaccctggaatcggtgttaattcctcttatggaacttaccaacgtggtcttgcaaaagatgtctttataaagtacgatggtaagccttatcttgctcaggtttggccgggtgcagtcaacttcccggattttctaaaccctgccaccgtgtcatggtggggggatgaagtccggcggtttcatgagattgttccggtggacgggttgtggatcgatatgaatgaagcttcgaatttctgttcgggtttgtgtactcttccacaagggaagcagtgtccaaccgggacgggtcccggttggatttgttgtttggattgcaagaatataacgaaaacaaaatgggatgacccgccttataagatcaatgcatccggtacccatgtcccgattgggtacaagactattgctacaagtgcggttcattacaatggtgtccgggagtatgatgctcatagcatgtatgggtttactcacgcgattgcgactcacaaggcgttgcaagcgcttcaagggaaacgcccgtttatactgtctcgatccacatttgttggatcgggtcattatactgctcattggacgggtgataaccaagggacgtggaatgatctaaagtattcgattcataccatgttgaatttcgggattttcggtattcctatggttgggtcggacatatgcgggttttacccacaaccaacggaagaactatgtaaccgttggattgaactcggtgctttttaccctttttcgcgagaccacgcgaactactattctccacgacaagagctttaccaatgggaaacagtagcagagtcagctcgcaatgcattaggtatgcgttacaagctgcttccatacctgtacacattgacttacgaggcgcacacgacgggagcacccatcgcgcggccagtctttttctcgttccccaacatccaagaactatatggattaagcacacagttcttgcttggtgagagtctcatgatctcaccggttcttgaccaaggtcaaaccaatgtgtcagccgtgttcccacctggaacatggtataatctgtttgaccttagtcaagcaatcatttcaaaagaaacccaaaccgtcacactagatgctccattacacgtgatcaatgtccacctataccaaaacaccatcctcccaatgcaaaggggaggtttgatctcaaaagaagcaaaaatgacaccatttactcttatagtaactttcccagcgggggccactgaggcccgggctaaaggaaagttatacctcgatgacgacgagcttcccgatatgagtcttgggaacggtcaatcaacttatgttgaattttacgcgtctgcatcaaaagaaaatgtaaaggtgtggtcggatgtcacagacagtaattatgctctcgataaaggttgggtgatcgagaaagttaccgtggtagggttagccgggattggtggacagtttgcgattgatgtcgagggaaatgcaggtattttggatgtgtcaaaatttaagatggtggaaaccgagcataagtttttaaatgagatgaaaaaggtaggagaggaggagaacaagagtgtcatggtggagattggagggctggctttaccagttggtaaacaatttacaatgtcgtggactttgggaattagttaattgttaaggggcttgtcatggaaattttccgttattttgtcttttctattttctttttttatttttgagggtttttagacaatttggcgaaacgagagggactaaaatgcaagtgattcctccttttggcatcggaatttgatgtaataagagaattttattaatgttattttgcaaatgcaaatgttattttaggtttttaatctaaagtgtttttttatatatgttggtgttaattgca

SEQ ID NO: 10545 - DNA, 2980 bp, Chrysanthemum coronarium
caccataccaccttgtaccatttacaccactccaaaccaccactatggtgtcttttaaaatgacacacattttttacctagcaacagtacttttaatatcttgttcatttgttaatgtttttggttcaaaacaaagtttggttgcacctacaaagattggtgatggatatcgtttggtttcactacaagagtcttccgatggtggtcttgttggactgcttaaagttaaccagaaaaacaacatttatggtcctgatatacctcacttgcaactttacatcaagcacgaaaccgatgaccgtttgagaatacacataaccgacgcacaacaacaacgctgggaagtaccctacgacctcttaccaagagacaaaccaccacaacaacgaccatcaaaacaaacaaccattcccatcaatgcggctgcattctctagtggcgagctgatatttagctacatcacagacccattctcattcgccgtcaaaagaacatccacgggccaaacactcttcaactcgtccacaccctacaactccctagtgttcaaagaccaatatatcgaaatctcaacatctttaccacatgatgcatcattatacgggctaggcgaaaactcacaaccacatgggattaaactctacccgaatgacccgtatacattatggaccacggatcaatccgctataaacttaaacatggacctttatgggtcacatcctgtttatatggacttaagaagtaatggtcatgctcatggggtattgttgctaaatagcaacggtatggatataatttacagaggtgactcgttaacgtataaagttatcgggggtgttttagacttttacgtgtttgcggggccgacaccgttaggggtggtggatcagtatacgcagcttattggacgaccagcacctatgccatattggtctctcgggtttcaccaatgtagatggggttaccacaatctatcagtagtagaagacgtagtcgaaaactacaacaaagcacaaatcccgctcgatgttatttggaacgacgatgatcacatggacggccacaaagacttcacattaaaccccgttgcttaccctcgacctaaactacttgacttcctacaaagaatccacgatcgtggtatgaagtacattgtcatcatagaccctggaatcggtgttaactcatcttacgggacctaccaacgaggcatagcaaaggatgtgttcataaaatataatggtaaaccatatctagcccaagtctggcccggtgcggttaactttccggatttcatgaacccggctacggtttcttggtgggtggatgaagtccggaggtttcacgagcttgtcccagtggacgggctttggattgatatgaacgaggcttcaaatttttgttcgggcttgtgcacacttcctgaaggaagaaagtgcccaaatgggactgggccgggctgggtatgttgtttggattgtaagaatataaccaacacaaaatgggatgatcctccttacaaaataaatgcatcagggacacatgtcccgattgggtacaaaactatagctacgagtgcggttcattataatggcgttcgtgagtatgatgctcatagtatgtacgggttctctcacgcaattgctactcataaggcgctcgaggggcttaatgggaaacgtccctttattttgtcgaggtcgacttttgttggatcgggtaaatacacagcccactggacaggtgacaaccaaggtacatggaacgatataaagtattcgatatataccatgttgaacttcgggctttttggtgtcccaatggttggatcggatatatgtgggttttacccacaaccaactgaagaattatgcaaccgttggatcgaattgggtgcattttacccattttcacgtgaccacgcgaattattattctccaagacaagagttgtaccaatgggaaacagtagcaatatcagctagaaatgcattgggtatgcggtacaagctacttccttacttgtacacattaacatatgaggcacacaccacaggcgcacccattgcgcgtccacttttcttctcgttcccaaacattccacaactctacgggttgagcacacagtttttgttaggtgagagtctgatggtctcacctgttcttgaccaaggtcgaacaaacgtgtcagccgtgttccctcctggaacatggtacagtttgtttgaccaaagtcaagtaatcaactcaaaagatttaaaacctatcacactagatgctcctttgcatgtgatcaatgtccatttataccaaaacactatccttcctatgcaaaggggaggaatgatatctaaagatgcaagaatgacaccttttacccttatagtcaccttcccggtggggtccactgactcgaacgcaaaaggtaaactttaccttgataacgacgagctccctgagatgagactagggaatggtcagtcaacttacattgactttagcgctagcgcgtctagaaagacagtgaaggtgtggtcggatgttcaagagagcaaatttgccttagataaaggttggtacattgagaaaattactgttttgggttcgagtgggattggtggctcgttcgctgttgaggtcgagggtgagtcggacattttggacgtgtcgaaagtggaagttgtgcaaactgagcataagttctttgatgagatcatgaaagatagtgatgtgaagaaaagcatgatggtggaagttggaggattaaacataccaattggtaaaaagtttacaatgtcgtggaaaatgggtattagttagtagttaagaagcttgttttgcaaatttcagtttattttcttcttgttaggaagtttgtcttgaagagagggaccaaaagtatgcgtttcctcctgaatttggttgaataagatgatttaatctccaaaaaggtgaagatcggtgggatcaccctggtccca

SEQ ID NO: 10546 - DNA, 2980 bp, Conyza canadensis
ctaacccaaacaccagccaccacaatggtgtcttttaaaatgacacccatttttcatcttatgataatattagtatttttatgtgtaacaaatgtgtcttgtgcaaaatctagtacaactccggtcgcaccacccaccaagattggcaatggctaccggttagtatcactacaagagtcatcggatggtgggctcgtgggtcaccttgaggttaaccagaaaaacaatgtttatgggcctgatatccctctcttgcagctgtacatcaagcatgaaacagatgaacgtttgagagtgcacataagcgatgcacaacaacaacgttgggaagtgccatacaaccttttaccaagagaccagccaccgccgttatcccagcccatccacgggtcaccccaaaacccgatcacagtgtccgaatactcagccggggagctaacattcagctacatttccaacccgttctcattcgccataaaaagaaaatcaaacggcgatacacttttcaactcaaactacaatgcattggtctttaaagaccagtacttggaaatatcaacgcatttaccaaaaaatgcgtcattatatgggctgggtgaaaactcccagccccacgggataaaactgtatccaaatgacccgtacacattatggactacggatcaatccgctatcaatctaaatatggatctttatgggtcacacccggtttatatggacttaagaaatgatggtgaaaaggctaatgcacatggggttttattgttaaatagtaatggaatggatgttttttacaccggtcattctttgacttataaagtcattgggggcatttttgacttttacttcttttcgggcccaacaccgttagcagttgtggatcaatatacccagcttattggtcggcctgctcctatgccatactggtcccttggatttcatcaatgtagatgggggtaccacaatctttccgtggtcaaagacgtagtcgagaattacaacaaggccaacatccctctagacgttatttggaacgatgacgatcacatggacggtcacaaggatttcactctcaacccgactgcttaccctcagcccaaactgtttgattttttgaagaggatacacgcccgtggtatgaagtacattgtcttaatagaccctggaatcggcgtaaattcaacttacggggtctaccaacgagccattgctaaagatgttttcataaaatatgagggcaagccttatttagcccaggtatggcccggggctgttaacttccctgatttccttaaccctgccactgttgattggtggggtgatgaaatccggaggtttcatgaaatggtccctgttgacgggctatggattgatatgaatgaggcttcaaatttttgttcgggcttgtgcacactccctaaagggcaatgcccaactggaactggtccgggttggatatgttgtttggattgcaagaatataaccagcacaaaatgggatgatccgccgtataagataaatgcatctggtacacaggttcctattgggtacaagactatagctacaagtgcggttcattataatggtgttaaagagtatgatgctcacagtatgtatgggttttctcatgctattgcaactcataaggcccttgaagcacttgaagggaaacgcccatttattttgtcgcggtccacttttgttgggtcaggtcattacacagctcattggaccggtgacaaccaaggaacatggaatgatatcaagtactcaatatacacaatgttgaattttgggatttttgggattccaatggtcgggtcagatatatgcgggttttacccacaaccaacagaagaactgtgcaatcgttggattgaattgggtgcattttacccgttttcaagagaccacgcaaattactattctccaaggcaagagctttatcaatgggaaacagtagcaacatcagctcgtaatgctttaggtatgcggtataagctactaccttacttgtacactttgatgtatgaggcacacacaacgggtgcacctatcgcacgaccactctttttctcgttctcaaacatcccagaattgtacgggttaagcacacagtttttgctaggtgacagtctaatggtgtcaccagttcttaatcagggtcaaacaaatgtgtcagccgtgtttcctccaggaacatggtacagtctgtttgacccgagtcacgcaatcatttcaaaaggaacccaaacgttcatcctagatgccccattacacgtgataaacgtccatttgtatcaaaacaccattttaccaatgcaaaggggaggtatgatatcaaaagaagcaagaatgaccccattcaccctcatagtaaccttcccagttggggcaacagatgcacaagcaacaggaaagctgtacctcgataacgacgagcttcctgaaatgaaactcgggaatggtcagtcaacttacgttgacttcaccgcgactacttccaaacaaatggtaaaagtgtggtcaaatgttcaagagagtaagtttgcacttcaacaaggtttgtttatagagaaaattactgtattgggctcggacggagttggaggacagttttcagttgaggtcgagggtgagtcagacgttttggatgcatcgaaagttgagttggttgagaccgagcacaagtttgatgtgctgcaagcaggtgacagtaagaaaagtgtgatggtggaagttggaggattgagtataccaattgggaaaagatttacaatgtcatggagaatgggagttagttaattgttagggtttgttttgaaatttctcatttcatttggacctttttagtcttttagagtgttgatgttggcgaatttgactgaaagtgaggaaccaaaatgaaagtgctatctccttttggaatttggtggaattaattatgaaaacgatatgtatggcgacaacacaaacgctt

SEQ ID NO: 10547 - DNA, 2917 bp, Chrysanthemum coronarium
gtggatccccggctgcaggattcgaattcataccaccttgtaccatttagaccactccaaaccaccactatggtgtcttttaaaatgacacacattttttacctagcaacagtacttttaatatcttgttcatttgttaatgtttttggttcaaaacaaagtttggttgcacctacaaagattggtgatggatatcgtttggtttcactacaagagtcttccgatggtggtcttgttggactgcttaaagttaaccagaaaaacaacatttatggtcctgatatacctcacttgcaactttacatcaagcacgaaaccgatgaccgtttgagaatacacataaccgacgcacaacaacaacgctgggaagtaccctacgacctcttaccaagagacaaaccaccacaacaacgaccatcaaaacaaacaaccattcccatcaatgcggctgcattctctagtggcgagctgatatttagctacatcacagacccattctcattcgccgtcaaaagaacgtccacgggccaaacactcttcaactcgtccacaccctacaactccctagtgttcaaagaccaatatatcgaaatctcaacatctttaccacatgatgcatcattatacgggctaggcgaaaactcacaaccacatgggattaaactctacccgaatgacccgtatacattatggaccacggatcaatccgctataaacttaaacatggacctttatgggtcacatcctgtttatatggacttaagaagtaatggtcatgctcatggggtattgttgctaaatagcaacggtatggatataatttacagaggtgactcgttaacgtataaagttatcgggggtgttttagacttttacgtgtttgcggggccgacaccgttaggggtggtggatcagtatacgcagcttattggacgaccagcacctatgccatattggtctctcgggtttcaccaatgtagatggggttaccacaatctatcagtagtagaagacgtagtcgaaaactacaacaaagcacaaatcccgctcgatgttatttggaacgacgatgatcacatggacggccacaaagacttcacattaaaccccgttgcttaccctcgacctaaactacttgacttcctacaaagaatccacgatcgtggtatgaagtacattgtcatcatagaccctggaattggtgttaactcatcttacgggacctaccaacgaggcatagcaaaggatgtgttcataaaatataatggtaaaccatatctagcccaagtctggcccggtgcggttaactttccggatttcatgaacccggctacggtttcttggtgggcggatgaagtccggaggtttcacgagcttgtcccagtggacgggctttggattgatatgaacgaggcttcaaatttttgttcgggcttgtgcacacttcctgaagggagaaagtgcccaaatgggactgggccgggctgggtatgttgtttggattgtaagaatataaccaacacaaaatgggatgatcctccttacaaaataaatgcatcagggacacatgtcccgattgggtacaaaactatagctacgagtgcggttcattataatggcgttcgtgagtatgatgctcatagtatgtacgggttctctcacgcaattgctactcataaggcgctcgaggggcttaatgggaaacgtccttttattttgtcgaggtcgacttttgtcggatcgggtaaatacacagcccactggacaggtgacaaccaaggtacatggaacgatataaagtattcgatatataccatgttgaacttcgggctttttggtgtcccaatggtaggatcggatatatgcgggttttacccacaaccaactgaagaattatgcaaccgttggatcgaattgggtgcattttacccattttcacgtgaccacgcgaattattattctccaagacaagagttgtaccaatgggaaacagtagcaatatcagctagaaatgcattgggtatgcggtacaagctacttccttacttgtacacattaacatatgaggcacacaccacaggcgcacccattgcgcgtccacttttcttctcgttcccaaacattccacaactctacgggttgagcacacagtttttgttaggtgagagtttgatggtctcacctgttcttgaccaaggtcgaacaaacgtgtcagccgtgttccctcctggaacatggtacagtttgtttgaccaaagtcaagtaatcaactcaaaagatttaaaacctatcacactagatgctcctttgcatgtgatcaatgtccatttataccaaaacactatccttcctatgcaaaggggaggaatgatatctaaagatgcaagaatgacaccttttacccttatagtcaccttcccggtggggtccactgactcgaacgcaaaaggtaaactttaccttgataacgacgagctccctgagatgaaactaggaaatggtcagtcaacatacattgactttagcggtagtgtgtctagaaagacagtgaaggtgtggtcggatgttcaagagagcaaatttgccttagataaaggttggtacattgagaaaatcacggttttggggtcgagtggggttggtggctcgttcgctgttgaggtcgagggtgagtcggacattttggacgtgtcgaaagtggaagttgtgcaaactgagcataagttctttgatgagatcatgaaagatagtgaattgaagaaaagcatgatggtggaagttggaggattaaacataccaattggtaaaaagtttacaatgtcgtggaaaatgggtattagttagtagttaagaagcttgttttgcaaatttcagtttattttcttcttgttaggaagtttgtcttgaagagagggac

SEQ ID NO: 10548 - DNA, 2896 bp, Chrysanthemum coronarium
caccataccaccttgtaccatttacaccactccaaaccaccattatggtgtcttttaaaatgacacacattttttacctagcaacagtacttttaatatcttgttcatttgttaatgtttttggttcaaaacaaagtttggttgcacctacaaagattggtgatggatatcgtttggtttcactacaagagtcttccgatggtggtcttgttggactgcttaaagttaaccagaaaaacaacatttatggtcctgatatacctcacttgcaactttacatcaagcacgaaaccgatgaccgtttgagaatacacataaccgacgcacaacaacaacgctgggaagtaccctacgacctcttaccaagagacaaaccaccacaacaacgaccatcaaaacaaacaaccattcccatcaatgcagccgcattctctagcggcgagctaatatttagctacatcacagacccattctcattcgccgtcaaaagaacatccacgggccaaacactcttcaactcgtccacaccctacaactccctagtgttcaaagaccaatatatcgaaatctcaacatctttaccacatgatgcatcattatacgggctaggcgaaaactcacaaccacatgggattaaactctacccgaatgacccgtatacattatggaccacggatcaatccgctataaacttaaacatggacctttatgggtcacatcctgtttatatggacttaagaagtaatggtcatgctcatggggtattgttgctaaatagcaacggtatggatataatttacagaggtgactcgttaacgtataaagttatcgggggtgttttggacttttacgtgtttgcggggccgacaccgttaggggtggtggatcagtatacgcagcttattggacgaccagcacctatgccatattggtctctcgggtttcaccaatgtagatggggttaccacaatctatcagtagtagaagacgtagtcgaaaactacaacaaagcacaaatcccgctcgatgttatttggaacgacgatgatcacatggacggccacaaagacttcacattaaaccccgttgcttaccctcgacctaaactacttgacttcctacaaagaatccacgatcgtggtatgaagtacattgtcatcatagaccctggaattggtgttaactcatcttacgggacctaccaacgaggcatagcaaaggatgtgttcataaaatataatggtaaaccatatctagcccaagtctggcccggtgcggttaactttccggatttcatgaacccggctacggtttcttggtgggtggatgaagtccggaggtttcacgagcttgtcccagtggacgggctttggattgatatgaacgaggcttcaaatttttgttcgggcttgtgcacacttcctgaagggagaaagtgcccaaatgggaccgggccgggctgggtgtgttgcttggattgtaagaatataaccaacacaaaatgggataatcctccttacaaaataaatgcatcagggacacatgtcccgattgggtacaaaactatagctacgagtgcggttcattataatggcgttcgtgagtatgatgctcatagtatgtacgggttctctcacgcaattgctactcataaggcgctcgaggggcttaatgggaaacgtccctttattttgtcgaggtcgacttttgttggatcgggtaaatacacagcccactggacaggtgacaaccaaggtacatggaacgatataaagtattcgatatataccatgttgaacttcgggctttttggtgtcccaatggtaggatcggatatatgcgggttttacccacaaccaactgaagaattatgcaaccgttggatcgaattgggtgcattttacccattttcacgtgaccacgcaaattattattctccaagacaagagttgtaccaatgggaaacagtagcaatatcagctagaaatgcattgggtatgcggtacaagctacttccttacttgtacacattaacatatgaggcacacaccacaggcgcacccattgcgcgtccacttttcttctcgttcccaaacattccacaactctacgggttgagtacacagtttttgttaggtgagagtctgatggtctcacctgttcttgaccaaggtcgaacaaacgtgtcagccgtgttccctcctggaacatggtacagtttgtttgaccaaagtcaagtaatcaactcaaaagatttaaaacctatgacgctagatgctcctttgcatgtgatcaatgtccatttataccaaaacactatccttcctatgcaaaggggaggaatgatatctaaagatgcaagaatgacaccttttacccttatagtcaccttcccggtggggtccactgactcgaacgcaaaaggtaaactttaccttgataacgacgagctccctgagatgagactagggaatggtcagtcaacttacattgactttagcgctagcgcgtctagaaagacagtgaaggtgtggtcggatgttcaagagagcaaatttgccttagataaaggttggtacattgagaaaattactgttttgggttcgagtgggattggtggctcgttcgctgttgaggttgagggtgagtcggacattttggacgtgtcgaaagtggaagttgtgcaaactgagcataagttctttgatgagatcatgaaagatagtgatgtgaagaaaagcatgatggtggaagttggaggattaaacataccaattggtaaaaagtttacaatgtcgtggaaaatgggtattagttttagttaagagttaagaagcttgttttgcaaaatttcagtttattttcttcttgttaggaagtttgtcttgaagagagg

SEQ ID NO: 10549 - DNA, 2939 bp, Chrysanthemum coronarium
cttttaaaatgacacacattttttacctagtaacagtacttttaatatcttgttcatttgttaatgtttttggttcaaaacaaagtttggttgcacctacaaagattggtgatggatatcgtttggtttcactacaagagtcttccgatggtggtcttgttggactgcttaaagttaaccagaaaaacaacatttatggtcctgatatacctcacttgcaactttacatcaagcacgaaaccaatgaccgtttaagaatacacataaccgacgcacaacaacaacgctgggaagtaccctacgacctcctaccaagagacaaaccaccacaacaacgaccatcaaaacaaacaaccattcccatcaatgcggctgcattctctagtggcgagctgatatttagctacatcacagacccattctcattcgccgtcaaaagaacatccacgggccaaacactcttcaactcgtccacaccctacaactccctagtgttcaaagaccaatatatcgaaatctcaacatctttaccacatgatgcatcattatacgggctaggcgaaaactcacaaccacatgggattaaactctacccgaatgacccgtatacattatggaccacggatcaatccgctataaacttaaacatggacctttatgggtcacatcctgtttatatggacttaagaagtaatggtcatgctcatggggtattgttgctaaatagcaacggtatggatataatttacagaggtgactcgttaacgtataaagttatcgggggtgttttagacttttacgtgtttgcggggccgacaccgttaggggtggtggatcagtatacgcagcttattggacgaccagcacctatgccatattggtctctcgggtttcaccaatgtagatggggttaccacaatctatcagtagtagaagacgtagtcgaaaactacaacaaagcacaaatcccgctcgatgttatttggaacgacgatgatcacatggacggccacaaagacttcacattaaaccccgttgcttaccctcgacctaaactacttgacttcctacaaagaatccacgatcgtggtatgaagtacattgtcatcatagaccctggaattggtgttaactcatcttacgggacctaccaacgaggcatagcaaaggatgtgttcataaaatataatggtaaaccatatctagcccaagtctggcccggtgcggttaactttccggatttcatgaacccggctacggtttcttggtgggcggatgaagtccggaggtttcacgagcttgtcccagtggacgggctttggattgatatgaacgaggcttcaaatttttgttctggcttgtgcacacttcctgaaggaagaaagtgcccaaatgggactgggccgggctgggtatgttgtttggattgtaagaatataaccaacacaaaatgggatgatcctccttacaaaataaatgcatcagggacacatgtcccgattgggtacaaaactatagctacgagtgcggttcattataatggcgttcgtgagtatgatgctcatagtatgtacgggttctctcacgcaattgctactcataaggcgctcgaggggcttaatgggaaacgtccctttattttgtcgaggtcgacttttgttggatcgggtaaatacacagcccactggacaggtgacaaccaaggtacatggaacgatataaagtattcgatatataccatgttgaacttcgggctttttggtgtcccaatggtaggatcggatatatgcgggttttacccacaaccaactgaagaattatgcaaccgttggatcgaattgggtgcattttacccattttcacgtgaccacgcgaattattattctccaagacaagagttgtaccaatgggaaacagtagcaatatcagctagaaatgcattgggtatgcggtacaagctacttccttacttgtacacattaacatatgaggcacacaccacaggcgcacccattgcgcgtccacttttcttctcgttcccaaacattccacaactctacgggttgagcacacagtttttgctaggtgagagtctgatggtctcacctgttcttgaccaaggtcgaacaaacgtgtcagccgtgttccctcctggaacatggtacagtttgtttgaccaaagtcaagtaatcaactcaaaagatttaaaacctatcacactagatgctcctttgcatgtgatcaatgtccatttataccaaaacactatccttcctatgcaaaggggaggaatgatatctaaagatgcaagaatgacaccttttacccttatagtcaccttcccggtggggtccactgactcgaacgcaaaaggtaaactttaccttgataacgacgagctccctgagatgagactagggaatggtcagtcaacttacattgactttagcgctagcgcgtctagaaagacagtgaaggtgtggtcggatgttcaagagagcaaatttgccttagataaaggttggtacattgagaaaatcacggttttggggtcgagtggggttggtggctcgttcgctgttgaggtcgagggtgagtcggacattttggacgtgtcgaaagtggaagttgtgcaaactgagcataagttctttgatgagatcatgaaagatagtgatgtgaagaaaagcatgatggtggaagttggaggattaaacataccaattggtaaaaagtttacaatgtcgtggaaaatgggtattagttagtagttaagaagcttgttttgcaaatttcagtttattttcttcttgttaggaagtttgtcttgaagagagggaccaaaagtatgcgtttcctcctgaatttggttgaataagatgatttaatctccaaaaaggtgaagatcggtgggatcaccctggtcccatgcatcctaa

SEQ ID NO: 10550 - DNA, 3008 bp, Chrysanthemum coronarium
gaccgtttaagaatacacataaccgacgcgcaacaacaacgttggaggtaccatttacactactctagtctaaaccaccactatggtgtcttttaaaatgacacgcatttttcacctagcaatagtacttttaatatcttgttcatttgttaatgtttttggttcaaaacagagtttggttgcccctacaaagataggtgatggatatcgtgtggtttcgctacaagagacttctgatggtggtcttgttggactgctaaaagttaaccagaaaaacaacatttatggtcctgatatacctcacttgcaactttacatcaagcacgaaaccgatgaccgtttaagaatacacataaccgacgcgcaacaacaacgttgggaggtaccttacgacctcttaccaagagacaaaccaccacaacaacaaccatcaaaacaaacaaccattcccctcaatgcagccgcgttctctagcggcacgctaatgtttagctacatcactaacccattctcgttcgccgtcaaaagaacatcaacgggccaaacactcttcaattcctccacaccctacaattccctagtgttcaaagaccaatatatcgaaatctcaacatctttaccacatgatgcatcattatacgggctaggcgaaaactcacagccacatgggattaaactctacccgaatgacccgtatacattatggaccacggatcaatccgctataaacctaaacatggatctttatgggtcgcacccggtttacatggacttgagaaacaatggtcatgctcatggagtattgttgctaaatagcaacggtatggatatagtgtaccgaggtgactcgttaacgtataaagttatcgggggtgttttggacttttacgtgttcgcggggccgacaccgttaggagtggtggatcaatatacgcagcttattggacgaccagcacctatgccgtattggtctctcggatttcaccaatgtagatggggttaccacaatctatcagtagtagaagacgtagtcgaaaactacaacaaagcacagatcccactcgatgttatttggaacgacgacgatcacatggacaaccacaaagacttcacattaaaccccgtcgcttaccctcgacctaaactacttgacttcctacaaagaatccacgatcgtggtatgaagtacattgtcatcatagaccctggaatcggtgttaactcatcttacgggacctaccaacgagccatagcaaaggatgtgttcataaaatataatggtaaaccatatctagcccaagtctggcctggtgcggttaactttccggatttcatgaacccggctacggtttcttggtgggctgatgaagtccggaggtttcacgagcttgtcccagtggacgggctttggattgatatgaacgaggcttcaaatttttgttcaggcttgtgcacccttcctgaagggagaacgtgcccaaatggaaccgggccgggctgggtttgctgtttggattgtaagaatataaccaacaccaaatgggatgatcctccttacaaaataaatgcatcaggaacacatgtcccgattgggtacaaaactatagctacaagtgcggttcattataatggtgttcgtgagtatgatgctcatagtatgtacgggttttctcacgcaattgctactcataaggcgctcgaggggcttcaggggaaacgtccctttattttgtcaaggtcaacttttgttggatcaggtaaatacacagcccattggacaggtgacaaccaaggtacatggaacgatataaagtattcgatatataccatgttgaacttcgggcttttcggtgtcccaatggttggatcggatatatgtgggttttaccctcaaccaactgaagaattatgcaaccgttggatcgaattgggtgcattttatccgttttcacgtgaccacgcgaattattattctccaagacaagagttataccagtggcaaacagtggcaatatcagctagaaacgcattgggtatgcgatacaagctacttccatacttgtacacgttaacatacgaggcacacaccacaggcgcacccattgcgcgtccacttttcttctcattcccaaacattccacaactctacgggctgagcacacagtttttgctaggtgagagtctcatggtctcacccgttcttgatcaaggtcgaacaaacgtgtcagccgtgttccctccaggaacatggtacagtttgtttgaccatactcaagtaatcaactccaaagatttgaaacctatcacactagatgctcctttacatgtgatcaatgtccatttataccaaaacactattctccctatgcaaaggggaggaatgatatccaaagatgcaagaatgacaccttttacccttatagtcacattcccggtaggatccactgaatcgagcgcaaaaggtaaactttaccttgataacgacgagctccccgagatgagactaggaaatggtcagtcaacttacattgactttagcgctagcgcgtctagaaagacagtgaaagtgtggtcggatgttcaagagagtaaatatgccttagataaaggttggtacattgagagaatcactgttttggggtcgagtgggattggtggctcgttcgccgttgaggtagaaggggagtcggacattttggacgtgtcgaaagtggaagtagtgcaaaccgagcatacgttctttgatgagataatgaaagatagtgatgtgaagaaaagcatgatggtggaagttggaggattaaacataccaattggtaagaagtttacaatgtcatggagaatgggtattagttagactagtaagttaaagagttaagaagcttgtttagcagatttcagtttattttgttccaagtgttgttaggaagttggacttgaagagagggacaaaaagtatgtttttcctcctttttggcttcaaatttggttgaataagatgatttaat

SEQ ID NO: 10551 - DNA, 2722 bp, Chrysanthemum coronarium
aaaccaccactatggtgtcttttaaaatgacacacatttttcacctagcaatagtacttttagtatcttgttcatttgttaatgtttttggttcaaaacaaagtttggttgcacctacaaagataggcgatggataccgtgtggtttcgctacaagagacttcggatggtggtcttgttggactgcttaaagttaaccagaaaaacaacatttatggtcctgatatacctcacttgcaactttacatcaagcacgaaaccgatgaccgtttaagaatacacataaccgacgcgcaacaacaacgttgggaggtaccttacgacctcttaccaagagacaaaccaccacaacagcaaccatcaaaacaaacaaccattcccctcaatgcagccgcgttctctagcggcacgctaatgtttagctacatcactaacccattctcgttcgccgtcaaaagaacgtccacgggccaaacactcttcaattcctccacaccctacaattccctagtgttcaaagaccaatatatcgaaatctcaacatctttaccacatgatgcatcattatacgggctaggcgaaaactcacagccacatgggattaaactctacccgaatgatccgtatacattatggaccacggatcaatccgccataaacctaaacatggatctatatgggtcgcacccagtttacatggacttaagaagcaatggtcatgctcatggagtgttgttactaaatagcaacggtatggatattgtttaccgaggtgactcgttaacgtataaagttatcgggggtgttttggacttttacgtgttcgcggggccgacaccgttaggggtggtggatcaatatacgcagcttattggacgaccagcacctatgccgtattggtctctcggatttcaccaatgtagatggggttaccacaatctatcagtagtagaagacgtagtcgaaaactacaacaaagcacagatcccactcgatgttatttggaacgatgatgatcacatggacaaccacaaagacttcacattaaaccccgtcgcttatcctcgacctaaactacttgacttcctacaaagaatccacgatcgtggtatgaagtacattgtcatcatagaccctggaatcggtgttaactcatcttacgggacctaccaacgagccatagcaaaggatgtgttcataaaatataatggtaaaccatatctagcccaagtctggcctggtgcggttaactttccggatttcatgaacccggctacggtttcttggtgggctgatgaagtccggaggtttcacgagcttgtcccagtggacgggctttggattgatatgaacgaggcttcaaatttttgttcaggcttgtgcacccttcctgaagggagaacgtgcccaaatggaaccgggccgggctgggtttgctgtttggattgtaagaatataaccaacaccaaatgggatgatcctccttacaaaataaatgcatcaggaacacatgtcccgattgggtacaaaactatagctacaagtgcggttcattataatggtgttcgtgagtatgatgctcatagtatgtacgggttttctcacgcaattgctactcataaggcgctcgaggggcttcaggggaaacgtccctttattttgtcaaggtcgacttttgttggatcaggtaaatacacagcccattggacaggtgacaaccaaggtacatggaacgatataaagtattcgatatataccatgttgaacttcgggcttttcggtgtcccaatggttggatcggatatatgtgggttttaccctcaaccaactgaagaattatgcaaccgttggatcgaattgggtgcatgttatccgttttcacgtgaccacgcgacttattattctccaagacaagagttataccagtggcaaacagtggcaatatcagctagaaacgcattgggtatgcgatacaagctacttccatacttgtacacgttaacatatgaggcacacaccacaggcgcacccattgcgcgtccacttttcttctcattcccaaacattccacaactctacgggctgagcacacagtttttgctaggtgagagtctcatggtctcacccgttcttgatcaaggtcgaacaaacgtgtcagccgtgttccctccaggaacatggtacagtttgtttgaccatactcaagtaatcaactccaaagatttgaaacctatcacactagatgctcctttacatgtgatcaatgtccatttataccaaaacactattctccctatgcaaaggggaggaatgatatccaaagatgcaagaatgacaccttttacccttatagtcacattcccggtaggatccactgaatcgagcgcaaaaggtaaactttaccttgataacgacgagctccccgagatgagactaggaaatggtcagtcaacttacattgactttagcgctagcgcgtctagaaagacagtgaaagtgtggtcggatgttcaagagagtaaatatgccttagataaaggttggtacattgagagaatcactgttttggggtcgagtgggattggtggctcgttcgccgttgaggtagaaggggagtcggacattttggacgtgtcgaaagtggaagtagtgcaaaccgagcatacgttctttgatgagataatgaaagatagtgatgtgaagaaaagcatgatggtggaagt

SEQ ID NO: 10552 - DNA, 2047 bp, Zea mays
cgggaatcgtgctgccacaccgccagcagcatgagcttgcaaaattcacctctccctcgaagttcccgcgcccccccgctgacttctactgcacacaaactgaagcagaacgttccctgctagctcgtcggcaacgccaaggctatacatccacgatcgagctcaccaccacatgcacacagctgctcccagtcccagcgatctagagagaagcacgtgcagggtgcaccgctgcatcggaacgaagaactagcagcatgggggtggccgccggcggtggggtgcggctgcgtgccagcagcgccaagaagcagcggcagcggaccctgaacaacatcaagatcacgctcctctgtggcttcatcaccgtgctggtcctccgcggcacggccggcttcaacctgctggtcagcagcggcgacctggacggcgcggcggcggacgccaaggtggtggaggacgtggagcgcatcctggccgagatccgctccgactccgaggcggacgacgtggtggtggtggtcgagggcgggtcgtcgtcgtcgtcgtcgccgcgcaacgcgacggcggccagcttcggcaacttctcggcgtcggcgacgctagtcaaggtgcgggagtacagcctgggcccgcccgtgcggggctgggacgcgcagcggcgggactggatggcccagcacccggagttcccgcgcctccacccgcggggccgcccgcgggtgctgctcgtcaccgggtcgccccctggcccctgcgacaaccccgccggcgaccactacctgctcaaggcgaccaagaataagatcgactactgccggctccacggcatcgacgtggtgcacaacatggcgcacctggacccggagctgacggggtactggtccaagctgccgctggtgcgccgcctcatgctggcgcaccctgaggtggagtggatctggtgggtggacagcgacgccatcttcaccgacatggcgttcgagctcccgctgtcccgctacgacggcagcaacctcgtcatccacggctacccggacctgctgttcgagaagcgctcgtggatctcgctcaacgccggcatcttcctgcttcgcaactgccagtggtcgctcgacctgctggacgcctgggtgcccatggggccccgcggcccctcccgcgtcgaggccggcaagctgctcacggccagcctcacgggccgcccgcccttcgacgccgacgaccagtccgcgctcatccacctgctgctggtgcagaaggagcggtggatggacaaggtgcacgtggagacggagttctacctccacggcttctggacggggctggtggacaggtacgagcagatgatggaggacaaccacccgggcctcggcgacgaccgctggcccttcatcacccacttcgtcggatgcaagacctgcggcaggtacgaggactacccgctcgaccgctgcatccggggcatggagcgcgccttcaacttcgccgacaaccaggtgctcaggctctacggattccggcaccgctcgctcacaaccgccaaggtcaggagggtcaccgaccccgccaccaacccgctcgaggcgaaggaggccgcgctcaacatggacgccaagttcacctagaaaacatcagttatacttacttatacgtacgagttttgatcagttctttctttgcgttttcttttgatttgtcttattagctttctggtttgcagaagctagaaacgttgctgttatatgtctgatgctctcggttggattcagaaaaaaaatggaactgggcagaagagtagtagtatgattcaaattgtttttgtactaaaacgcagagagatcatgcagttgtcagtgagtgtactgtttcagcaaaccggaaatgctgttcttttcgtctgtatgctttgcggaatctactgtttcagcaacagatcatgaatggacatgtatgtactctggatatctttggtattccggttttgaaaaaagaagtgttgcactgcttaaattatttcaagtttattagctgtaaaagattatga

SEQ ID NO: 10553 - DNA, 2370 bp, Zea mays
caaaaaaaagatgttctagttctagctagttaccgtcagtaaccaagccagttgcgcttgctgactctccagtgaatggacatgcgcgtacagcctgtgcaaattaatcaataaacaaacaaatagtactcgatctccgctataaatgctttaatttgcgcgtgctacgattcccgtgcagattagtttagagcctgtgtgtcacttgtgtttggtgctaaaacctcggaggaagcaccagtagtcttgcagatcgggaatcgtgctgccacacgcccaggcccagctgcatgagattgcaaaattcacctctccctcgaagttcccgcgccccccgctgacttctagtacacacaaactgaagcagaacgttccctgctagctcgtcggcaacgccaaggctatacatccacgatcgagttcaccaccacatgcacatgcacagcttctcccagtcccagcgatctagagagaagcacgtgcagggtgcaccgctgcatcggaacgaagaactagcatgggggtggccgccggcggtggggcgcggctgcgtgccagcagcgccaagaagcagcggcagcggaccctgaacaacatcaagatcacgctcctctgcggcttcatcaccgtgctggtcctccgcggcacggccggcttcaacctgctggtcagcagcggcgacctggacggcgcggcggcggacgccaaggtggtggaggacgtggagcgcatcctggccgagatccgctccgactccgaggcggacgacgtggtggtggtggtcgagggcgggtcgtcgtcgtcgtcgtcgccgcgcaacgcgacggcggccagcttcggcaacttctcggcgtcggcgacgctggtcaaggtgcgggagtacagcctgggcccgcccgtgcggggctgggacgcgcagcggcgggagtggatggcccagcaccccgagttcccgcgcctccacccgcggggccggccgcgggtgctgctcgtcaccgggtcgccccctggcccctgcgacaaccccgccggcgaccactacctgctcaaggcgaccaagaacaagatcgactactgccggctccacggcatcgacgtggtgcacaacatggcgcacctggacccggagctgacggggtactggtccaagctgccgctggtgcgccgcctcatgctggcgcacccggaggtggagtggatctggtgggtggacagcgacgccatcttcaccgacatggcgttcgagctcccgctgtcccgctacgacggccgcaacctcgtcatccacggctacccggacctgctgttcgagaagcgctcgtggatctcgctcaacgccggcatcttcctgctccgcaactgccagtggtcgctggacctgctggacgcctgggtgcccatggggccccgcggcccctcccgcgtcgaggccggcaagctgctcacggccagcctcacgggccgcccgcccttcgacgccgacgaccagtccgcgctcatccacctgctgctggtgcagaaggagcggtggatggacaaggtgcacgtggagacggagttctacctccacggcttctggacggggctggtggacaggtacgagcagatgatggaggacaaccacccgggcctcggcgacgaccgctggcccttcatcacccacttcgtcggatgcaagacctgcggcaggtacgaggactatccgctcgaccgctgcatccggggcatggagcgcgccttcaacttcgccgacaaccaggtgctcaggctctacggattccgccaccgctcgctcaccaccgccaaggtcaggagggtcaccgaccccaccaccaacccgctcgaggcaaaggaggccgcgctcaacatggacgccaagttcacctagaaaacatcagttatacttacttaaacgtacgagttttgatcagttccttctttgcgttttctttttgatgtcttatgcaaaacctagaaactttgttgttatatgtttgatgccttcagttggatttagagaaaaaaaatgaaatgggggcagaagagtagtatgattcaaacaatgtgtgactgaattgcagcactaatgcaccaccattcgtcggattaattagcattgtttaagacgcagagagatcaagatcatgcaactgtcactgtcagcgagtgtgtgcctagttccctacagatcgaattggaaatgctgttcttttcgtctgtatgctatgcggaatgtactatttcagcaacagatcatgaatggccatgtatgtactctggatatctttggtattccggttttgaaaaaagaagtgctgcgctacttaaattatttcaagtatattagctgtaaaagattatgaacattgc

SEQ ID NO: 10554 - DNA, 1596 bp, Setaria italica
gatcgagagatccatccgtgaggtcgcagcatgggggtggccggcggcgggcggctgcgtgcgagcagcatcaagaagcagcggcagcggacgatgaacaacatcaagatcacgctcctctgcggcttcatcaccgtgctcgtcctccggggcaccgccggcttcaacctcctcgtcaacagcggcgaccccgacggcgccgcggccgacgccaaggtcgtcgaggacatcgagcgcatcctcgccgagatccgctccgactccgagcccgacgacgtcgtcgtcctcgtcggggacgggtcgtcgtcgtcccccaataacgcgacggccggcctcggcaacttctcgtcgtccgcgacgctgatcagggtgaaggagtacatcctgggtcccaaggtgagcgactgggactcccagcgccaggagtggctgtcccggcacccggagttcccttcccgcgacgcgcgcggcagcccgcgcgtcctgctcgtcaccggctcgccgccggggccctgcgacaaccccgccggcgaccactacctcctcaaggcgaccaagaacaagatcgactactgccgcctccacggcatggacatcgtgcacaacatggcgcacctggacccggagctgacggggtactggtccaagatccctctcgtgcgccgcctcatgctggcgcacccggaggtggagtggatctggtgggtggacagcgacgccatcttcaccgacatggccttcgagctcccgctctcccgctacgagggccgcaacctcgtcgtccacggctacacggacctcctcttcgagaagcgctcctggatctccctcaacgccggcatcttcctgctccgcaactgccagtggtcgctggacctgctcgacgcatgggtgcccatgggcccgagaggcccgtcccgcgtcgaggccgggaagctgctgactgcgagcctgtccggccggccgccgttcgaggccgacgaccagtcggcgctgatccacctgctgctcatccagaaggacaagtggatggagaaggtgcaaatcgagacggagttctacctccatggcttctggacggggctggtggacaggtacgagcagatgatggaggagcaccacccgggcctcggcgacgaccgctggccgttcatcacgcacttcgtcgggtgcaagacctgcgggaggtacgaggactacccgctggagcggtgcctgagggggatggagcgggccttcaacttcgccgacaaccaggtgctcaggctctacggcttccagcaccggtcgctggtgagcgccaaggtcaggagggtcaccgacccaagggctaacccgctcgaggcaaaggaggccgcgctcaagatggacgccaagttccagcgcgtctagtgggcctcagtagagagacactatgttcttgaatgttgatgagtcctttggttgttcttggctttcagttttgcagtagttagtgcaagcagtaagagtgttcgatgtttttagttggattcagagcaatacgaaataggcaagaaatgcatggttcaaacaatgcgactgtgaattatgccactaaatacacaacaattcaga

SEQ ID NO: 10555 - DNA, 1988 bp, Setaria italica
tggcatctccctacgggacggtgagcatatagtaatgcagaacgggaatcgtgctctcgcctgccgtacctctctgcaaaatccgagcaatttcgtattcacctcctccctcgtagttcccgcgcccccgctgacttccactgcacacaaacgtgccacctcctggaaccgaacgttcctgcctgctcctgctcgtccaaaaccctgtccctcctccctatacatctaactccacccgacagccccatcaatcactagctctcacagcttccaacgacgatcgagagatccatccgcgaggtagcagcatgggggtggccggcggcggtgggcggatgcgtgcgagcagcatcaagaagcagcggcagcggaccatgaacaacatcaagatcacgctcctctgcggcttcatcaccgtgcttgtcctccgcggcaccgccggcttcaacctcctcgtcaacagcggcgaccccgacggcgccgctgccgacgccaaggtcgtcgaggacatcgagcgcatcctcgccgagatccgctccgactccgagcccgacgaggtcgtagtcttcgtcggggacggcggctcctcctcctcgtcgtcccccagtaacgtgacggccggcggcttcggcaacttctcgttctcgccgtcggcgacgctgatcaaggtgaaggagtacagcctgggccccaaggtgagcgactgggactcccagcgccaggagtggctgtcccggcacccggagttcccttcccgcgacgcgcgcggcaacccgaaggtcctgctcgtcaccggctcgccgccggggccctgcgacaaccccgccggcgaccactacctcctcaaggcgatcaagaacaagatcgactactgccggctccacggcatggacatcgtgcacaacatggcgcacctggacccggagctgacggggtactggtccaagatcccgctggtgcgccgcctcatgctggcgcacccggaggtggagtggatctggtggatggacagcgacgccatcttcaccgacatggccttcgagctcccgttctcccgctacgagggccgcaacctcgtcgtccacggctacccggacctcctcttcgagaagcgctcctggatctccctcaacgccggcatcttcctgctccgcaactgccagtggtcgctggaccttcttgacgcgtgggtgcccatgggcccaagaggcccgtcccgcatcgaggccgggaagctgctgacggcgagcctgtccggccggccaccgttcgaggccgacgaccagtcggtgctgatccacctgctgctcatccagaaggacaagtggatggagaaggtgcaaatcgagacggagttctacctccatggcttctggacggggctggtggacaggtacgagcagatgatggaggagcaccacccggggctcggcgacgaccgctggccgttcatcacgcacttcgtcgggtgcaagacctgcgggaggtacgaggactacccgctggagcggtgcctgagggggatggagcgcgccttcaacttcgccgacaaccaggtgctcaggctctacggcttccagcaccggtcgctggtgagcgccaaggtcaggagggtcaccgacccgagggccaacccgctcgaggccaaggaggccgcgctcaagatggacgccaagttccagcgcgtctagtaggcctcgttggagagagagggagactatgttcttgaaagttacaagtttttctgagttctttgtttgttcttggctttcagttttgcagtagctagtgcaagcagtaagtgtgttcgatgtttttagttggattcagagcaatacgaaataggcaagaaatgcatggttcaaacaatgcgactgtgaattgtgccactaatacacaacaattcttcagatttcgctggtactagttgttttgtttaggattcaggtcaaaatgaaacaggcaagaaacgtatggttcaaacacag

SEQ ID NO: 10556 - DNA, 999 bp, Cajanus cajan
agaagaatggagaagagatagataatcgattagaatggagaaggcaagcttgagccacatgaatactcgtctcccacttcctaatcgcacctgcgcttttcttcaattcaaacaccccacttccttccccaccttcccaaacccaaggccccttcgattgcgcaggcccaattgctccatatcagacggcgccgttccgtcttgggttggtgcctctgactcttctctcgcggtgaagaagaaagcagcagaggtgtctcctgagctcaaagggacctccatatttctggttggtctgaaaagctctctcaaaaccagtttggggaagctgctggctgatgtgttacgatattattatttcgacagtgatagtttggtggaagaagctgtaggtggtgcacatgctgcaaaatcctttagagagagtgatggaaaaggcttctatgagtctgagactgaagtactgaagcaattatcatctatgggtcgcctagtggtttgtgtgggaaatggcgctgttacaagttcaactaatctggcacttttgagatatgggatttcattgtggatagatgtgcctctagattttgtggctagggatgtaattgaagaccagagtcaatttgccccatctgaaatatctatttcaggatcatacccagaggtaaaggatgaactaggtgctctatacgataaatacagagatggatatgctacagctgatgctactatttcagttcaaaaagtagcatcttggttggattgtgacaacttagatgaaattacaagagaagacttggctttagaggctcttaaggagattgagaagttgacaagagtaaagaagatgatggaagaagctgcaagaccattttaaccaacctggacatgcttctttcctttgcctgtaatcaaattggacaatctaaaacatttttcaattggcaaccccctgggttcgcttctcaaatttcagttttcttagttgtctccctttga

SEQ ID NO: 10557 - DNA, 1735 bp, Manihot esculenta
acgatgggattaggcagtgaagatgggaaagtggagactgcttgcaacacgtgccaatcaaagggaaggaggaagaagaaagacagtggtagtggtggtgatgaggttgtggagcggtcagagactgggtgttgggtcaagttcaggtttatagggagctgcatttcttcaagatccaaagttgatagctcagttagtgggaccagtactcattgcgaaagtaaatcaacaattgacacaagcagggaccaaccagttgctcctgcaatctcatctacaaccacaagtaatacagaaagtaattcatccacctccaaacttgaagaggaacttaaaattgcttctcgactgcgaaaattcacatttaatgatcttaagttggcgacaagaaattttagacctgagagtcttcttggtgaaggtggttttggctgtgtgtttaagggatggattgaagaaaatggaactgctccagtgaaacctggtacaggacttacagttgccgttaaaacccttaatcatgatgggcttcagggtcataaagagtggttggctgaagtgaattttcttggtgatcttgttcattctaacttggttaaactgattggttattgcattgaagatgatcagaggcttctagtctatgagtttatgccccgaggaagcctggagaaccaccttttcagaagatctctgcctcttccatggtctatgaggatgaaaattgccctaggggctgcaaagggtctttcttttcttcatgaagaagctgaaagaccagtcatatatcgtgattttaagacttccaatatcctattagatgcggattataatgccaagctttctgattttggacttgctaaagatggtcccgagggagataaaacacatgtatcaacccgtgtgatgggaacatatggttatgcagctccagaatatgtaatgactgggcatctcacatcaaagagtgatgtctatagttttggtgtagttttacttgaaatgataactggcagaagatccatggataagaaccgacctattggagaacataaccttgtggaatgggctcggccacatctaggagagagaaggagattctacagattgatagatcctcggcttgaaggccacttctccataaaaggcgctcagaaagcagcacaactggctgctcattgcctcagccgggatccaaaagccaggcccctgatgagtgaagttgtggaggcgctgaagcctctgccaaatctcaaggacatggcaagctcatcatactatttccagacaatgcaagctgagcgagctgcatccagcccaaattccaaaaatagcagccgaacgccaggaggattattgaggaatggacagcaacagaggagcctttctataccaaatggttcaaatgcatctccttaccatcaacaataccctcatcaatcgccaaaacccaatagaaaaccgtagcacagggtcagtaattacggcttttctccaacaattttcatcattcatttctttttcccgttgttcctggtatagatgtattttctttgaaaatgttcctttctcggacactggaaaaagcaacagcgggatatgtgcgttgtgtttagaatgatgatctgtcctcccagcagggaagaatgctaggcgggtgaagctcatagaacaaaatgtctgtcaaaattatgtactacgcaatgtcagtgtctcgaaatgtttaaagattatt

SEQ ID NO: 10558 - DNA, 2056 bp, Medicago truncatula
gttttgtttaacagtactgtagtgtttgtgtttgtgtcacatacgaggaggacccatctccgataatttcacttttctagaccgaagatttctgaattcagttcagtttctgttgtgttgtgttgtgttgtctctctttctctgcttctactctccacttccccaaccaacctttttcatccttcaagacgtacgcagaaactcacacacggacgctgaaactcacacacacaactgcaagatcctgggttcaaacgcgatgaaggtgttcagactaacaatctcagctttgtcagttgagctagaccttatgcacttacatttaggttttggttctctatagagtttgttagagatggggttgttgggttctgataatgttaaaatggtggagtcttgggatatgtctaaatcaaaggggagtaagaagatgaagaaggataaagagaatgaggatgtgattgatgcgggaaaaacaaaaactgggtgttgggttgggttgagattcattggtagctgcatttcttcaagatccaaagttgatagctcagtcagtggcagtggcacaagtacacattatgctgaaagtaaatcaactaatgatacaagtagaggccaacgaactgctccagtaatctcttctacaaccactagtaacgcagaaagcaattcctcaactactaaacttgaagaggagcttaaaattgcttccaggctgcgaaaattctctttcaatgaacttaagttggcaacaagaaatttccggcctgagagttttcttggcgaaggtgggtttggttgtgttttcaaaggttggattgaagaaaatggaactgctccagtgaaacctggcacagggcttacagttgctgtaaaaacccttaaccacgatgggcttcagggtcataaagaatggctggcagaggtgaattttcttggagatctagttcatcaaaaccttgttaaactcataggttactgcattgaagatgatcaaaggctgctagtgtatgagttcatgcctcggggaagcctggaaaatcacttatttaggagatccatgcctcttccatggtccattaggatgaaaattgcactaggagctgctaagggtcttgcttttcttcacgaagaagctgaacgaccagtaatatatagggattttaaaacttcgaacattctattagatgcagactacaatgctaagctctcagactttggtcttgccaaagatggtccagaaggtgataaaacccatgtgtctactcgagtgatgggaacatatggttacgcagcaccagaatatgtcatgacaggtcatcttacgtcaaaaagtgacgtgtacagttttggagtcgtactacttgagatgatatccggcagaagatctatggacaaacaccgacccaacggcgaacataaccttgtcgaatgggctcgaccacatctaggagagagaagaaggttctaccggttgatagaccctcgtcttgaaggtcacttttccgtaaaaggagctcagaaagccgctcagctagctcatcactgcctaagcagagatccaaaagccagacccctaatgagtgaagttgtcgaagctctaatgcctctaccaaacctaaaggacatggcaagctcgtcgtactatttccaatcaatgcaagccgagcggtttggagcgagtccaaattctagaagtgtgcatgcacaaggagcgtcgcttgctcgcaacggacagcagagaaggagcctttcgataccgaacggtgcacatgtatccccatatcaccataagtatcctcaacaatcacctaaacctaatgtcaaagcatagagctggtgaaaattttccaaattttccatctctttatgtttcatctggttgtttgaaaatatttaaacattattttactttatttttttgcccatggaaatgttatctcttgatttctttaggctttgcttgtgtataatgttaaacactgtggctcctttaattaatcacaagcttttgtttatagaaaaatgagaaaggaactttattattgtattaatt

SEQ ID NO: 10559 - DNA, 1904 bp, Trifolium pratense
atatattttattcattatttttcaatttaattcctaatgttttgctttgcagtacagagacatagtgtttgtgtttttgttgcatacgaggactgaccccatcctccgatatttcatgtttcttgagcgaagatttctcatttcagttcagtttctgttgtcttaaatctctgttcttactctccacttcccaatccttttttcatcaaaatcatctcttcaaaggttttgttattgatggggttgttgggtgctgagaagggtaaagtggtggagtcttgggatgtgtgtaaatctaaggggaggaagaagaaaaagaagagtcaagagaatgagggtgttgttgaagagaaaaaacctgggtgttgggttgggttagggttgtttgggagctgcatttcttcaagatccaaagttgatagctcaatcagcggcgcaagtactcattatgctgaaagtaaatcaactaatgacacgagtagaggacaaccaacagctccggtaatatcttctacaaccactagtattgcagaaagcaattcctccacctctaaacttgaagaggagcttaaaattgcttctaggctgcgaaagttcactttcaatgaacttaagttggcaacaagaaatttccggcccgagagttttcttggcgaaggtgggtttggttgtgttttcaagggttggattgaagaaaatggaactgctgcagtgaaaccaggcacagggcttactgtcgctgtaaaaactcttaaccatgatgggcttcagggtcataaagaatggctggctgaggtaaattttcttggtgatcttgttcatcaaaaccttgttaaactcgtaggttactgcattgaagatgatcaaaggctgctcgtgtatgagttcatggctcggggaagcctggaaaatcacttatttaggagacccttacctcttccatggtccattcggatgaaaattgcactaggagctgctaagggtctcgcttttcttcacgaagaagctgaacggccagtaatttatagggattttaaaacgtcaaatatactattagatgcagactacaatgccaagctctcggactttggtcttgccaaagatggtcctgaaggtgataaaacccacgtgtccactcgagtcatgggaacctatggttacgccgcacctgaatatgtaatgacaggtcatctcacatcaaaaagtgacgtgtacagtttcggagtcgtactgcttgagatgttgagcggcagaagatctatggacaaacaccgacccaacggcgagcataaccttgttgaatgggctcgaccacatctaggagaacgaagaagattctaccggttattagaccctcgccttgaaggtcacttttccgtaaaaggagctcagaaagctgttcaactagctgcccactgcctcagtagagacccgaaagtcagacccttaatgagtgaagttgtcgaagctttaaagcctcttccaaaccttaaagacatggcaagctcttcatactatttccaatcgatgcaagccgagcggttcagtgcgagtccaaacactagaagtgcacatgcacaaggagcattgctcgctcggaacggacaacagcgaaggaccctttcgataccgaatggcactcatgtatctccttatcaccacaagtatcctcaacaatcacctaaacctaatggtaaagcatagagttggtgaaaattttccatctctttatgtttcttcaggttgtttgaaaatattgaaacactattttactttatttattttcccattttgcccttggaaatattatttcttaatctctttaggctttgcttgtgtatgatttcaaacattatggctccttaaattaattaatcacaagcttttgtttatagaaaaaagaa

SEQ ID NO: 10560 - DNA, 1792 bp, Trifolium pratense
cacttcccaatccttttttcatcaaaatcatctcttcaaaggttttgttattgatggggctgttgggtgctgagaatggtaaagtggtggagtcttgggatgtgtgtaaatctaaggggaggaagaagaaaaagaagagtcaagagaatgagggtgttgttgaagagaaaaaacctgggtgttgggttgggttagggttgtttgggagctgcatttcttcaagatccaaagttgatagctcaatcagcggcgcaagtactcattatgctgaaagtaaatcaactaatgatacgagtagaggacaaccaacagctccggtaatatcttctacaaccactagtattgcagaaagcaattcctccacttctaaacttgaagatgagattaaaattgcttctaggctgcgaaagtttactttcaatgaacttaagttggcaacaagaaatttccggcccgagagttttcttggcgaagggggatttggttgtgttttcaaggggtggatcgaagaaaatggaactgctgcagtgaaaccaggcacagggcttactgtcgctgtaaaaactcttaaccatgatgggcttcagggtcataaagaatggctggctgaggtaaactttcttggtgatcttgttcatcaaaaccttgttaaactcgtaggttactgcattgaagatgatcaaaggctgctcgtgtatgagttcatggcccggggaagcttggagaatcacttatttaggagacccttgcctcttccatggtccattcggatgaaaattgcattaggagctgctaagggtcttgcttttcttcacgaagaagctgaacggccagtgatatatagggattttaaaacatcgaatatactattagatgcagactacaatgccaagctctcggattttggtcttgccaaagatggtcctgaaggtgataaaacccacgtgtcgactcgagtgatgggaacctatggttacgccgcacctgaatatgtcatgacaggtcatctcacatcaaaaagtgacgtgtacagtttcggagtcgtactgcttgagatgttgagcggcagaagatctatggacaaacatcgacccaatggcgagcataaccttgtcgaatgggctcgaccacatctaggagaacgaagaaggttctaccggttattagaccctcgccttgaaggtcacttttccgtaaaaggagctcagaaagctgttcaactagccgctcactgcctcagtagagacccgaaagccagacccttaatgagtgaagttgtcgaagctttaaagcctcttccaaaccttaaagacatggcaagctcttcgtactatttccaatcaatgcaagccgagcggttcagcgcgagtccaaacactagaagtgcacatgcacaaggagcatcgcttgctcgaaacggacaacagcgaaggaccctttcgataccgaacggttctcatgtatctccttatcaccataagtttcctcaacaatcacctaatcctaatggtaaagcatagagctggtgaaattttttcacctctttatgtttcttcaggttgtttggaaatatttgaaacactattttactttatttatttattttcccattttacccttggaaatgtttatttcttaatttctttaggctttgcttgtgtatgatttcaaacattatggctccttaaattaattaatcacaagcttttgtttatagaaagatgagaagaagcttttatttacatttatttatgtctgttgtgtgtatttaacactagtacttgatcccatc

SEQ ID NO: 10561 - DNA, 2346 bp, Vitis vinifera
cccccctctctctgttcttcagtggccgcgaaagctacttttgtcgccatttttactctctaaaaaccctaatgccggttttgtgaagttaatggagttccctggcggtgggtgggtgtggtgggcggacaaaaaagtgataattgggagtgcattttaactttgaggttgtcaccttattggattcgattcctagggttttttgggctccgaattggacgattgatgaaatattcgcttctgattggtctggatgttggggttgtggtcttgcatgtccattttgcgatctgggtcatgcacatttttctgatttgaggcttccggacccggttttctcatctgggtctgagtgatttggctctatttgattctctaattttcggttctgaaaagggtttcccttttttgggtggaattttaggttatttaataattatttttggggtgggcgtggtgttttcattttcgtgaagaggtattttcggtgaattttgatttttggtgttgttttatgtattggacatttagagggtttggagtaaggtagtaaaggagggaggattttgatggattgaaatatttatgagaaaatgggaatttgattttgttggtgttcagagaaaatgggattaggcccggatgctattcaggtggggaattgggaggtgggcaattcaaagggaaggaagaagaaagatgatgaagaagaggcgacagggtgttggattaagtttagatttatggggagttgcatgtctgcaaggtccaaagtagagagctctgtaagtagctctagcacacaatatgcggaaagtaaatctacgaatgatacaagcagagatcaaccagttgcaccagttgtatcctcttcaaccactagcaatggggaaagtactccatcaacgcccaacacaggcgaggaactgaaagttgcttctcagctccgaaagttcaccttcaatgagcttaaatcagcaacaaggaattttagaccagagagtcttcttggtgagggtgggtttggttgtgttttcaagggatggattaatgggactggaacaacacctgtcaaacctggtacagggcttactgttgcagtgaaaaccctcaatcatgatggacttcagggtcataaagaatggcttgctgaagttaattttcttggtgatctcctccatcctaatttggttaaattaattggttattgcattgaggatgatcaaaggctgcttgtttatgagtttatgcctcgtggaagcttggagaatcaccttttcagaagggccctgcctcttccttggtccatcagaatgaaaattgcacttggtgctgcaaagggtcttgcctttcttcatgaggaagctgaaaggccagtaatatatcgagattttaaaacatctaatatcctgttagatgtggactacaatgctaagctttctgactttggacttgccaaagacggtccagaaggagataagacacatgtatctactcgtgtaatgggcacctatggctatgcagcccctgagtatgtgatgacagggcatcttacgtcaaagagtgatgtttatagctttggggtggttctccttgaaatgttgactgggcgaagatccatggacaaaaaccgtccaaatggggagcataaccttgtggaatgggcacgacctcatcttggagagaggagaaggttctataggttgctagatccccgtctcgaaggtcgcttctcaatcaaaggtgcacagaaagcggcccaattggctgcacactgccttagtcgggacccaaaagccagacctctaatgagtgaagttgttgaagccctaaagcctctgccaaatctcaaggacatggccagttcttcatcctttttccagaccatgcaagcagagcgcacgggctccacccctaactctagaagtggcattagagcacaggcagggttcctatcaaggaatggacaaccaaacagaagtctctccatgccaaacggtccacatgcctctccatataaccacaacaatcctcaccggtcaccaaaaccctaatttcaggcaaacatagcaccaagttcatgtccatctgtttcttccccatgtcacttccttatcttacatgctatctgttaaagggattgggggcatcttgaaaaattgaacaaaaaatgctgagactgtatcttgaagttaatgctgatgtgttggtttttcctttttgagatgtgagtgagagaagtaggtggaggagattgaaggagtagcctggagagaatcatgggcttttgcttttgttgattgtactctgttttgaacatgaaaaattgatccatgatgttttctt

SEQ ID NO: 10562 - DNA, 2249 bp, Arachis hypogaea
gtgtatcaacgcagagtgccattacggccgggggcagcattgtgtttgtgtagcagtaacgagggaccctccaatcactgagagatttctctctattctttgagcttagcggagttttctgagtttcatctcagctctcagctctcaggtattctgctctctctgcgagtgttttctttcttcgttaaaagctgccacttcactctctcttctcttcttttacccttcctttctcatttcccaacccatcatccttcatcatcaatctagggttcaagtttcttcttgtgcttttcccaccaccccttttcatttgggtactttgatctgtttcatgtgatccgtttctctttcctcttgggttttctcagttgcactgttttgaactgttctgatatgaaaagttgtgatttttagccccttttgtatcaaaattttagtggatatggtggtgggagagtaggggaatttaaaagtttttttttttttttttgggaattgtggcggtggttttggttttgatgatatctggggtttggtctctttgctagagccatgggtttgggtgctgagaatggtaaggtggtagattcttgggatgtgtgtaaatcaaaggggaagaagaagagtaagaaattgaagcagaaggaaggggaggtagtggtggatgaggaagatgaggagtttgagggagagactgggtgttgggttaggctaaggttcatggggagctgcatttcttcaagacccaaagttgataactcagtcagtggcaccaccactcatgatgctgaaagtaaatcaactagtgatacaagtagagaccaacgaagtgaaccaacggccccagtagtctcatctacgaccactagcaatgcaagcagttcatcaacttctaaactcgaagaggagcttaaagttgcctccaggctacgaaagttctctttcaatgatcttaagttggcaacgagaaattttcggcccgagagtcttcttggcgaaggtgggtttggttgcgtattcaagggatgggttgaagaaaatggaactgctccagtgaaacctggcacagggcttaccgttgccgtaaaaaccctcaaccatgatgggctccaaggccataaagaatggctggctgaagtaaactttcttggtgatctagtccatccacaccttgttaagcttatagggtactgcattgaagatgatcaaaggttgctagtgtatgagttcatgcctcggggaagcctagaaaatcacttatttaggagatccatgcctcttccatggtccgttaggttgaaaattgcactaggagcagctaagggtcttgcttttcttcacgaagaagctgaacgaccagtaatatatagagattttaaaacttcaaatatattattagatgcagaatacaacgccaagctctcagactttggacttgccaaagatggtccagaaggagataaaacccatgtgtctacccgagtgatgggaacctatggttatgcagcaccggagtatgtcatgacaggtcatcttacatcaagaagtgacgtgtatagttttggagtggtactacttgagatgttgaccggaagaagatctatggacaaacaccgtcccaatggcgaacataaccttgtggaatgggctcggccgcatctgggagagaagagaaggttctataggctgttggaccctcgccttgaaggccatttctccataaaaggagctcaaaaagctgcccaaattgccgctcgctgtcttagtagagatccaaaagccagacccctaatgagtgaagttgtagaagatctaaagcctctgctaagtcttagggacatggcaagctcttcatattacttccaatcgatgcaagctgaccgctttagccctagtccaaatacccgaaatgggcggacacaaggagtgttcctcgcccggaatgcgcagaggagtctttcaataccccatggtatccatgcctctccatatcaccatcagtttctgcaacaatcaccaaaacctaatggcaaaacataagctggcgagaattctttccttttcaccctttcttctttttcgagacttcttattttcctccagtatagaatgtgcccttgtgtcaaaaaaccatttttcatggacaacttgagatcagacaaagaaacatgctgctttatgatgtatgttatgagtatctagtagaagctattgaaatagctttgtcttgtgtcaaaaattcttaa

SEQ ID NO: 10563 - DNA, 3030 bp, Amborella trichopoda
ttttaactcctatattcccggttgctctttctctctctaccctatggtccgtactttctctctctacccagtggactattatttgttctctctctaaccaaagtggccctctctctctctaaccagtgacctctctctggggcctgtgctttttctggctttatgcccttttcgctctctctctctctctctgtatttctctctctctagctgactcgttgaatgcctggaccgagaaagcatttgtacatcaacgaggtcaggttttgagccaggaagctcgtctctgcaacttcacctgattctctttctgctctctctctctactgcatgatctgcttataatctcagtttaagattgggtggtgtttatttggagggcttcagttcgacttttgatttggtgacgagcttcttcgtgtggattttggggtgtttttatggtttgtggagctgttttgctctactgattgagggtttcgaggagagtttcttctggttcactttgtggtgatagatttgctgtataagggtttttcttgaatgagttccatttttattgcaatctgggatatttataacatttgaagcttcgatactttacatatttatttggattagggtttcctctttgtatgaatggtgggcatgcatcgtggttaaacgacatggttttagggcagggtttatggtggcactgaaagagagaatcagtggattagggtttctgttgttttgaatgcatggttttttgatcgggatttttggagatgggtttttgtttttgaaagatggcgttttgattagggtcttgagaagatgggtttagggcctggagctacccaggttgaggcatgggagcaggtgaaaagatcaagggggaggaagaagggtgaagatggagaagacactggctgctggtttaagttcaggttaatggggagctgcatttcttctagatccaaagtggacaattccattagtagcgccagtactcattatgctgaaagtaaatctacaaacgatgtaagtagagatcagcccgttgtgcctgtggtttcttctacaactaccagtaatgcagagagtaatccctctactcccaaagtgggagaggagctcaaagttgcctctcagttgaggaaattcacattcaatgatctgaaatcagcaacaagaaatttcagaccagagagccttcttggggagggcggttttggttgtgtcttcaagggttggatcgaggagaatggaacagctcctgttaagcctggaacaggtcttactgttgctgtcaaaaccctaaaccatgatggtcttcagggccataaagagtggctggctgaagttaactttttgggcgacctattgcatcctaacttggttaagctaattgggtattgcatcgaagatgaccagaggcttcttgtctatgagtttatgcctcgaggaagtctagagaatcatctcttcagaagggccctgccactcccgtggtccatacgaatgaaaattgctcttggggctgcaaagggccttgcatttctccatgaggaagctgaaaggccggtgatatatcgtgacttcaaaacatctaacatcctgttggatgcggaatacaatgccaaactatctgattttgggctagctaaagatgggcctgaaggagacaagactcatgtttctactcgagtgatgggaacgtatggttatgcagctcctgagtatgtaatgactggacacttaacatcacgaagcgacgtctatagttttggtgttgtcctcctcgagatgcttacaggacggaggtcaatggacaagaatcgtccaaatggtgagcacaacctcgtagagtgggcccggcctcatctcggagagaggcgtaggttctatcgcctcattgaccctcgcttagaggggcacttctctatcaagggcgcccaaaaggccgcacaattagcctatcactgcctaagccgagatcccaaagcccgccccctaatgagtgaggtcgttgaagcccttcagcctttgctaaaccttaaggacatggccagctcctcatttaattaccaagctatacaagctgagcgtgcgggtgctaataatggaaggacccaacatgccgctcattatgccctcaaaaatgggcagcagccagcgagaagcctgagcaatgggtcccactaccatccctccccttatcggcagtcaccgaagcccaatggtaaacacccatagaaaaaaaaattcatcttttcttttctttacttcttttcttcttttgtttatttaatggatttgtatgcttgaagacttgagtgcttgcttataagcatggatgaacttgttgggggagtggggctggttttaggctctgttgtgctgtggagcttgaggtggataggtgtttgggaggcgggttggatggtttttaagggaactttgatggtgcacacattgtgggttgtgtgcttataattgttctgaatctaactgagagggatgccctaactgctgctcaagtatgtttttttcctagttgactttttatgcttgaaagaagtgatggtctccttgatggttcaagcattgttcggcaggaaattatgtattggctaatatatttcacctctttttcttgatttctttttcttcgaagcagtcactacagaaatctacaaacttctacgcttttcttctgttttgtttttttttaaagagttatatgtttccttcttcctacttttttttggttgaatatttctattatttgcttgctattattttcaatttgggtgtttaaactgtttagatttggacaatttgtgttctttgcttagagtgccggtgcatgagcccagatcagaaaaagaaatattgtctgaaatgaaaaagaatcccgatatcgaaatttctatctaaacaggtattctttctatttttttctttgtattcttggactttactggacattttcagggagatttcttattgttttagaaacttttgggacctatacttattgta

SEQ ID NO: 10564 - DNA, 2063 bp, Ananas comosus
ctctctctccgcccctttgctattctcacccccaaatttcgcccaatgcgcccagagtcggcgccctcggcatctccccgccgactttctccttcgccggaggccccttcgcgaagctcctgctccgggtagtgtcggtggacctagtcttcgtccggggacctcgtcttcctcccgttcgaaaccctaatcagggtttcggattcttctacgagggatcacgagttcgggattcgttgcgttactcggctttcgcccgatttcggtggatttctcccctgtcgtgtagggtttcggggctcgatttggacgatcgaaacttgttgccttgttttccgttcggaagatctctactatggcgatcttaagggtccggtagttaacttgcagcgatttctcttcgatttccctgagattttgttgtgatttgtggggatctttgagatagtcgggatttttgatggttctctgaagaagtgcgagaagtcctgtagaggatgggattgggacccgatgaggtgcagctcgaggcgtgggatagtgtcgggaaatcgaaggagaaagggaggaggaagaagaagaaggatgaggcgagggaggagactgggtgttggattaagttccggctgatggggagttgcatctcttcgagatccaaagtggattcatccatcagcagcgccagcactcattgtggtagtaaatcaacaaatgatggtagtagggaccaaccggttgcaccagtactctccggttctacaactactagcaatgctgagagtatttcatcagcatctaaagcgggagaggaatttaaagttgcatctcagttgcggaaattcactttcaacgagcttaaggctgccaccagaaactttagaccagagagtcttcttggtgagggaggtttcggttgtgtctttaagggatggattgaggagaatggaactgctcctgtgaagcccggtacagggcttactgttgctgttaagacactcaaccacgatggacttcaagggcataaagagtgggtggcggaagttaattttcttggtaaccttctacacccgaatttagtgaagttgattggatattgtattgaagatgaccaaaggttgctggtgtacgagtttatgcctcgtggaagtttggaaaaccatctctttaggaggtcactgcctctcccgtggtccatcagaatgaaaattgcacttggtgcagcaaagggccttgcttttctccacgaagaagcggaaagaccagtaatatatcgtgatttcaaaacatccaatattttgttagatgcggaatacaatgctaaactctcagattttggtctcgctaaagatggtcctgagggtgataaaactcatgtatcgactcgagttatgggaacatatggatatgcagctcctgagtatgtcatgactggacatctaacatcaaagagcgacgtctacagctttggggttgtgctattggagatgatgacgggccgaaggtccatggacaaaaaccggcccaacggggagcacaacctggtcgagtgggcccgtcctcacctaggagaaaggcggcgcttctaccgcctcatagaccctcgcttggagggcaacttctccatcaaaggggcccaaaaggcagcacagctggcacatgcctgcctcagccgcgaccccaaggcccgccctctcatgagccaagtagtcgaagttctcaaaccacttctcaacctcaaggacatggcaagctcctcttacttcttccagaccatgcaggccgagcgcgccgcccatactggcagcacaaatgggctaaaatcacagagctccttcacaaggaacggtccacagcccatgaggagcttatcgaacggtccgcatgcttctccgtaccgccattcgccgaaacccggggggagacagtcttaagccatagggtcatcgttctctgttaattgcttttgcgaaactctgcctggttgaaactgcggggtttgtgggcatgtgatgatttggattgccatatataactggcgaagagatcggaagagacacgtctga

SEQ ID NO: 10565 - DNA, 1556 bp, Castanea mollissima
gcagaaagtaaatcaaccaatgatacaagtagagaccaacctgcagctccaattgtcccatcctcaaccactagtaatgcagaaagtaattcatccacttccaagcttgaagaagagcttaaagttgcttctcgtctgcgaaaattctcatttaatgatcttaagttggcaacaagaaattttagacctgaaagtcttctgggtgaaggaggttttggttgtgtgttcaaggggtggattgaagaaaatggaactgctccggtgaaacctggcacagggcttactgttgctgtaaaaactctcaaccatgatgggcttcagggtcataaagaatggctggctgaagtaaattttcttggtgatctggttcagtcctaatctggtcaagcttattggttactgcattgaagatgatcaaaggctgctagtatatgagttcatgcctcgagggagcttggaaaaccatctatttagaaggtccctgcctcttccatggtccattaggatgaaaattgcactaggtgctgcaaagggtcttgcttttcttcatgaggaagcagaaagaccagttatatatcgtgattttaaaacctccaacatcctgttagatgcagactacaatgcgaaactttctgattttggacttgccaaagatggtcctgagggtgacaagacccatgtttctacccgcgtgatgggaacctacggttatgcagccccagaatacgtcatgacaggacatcttacttcaaggagtgatgtctacagttttggtgtggttctacttgaaatgctgactggcagaagatctatggacaaaaaccgacctaatggtgaacataacctagtggaatgggctcggccacatctaggagagagaagaagattctaccggttgatagaccctcggcttgaaggtcacttttcaattaaaggagcccaaaaagctgcgcaactggctgctcactgccttagtcgggatccaaaagccagacccctgatgagtgaagttgttgaagccttaaaaccactgccaaaccttaaggacatggcaagctcatcatattatttccagaccatgcaagctgaccgcgtggggtccagcccaaatgctagaaatggcatccgaacacaaggaggatccttttcaaggaatgggcagcagcagaggagcctttccataaatagttcccatgcttctccatatcaccatcattacacttatcaatccccaaaacccaatggtaaaccatagcattcgctttggtaatatctgtttcttttctccaccccattggcttcttttttccctcttcttcagtatagatgtatcttctgctaaagcatttgttcttagacaactggaaaaaagcaacacagaaacatgtttgctttgatgatgtgtttagagtggtgaactccctgcgggggagaatgtaagggcaagtgaaagcttgttgagcaaaatgtcttatctcaaccaatgtatcttcagtttgttttttaatgttagaagtgtattacgcctccccactcccccgccccctctctttttt

SEQ ID NO: 10566 - DNA, 2288 bp, Elaeis guineensis
gacgccgttaactcccgcagctgcccgctcactatttccctcgcctgacgccccccaagggtcccacccacgcagcccgtcgggcaggggaccgtgtccagttctccactccaccaccacctccgtctccaagcgagttccaaagctccctcggcgaggaagccccctagggttttgaagattccgaggagaaatctcgagctccctggccgctcttcgatcttggtaccagtccagctcgttcgattctctcttcttggtttagggttacgagctctggattcgttgattactgttctgaaatggtaatcttggtttcctgtagcggttttgatgtagatttgttgagagatttttggcggagaagagtttgtaggggtgatctctaaagaaggaatctatttgggagagagggcttcgggttccctttcttggatcttggatttcgagttgggatgagattttgagcgatggggttgggtctcgaggaggttaaattggagggatggggcagcgttgggaaagggaaggacaaggggagtaagaagaagaagaagaagagcgaggcgagggaggaggagaccggatgttggattaagttcagattgatagtgagttgcatctcgtcgagatccaaagtggacacatctatcagcagtgccagcactcattgcgaaagtaaatccacaaatgatggtagcagagaccaaccagctgcaccagtagtctctggttccaccaccactagtaatgctgaaagcaattcatctacttctaaagtaggtgaagaattaaaagttgcatctcagttgcggaagttcactttctatgagctcaagtctgcgacaagaaactttagaccagagagccttctgggagagggaggttttggttgtgtcttcaaaggatggattgaggagaatggaactgctcctgtgaaacctggtacagggctaaccgttgccgtcaaaacactcaaccatgacggacttcaagggcataaagaatggctggcagaagttaattatctaggcgagcttcaacatccaaatttagtaaagttgattggttactgtattgaagatgatcaaagactgctggtatatgagtttatgcctcgaggaagtcttgaaaaccatcttttcagaaggtccctgcctctcccatggcccatacgaatgaagattgctctgggtgctgcgaggggccttgcttttcttcatgaggaagcggaaaaaccagtgatatatcgtgactttaaaacatccaacattctattagatgcggactataatgcaaagctttcagactttgggcttgctaaggatggtcctgagggtgataaaactcatgtgtcaacacgagtgatgggcacatatggatacgcagctccagaatatgtaatgacaggacatctgacatcaaagagtgatgtctacagttttggggttgtgctacttgaaatgatgactgggcgaaggtccatggacaaaaaccgaccaaatggtgagcacaacctggtggagtgggcacgcccccatctaggagaaagacgacgcttcttcagacttatagatcctcgtctagatggcaacttctcaatcaaaggtgccctgaaagctgcccagctggcacatgcctgtctcagtcgtgatcccaagtccaggcccttaatgagtgaagtagtggaagtgctcaaaccattaataaaccttaaagacatggcaagctcttcgtacttctttcagtcaatgcaagcagaacgtgctgcagcaaacagcaataaccagactggaagaaatggtttgaaatcacaggcttcgtttccaagaaatgggcaccagcctgtaagaagcctttctaatggttcacatccttctccataccgtcagtcgccaaagcccaatgacaaacaaccatgagcgcatatattcctgtaagttattccaaggaattggagatcttgaatggcgagaagtatgcaggactctggtgatctctgtgttgtatatctggtgataggaagtctgagggctcctgtggataaaggttgatggaggtgtgtggggctggggtcaacctttgttggtcacaacttacctgaaaagaatgactctgaagatatttataatttgatgctaccattgtcttttgccttgttaaagtaattgtggttgcttgatatagtcaattgagttgaagaaggttttacagggttatcaggtttgttctcggggcttgaacagtttgtgaatgattcttactgaaggatcatggggaatgttcct

SEQ ID NO: 10567 - DNA, 2001 bp, Cichorium intybus
gtcttccattttttaatgcgatctgaatctcttttttgttcctacatactaattttataaaaagttataatcttgtttgaaaattctgaattgggccttttcagtttccacttaaaaactccattttggtggagtttgagggaattttctgttgtatgcaagtcaaagaccttttttcttcctttttggagttgagtgtcatcatttcccacctttcatcttgaatgggttttgatctttatatataacttctcgatctttaaccaagaaactgctcaaaaattgggaaatttccgatctttctgattgatgggggtttgattgatgatatccattggggttgattttagggtttgttttagaagatgacatccggtgatcaagaagttgttaaattggagtctttacatgtaatgaaatcaaaggggaataagaaaaagaagaaaaacgatgaaggttccgttggatgttggaacaaatggggtttattcggcagttgcgtttcttcaagatctaaagtcgatagctccaccagtggcataagttctcacttcgaaagtaaatcaagaaacgataccagcaaagatcaaccggcggttccgatagttactccgaccaccacaagtaacggtggagaaaacaatctgtcgagtccaaaaccagaggatgaactcaaagttgcttcccgccttcggaaattcgctttcaatgatctaaaaatggcgacgcgaaatttcagacccgaaagtcttctcggtgaaggcggttttgggtgtgtgtttaaaggatggattgaagaaaacggcaccgcacctgtaaaacccggcaccggactcactgttgccgtcaaaacgctaaatcacgacgggcttcagggtcataaagagtggctgacagaagtgaattttttaggcgatcttgtaaatccgaatttggttaaattgatcggttattgcattgaagatgatcaacggttgctcgtgtacgagttcttacctcgagggagcttggagaatcacttgttcagaagatcattgcctcttccatggtccataaggatgaaaatcgctcttggtgctgcaaagggccttgctttccttcatgaagaagcaaaacgacccgtgatttatcgtgattttaaaacctccaacattttgttagatgcggaatataacgctaagctttcggactttggtcttgctaaagatggcccggagggtgataagactcacatatccacacgagttatgggaacttacggttatgccgccccggaatatgtcatgacaggacatctgagtacaagaagtgatgtatatagcttcggtgttgtattacttgaaatgttgaccgggcgaaggtcaatggataaaaaccggcccaacggagaacacaacctcgttgagtgggcccgcccgcatttattagaaagaagacggttttaccgcttaatcgacccgcgattagaaggccatttctcaataaaaggagcccaaaaagccgcacagctggcatcccgttgtcttagtcgcgacccaaaagcccggcccttaatgagtgaagttgttgaatgtctcgaacctttgcccgcccttaaagacatggcgggctcttcttattacctacaaacgggtcaagccgatcgggttgggtcgagcccagatggggcgcgggctcgagccgggtcgttttcaagaaacgggcaacagcagccacggactttatcgatacctcgtggctcgcctaatcatcatcagtttcttaaggactcaccaaaaccgaatattcttaaggactcaccaaagccaaatgagaggcgatgacaaagggcatgattgggtgtcaaatttgtggtgttgtgatcatttgagttaacgtgacaaactcccaatttgggaggctgtaattttgtgatgtgacatttttattaacattgtatcatattatctttgtttataactttatatagtatgataaattggtcacgtcggtgtcttggcc

SEQ ID NO: 10568 - DNA, 2011 bp, Cichorium intybus
tctctctctcgtcttccattttttaatgcgatctgaatctcttttttgttcctacatattaattttataaaaagttataatcttgtttgaaaattctgaattgggccttttcagtttccacttaaaaactccattttggtggagtttgagggaattttctgttgtatgcaagtcaaagaccttttttcttcctttttggagttgagtgtcatcatttcccacctttcatcttgaatgggttttgatctttatatataacttctcgatctttaaccaagaaactgctcaagaattgggaaatttccgatctttctgattgatgggggtttgattgatgatatccattggggttgattttagggtttgttttagaagatgacatccggtgatcaagaagttgtaaaattggagtctttacatgtaatgaaatcaaaggggaataagaaaaagaagaaaaacgatgaaggttccgttggatgtttgcacaaaaggggtttattcggcagttgcatttcttcaagatctaaagtcgatagctccaccagtggcataagttctcacttcgaaagtaaatcaggaaacgataccagcaaagatcaaccggcggttccgatagttactccgaccaccacaagtaacggtggcgaaaacaatttatcgagtccaaaaccagaggacgaactcaaagttgcttcccgccttcggaaattcgctttcaatgatctaaaaatggcgacgcgaaatttcagacccgaaagtcttctcggtgaaggcggttttgggtgtgtgtttaaaggatggattgaagaaaacggcaccgcacctgtaaaacccggcaccggactcactgttgccgtcaaaacgctaaatcacgacgggcttcagggtcataaagagtggctgacagaagtgaattttttaggcgatcttgtaaatccgaatttggttaaattgatcggttattgcattgaagatgatcaacggttgctcgtgtacgagttcttacctcgagggagcttggagaatcacttgttcagaagatcattgcctcttccatggtccataaggatgaaaatcgctcttggtgctgcaaagggccttgctttccttcatgaagaagcaaaacgacccgtgatttatcgtgattttaaaacctccaacattttgttagatgcggaatataacgccaaactttcggactttggtcttgctaaagatggccccgagggtgataagactcacatatccacacgagtcatgggaacttacgggtatgccgccccagaatatgtcatgacaggacatctgagtacaagaagtgatgtatatagcttcggtgttgtattacttgaaatgttgaccgggcgaaggtcaatggataaaaaccggcccaacggagaacacaacctcgttgagtgggcccgcccgcatttattagaaagaagacggttttaccgcttaatcgacccgcgattagaaggccatttctcaataaaaggagcccaaaaagccgcacagctggcatcccgttgtcttagtcgcgacccaaaagcccggcccttaatgagtgaagttgttgaatgtctcgaacctttgcccgcccttaaagacatggcgggctcttcttattacctacaaacgggtcaagccgatcgggttgggtcgagcccagatggggcgcgggctcgagccgggtcgttttcaagaaacgggcaacagcagccacggactttatcgatacctcgtggctcgcctaatcatcatcagtttcttaaggactcaccaaaaccgaatattcttaaggactcaccaaagccaaatgagaggcgatgacaaaaggcatgattgggtgtcaaatttgtggtgttgtgatcatttgagttaacgtgacaaactcccaatttgggaggctgtaattttgtgatgtgacatttttattaacattgtatcatattatctttgtttataactttatatagtatgataaattggtcacgtcggtgtcttggcc

SEQ ID NO: 10569 - DNA, 2159 bp, Cichorium intybus
aggaagatgagaataaatatatgttaaatatagggagtatgtttaacgaaaactttttctttggttgaacaagtcagtccttttgtgagatttcaaatcttcttttgagtactacacattgctaggtggtgccgtggtgggtgcttttaaacgcaagagtatatctgatacagcttgcactctctcccccccccccccgatctgaatctcttttttgttcctacatattaattttataaaaagttataatcttgtttgaaaattctgaattgggccttttcagtttccacttaaaaactccattttggtggagtttgagggaattttctgttgtatgcaagtcaaagaccttttttcttcctttttggagttgagtgtcatcatttcccacctttcatcttgaatgggttttgatctttatatataacttctcgatctttaaccaagaaactgctcaagaattgggaaatttccgatctttctgattgatgggggtttgattgatgatatccattggggttgattttagggtttgttttagaagatgacatccggtgatcaagaagttgtaaaattggagtctttacatgtaatgaaatcaaaggggaataagaaaaagaagaaaaacgatgaaggttccgttggatgttggaacaaatggggtttattcggcagttgcgtttcttcaagatctaaagtcgatagctccaccagtggcataagttctcacttcgaaagtaaatcaggaaacgataccagcaaagatcaaccggcggttccgatagttactccgaccaccacaagtaacggtggcgaaaacaatttatcgagtccaaaaccagaggacgaactcaaagttgcttcccgccttcggaaattcgctttcaatgatctaaaaatggcgacgcgaaatttcagacccgaaagtcttctcggtgaaggcggttttgggtgtgtgtttaaaggatggattgaagaaaacggcaccgcacctgtaaaacccggcaccggactcacggttgccgtcaaaacgctaaatcacgacgggcttcagggtcataaagagtggctgacagaagtgaattttttaggcgatcttgttaatccaaatttggttaaattgatcggttattgcattgaagatgatcaacggttgctcgtgtacgagttcttaccacgagggagcttggagaatcacttgttcaggagatccttgcctcttccatggtccataaggatgaaaatcgctcttggtgctgcaaagggccttgctttccttcatgaagaagcaaaacgacccgtgatttatcgtgattttaaaacctccaacattttgttagatgcggaatataacgctaagctttcggactttggtcttgctaaagatggcccggagggtgataagactcacatatccacacgagttatgggaacttacggttatgccgccccggaatatgtcatgacaggacatctgagtacaagaagtgatgtatatagcttcggtgttgtattacttgaaatgttgaccgggcgaaggtcaatggataaaaaccggcccaacggagaacacaacctcgttgagtgggcccgcccgcatttattagaaagaagacggttttaccgcttaatcgacccgcgattagaaggccatttctcaataaaaggagcccaaaaagccgcacagctggcatcccgttgtcttagtcgcgacccaaaagcccggcccttaatgagtgaagttgttgaatgtctcgaacctttgcccgcccttaaagacatggcgggctcttcttattacctacaaacgggtcaagccgatcgggttgggtcgccccggggcgcgggctcgagccgggtcgttttcaagaaacgggcaacagcagccacggactttatcgatacctcgtggctcgcctaatcatcatcagtttcttaaggactcaccaaaaccgaatattcttaaggactcaccaaagccaaatgagaggcgatgacaaagggcatgattgggtgtcaaatttgtggtgttgtgatcatttgagttaacgtgacaaactcccaatttgggaggctgtaattttgtgatgtgacatttttattaacattgtatcatattatctttgtttataactttatatagtatgataaattggtca

SEQ ID NO: 10570 - DNA, 2200 bp, Aquilegia formosa
gaaagaagtaaggttttggttttgggcaggtgaatctatctgcccgaattttccgggcagtttggtttgtggaaatattctctttcactagacaaaaggaaaaaaaaatgttagttttgattacttaatttcataaatttacttcaatttgggcaatttttttgaattgatttctagggttttgtgaacactttaaagggtattttaagctgaaattttagcttttagtgatctggggttatttaagtggtttttaaggaatttgggtattttttagattgtatgattggaacttgggttggtgaatttttgttgatttgaggtgtttaaagtgagattccaaatggggggttttgcttttctggtggattttgattttgaagttataaagttgataatttgaagttaaatttggaaaaaaagttgtgagttttgagagctagatcaaagggggtctttttattggtttttgaagaaattgagagaaatggtattttgaatttgtggattttgtaaagatgggattagttcctgaagatattcagctggaagggtgggatgtggcgaaatcaaaatcgaaatcaaaggggaagaagaacagtataaaagacggtgaagaagaagagaatgatattgggtgttggtttaagttcaggtttatgagaagctgtatatcctcaagatccaaagtcaacagctctataagtggtgcaagcactaattatgctgaaagtaaatctacgaatgacgcaagcagagaccaaacagttgctcctatagtatcttctacaaccaccagtaatgcagaaagcgtcccatgcactcctagagaaggggaggagctaaaaattgcatctcagcttcggaagttcacaaacagcgagctgaagtcagctacacgaaactttagaccagacactatgctaggggaaggtgggtttggttgtgttttcaagggatggattgaggagaatggaactgctgcagcaaaacctggcactgggcttacagttgcagtaaaaactctcaaccatgatggacttcaaggtcataaagagtggctggctgaagttaattttcttggcgacctcctccatcctaatttggtcaaactgattgggtattgcattgaaggcgatcaaagaatgttagtgtatgagtttatgcctcgaggaagcctggagaaccatcttttcaggaggtccttgcctctcccatggtccatcagaatgaaaattgctcttggtgctgcaaaggggcttgcttttctccatgaagaagcagaaagaccagtgatatatcgtgattttaaatcgtccaacatcctcttagatgcagaatacaatgcaaagctctctgactttggacttgctaaagatggtccagagggagataagactcatgtatctaccagagtcatgggaacttatggttatgcagctccagagtatgttatgacagggcatttgacatcaaggagtgatgtgtacagtttcggggttgtcttacttgagatgctaactggccggagatccatggataaaaaccggccaaatggggaacacaatctggtcgaatgggcaagaccacatcttggtgagaggcggcggttttataagctaatagatccacgcctcgaaggtcacttctccatcaaaggcgcacagaaggctgcccaactggcccaccattgcctcagcagggaccctaaagccagacctcttatgagtgaagttgtagaaatcctgaagcctctcccaaatctcaaggacatggcaaactcttctccgtattttcagaccatgcagatggagcgggctggggccaacaacacaaacgctagaaatggcctaagatcacctgcattatctttatcaagaaacgggcaatcaatgaggagtccctcaatctcgaaaggttcacatgcttcaccataccacaactatcatcggtcaccaatgcctactggtaaatagtcatagcaatggatagtgttaatcaccttcttcttcccttgtctttatttttttctcatatttaaaagtaaatatcaccagtctgggcttttgagttttgtggtactggtcaaatattgaggcagtatgtcaacttcatgctgctgcattggtcttttaaagccgagtagaatcttgttaatgccaatgtccaatgaaatggttaatggaaatagactttacag

SEQ ID NO: 10571 - DNA, 2593 bp, Cocos nucifera
gcagattcatctactgcatataaaatttttgaggtcatctatgcaaaaatatccacatcaagacaactcgcagcatcctacctccctcggtctttgctaaattcccactccctgcccgttctgcccgcattttccgcactctcgtgcctctccccctgcccgacctgcccgtctctttttctctgttctcttccccgttcccacactcttctcctcttccctccccctttatctctaagccaagccgtcgttctcttttcttccctcaccgtccaatgctcgctgacgccgttacctcgcgcagctgcccgcttactgtttccctcgcctgaggcccccaagggtcccacccacgcagcccttcgggcaggggaccgtgtccagttctccactccgccaccacttccgtctccaagcgagttctaaagctccctcggcgaggaagcccctagggtttcggagattccgaggagaaatctcgagctccctggccgttcttcgatctcggtaccactccacctcgttcgattctctcttcttggtttagggtttcgagctctggattcgttgattactgttccgaagtggtaatcttggtttcctgtagcgcttttgatgtagatttgtggagatatttttggcggagaagagtttttaggggcgatctctaacgaaggaatctatccgggagagagggattcggcttccctttctcggatctttgatttcgagttgggatgagattttgagggatggggttgggtccggaggaggttaaattggagggatggggcagcgttgggaaagggaagcacaaggggagtaagaagaagaagaagagcgaggcgagggaggagcagactggatgttggattaagttcagattgatggtgagttgcatctcgtcgagatccaaggtggacacatccatcagcagtgccagcactcattgcgaaagtaaatccacaaatgatggtagcagggaccaaccagctgcaccagtagtctctggttccacaaccactagtaatgctgaaagcaattcatctacttctaaagtaggtgaagaattaaaagtttcatctcagttgcggaagttcactttctgtgagctcaagtctgcgacaagaaactttagaccagagagccttctcggagagggaggttttggttgtgtcttcaaaggatggattgaggagaatggaactgctcctgtgaaacctggtacagggctaaccgttgctgtcaaaacactcaaccatgacggacttcaagggcataaagaatggctggcggaagttaattatcttggcgagcttcaacatccaaatttagtaaagttgattggttactgtattgaagatgatcaaagactgctggtatatgagtttatgcctcgaggaagtcttgaaaaccatcttttcagaaggtccctgcctctcccatggcccatacgaatgaagattgctctgggtgctgcgaggggacttgcttttcttcacgaggaagcggaaagaccagtgatatatcgtgattttaaaacatccaacattctattagatgcggactataatgcaaagctttcagactttgggcttgctaaggatggtcctgagggtgataaaactcatgtgtcaacacgagtgatgggaacatacggatatgcagctccagaatatgtaatgaccggacatctgacatcaaagagtgatgtctacagttttggggttgtgctacttgaaatgatgacagggcgaaggtccatggacaaaaaccgaccaaatggtgagcacaacctggtggagtgggcacgcccccatctaggagaaagacgacgcttcttcagacttatagatcctcgcctggatggcaacttctcaatcaaaggtgccctgaaagctgcccagctggcacatgcctgtctcagtcgtgatcccaagtccaggcccttaatgagtgaagtagtggaagtcctcaaaccattaataaaccttaaagacatggcaagctcttcgtacttctttcagtcaatgcaagccgaacgtgctgcagcaaacagcaataaccagactggaagaaatggtttgaaatcacaggcttcgtttccaagaaatgggcaccagcctgtaagaagcctctctaatggttcacatccttcaccataccgccagtcgccaaagcccaacgacaaacaagcatgaacgcatatattcctgtaagttattccgcggaattggagatcttgaatggcgagaagtatgcaggactgtggtgatctctgtgttgtatatctggtgataggaagtctgagggctcctgtggataaaggttgatggaggtgtgtgggactgaagtcaacctttgttggtctcaacttacctgaaaagaattgactcttgaagatatttataatttgatgctaccattgtcttgtcttgttaaagtaattgtcggttgcttgatatagtcaattgagttgaagaaggttttacagggttatcaggtttgttctcggggcttgaacagtttgtgaatgattcttactgaaggatcgtcgggaatgttcctatttttccccatttcttttcttttt

SEQ ID NO: 10572 - DNA, 2271 bp, Citrullus lanatus
ggaaaataatttccttttttcttccctatctttttatttaatttttattttctccggcataaaatttataactctaccagcttaaaactaatctggttgttcttgttggaaacccatcttggagataatctgtatctttgggggcagagatttgtaagttaagctgcgaaagactgcgagtatcattgtcttttgatggaagaggagacttctttatgagctcattctagttgatccatttgttttgcctttggaagggtttctcttggaattcatcgaatttttatacgatctggtaatcttcttctcaactgggtctcaactgggtgtcttcttctttttgccctaagtgaaacatggtaaatttgagtgatcttttggtaggtttcacttgcgctgtttcaaggagaagttaactagctggggttgaagtagcgactcgagggaaggtgaggcactggatggtgtttcggattccaggagttttatgattatctgtgttcttttgggtacttaagctatggaggtaatcgctgaagatgggaaagttgagtctcgggaagtgagggaatcgaaggggaagaagaagcagaagaacaacaaggaacaagttgaaactgtggaagaggagactggttgttggattgctctgaggatttttggtagctgcatttcttcgagatccaaagttgatagttcgataagtgggactagtatcaactatgctgaaagcaagtctacggctgattcaagtagagaccaaccaacacctagagacatatcttcaacaaacacaagtatgagtaatgcagagagtaattcatcaacttccaaattagaagaggaacttaaaatttctcctcatctacggaaattttcattcaatgatcttaagttggctacaaggaacttcagacccgagagtcttcttggtgagggtggttttggttgtgtttttaagggttgggttgaagaaaatggaactgctccagttaaacctggcacaggactcactgttgctgttaaaaccctcaaccatgatggtcttcagggccacaaagaatggatggctgaagtgaattttctcagtgatctcaaacatcccaacttggtcagacttattggttactgcaatgaagatgatcaaagactgcttgtatatgagttcatgcctagaggaagcctggagaatcatcttttccggagatctctaccccttccgtggtctattaggatgaaaattgcactaggtgctgccaagggtcttgcttttcttcatgaggaagcaaaaagacctgtgatatatcgtgattttaaaacatccaacatcctattagatgctgaatacaatgccaagctttctgattttggacttgcaaaagatggacccgatggagataaaacccatgtctctactcgtgtgatgggaacatatggctatgcagctccagaatacgttatgactggacatcttacatccaggagtgatgtttacagttttggggtggttcttctcgaaatgttaactggcagaagatccatggataaaaaccgtcctaatggtgagcataaccttgtcgaatgggcacggccatacctaggagagaaaaagagattctatcgcttgatagatcctaggcttgaaggtcatttctcaataaaaggtgcccaaaaagcagtacaattagctgctcagtgccttagccgagatcaaaaggtcagacctttgatgagtgaagttgttgaagccttgaagcctctcccaaacctcaaggatatggcaagttcatcttattattttcagacaatgcaagctgaccgcatacgatccagcccaatggcgagaaacggctaccacacagcagctggaccggttccaaagaacgggcagcaactacgcagctattcagtcgcgaatggttctcatgcttctccatatcatcatcagcaaccccatccatctccgaaacccaatgtcaaagcctaagaattgggttgtttggtaattaattagtaattatctagttgtgttaacccatctcattttgtcatcaaatagatctccccctacctcagtatagatagatgtttattttgcaaaacagcatttgctggtggatcattggaaatgctacagacagagatgtctgcactatcatcttgttaaaatgggaaacctggcagaaagagtatgatagcagatgaattttgttcatcgattttcaatgtcatattgttttgggaaagaacagacaaatctcaatctctctt

SEQ ID NO: 10573 - DNA, 1488 bp, Silene vulgaris
tgttgataatgtagatgttgatgatgaagaattaggtgtaaacactggttgttgggttaaattaaggttaagtagttgcatcagttcaagatccaaagttgatagttctgtcagtggaagtagtactaactatgctgagagtcaatcaacaaatgatgctagtagagatcaaccagcaactgcagttgtctcatctacgacaacaagtaacgctgaaagcagcacctcaacatccaagttggaagaagaactcaaaatttcttgccgccttcggaaattccaatttaatgacttgaagttagcaactaggaactttagacctgagagtctacttggcgagggtggtttcgggtgtgttttcaaaggatggattgaggagaatggtactgctcctgtcaaacctggtactggtctaactgtagccgttaaaacactcaaccatgatggactccagggtcacaaagagtggctggctgaggtgaattacttgggtgagctaattcatgcaaatctggtcaaacttattggctattgcatcgaagatgatcaaaggttgctagtttatgaattcatgcctcgaggaagcttggaaaaccatcttttcaggagatctctacctcttccatggtcactcaggatgaaagttgctttgggagctgccaagggtcttgcgtttcttcatgaagaagctgaaaagccagtgatatatcgtgattttaaaacctccaatatattgttagatgcggaatacaatgctaaactgtcagatttcggacttgctaaagatggacccgaggaaggcaaaactcatgtatccacccgcgtgatgggaacgtatggttatgcagcccctgagtatgtaatgacaggccatctgacatcaagaagcgatgtttacagctttggagttgttttactcgaaatgatcactggtaggagatctatggacaaaaaccggccaaatggggaacacaaccttgttgagtgggccaggccacatcttggagatcgaagaaggttttaccgtctaatagaccctcgtcttgaaggtcatttctctataaaaggcgctcaaaaggctgtccagttggctgctcactgccttagccgagaccccaaagcacgtcctgtaatgagtgaagttgtagactctttgaagccactaccgaacctaaaagacatggcaagctcatcgtactatttccagacaatgcaggcagatcgtgttagggccaaccaaattgctcgaaatggccaagctcaagcggcccaccacaggaatgggcagcaacccggcctgagaagtctgtcaataccaaatggttctcatgcatctccatataaccatcatcaatcgcctaaacccaccgggaaatcttagctttgtggggtttatccattacttttccccgagatggcgatgactcttttgccttagtttccaattggtaggtagagcttgatatcatagcagaagaggagagaaaa

SEQ ID NO: 10574 - DNA, 1590 bp, Triticum aestivum
tcggcacgaggcagccacccatccagccattgagcccctctcctctcctctcctcgccgaatccagcccggcgttcgctgtccgacatccccaccaattcggcgcgccgcacgtgcgtacgtataacacatcggtcgcccgatcaatggctctgctcaaggccgcgcgcgtcgccgacgtccccaccctcgacgtcgtcgtgccggaccacctcgccgccgccgccgcgcgggtcctcgacgcggaggcggcgtcgatggtgaagaagcagcggggcgcgggccggcggttcgcggtgatcgggcaccgcggcaaggggatgaacgcgctggcgtcgccggaccggcggatgcaggaggtgaaggagaactcggtccggtcgttcaacgaggcggcgcgcttcgccgtcgactacgtcgagttcgacgtccagggtcaccaaggacgtctgcccagtcatcttccatgacaacttcatcattactgaagaacatggcaaaatttcagagaagcgtgtcactgatcttcagttggaagatttcctccagtatggcccacaaaacaagcaaggcaagaatgggaagcctttgctgcggaaaatgaaggacggtcgggtgttgaattggaacgtccagtcagatgatcctctttgcacccttcaagaagcattcgagaaggtcaatccaagattgggcttcaatgtcgagctgaaattcgatgacaatcttgtgtaccaagatgaggagcttactcacatcctccaggccatcctcaaggtggtcttcgagtgtgccaaggataggcccatcattttttctagcttccagcccgatgctgcgcagctcatgcgaaaactgcagagcacataccctgtgtacttcttaacgaacggagggacggaaatctacgccgacgtgaggaggaactcgttggaagaggcggtcaagctgtgccttgccagcggcatgcaagggattgtgtccgaggcccgcgccgtcttcaggttcccgaccgctatacccaagatcaaggaggctgacctctccctactaacttacggcactctcaataacgtgccggaggcggtgtacatgcagcacctgatgggggtgaacggggtcatcgtcgacctcgtgccggagatcactggggctgtctctgatctcatcgccctcccggagaccgatacagagatcaatgatctgagcggcaaggtggtgaaagatgccgcatcgacgccgaatttcacacagcgggagatctcgttcctgctgaggctgatgccagagcttgtgcaatagcacagattgcacaccattaactcatggctttggatgtaactgattgattggcatgcaggacaggaggagccccttgtggaggaaagcacaggtttacatactgggttggtgtgatgtccttcggtgagccctggtactgggagagttggggattgatatgatatgtacatgttgtagtgtgggtggcgaaatttttggatatacatgttgtagtgaatgtcaccgtcacaatggaccgtgttactaaactaatacatgatcctgggtctggtatccagcattttcgatc

SEQ ID NO: 10575 - DNA, 1613 bp, Secale cereale
acgcgcgtacgtataacacgtcgaccggccgatcaatggctctgctcaaggccgcgcgcgtcgccgacgtccccacctccgacgtcgtcgtgccggaccgacctcgccgccgccgctgcgcgcgtcctcgacgcggaggcggcgtcgatgatgaagacgcagcagcgcgccgcgggccggcattcgcggtgatcgggcgaccgcggcaagggagtgaacgcgctggcgtcgccggatcggcggctgcaggaggtgaggagaactcggtccggtcgttcaacgaggcggcgcgcttcgccgtcgactacgtcgagttcgacgtccagtgtgcaaagatgttgagaagcgaaccatgaatatcaattttgtaggtgaccaaggacggctgcccagtcatcttccatgacaacttcatcattactgaagaacatggcaaaatttcagataagcgtgtcactgatcttcagttggaagactttctccagtatggcccacaaaataagcaaggcaagaatgggaagcctttgctgcggaaaatgaaggacggtcgggtgttgaattggaacgtccagtcagatgatcctctttgcacccttcaagaagcattcgagaaggtcaatcctagattgggcttcaatgtcgagctgaaattcgatgacaatcttgtgtaccaagatgaagagctcactcacatcctccaggccatcctcaaggtggtctttgagtgtgccaaggataggcctatcattttctctagcttccagcctgatgctgcgcagctcatgcgaaaactgcagagtacataccctgtttacttcttgacgaacggagggacggaaatctacgccgacgtgaggaggaactcgttggaagaggcggtgaagctgtgccttgccactggtatgcaagggatcgtgtccgaggcccgtgcaatcttcaggttcccgacagctataccgaatatcaaggaggctgacctctccctgctaacttacgggacactcaataacgtgccggaggcggtgtacatgcagcacctcatgggggtgaacggggtcatcgtcgaccttgtgccagagatcacgggggctgtctctgacctcatagccgtcccagagacagacgcggagatcaatgatctgagcagccaggtggttaaagatgccgcgtcgacgccaaatttcacacagcgggagatttcattcctgctgaggctgatgccggagcttgtgcaataacacagattgcaccccgctcatgactttggatgtaactgactggcatacaggaagaggagccccttgtggagggaagtacaagtatatgtactgggttggtgtaatgcccttcggtgagccctggtcctaggagaattgggggttgatttatacatgttgtagcgagggggcattgatttatacatgttgtagcgagggtggtgatttttttggatatacagttagtgtcaccgtcacaatggcggtgttattactaaactagtactccctcatattgaatatgttagggcatctccaacgcagaacaacatgcaggtgcggaccacgctgtccggacatgttgtgccatccaacatgagcttgtatcagttcaaa

SEQ ID NO: 10576 - DNA, 1297 bp, Avena sativa
gcacgtgcgtggatcggttcctcagattggtgggtggatcgatcaatggctcagctcaaggccgtccgcgtctccgacgtgccgaccctcgacgtcgtcgtcgtcccggacattgacgttggctctgccgcggcgtcggcgaagcagaagcagcagcagcgcggtgctggcggcgcgggtcggttcgctgtgatcgggcaccgcggcaaggggatgaacgcgctgtcgtcgccggaccggcggctgcaggaggtgaaggagaactcggtgaggtccttcaacgaggcggcgcgcttccccgtcgactacgtcgagttcgacgtccaggtgaccaaggacgcctgcccagtcatcttccatgacaacttcatctatacccaagaacagggtaaagtttcagataagcgtgtcactgatcttcacttggaagaattcctctggtatggcccacaaaaggaggggaagagtgggaagcctttgctgcggaaaatgaaggatggtagaatagtgaattgggatgtgcaatcagatgatcctctttgcacccttcaagaagccttcgagaaggtcaacccgagattaggcttcaacgtagagctgaaattcgatgacaatcttgtataccaggaggaagagcttagtcgcatcctccacgccatccttaaggtagtctttgggcatgccaaggacagacccatcattttctctagcttccagcccgatgctgcacagctcatgacgaaaattgcaaagcacataccccgtttactttttgaccaacggagggacagaaatctacgccgacgtgaggaggaactcgttggaagaggcactcaagctgtgtcttgccagcggcatgcaaggtatcgtgtccgaggcccgcgcagtattcaggtttcctgccgctataccaaagatcaaagacgccgacctctccctactgacttacggaacattgaataacgtgccggaggcggtggtacatgcagcacctgatgggagtgaacggggtcgatagtggacctcgtgcccgagatcaccaaggccatctccgatctcatcgccgtgccgcagactgacatgaaaatcgacgatttaagcagcaaggttgcgacatcgacaccaaatttcacgcggcgggagatctcgttcctgctgaggctcatgcctgagcttgtgcaatagcacaatcctagatgtaactgactggcatacaggaacagggagaaccctttgagtgagggtagtaaaattatatgtagtttgatgggatgtcttactgtgagccctcgtcctg

SEQ ID NO: 10577 - DNA, 1778 bp, Zea mays
ccggggactctggctatagggagtagcgacgaccttagctagcaatagcagccagcaggaactgtagattgctgctgggcaacagactgagagttgcttgcgctgcggcagcggagaagagagatgattgctgttcgatgggcggcgctgctggtcgcgctggtggtggcgtgcggcagcgctgctgcaggtgcagcggcgggggaaggacctaactggctgggcgggctgagccgggcggcgttccccaaggacttcgtgttcgggaccgcgacgtcggcgtaccaggtcgagggcgccgcgtccaccaacggccgaggcccctccacctgggacgcgttcgtgcacaccccaggaaacattgtatacaatcagacggcagatgtcgcagtggatcaatatcatcgctacagggaagatgtcgacctcatgaaaagtttgaattttgatgcctaccggttttcaatctcatggtccaggatcttcccagatggcgagggaagagtcaatccagaaggtgttgcctattacaacaatctgataaactacctgcttcggaaaggcattacaccgtacgccaatctttaccattccgatctccctcttgcgcttcagaacaagtatggagggtggttaaatgccaagatggcgaaactgttcacagactatgccgacttctgttttaagacttttggcgaccgtgtaaagcattggtttacattcaatgagccaaggatagtagcactacttggttatgacgctgggtcgattcctcctcaaaggtgtaccaaatgctctgctggtgggaattcagcaacggaaccttatatcgttgctcataattttctcttgtcacatgctgctgctgtgtcaagataccgtaacaagtatcaggctgctcagaaaggaaaggttggaatagttctggacttcaattggtatgaagctctcacaaactcaaccgaagaccaagcagcggctcaaagagcaagggatttccatgttggttggtttgctgatccattaataaatggacattatccacagataatgcaagatattgtgaaagagaggctgcccaagtttactccggagcaagctaagttggtcaagggctcagcggattacattgggatcaatcaatacaccgctagctacgtgaagggccagaaactgctccagcagaagcctactagctactcagctgattggcaggttcaatatgttttagaacggaacggcaaaccgatcggaccacaggcgaattcaaagtggctttacatcgtcccagaagggatgtacggttgtgtgaactatctgaagcacaagtatggaaatccaacagttttcataaccgagaacggaatggatcagccaggaaacttgactcgtggccagtacctgcacgacaccacaagggtgcaattctacaaaggctacctcgctgagctgaggaaagccatcgatgacggcgccgacgtggctggctacttcgcttggtctctcctcgacaacttcgagtggcagtcaggttacacgtccaagtttggaatcgtctacgtcgacttcagcacgcccaagctcgaacgacaccccaaggcgtcagcctactggttcagagacatgctccagaaacacttatgagcgtctaacaaccaagcctgaaataggtaccattaaatttcttcagcgttgcctaagctagtggccatattattgtagcaaaagttgtaagctagcacagtgcaagggtatcaaaaattataaacgggcaatga

SEQ ID NO: 10578 - DNA, 1739 bp, Secale cereale
cgagttggcagtggccagtgggtgggtgtgaacagtggacaagagtgtgccactgccgcactgcgtcgtgcgagcgccgagcggggtcggtcggtcggcggcgagatggccgcgagccgcgtgctgctgctgctggcgctggtggcggcgtgccatggcgtgagcgccgcgggcgcgggggcgacgccgcgccgggccaactggcttggcgggctgagccgggcgtccttcccaagggcttcgtcttcgggacggccacgtcggcgtaccaggtggagggcatggccaacgccggcggccgcgggccctccatctgggacgccttcgcccacgtcccaggaaacatcgcgggcaatcaaaatgcagacgttactacggatcagtatcatcgctacaaggaagatgtcaatctcatgaaaggactaaatttcgacgcctaccggttttcgatctcatggtcgagaatcttcccagatggtgacggaaaagttaaccatgaaggcgtcgcgtattacaacaatctgataaactaccttcttcagaaaggcattactccttatatcaacctttaccactacgatctccctcttgcgcttgagaagaagtatggaggctggttaaatgcaaagacggtgggactatttgcagactacgctgacttttgttttaagacctttggcgatcgtgtaaagcactggtttacattcaacgaaccaaggatagttgcgcttcttggttacgatgtagggtcgaatcctcctcagaggtgcagcaaatgcgctgccggtggcaactcagcaacagaaccttacattgttgctcacaattttctcttagcacatggttatgcagttgcaagataccggactaagtatcaggcagctcagaaggggaaggttggaatagttctggacttcaactggtacgaggctcttaccaactcaactgaagaccaagcagcagctcaaagagccagggacttccatgttggctggtttgtcgacccgctaataaacgggcattacccacagataatgcaagaccttgtgaaagagaggttgcccaggttcactcccagtgaagctaaactggtcaagggctcagcagactacattgggatcaaccaatacaccgccagcctcatgaagggacagaaactgctgcagcagacgccgaccagctactcggccgattggcaggtcacctatgcctttgagagaaatggcaaaccgattggaccaaaggcgaattctaactggctttacatcgtcccgtcggggatgtacggatgcgtgcactacctcagccagaagtatgggaatccacctattgtcataaccgaaaacggaatggatcagccgggggggctcacccgggaccagtacttgcgggacgcgacgagggtccggttctaccggagctaccttggcgagctgaagaaggccatcgacggcggcgccaacgttctcggctacttcgcgtggtctctcctcgacaacttcgagtggatctccggctactcgtccaagttcggcatcgtctacgtcgacttcaacagccccaccctggaccggcaccccaaggcgtcggcctactggttccgagacctgctgcaacactgatgttgtcatcatcatcaccacgatcattctgagtttgtgcctactgttgttcgaatggaaccataattcagactgctaccaaatgagaataaaaagttggcatgatagttcagtgtt

SEQ ID NO: 10579 - DNA, 1881 bp, Secale cereale
ctaccagtcgcaggccagtgggtggtgggcgtgaacagtgaccaagcaagagtgtgccactgcttcgtgcgagcagcgccgagcggggtccgtcggtcggtcggcggcgagatggccacgaggtcggcgctgctgctgctgctgctgtcgctggtggtggcggcgtgccatggcgtgagcgccgcgggcgcgggggcacgccgcgccgggccaactggctgggcgggctgagccgggcgtccttcccaagggcttcgtcttcgggacggccacgtcggcgtaccaggtggagggcatggccaacgccggcggccgcgggccctccatctgggacgccttcgcccacgtcccaggaacatcgcgggcaatcaaaatgcagacgttactacagatcagtatcatcgctacaaggaagatgtcaatctcatgaaaggattaaatttcgatgcctaccggttttctatctcatggtccagaatcttcccagatggcgacggaagagttaaccaagaaggcgtcgcgtattacaataatctgataaactaccttcttcagaaaggcattactccttatatcaatctttaccactacgatctccctcttgcgcttgagaagaagtatggaggctggttaaatgcaaagacagtgggactatttgcagactacgctgacttttgctttaagacctttggcgatcgtgtaaagcactggtttacattcaacgaaccaaggatagttgcgcttcttggttacgacgtagggtcgaatcctcctcagagatgcagcaaatgcgctgccggtggcaactcagcaacagaaccttacatcgttgctcacaattttctcttggcacatggttatgcagttgcaagataccggactaagtatcaggcagctcagaaggggaaggttggaatagttctggacttcaactggtacgaggctcttaccaactcaactgaagaccaagcagcagctcaaagagccagggacttccatgttggctggtttgtcgacccgctaataaacgggcattacccacagataatgcaagaccttgtgaaagagaggttgcccaggttcactcccagtgaagctaaactggtcaagggctcagcagactacattgggatcaaccaatacaccgccagcctcatgaagggacagaaactgctgcagcagacgccgaccagctactcggccgattggcaggtcacctatgcctttgagagaaatggcaaaccgattggaccgaaggcgaattctaactggctttacatcgtcccgtcggggatgtacggatgcgtgcactacctcagccagaagtatggaaatccagctattgtcataaccgaaaacggaatggatcagccggggggctcacccgcgaccagtacttgcgggacgcgacgagggtccggttctaccggagctacctcggcgagctgaagaaggccatcgacggcggcgccaacgttctcggctacttcgcgtggtctctcctcgacaactttgagtggatctccggctactcatccaagttcggcatcgtctacgtcgacttcaacagccccaccctggaccggcaccccaaggcttcggcctactggttcagagacctgctgcagcactgatggagtgcctctgatgttatcatgaccatcatgttgagtttctgcctggtgttgttcgaatggcaccatgattcagacctcagagccagctcggttctggagttatctaatgggaataaaagatggcgcgatatttgagtcttgcatttcatgtttcttttctctgtcaatgagcatttttttttttgcgagagaaatattgtattactcaatcatatagtccttacaatcaacgagggctagagcc

SEQ ID NO: 10580 - DNA, 1698 bp, Secale cereale
cgagttggcagtggccagtgggtgggtgtgaacagtggacaagagtgtgccactgccgcactgcgtcgtgcgagcgccgagcggggtcggtcggtcggcggcgagatggccgcgagccgcgtgctgctgctgctggcgctggtggcggcgtgccatggcgtgagcgccgcgggcgcgggggcgacgccgcgccgggccaactggcttggcgggctgagccgggcgtccttccccaagggcttcgtcttcgggacggccacgtcggcgtaccaggtggagggcatggccaacgccggcggccgcgggcctccatctgggacgccttcgcccacgtcccaggaaacatcgcgggcaatcaaaatgcagacgttactacggatcagtatcatcgctacaaggaagatgtcaacctgatgaaaggattaaatttcgatgcctaccggttttctatctcatggtccagaatcttcccagatggtgatggaaaagttaaccaagaaggcgtcgcgtattacaataatctgataaactaccttcttcagaaaggcattactccttatatcaatctttaccactacgatctccctctcgcgcttgagaagaagtatggaggctggctaaatgcaaagacagtgggactatttgcagactatgctgacttttgttttaagacctttggcgatcgtgtaaagcactggtttacattcaacgaaccaaggatagttgcgcttcttggttacgatgtagggtcgaatcctcctcagaggtgcagcaaatgcgctgccggtggcaactcagcaacagaaccttacatcgttgctcacaattttctcttggcacatggttatgcagttgcaagataccggactaagtatcaggcagctcagaaggggaaggttgggatagttctggacttcaactggtatgaggctcttaccaactcaactgaagaccaagcagcagctcaaagagccagggacttccatgttggctggtttgtcgacccgctaataaacgggcattacccacagataatgcaagaccttgtgaaagagaggctgcccaggttcactcccagtgaagctaaactggtcaagggctcagcagactacattgggatcaaccagtacacggctagcctcatgaaggggcagaaattgctgcagcagacgccgaccagctactcggccgattggcaggtcacctatgcctttgagagaaatggcaaaccgattggaccaaaggcgaattctaactggctttacatcgtcccgtcggggatgtacggatgcgtgcactacctcagccagaagtatgggaatccacctattgtcataaccgaaaacggaatggatcagccgggggggctcacccgggaccagtacttgcgggacgcgacgagggtccggttctaccggagctaccttggcgagctgaagaaggccatcgacggcggcgccaacgttctcggctacttcgcgtggtctctcctcgacaacttcgagtggatctccggctactcgtccaagttcggcatcgtctacgtcgacttcaacagccccaccctggaccggcaccccaaggctcggcctactggttccgagacctgctgcaacactgatgttgtcatcatcatcaccacgatcattctgagtttgtgcctactgttgttcgaatggaaccataattcagactgct

SEQ ID NO: 10581 - DNA, 2202 bp, Secale cereale
tcagctccttcctcctccgtgaccgtgagcgagggtggacaccgtaacccacgcggcgttatcaccggcgcccggccgtgtccgtccgtcagcctcgaccacgcgcgcgcaccgccaggaaaagatgccctccgccccgccccaccgcgccggcaattattaggacgcgcccacaaatactgctcgaggagcgtgccgctgccctggcactagagacagccagctaccagtcgcaggccagtgcgtggtgggcgtgaacagtgagcaagagtgtgccaccgcgtcgtgcgagcggtcggcggcgagatggcggcgaggtcggcgctgctgctgctgctgctgtcgctggtggtggcggcgtgccatggcgtgagcgccgcgggcgcgggagcgtcgccgcggcggcccaactggctgggcgggctgagccgggcgtccttccccaagggcttcgtcttcgggacggccacgtcggcgtaccaggtggagggcatggccgccggcggcggccgcgggccttccatctgggacgccttcgcccacgtcccaggaaacatcgcgggcaatcaaaatgcagacgttactacggatcagtatcatcgctacaaggaagatgtcaatctcatgaaaggattaaatttcgatgcctaccggttttctatctcatggtccagaatcttccagatggtgacggaaaagttaaccatgaaggcgtcgcgtattacaacaatctgataaactaccttcttcagaaaggcattactccttatatcaatctttaccactacgatctccctctcgcacttgagaagaagtatggaggctggctaaatgcaaagacagtgggactatttgcagactatgctgacttttgttttaagacctttggcgatcgtgtaaagcactggtttacattcaacgaaccaaggatagttgcgcttcttggttacgatgtagggtcgaatcctcctcagaggtgcagcaaatgcgctgccggtggcaactcagcaacagaaccttacattgttgctcacaattttctcttagcacatggttatgcagttgcaagataccggactaagtatcaggcagctcagaaggggaaggttgggatagttctggacttcaactggtatgaggctcttaccaactcaactgaagaccaagcagcagctcaaagagccagggacttccatgttggctggtttgtcgacccgctaataaacgggcattacccacagataatgcaagaccttgtgaaagagaggctgcccaggttcactcccagtgaagctaaactggtcaagggctcagcagactacattgggatcaaccagtacacggccagcctgatgaagggccagaaattgctgcagcagacgccgaccagctactcggccgattggcaggttacctatgcctttgagagaaatggcaaaccgattggaccaaaggcgaattctaactggctttacatcgtcccgtcggggatgtacggatgcgtgcactacctcagccagaagtatgggaatccacctattgtcataaccgaaaacggaatggatcagccgggggggctcacccgcgaccagtacttgcgggacgcgacgagggtccggttctaccggagctacctcggcgagctgaagaaggccatcgacggcggtgccaacgttctcggctacttcgcgtggtctctcctcgacaacttcgagtggatctccggctactcgtccaagttcggcatcgtctacgtcgacttcgacagccccaccctggaccggcaccccaaggcttcggcctactggttcagagacctgctgcagcactgatggagtgcctctgatgttatcatgaccatcatgttgagtttctgcctggtgttgttcgaatggcaccatgattcagacctcagagccagctcggttctggagttatctaatgggaataaaagatggcgcgatatttgagtcttgcatttcatgtttcttttctctgtcaatgagcatttttttttttgcgagagaaatattgtattaatcatatagtccttacaatcaacgagggctagagccaaagaaacatccgggccagaggataaccaggtcatagttctgccctcaactctagcaaatttagctaaactatcattaacattattttgagtgcggtaaatatgagtactacaacattcacgtagtc

SEQ ID NO: 10582 - DNA, 2079 bp, Sorghum bicolor
aggaagaggatcgcgccagccactgcaatcgacagggcgacccataaacaatccaaagtctccaagaaaagtagacgcgcacgacttggataatcgctatccggaccagccgtgccgtgccgtcgtagtcaggaagatgccacgccggggactgtagctgtagcctgttggggtggtgagtggtgacaacccctatctagcaggacaggaggcagtagtgctactgccacccaaaccgttagcttcaggagcccggaggccggagccagtgggcaacagagtgagagttgctttgcttgcgccgaggcaggggacaggagatggttgctgctcggtggacgggggcgctgctgctcgcgctgctggtggtggcgtgcggcggcgcgcgtgcaggtgcagcggcagcggcggcggccgggggaggaggagccggagcgagctggctgggcgggctcagccgggcggcgttccccaggggcttcgtgttcgggaccgcgacgtcggcgtaccaggtcgagggcgccgcgtccaccaacggccgcggcccctccacctgggacccgttcgtgcacaccccaggaaatattgtagggaatcagactgcagacgtcgcagtggatcagtatcatcgctacagggaagatgttgacctcatgaaaagtttgaattttgatgcctaccggttttcaatctcatggtccaggatcttcccagatggcgagggaagagtcaatccagaaggtgttgcctattacaaaaatttgataagctacctgcttcagaaaggcattactccatacgccaatctctaccactccgatcttcctcttgcgcttcagaacaaatatggaggatggttaaaccccaagatggcgaaactgttcacagactatgctgacttctgttttaagacttttggagatcatgtaaagcattggtttacattcaatgagccaaggatagtagcactacttggttatgatggtgggtcgattcctcctcaaaggtgtaccaaatgtgctgctggtgggaattcagcaacggaaccttatatcgttgctcataattttctcttgtcacatgctgctgcggtggcaagataccgtaataagtatcaggctgctcagaaaggaaaggttggaatagttctggacttcaattggtacgaagctctcacaaactcaactgaagaccaagcagcggctcagagagcaagggatttccatgttggttggtttgctgatccattaataaatggacattatccacagacgatgcaagatattgtgaaagagcggctgcccaagtttactcctgagcaagctaaattggtcaagggctcagcagattatattgggatcaatcaatacacagctagctacattaagggccagaaattgctccaacagaagcctactagctactcagctgattggcaggttcaatatgcttaacggaatggcaaaccaattggaccacaggcgaattcaaactggctttacattgtcccatcggggatgtatggttgtgtgaactatctgaagcagaagtatggaaatccaacagttttcataactgagaatgtacttgcacgacaccacaagggtgcaattctacaaaggctacctcgctgagctgaagaaagccatcgacgatggcgcgaatgtggctggctacttcgcttggtctctccttgataacttcgagtggcagtcaggttacacgtccaagttcggaatcgtctacgtcgacttcagcacgcccaagctcgaacgacaccccaaggattcagcctactggttcagagacatgcttcagaaacactgagtgtctaacaaccaagcctgaagtagttaccattaaatttcttcacgttgcctaagcgtgtttggctggccatattattctagcaaaagctgtaagccagctcagtacaagggtatcaaaaatggagtaaaagatgataaacggaaaatcaatttgcgagttccatgtgtttgatctgtttgcatccttgctttttctactcaagctaacatattgacttttcataagacggctactagagccacctaatca

SEQ ID NO: 10583 - DNA, 1604 bp, Panicum virgatum
tttttgtgcctattaagactttcaaatgaccaggaaatgttgtgggaaatcaaaatggagatgtcgcggtggatcaataccatcgctacaaggaagatgttgatctcatgaaaagtttgaattttgatgcctaccgattttcaatctcatggtccaggatcttcccagatggagagggaagagtcaatccagaaggtgtagcatattacaacaatttgataaactacctgctccagaaaggcatgactccttacgtcaacatttaccactacgatcttcctcttgcactcgagaagaaatacggagggtggttaagctcaaagatggcagacctgtttacagagtatgctgacttctgttttaagacctatggcgatcgtgtaaagcactggtttacattcaatgagccaaggatagtagcagcgcttggttatgacgctgggtcaaatcctcctcaaaggtgcaccaaatgcgccaatggtgggaattcagcaaccgaaccttatattgtagcccataattttctcttggcacatgctgctgcagttgcaagataccgtacaaagtatcaggctgctcagaagggtaaggttggtatagttctggacttcaactggtatgaacctcttacaaactcacctgatgaccaagcagctgctcaaagagctagggacttccatgttggctggtttgttgatccattgataaacggacattatccacagataatgcaagatcttgtgaaagagagactgcccaggttcactcctgagcaagctaaattggtcaagggctcagcagactatatcgggatcaaccagtacacagccagctacatgaagggccagaaattgctccagcagacgcctactagctactcagatgattggcaagttcaatatgttcatgaaaggaatggcaaaccaattggaccacaggcgaattctgattggctttacatcgtcccgacgggaatgtatggatgtgtgaactacctcagggagaagtatggaaatccaacagtctacataaccgagaatggaatggatcagcctggaaacctgacccgcgaccagtacctgcgcgatgtgacaagggtgcggttctacaagagctacatcggccagctgaaaagggccattgatcagggcgctaacgtggctggctacttcgcgtggtctctccttgacaacttcgagtggcggtcaggatactcgtccaagttcggcatcgtctacgtggacttcaacacgctcgaacggcacccgaaggcttcggcctactggttcagggacatgcttaagaagaattgagatttctagaggccaagcctgaagttaccattttgctcagctttgccttgtgtttcggatggccgccatggttcgagcgtgctaggctgtcaaaatgggaataaaagaagaacagaacagccgctccaaattgtgcattccatttatgattatggccagaacgttgtatgtttcctgtggagtttgagctgtgtgattgttgattgaaatatttaaaatacttgatcacgagtggtgtccaaaattaggggggcggcgagcgcccgtcctaacaaactgcaacaaaaacaa

SEQ ID NO: 10584 - DNA, 2479 bp, Panicum virgatum
cggctccttttgccgtggtcgtactcgtgcttcttcaccgcgcggcgagcggagccgagcagtgcgtgtctggccccaaccgatgccaaaaccaatccaaccgagctcccaaacctctccggccggcgcccggtcaaaatctgccccggcccttgcttgcttgcgtcgccaagggcagcagcaaagcaaggccaaacccaccctaccccaaccattacctcgccaccaaaccaaacccgaacaagtccacccccgcctccaactccaaccccacgccacggcacccgaacgcgacgcgccccccgctcgcctcgccccgcctcgcctattagctagctttgccgccgcgcccggcccccaactcctccgcgctcccgagtattctattccgttccccccggggaggagtcgaaccaattcaacacggtgcgcgcgcgcgcgcgtcccgtgtcgggcggggtcgcgtcgcggatataagcccgcgcgagccgcttgtcacggaggacgggggaggccaagccagaccagtcgatctctctcgctcgatcgcgcgcgcgcccacacacagaggcggcggcagaggaacgcggcgcgcggcagagcaagggcggcgcggaggcagcagccgcatgcgacggcgccgggcgggggctctactcttgcaatgagcggcgcgggcaccgcgccatcgtgccggcggcggcagctcgggggcgcgcttctgctggtgctggttgtcctcgcgggtggtctcggcggagccgaggggaaggcgcacaactacggggacgcgctgcagaagagcctgctctacttcgaggcgcagcggtcggggcggctcccgcacagccagcgcgtcacctggcgccaccactccggcctcaccgacggcctcgagcaaggggtggatctggtgggcggctactacgacgccggggaccatgtcaagttcggcctgcccatggcgttcacggtgacgatgctgtcgtggagcctgatcgagtacggcggcgacgtcgcggcggccggcgagctcggccacgcgctcgaggccgtcaagtggggcaccgactacttcatcaaggcgcacacccagcccgacgagctctgggccgaggtgggcgacggcgacacggatcactactgctggcagcggccggaggacatgacgacgtcgcggcaggcgtacaaggtcgaccgcgaccacccgggctccgacgtcgccggcgagaccgcggcggccatggccgccgcctccatcgtcttccgcgacgccaacccgcactacgcgcaccttctcctgcaccacgcccagcagctgttcgagttcgccgacaagtacaggggcaaatacgacagcagcatcgcggaggtgaagagctactacgcgtcggtgagcgggtacaaggacgagctcctgtgggccgccctctggctccaccgcgccaccggccgggccgagtacctcgactacgtcgtcgacaacgccgactccttcggcggcaccggctgggccatcaacgagttcagctgggacgtcaagtacgccggcgtccagatcctagccacaaggctgctgctgagaggggagcacgcggcgcgccaccggagcacgctggagcggtatagggccaaggcggagcgctacgtgtgcgcgtgcctgggccggaacgcggacggcggacggaacgtggagcgcagccccggcgggatgctctacatccggcagtggaacaacatgcagtacgtgaccagcgcggcgttcctgctctcggcctactccgactacctggccgaggccggcgtcggggccgtgtcgtgcggggagggcggcgctttggcggcggcgtcggaggtgttcgcgctcgccagggcgcaggtggactacgtgctgggcaccaaccccaggggggtcagctacctggtcgggtacggccccaagtaccccaaccgggtgcaccaccgcgccgcctccatcgtgccgtacaagcacagcaaggagttcatcggctgcacgcaggggttcgaccactggttcggccgccggagctccaaccccaacgtgctcgtcggcgccatcgtcggcgggcccgaccgccgggacaggttcagggacaaccgggagaactacatgcagacggaggcgtgcacctataacacggcgcccatggtcggcatgttcgccaagctgcaccggatggcgcggcaggagcgggagcagggcccgacgccgccggcggcggcggcggtgtaaatagataggacgtagaggggggcctgtacaattttccccattctttggttcaattcttttgggctttggattccattttacacagatcggagatggttgtacgtatacagaaaaagaaaaagagaaaggtggaggcattgacatgcaaatgtaaattcgctaccagtacatacgaggaaaaggaaatgacacgcttaatttattggtggtgcttgtctgtacctt

SEQ ID NO: 10585 - DNA, 867 bp, Triphysaria pusilla
aacattttaccaaatctagcgatctcaggttagaacacaatggggttgacttttacgaagcttttcagccggctttttgccaagaagagatgcgtattcttatggtaggtctcgatgcggctggtaagacaacaatcctgtataagctcaaactcggagagattgtcactaccattcctactattggctttaatgtggagactgttgagtacaagacatcagtttcaccgtttgggatgttgggggtcaagacaagatccgtccattgtggaggcactacttccagaacacccagggtctcatattcgtggtggatagcaatgacagggaccgtgtcgttcaagccagggatgaattgcataggatgttgaacgaggatgagctgagagatgcagtattacttgtatttgcaaacaaacaagatcttcctaatgcgatgaatgctgctgaaataaccgataagctcggcctacactcactcaggcagcgccactggtatattcagagcacctgtgctacctctggtgagggtctttacgagggactggattggctctccaacaacattgctaacaaggcttaaagtgcttcatggagccgttgtagtgagctgatgaaaatgcactcgagtttttttctggctatatatatacaaattatgtttggacctttgtgatagctctgtatagcaggcaatggtttgtttcctatatttgcaatcatttttttaaaattgtaacgcgtgactaagaagactatggtggttttggaattttgtattggtttcttaatatgtatgaacctttctcgacttgggtgttgatggttttcgttaaatgttggaaatagataaattcatattcgaat

SEQ ID NO: 10586 - DNA, 973 bp, Picea glauca
tgtaaccacagtgaaccgtccgactgacaagcgaacgaagctatttcttcccatttcttctcgatattctgccctccttctcgactgcagcgctaggtgttcgagaggcaccagagatctctttgcggggagtcattcttctcccctggaatctcagatctgactcttcaactcgggatctataacaggtggtcaagatggggctcacttttaccaagctttttagccggctcttcgcaaagaggaatgcgcattttgatggttggtcttgatgctgctggtaagactaccatcttgtataagctgaagctgggagagattgttaccacatccctaccatcggattcaatgtcgaaactgtggagacaagaacatcagcttcactgtgtgggatgttgggggtcaggataagatccgtccactatggagacactacttccaaaatactcaaggtctcatcttgtggttgatagcaatgacagagatcgtgttgtagaagcaagggatgaattgcaccggatgctgaatgaggatgaactacgtgatgctgtcttacttgtattcgcaaacaagcaagatcttccaaatgctatgaatgccgcagagatcactgataagcttggtctgcattctctgcgacagcgccattggtatattcagagcacttgtgcaacttctggtgaaggcctttatgaaggcttggattggctttcaaacaacattgccaacaaggcataatttggaatgcgtctaatatctatattgggcacgaagtttattagccatgaagtagattccttcagaattacaatgatcgacagccactggcatggaatttttaaagaagaccttgactcgattcatttcttgatagcttgattgctatgtatttacactagtcattattgtgtgagaatctgggatttttatgtctgccagttgtgctatattgactatattagctctgctacac

SEQ ID NO: 10587 - DNA, 905 bp, Arachis hypogaea
ccacaagcttagtgaatgtgagccccatttctccttcagcttgtggatcccttaagggatctggaaccagaaaaaggaagggagagaaacgatgaaggagaaatggggctcacattcactaagcttttcgagtcggctttttgccaagaaaggaaatgcgaattctgatggttggtcttgatgcagctggtaagaccaccatcctctacaagctcaagcttggagagatcgttaccacaattcctaccattgggttcaatgtggagtactgtggagtactaagaacattagcttcactgtttgggatgtaggtggccaagacaagattcgtcccttgtggaggcactacttccagaacacacagggtcttatatttgttgttgacagcaatgacagagacagagttgttgaggccagagatgagttgcacaggatgttgaacgaggatgaactgagagatgcagtattgcttgtatttgctaacaagcaagatcttccgaatgcaatgaatgctgcccgtaaatttacttgtactaagtcttggggttcttcctacttcttctcagacagcgccactggtacatccagagcacctgtgcaacctctggggagggtctttatgagggtttggactggctttccaacaacatagccaacaaggcttaatgcttgttgggagtcttcttctgaaccggtgattctggatgcagggggtgaatattatctagtttgtcgtttttggtcgtcttccgagacaaattggatttgtgttcatgtttttgtggtttaggacatcttgatcgctaaaattatagtaggaatttgtttcatgggatgtcgaatacttttgacctttctattgggtttggattcaatgtttataaatgtaatggataacaaagcaa

SEQ ID NO: 10588 - DNA, 977 bp, Vaccinium corymbosum
tctctctcttctctttcctcgatcctcctgcgaagcattcgagaggtgttaaccaacaacagtatcataagcaggtagctggagtgaaacagagatggggctgaccttcacgaagttgttcagcaggctttttgccaagaagagatgcggattcttatggtaggtctcgatgctgctggtaagactaccatattgtacaaactcaagcttggagaaatcgtcactacaatccctacattggatttaacgtgaacagtggagtacaagaacattagttcacagtgtgggatgttggtggtcaggacaagatccgtccattgtaggaaggacaactaatttaccaagaaataacaacaggggctaaatattcgttgtggatagcaatgacagggatcgagttgtggaggcgagggatgagttgcataggatgctgaatgaggatgagttgagagatgctgttttgctagtgtttgctaacaaacaagatcttcccaatgcaatgaatgctgcagaaataactgacaagctcggacttcattcactccgacaacgccactggtacatccagagcacatgtgcgacctctggagaggggctttatgaagggctggattggctctctaacaacatcgccagcaaggcttaaggctctcgaggattctggctgctctcaggatgttttgccgatgctaaggttaagggaaagatcaagagacctgagttctatttccgcaactacctcataaaacttgtccgaatttttagggttcttatgtcacatactttctcttaaaatacttcagtgaggttgttatagcaagattgtcgactcaatatgctttcttgaattgttgtttggttgtattgctactactttcggtcagatgtttagctgtaatggttttgttatgtgttaattgacttccggttttgtcttctctttctggaatgagcaccccattctttcgtcgttcgaa

SEQ ID NO: 10589 - DNA, 525 bp, Brassica oleracea
ataggtaaaaggaagatggggcttaacttcacgaagctgttcagcagaagatgaggattctgatggtgggtcttgatgctgctggtaagaccactatcttgtacaagctcaagcttggcgaaatcgtcaccaccatccccaccattggattcaatgtggagactgttgagtacaagaacatcagcttcactgtttgggatgttgggggtcaggacaagattcgtcccctgtggaggcactacttccagaacactcaaggtcttatattcgtggttgatagcaacgacagggaccgagttgtggaagctagggatgagttacatcgcatgtgctgtccttctcgtgtttgctaacaaacaagatcttcccaacgcaatgaatgctgcagaaataaccgacaagcttggccttcactctcttcgccagcgccattggtacattcaaagcacatgtgccacatctggggaaggtctttatgaaggccttgattggctctccaacaacatcgctagcaacgtaaattaa

SEQ ID NO: 10590 - DNA, 713 bp, Rosmarinus officinalis
atttttaacgtgcctttaaatagcgaacaggatcgagagaatccgtcccctcccaagacgcagcccttctctctgtgccaggaatctcttcccactcgattctccagcggaagcttatcgagagttttaagtgggggggggggtaggtcttgatgctgctggtaagactaccatcttgtacaagctgaagcttggagaaattgttaccactattcccactataggtttcaatgttgagactgtagaatataagaatattagcttcactgtctgggatgttggtggccaggacaagattcgtcctttatggaggcactacttccaaaacactcaaggccttatttttgtggtagatagcaatgacagggatcgcgttgttgaagcaagggatgagctccataggatgttgaatgaggatgaattgcgtgatgctgtcttgcttgtatttgctaacaagcaagatctgccgaatgcaatgaatgctgcagaaattactgacaaacttggtctccattctctccgtcaacgccatgggtatattcagagcacctgcgcgacctctggggagggcctgtatgaagggctggattggctttcaagcaatattgctaacaaggcatgaagcaggcaaggaatttcgttgctgttgggaattttgtggggttatggtccatactattttgcttttatatggtattgggcaattcctagat

SEQ ID NO: 10591 - DNA, 708 bp, Solanum tuberosum
gtatacttatggtaggtctcgatgcagctggtaagaccactatcttataaagctcaagcttggagagatcgttacaaccattcttacgatcgggttcaatgtggaaacagtggaatacaagaacatcagcttcactgtctgggatgttggaggtcaggacaagatccgtcctctgtggagacattacttccaaaatacacaaggactcatttttgtggttgatagcaatgacagggaccgtgttgttgaggctagagatgagctgcacaggatgttgaatgaggatgaattgagagatgcagtgcttctagtttttgctaacaaacaagatcttccaaatgctatgaatgctgctgagataactgataagcttggtcttcactctctccgtcagcgtcactggtacatccagagcacatgtgccacatctggtgaaggactttatgaaggacttgactggctctcaaacaacattgcaaacaaggcatagagatttattagttaaaggtgcaagaacttgagtttacttctgcgattaagatctccagcatctggttttcttgcctgcatagattttcattgctcgagtgtattatttgttttaaaaaagaactgcagtctattactgaggaataatttgattttttttcccccatggtataaccaaatagtattgtttaaagtttacccttctgattgtgaagttaa

SEQ ID NO: 10592 - DNA, 561 bp, Primula obconica
agatccctctgcatagaaccttcttacagggttcaaccaacaggaaagagacatgggattgacgttcaccaagcttttcagtcggctgttgccaaaaaggcgatgcgtatcctgatggtaggtcttgatgcggctggtaagaccaccattctctacaagctcaagctcggtgagattgtgaccacaatccctactatcggatttaatgtcgaaactgtagagtacaagaacattagctttaccgtgtgggatgtcggaggccaggacaagatccgtccattggtggaggcactatttccagaacactcagggtcttatttttgtggtggatagcaatgacagagaccgtgttgttgaggcaagagatgagttgcaccgcatgttgaatgaggatgagttgtgagatgcagtactgctggtctttgctaacaaacaagatcttccaatgctatgaacgctgctagaaataacagacaagtcttggtctccactctctacgacagcgccacgtggtacatccagagctacttgtgacaactatcgtggcggagggtctgtagt

SEQ ID NO: 10593 - DNA, 1081 bp, Festuca arundinacea
tgttgcaaaattgacgtggcatcaaacaacaattcgaatataatcaattgattgaatacgtttttcaatagtataattattatactttagtgtcaattagtgaatatgggtctaacgatttcaaatttattcagtcgactctttggaaagaagcagatgagaattcttatggttgggttggatgctgctggtaagacgacgatactgtataaactgaagcttggtgagattgtgacgaccattccaacgataggatttaatgtggagacggtggagtacaagaacatcagcttcactgtgtgggatgttggtggtcaggataaaatcagacctctgtggagacattacttccagaacacacagggtttgattttcgttgtcgacagcaatgatcgagaaagagcgccagaagcaagagaagaactttctaagatgttacaagaggatgagctgagggatgctgctcttcttgtattcgctaacaagcaggatttaccgaatgcaatgtctgctgctgagatactgataaacttggtctaaatcaactcaggggacgcacctggtacattcaggcgacgtgtgccacgcaaggaaacggtctctacgaaggattggattggttgtctcaagagctctccaagcgctaacctatactcactcttcatatggctaaaatctctatttattatgttccgatttatgaaattattgtactaataaagttatatgtttaggtactgatcattgttcatcacttaagcttaatgcacttatcacacgattgtgctgataatttgctattccacgcatgtaaatttgcttgtcgcttctctccaaggccaatcaagcgatacagtactataaaataaatacgagagtcgctttaagcaaatgatgttagcatcatgtgaccaagtattagcttgttgataccataatgaactcctttaattcatagaactttattaatgttgtgtcagtttaactaatatcttttgcaatcagttagctgcaatttaatgtctagtttgctggtgttgatatcatcaatgtatttaacaaaaatcattcataaaaattt

SEQ ID NO: 10594 - DNA, 521 bp, Phalaenopsis aphrodite
cgtttggtaaaactacttctagccgcctgttcggctaagcgtgatatgtaggattttgtatggtcggtctcgatgctgccggaaagaccaccatcctctacaagttgaagctcggtgagatcgtcacaaccatcccaccattgggttcaacgtagagacagtcgaatacaagaacattaacttcaccgtgtgggatgttggaggtcaagataagattcgccccttgtggaggcactatttccagaacacccagggtctcattttcgtggtcgactccaatgatcgcgagcgtatcaacgaggcgaacgaggagcttcagaagatgttgaacgaagacgagcttcgtgatgccgtcctccttgttttctgcaacaagcaggatctccccaacgccatgtccgtcgccgaggtcaccgacaagctcggccttcactccctccgcaaccgcaagtggtacatccagtccacatgcgccacctctggtgatggtctctacgaaggtttggactggctcagcaaca

SEQ ID NO: 10595 - DNA, 945 bp, Picea glauca
caatagatagagaggtgaactcgggggaaatacagaggactgagaaggaacaatggacgaagttgtagtggccaacgatggacgttctctatcagccggatctcccgtccattcatattctcttttcagcaattatccattgatggcggctcttctgtcattcgcgttggctcaatccctcaaaatcttaactacctggtataaagaaagcggtgggatgctaaacgacttcttggttctggtggaatgccctcatcccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcaggatacccagggtcttatatttgtcgtgatagtaatgacagggaccgtgttgttgaagcaagagatgaattgcatagaatgttgaatgaggatgagctacgagatgctgttcttcttgtatttgcaaacaagcaggatcttcccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaaggcataatgttgaagcatagtaatgatgctgtgatgcctttcagaatgggttggattctgtgcatttgatgtctttgccgacgagtaagggacaaggagttgtgtggtgaattggcccttacatttgttcctataagtaacaaatactatattatttgtatttatctaagaatttggggggtttccttcttgggttgttatgttaaatctgagatttcggtttccttttctttgttggaagtac

SEQ ID NO: 10596 - DNA, 630 bp, Centaurea maculosa
agatgagaatattgatggtcgggttggatgctgctggtaaaaccaccattttgtacaaactgaaattaggagagattgttactactattcctactattggattcaatgtggagactgttgaatacaagaacatcagcttcacagtgtgggatgtgggtggtcaggacaagatcaggcccctgtggcggcactatttccagaacactcaaggattgatatttgttgtggacagcaacgatagagagagaattggtgaagcaagggaggaactcatgcgtatgcttgcggaagacgaacttcgggatgctgtgctactcatatttgccaacaaacaggatctgccgaatgcaatgaatgctgctgaaataacagataaactgggtcttcactcactacgtaaccgcaattggtacattcaagccacctgtgcaacaagcggtgatggcctgtatgagggcctggaccggctgtccaatcagctcaagagtgcaaatcgttaagtttcttcagttcaccctcctgaccatcagtggctgcctcatggcagtttctgcaagagagattgggactgtggccgcaaaacacattgctatttatctttcacggcaggactgtctgtttccaagaact

SEQ ID NO: 10597 - DNA, 973 bp, Arachis hypogaea
aagcagtggtatcaacgcagagtacgggggagcgttcttcgaaagcattcttcaccctccttctctctctctctctgtttatcctctctcatcgtttctctcccttcctttttctggttccagatcccttaagggatccacaagctgaaggagaaatggggctcacattcactaagcttttcagtcggcttttgccaagaaggaatgcgaattctgatggttggtcttgatgcagctggtaagaccaaccatcctctacaagctcaagcttggagagatcgttaccacaattcctaccattgggttcaatgtggagactgtggagtacaagaacattagcttcactgtttgggatgtaggtggccaagacaagattcgtccttgtggaggcactacttccagaacacacagggtctatatttgttgttgacagcaatgacagagacagagttgttgaggccagagatgagttgcacaggatgttgaacgaggatgaactgagagatgcagtattgcttgtatttgctaacaagcaagatcttccaaatgcaatgaatgctgccgaaattactgacaagctgggtctccactctctcagtacagcgccactggtaattatcttgatcgtgatgtcctcttgtccaggattacgtctttatagctatatcctgttggttctaacatctttttgcggtttttcaggtacatccagagcacctgtgcaacctctgggagggtctttatgagggtttggactggctttccaacaacatagccaacaaggtatctattgatttctttctggccctcgttattctgcacattttattgaaaaatgacatgttaaatggaaagaaagcatcatgatagaatatataatatgataaataggaagtaattgactatttgggtattattattagtgatgagaggaatagtataattaaggggaaacaccattgtaatagagaaa

SEQ ID NO: 10598 - DNA, 2276 bp, Oryza sativa
tgagacaaggacagccttccaatcaaaataagaaggtggtatacataccaaaaaggcaactttttcaccatgtgtcattgaagcaattatctcgttcatcatcatcaccatgatggcattggcaatacaatagatgaatagacagatcaaacttaaccgtatcagctcgatcaatatccaatagctaaaccttactcccaaaattcagattgatgaatgcaattgcaaggacaaatattgccaccaagccccaaaattgagtctaaaatttctatataagcatatgcagattgcagagtatagtagagccacttcccctagttgcgagttcatgtcagtcttcgaaggcggacaccaactccggcaccggctccggcacggtggggagcaccgggtaattccgcgagaagcaggcgtcgcagagctcatgcgcctcgtcgccatagatggtgtggagcttgtcgagcgagaggaacgcgagggagtcgcagccgatcgccctgcggactccctcgaggtccatcctgtttgatatcagctcgccctcgctgggcgtgtcgatgccgtagaggcaggagccgatgaccggcgggctggcgatccgcatgtgcacctcgcgcgcgccggcgtcgcggagcaggcgcacgatcttgctcgaggtggtgccgcggacgagcgagtcgtcgaccaccaccacgctcttgcccctgatgacgccgtgcacgggcgcgagcttgagcttgacggcgaggtcgcggatcgcctgcgacggctggatgaagctgcggccgctgtagtgccaccggatgaggccttgctggaactcgagccccgacgtctgcgagaatcccagcgcggcgtagaaccccgagtccggaacggggatgacgacgtcggcggtgggggcgggggactcctcggcgagcgcgcggccgtaggcgttgcggcgctcgtggacggcgtggccgaacaccacggagtttgggagcgcgaagtagatgtgctcgaagacgcacgacttgcgggggcggtgcgggacgaggcaggcggaggacaccgacatgtcgcggcggtcgacgacgacgacctcccctggctccacctcgcgctcgtacgtggcgtcgatgaggtcgagcgcgcaggtctccgacgcgaacacgatggcgccgttggcgcggcggcccatcaccaggggcctgaagccgaacgggtcgcgcacggccaggagcttgtccgccgtcaggaacagcagcgagtaggccccggcgaggcgctcgcaggcgtcgcagatgcgcgcgagcagagggcgcgagagcgaggtggcgatgaggtgcaggatcacctccgtgtccgacgacgtgctaaagatggagccctgcgcctccagcttgttccgcagcgcctggtagttcaccaggttgccgttgtgcgccacggcgagctgcccgaacctgtacccggcgaggaacggctgcacgttgcgcagggaggcggcggcgccggcggtggagtacctcacgtggccgatggcggcctggccggggagcttgccgaggcgggccgggtcgccgaacacgtccccgacgagccccagccccctctccagcttgatcgtgccgtcgtcccccgcggcggcgatgccagccccctcctccccgcggtgctgcagcttctgcaggccgaggtagcagagcgacgtggcgtccgggtccccgacgacgccgaacacgccgcactcctcgcgcgggtggtcgtcgccgtcgccgccgtccacctcaccgtcatagtcgaaaggcgtgacgcggtcgtattcggggaaggcctgcagcggcgcggggcggcccgcgcggtggcgcagcgcgagaggggacggcttggcggcggagcacctgaacacctggtggtggccgtgcgccggcgcgcctcccgtggcgcagcggatgaggccggaggaggcggtggcggtggcggcggcggcggcggcggccattggtggtgtgcgtgggagttttgggagggtgagggcttccgaggatgccctcccgaacgtaagtgaagggacgagatttaaggaggcccaggtgggcgtgtggcgatcgtatttcttactaaatttttttttatacgtacgcagtgtgtattgtaccgtataatatacggtccgtgttatccggaatggtatctttgggcctcgtatttcccagttcatcccagcgaaaagaaatggaatcgtttaattgtagtcttggatatggaaatttttaatcggttttcca

SEQ ID NO: 10599 - DNA, 2190 bp, Oryza sativa
ctaaaatttctatataagcatatgcagattgcagagtatagtagagccacttcccctagttgcgagttcatgtcagtcttcgaaggcggacaccaactccggcaccggctccggcacggtggggagcaccgggtaattccgcgagaagcaggcgtcgcagagctcatgcgcctcgtcgccatagatggtgtggagcttgtcgagcgagaggaacgcgagggagtcgcagccgatcgccctgcggactccctcgaggtccatcctgtttgatatcagctcgccctcgctgggcgtgtcgatgccgtagaggcaggagccgatgaccggcgggctggcgatccgcatgtgcacctcgcgcgcgccggcgtcgcggagcaggcgcacgatcttgctcgaggtggtgccgcggacgagcgagtcgtcgaccaccaccacgctcttgcccctgatgacgccgtgcacgggcgcgagcttgagcttgacggcgaggtcgcggatcgcctgcgacggctggatgaagctgcggccgctgtagtgccaccggatgaggccttgctggaactcgagccccgacgtctgcgagaatcccagcgcggcgtagaaccccgagtccggaacggggatgacgacgtcggcggtgggggcgggggactcctcggcgagcgcgcggccgtaggcgttgcggcgctcgtggacggcgtggccgaacaccacggagtttgggagcgcgaagtagatgtgctcgaagacgcacgacttgcgggggcggtgcgggacgaggcaggcggaggacaccgacatgtcgcggcggtcgacgacgacgacctcccctggctccacctcgcgctcgtacgtggcgtcgatgaggtcgagcgcgcaggtctccgacgcgaacacgatggcgccgttggcgcggcggcccatcaccaggggcctgaagccgaacgggtcgcgcacggccaggagcttgtccgccgtcaggaacagcagcgagtaggccccggcgaggcgctcgcaggcgtcgcagatgcgcgcgagcagagggcgcgagagcgaggtggcgatgaggtgcaggatcacctccgtgtccgacgacgtgctaaagatggagccctgcgcctccagcttgttccgcagcgcctggtagttcaccaggttgccgttgtgcgccacggcgagctgcccgaacctgtacccggcgaggaacggctgcacgttgcgcagggaggcggcggcgccggcggtggagtacctcacgtggccgatggcggcctggccggggagcttgccgaggcgggccgggtcgccgaacacgtccccgacgagccccagccccctctccagcttgatcgtgccgtcgtcccccgcggcggcgatgccagccccctcctccccgcggtgctgcagcttctgcaggccgaggtagcagagcgacgtggcgtccgggtccccgacgacgccgaacacgccgcactcctcgcgcgggtggtcgtcgccgtcgccgccgtccacctcaccgtcatagtcgaaaggcgtgacgcggtcgtattcggggaaggcctgcagcggcgcggggcggcccgcgcggtggcgcagcgcgagaggggacggcttggcggcggagcacctgaacacctggtggtggccgtgcgccggcgcgcctcccgtggcgcagcggatgaggccggaggaggcggtggcggtggcggcggcggcggcggcggccattggtggtgtgcgtgggagttttgggagggtgagggcttccgaggatgccctcccgaacgtaagtgaagggacgagatttaaggaggcccaggtgggcgtgtggcgatcgtatttcttactaaatttttttttatacgtacgcagtgtgtattgtaccgtataatatacggtccgtgttatccggaatggtatctttgggcctcgtatttcccagttcatcccagcgaaaagaaatggaatcgtttaattgtagtcttggatatggaaatttttaatcggttttccatctgctgtgcgtgatttttaaggggtttttggctgtcaatgttttgaatcaatttacagctgtgcccaaggcttgctgccgtccgagtctcttttatgggtgtgtttagttcttgaaaaaagttgaaagtttgaagaaagttgggagtttgaaaaaatagttgaaagtttatatgt

SEQ ID NO: 10600 - DNA, 2123 bp, Hordeum vulgare
tgcaatccccccctcccccccaccagcacaagaatgggaatggccgccaccgccccgtccacgtcgcgcctcctccatcaccaccagaccaaccgcgtcgtctccaagcaccaccaccagcagcagctgaggcagcgactcaggtacgcccccaacccgtcccctctcgccctgcgcggccgcctttcgccgccggccggggcgctcctgccggaccgcgtgaccccgttctcctacggggcggacgacgaatctgacgaccacccgcgcgaggagtgcggcctggtgggggtcgtgggccacccggacgcggcctcgctctgctacctgggcctgcagaagctgcagcaccgcggggaggagggcgccgggatcgtcgccgccgggggcgacggcaagctcaagtccgtcaccgggctggggctcgtcgccgacgtgttcggcgacccgtccaggctcgcctcgctgcccggtcccgccgccatcggccacgtgcgctactccaccgccggcgccgccgcgtccctgcggaacgtgcagccgttcctggcgggctacaggttcggccaggtcgccgtggcgcacaacggcaacctcgtcaactaccaggcgctgcggagcaagctggaggcgcggggctccatcttcaataccacctccgacacggaggtcatcctccacctcatctccacctcgctctcgcgcccgctgctcgcgcgcatctgcgacgcctgcgagcgcctcgcgggcgcctactcgctcctcttcctcaccgccgacaagctgttcgccgtgcgcgacccgcacgggttccgcccgctggtactgggccgcctcgccaacggcgccgttgccttcgcgtccgagacctgcgcgctggacctcatcgacgccacctacgagcgcgaggtggagcccggggaggtggtgatggtcgaccgccgcgacatgtccgtgtcctcggcctgcctcgtcccgcgcctcccccgccgggcctgcgtcttcgagcacatctacttctcgctccccaactcggttgtcttctcgcacgacgtccacgagcgtcgcaccgccttcgggcgcgctctggcggaggagtcgcccgcggcgggcgcggacgtggtgatcccggtgccggactcggggttctacgcggcgctcgggttctcgcgcgagtcggggctggagttccagcagggcctgatccggtggcactacagcgggcgcagcttcatccagccgacgcaggcgatccgcgacctggccgtgaagctgaagctggcgcccgtgcgcggcgtgatccgcggcaagagcgtggtggtggtggacgactccctggtccgcggcaccacgtcgagcaagatcgtgcggttgctccgcgacgccggcgcgcgcgaggtgcacatgcgcatcgccagcccgccggtggtggggtcgtgcctgtacggcatcgatacgccgagcgacggggagctcatctccaaccggatggacctggagggcgtgcggcgggagatcggcagcgactccctcgccttcctctcgctcgacaagctgcacggcatctacggcgacgaggccggggactactgcgacgcctgcttctcccgcaagtaccccgtgctgcccacgctgccggagccggccgccgaattcgacgacgaagactagtgatctgctctgcccagctcctctgcttcagtcagctcattatgctcccaggttcagttacgggtaggggcttgcgaatttttctttagagaagatcatcagggagccggagcctcccagttccattagttgaatgaaacctctgggcaggcttgcgaaatttgtatgcctgcaacatcatttggtcatgaattctatccctgatgtaaaagttactctaagttgttgcaatggttgacaccgaactggcgaagatgaccgatgtttgccatcgctgatactatcttcagctaccactttcaagtgcaaagttggtgctgaaatcccagaatcaagaattcgggatggacgaatctactatcgtctttagtcaagtttattatatgcctgggtacttgtgagttgtgagtatcgtcatgcgcccatgtcttcaggctggctcgtctgaataa

SEQ ID NO: 10601 - DNA, 1495 bp, Zea mays
aaatcacctagtagttgagcacaagcagcaagtcgatcattagcagctcttccctgctcatcgtcgccagctggtccaagggaggaagaagagatagatggacgtcgtcggcggtgctgctgctggtggtggcgattcaaagcagctcttggttgaagcagatgggaacacacgcacgcttattttgaacaggccgaaccagctgaatgtactctcccctgcaatgattaagggactcctgagctgtttcactgcttatgtgaaagatgatggagttaagttgttgattatgaagggttctggaagagcattttgtgctggaggtgatgttgttgctggtgtccaatcaataaataatgaaggatggaaatggggcgctgatttcttccgagatcaatattttttaaactacataattgcaagatgtatcaaacctcaggtttctcttcttactggaattgtcatgggtggaggcgctggtgtttctttacatggaaaatttcgagttgccactaataacacggtttttgcaatgccagaaacatctcttggtctttttcccgatgttggggcctcatattttttggctcgacttcctgggttctatggagagtatgttgctcttgttggtgctagattggatggtgctgaaatgcttgcatgtggtctcgcaactcattttgtcccttcaaatagaatgcttttgctggaagaatcccttaaaaaggtggacacctcgaatagttttgttgtatgtagtactatcgatcaattttgtcaacaaccatccctaaaacaaaaaagttccttgaataggttggaaatcatcaacaaatgcttttctaaaagaacagttgaagaaattatatcctctcttgaggaagtggcctcaaattcagcaagcaaatgggttgctcagacaattcagtatctgaaaaaggcttctcctactagtctgaaaatcacattgagatcgataagagaagggagaacacaaaccgttggggagtgcttgcaacgggaatatagaatggtttgccatgttgtacgtggtgacttcagtcgagacttttttgaaggatgcagggctatactagtagataaagataaaaatccaaagtggatgcctccaaggttggaacaagtgcatgatgatgcagttgaagagtatttctctagggttgatgatccagagtgggaagatttggacctacctgtcatgtattcaaatggaagaattatggagtccaagctttgaatggagcctttattgaacaatttaatggaacctcagttgtggttaaaataacaacccatcccatgttcgaagagtctatgtacactgaatactattggtaaaataaatctaaatatgttgtgtatatccacttataccatagaaggtactcattgctatttgtgttatagggatagacaatatcggttcctagctcgatctggcttatttagctcgtgagccaccatataatatgct

SEQ ID NO: 10602 - DNA, 1978 bp, Setaria italica
gttgaattccacccgccccgtccgtttctgcttccgcgcctccggacccccacgccattcccgtgggcgccgcgggcgtgccggtgccgccgaatccccgcctttccctcctctgttcccgctgacgccgcctcgtcgccgccggttattaaaataaccgagagaaaccgacgcggccacctccgcccgccgtgctcctccaactcccgtccgtccccatggcgccgccgcccgccctgctcctcctcgccgccctcgcgctcgcgctctgccggagcacggccctctccgacgcccacggcggcggcggcggcttctacgaccctaggcgcgcgtcacccagctctcctggcggcccagggcgttcctgtacagcggcttcctctccgacagcgagtgcgaccacctcgtcaatctggcgaaggggagcatggagaagtcgatggtggcggacaacgactccgggaagagcgtcatgagccaggtgcgcaccagctccggcaccttcttggccaagcacgaggatgaaatcgtctctgggattgagaagcgtgtagctgcttggacatttcttcccgaagaaaatgctgaatcaatgcaagttctgcactatgaaattggtcaaaagtatgatgcccattttgattattttcatgacaaaaacaacctgaagcgtggtggtcatcgaattgccactgtacttatgtacctgtcggatgtcaagaagggtggagagactgtatttccaagtgctgagggtggccatttgcagtacaaggatgaaacttggtcagattgtgcaagatctggtctggcagtgaagccgaaaaaaggagacgcactcctgttcttcagtcttcatgtcaacgcaacaactgatacaagtagtcttcatggaagctgcccagtaattgagggtgagaaatggtctgccacgaaatggattcatgtccgatcattcgataatcctccaaatgtgaggacagatgcgccatgttcagacgacaacgacctctgccctaaatgggctgctattggggagtgttacaagaacccaacatacatggtgggtaccaaggatactcttggattttgccgcaaaagctgcgggctctgtgatgcctgaactactcaccaatctcaacgtgctgtgctgtggggtgttaggccgctattgtttgcatccctatcgggttttctgttactggcttgtaaataacaggtgaggcaggtccttgagtagtatcggagtaatgtttactcttttgcatactacatgaaaattgaccttgcaggttacaacatcttgatataagagtaatgaaattttggtcaggattatggctgcatgatctcgttgtgcttctctacaggcgttgttgcgtagttgttgatgacttgatgtgttacagtgttactgggcactggccgtgttcaagtagaaatcttttgaggaaattttttttttgaggaaaattcaagtgaaaatctaatgatcaacaaagcaaaagaactttacaaagctgaaatttgcagggaaaccgttgcgttccgagggcatgaaactccatagagtgttcgaccatcctattccaaagcagaccgcagcaggaatcgaacattcgaacttctccagcttgctcgccactgaggtcgagccttggaagtccgaacaaaattctcgcgagacgcggatgccaagcctagggttctacaaaaacaaagaggcgcggcggcgggggctcgtcaagaacgttcggtcgcattttctcggtgccacgaagctcgccgcccgcggaccggcggtgaagccgagcccataatcgataactgtgcaggacagcaaattgttctaggagtaatacattttagttcatcactctgttacgtttctcgatccatcagttcacatttagtttttcctgttcatgcatcgtcccaaaatgttgtgattattttgggccgctactcgctgccg

SEQ ID NO: 10603 - DNA, 1259 bp, Cucurbita pepo
ttctcctccttctctttggagtccagcccagcagaggccaacccgcggtctctcccatttccaattcacaatctcaagagtatcgagaaaggacccccaaaaagcgagcacgcagagatctagccattgccccttcctcttcccttactccaaccaaacttcttctacttcttcttcttcttcagaagggagcactgtgatggccggctacagagctgaagatgactacgactacctctttaaggtggttctgattggagattccggcgtgggcaagtccaatttgctctccaggttcaccaaaaacgagttcagcctcgagtccaagtccaccattggggttgagtttgctactcggagcttgaatgtcgatagcaaggtcatcaaggcccagatttgggatactgctggccaggaaggtatcgtgcaataaccagtgcttactatcgaggcgcagtaggtgcactgcttgtctacgatgtcacacgacattccacttttgaaaacgtcgaaaggtggttaagggagttgcgagaccatacagatcctaacattgtcgtcatgcttgttggtaacaagtcagacctacgacacctggtggcagtatcaacagaggacggaaaatcttttgctgagaaggagtctctctatttcatggaaacttcagcactggaagcaaccaatgtcgaaaactcattcgccgaagtccttacacaaatctatcacattgtaagcaagaagtccatggaggctggcgatggcgctgctgctgctgccacagttccttcaaaaggagataaaatcgacgttggtaaggacgtctccgctgtaaagaaggctggctgctgttcgagttaggctcttgatttgcattcttttcgatgccgctgattcgatattgctgcatccttatgcgcaccatagttgagtagcaattcttcagagatgtcttcaataggatattgatattgcctggattttatttactttccaatatattatggtctgaaatttaagttgatctcaccgagagagccattgatttcatttaggtgtttgttgattagtattcgatttaaaatagaaaattaaataattgtattaatttaaactaaaacataaaattaagggtagaaagacatttttatcaacctaataaaataaataatattatggaagaatttacattattataatataaggaatgacgttattataatattaatttctgacgtgtaatttattaagtatattacgta

SEQ ID NO: 10604 - DNA, 1063 bp, Sarracenia psittacina
gacgccctcaacccacaggccgtttcagccagaaaaaagatatacatacataaattcttctgtgtacatcttcatcgaaggagatagagataaagatacagtgttggtgtcgtagtacttctttgcagttatggctgggtacagagctgaggatgactatgattacctattcaaggtggttctgatcggagactcgggcgttggcaagtccaatttgctctcaagattcaccaggaacgagttcagcctcgagtccaagtccacgatcggcgttgagttcgcaaccagaagcttgactgttgatggcaaggtcatcaaagctcagatttgggacactgctggccaggaacggtatcgtgccatcactagtgcctactaccgaggcgctgtcggtgctctgctcgtgtacgatgttacccgacactccacatttgaaacgtcgagaggtggttaagggagttgagggatcacacggatcccaatattgtagtcatgcttattggtaacaaatcagatcttcgacaccttgtggcagtttcgacggaggacggaaagtcatttgccgagagagagtcgctcttcttcatggaaacctcggctctggaagccatgaacgtcgacaatgcatttgcagaagttctcactcagatctaccgaatcgtcagcaagaaggccatggagtctgccgacgatgaagctgcttctaccgtgccttcaaagggagagaaattgatgtcggtaaagatgtgaccgcgatgaagagagttgggtgctgctcaacctagggttttgctgcttctgttttcatgtgcacacaccatgattgtgtaaaattttctacattaggagaaaggtgagggttacttttttagttcttcctattttgatttatttggctaagagactataatgatcatttgttggaacaaagagcttgatcagggacaggatgttaacatctattgctttcattcagttggtaggttgtgctttgttctaaatttgcattaaaattgtcttttttatgcaaggagttgttcagtgggtagagaatattatgtca

SEQ ID NO: 10605 - DNA, 1276 bp, Eucalyptus grandis
atggagaaaagtacacacgctttagcctttgatttagaccaagaaggggggctctctgtttttttaacggggaaggaaacaagcacgtcgtgcaacttgccgtgtagctctcgaaaacgcccctccttgtctctctctctctctctctctctctctctctctcctatctctcttgggtctgagcaagaaatggcagggtacagagcagaggatgactacgactacctcttcaaaattgtcctgatcggcgactctggcgtgggcaagtccaacctgctctccagattcaccaggaacgagttcagcctcgagtcgaagtccaccattggggtcgagttcgccactcggagcttgaacgtcgatggcaaggtcatcaaggcccagatttgggacaccgctggtcaagaaaggtaccgtgccatcactagtgcttattaccggggagctgtgggcgcattacttgtgtacgacgttactcgtcactccacattcgaaaacgtggagagatggttgagggaattgagggatcacacggaccccaacatcgtggtcatgctcgtcggcaacaagtccgatctccggcacctcctggcagtctcgacagaggatgggaaatcattcgcggagagagaggccctcgtcttcatggaaacttctgcactcgaggcgaccaacgtggagaatgctttcgccgaagtcttgactcagatttacaacatcgtgagcaagaaggccctggaaacaagtgagcaagcaaatggctcggctgtgccgtctcagggagagaagattgatgttggtaaggatgtgtcagctgtcaagagaggtggatgctgctcaagctagtcagattcttggaacattcgagagttttggattactgggtagttgccgtttttcctgtcatcatattttgcgatatatagcgtgagatattttttctgcacgacactggccgatccggtctagattgcaggtacacgaatttgtatcatttatgtcagcgatttcttgtgatgggtacagagcttaatttaggaaactgcttgttaattttacatctattggttcattaccatgttggtcttcttttgttttttggacacaatgtattaggtgcttgatgctagcgcggacacattgtattattttccgagggaatcatgacgttgaattggaactatatttgtatgcattgagtttcttttctctttcattctttgctaactgctctaaagaatgcaaagtaaattctataatcaacggcattgatata

SEQ ID NO: 10606 - DNA, 1073 bp, Papaver somniferum
gaaagatacaaaaacctaaaacaaagacatccctcttttattcttctcttcatctctttagcaaaaatctcattttgtaaatttttgcaaagaagaagagaagaaaacaaaactaacaaaaatgggtgcgtataaagctgaagatgactatgattacctatttaaggtagttttaatcggagattcaggtgttggtaagtcaaatttactctctagatttactaggaatgagttcagtctcgaatccaagtctaccattggtgttagagtttgctactaggagtttgaatgttgatggtaaagtcatcaaagctcagatttgggacactgctggtcaagaaaggtaccgtgccattactagtgcttactatcgaggagctgttggtgcactgctagtgtatgatgtcactcggcatgccacatttgagagtgtcgagaggtggttgaaggagttgaggaaccacacagaccctaacattgtcgtaatgctcatcggaaacaagtctgacctgcgtcaccttgttgctgtctcaaccgaagatgggacatcctttgcggaaagagaatcactttatttcatggagacttctgcattggaagcaactaatgtagaaaatgcattcgctgaagtgctgactcaaatttaccgtatcgtaagcaagaaggcagtggagacgggtgatgatggatcagcttcagctgtacctgccaaaggtgaaaaaataaacatcaaagatgatgtctcagcacttaaaagagttgggtgttgctccacctagggtgtaacaaggatctactgaatatttctgcttgaaaaggatatggttttagcttcatctgtaatttcatttctgtgaatgattccttaagatatcaaaactggggagatgatgaaaagagagatagtagcgaagtagtagccttgttttcaatagacttatttgctgtaatgaaaactgcgtgtttaagagagtttaggtacggagcacatcttccctcctgtttctttgtttagtatttatatttagatgtaacttcagtttgtgacgattaagattacaatcagaatgtga

SEQ ID NO: 10607 - DNA, 971 bp, Triphysaria pusilla
ccaaaatcattcctcaaatcacagttaaatcatcttaacatgccataaaaacaaaaattaaatacccaagagatcctattactgtcgtttgaaattcaacctcaaatctgtacatattcatggccggttacagagcagaagacgattatgactacctattcaagttggttttgatcggcgactcgggagtcggcaaatccaacttgctctcgagatttaccaggaatgagtttagcctcgagtcgaaatcgaccattggcgttgagtttgctacccgaagcttgaccgttgatggaaaagtaatcaaggctcagatttgggacactgctggccaagagaggtaccgagccattaccagtgcatactatcgtggggccgttggggctttgctcgtgtacgacgtgaccaggcactccacattcgggagtgtcgagaggtggctaaaggagttgagggatcacaccgatcccaacatcgttgtcatgctcatcggcaataaatccgatcttcggcatcttgtggccgtctcgacagaggatgggacctcgttttccgagaccgagtcactttactttatggaaacatctgccctcgatgccaccaacgttgatagcgcgttcacggaggttcttacgcagatatatcgggtcgtgagcaagaagacgattgaggcgggggataatggggacgcgccaagtgtcccgtcgaagggtgagaatattgatgttagtaaggatgtatcggctatgaaaaaaggtgggtgttgttcgtcgtaaaatgaaagggttaatgagctcgcaccatttcacccgcagatcgataggattaactttatatatgaattatcgttgtatttggaaaatggaataattttctccatatttctttcataactcttttctttatgaagtgtaatacactatattcttcaggaatcgagaatgtttaccgtgcagctatatgcacctagg

SEQ ID NO: 10608 - DNA, 1596 bp, Eucalyptus grandis
atttttgtggcgcttttttaattcaaaagagcacctcccttcacattcccccattcacttaccttcacccccaacagtaaagttcatatctttcgccctgcagatctcgccctctccctttctctctctacccttcactctctctctctctctctagagaaagaaggaattgaacgatagcaatggcgggttacagagccgaagacgactacgattacctgtacaaggtggtgctgatcggggactccggggtgggcaagtccaacctcctctcccgcttcaccaagaacgagttcaacctcgagtccaagtccaccattggcgtcgagttcgccacccgcactctcactgtcgacggcaaggtcgtcaaggctcagatttgggacaccgccggtcaagaaaggtaccgtgccatcactagtgcttactatcgtggagctgtaggtgcactccttgtgtatgatgtcactcgccatgcaacatttgaaaatgtggatagatggctgaaagaattaaggaaccacacagatccaagcattgtggtgatgcttgttgcgaacaagtctgaccttcgtcatcttatagcagtctcaacagaagatgggaaatcctatgctgagagggaatcgctgtacttcatggaaacctctgcactagaggcaacaaatgtagaaaatgcctttgcagaagttctaacgcagatctaccgtaccactagtaagaagacagtggaaggagatgatggatctgctgctgcattcccttctcaaggagaaaagataaatatcaaggatgatgtctctgctttgaagaaagttggctgttgctcaacttaaggttggaggtgattgttgcttgcatagattaatactttgatttcagttgtataacatttttcatgcccaaaagctgaagaaaagttagctagaagaaacttatgagacactaaatttgtgcagcaaaagcttagtacatcatgcctttggcatggcagtaggatagctgcataagttagttatttctctgttctgattcatgcaaagtcattatttaggcagtttcatctttctgagaattaacaagatgttgctttatgtactctttcatactgttattacagtaatgatggctgtgtgactgcatctccaggtttctggtgaaacttttgatgtcttccaccatatagagaacacaattcactacaacgatgcgcaggcatgagtgagcttattttcttgttagggctttgtattaaatatgcagcacaaagataggactgctaaggcaggagctcatttttcttgttgagaggggacatccattttgagtagcttttaatgtcgcagcagctacgtgttctctttcatgtgcatcagatttagagattggcttgcccttcaggagccccccaaagagttctgctggatcatagtagagttaaacttcttaggccctcatagattcatcaacgtgcgaacaatttcatgtgtaactggaaatggaaccagagattatatagtttttcagtcttttccttttctctattttcacaacactaaacagaaatgaagagtggatgcaccttcataattccaa

SEQ ID NO: 10609 - DNA, 1159 bp, Rosmarinus officinalis
ctgttgtaaaacagcaaatcccactatcttactgttgttatctccctaactattaactcgtcccaaatcccacctcattttgcattactttaccttttcgcagaagagggtttgtttcttgtaaactggatccgggtacccgaccctgctagcatccgaatctattacagcaatggcgggttaccgggcagaagacgactacgattacctgtttaaggttgttttgataggggattccggcgtagggaaatccaacttgctttctaggtttacgaggaatgagttcagcctcgagtctaaatcaactatcggcgtcgagttcgccaccagaagtttgaccgtcgacgggaaagtgatcaaggctcagatttgggacacggcgggtcaagagaggtaccgtgccattaccagtgcatactaccgcggtgctgttggtgctttgcttgtgtatgatgtcaccaggcactccacatttgaaaacgtcgagaggtggttaagggagttgagggatcacaccgatcccaacgtagtcgtcatgcttattggcaacaaatgcgacctccggcatctggtggcagtcgcaacagacgacgggacctcgtttgctgaaagggagtctctctactttatggaaacttccgccctcgatgccaccaatgtcgagaatgcattcacagaagttctcacacaaatataccgcattgtgagcaagaagagcatggaggccggtgacgatgggaatgcgcaaaatgttccgtctaagggcgagaaaatcgacgtgagcaaagacgtatcggatgtgaagaaaggaggttgctgctcctcgtagattttgaacgaaggtttgtcctcgtgaggtatgatgccagcgtctttcttttctctgctgcatcttcttcagattgtggtgtaaaattttatctgccgatgttagaaatactatgatccacacaatgctttaatatgtattgctttcatggtacgtgcaatgccaaattcacatgatgttcagtaaacgaaattctgattcaaacatcatatacgtgtcatttcaagaaagagggaaaaaatacccgactgttgttttggttgtttctatagtttgtcaatttgtacttttccttgttagatttgaaactgtggtgtagtgtgtttaaag

SEQ ID NO: 10610 - DNA, 970 bp, Euphorbia peplus
tactgaatttggaaaatatctgtatagtggtgtggtgactgggaggatacaaaagcagaaagatgactatgattacctattcaaagtagtcctcatcggcgattcaggcgtaggcaagtccaatcttctctctagattcacccgtaacgagttcagcttggagtctaagtcgaccatcggcgtcgagttcgctactcgcagcttaaccgtcgactctaaagttattaaggctcagatttgggatactgctggtcaggaaaggtaccgggccattaccagtgcttactacagaggagctgtcggagcattacttgtctatgatgtgactcgacactcaacatttgagaacgttgagaggtggctgagggaattgagggaccacactgaccccaacattgttgtcatgctcataggtaataaatcagatcttcgccaccttgttgctgtctcaaccgaggacgggaaatcctttgcagagagagaatccctctacttcatggaaacttctgctctcgaagcaactaatgtagataatgcatttgctgaagtgcttacccagatatatcgtattgttagcaagaaagcaatggaggctggtgatgagagtgccgcttcagctgtcccttccaaaggagagaaaatcgatgtgaataaagatgtttcggccatgaaaagagcaggctgctgctcaagctaggagttgattaaccagaaatttgctgcagagatagaggagctggtttgttttgctgcatctgtttctattatacaccgattattgtgtaaaattttctcaaagatgtcaacggtaggaaatatggcgattgattttcattttcattttcaaagattctgctgtatcttgctgacagagagcttaactaggaacaagctattacactattacttgcaaattaatggttctgagtgaagtccaaatctgcattatctatcttagtttgtagttaag

SEQ ID NO: 10611 - DNA, 1101 bp, Citrullus lanatus
gagagagaaaatcttgcgatctgaagaaaacaagaaccccccccccccccccccccccccccccctctctctctctttctccacggctggagggcttctgaaaaatgtctgcctatagagctgaagatgactatgactatctcttcaaggtcgtcttaatcggagattctggcgttggcaagtccaatttgctttcccgctttaccaaaaacgagttcagcctcgaatctaagtctactattggggttgagtttgctactcgcagtttgaatcttgatggcaaggttattaaggctcagatttgggacactgctggccaagaacggtatagagcgattacaagtgcttactatcgaggagcagttggtgccctgcttgtttacgatgttacacgacactccacctatgaaaatgttgagaagtggttgaaggagttgagagatcatacagatcccaacattgtagtaatgctagttgggaacaaatcagatcttcgccaccttgtggcggtgtcaaccgaggatgcaaaatcatttgccgagacagagtccctctatttcatggaaacctctgcccttgaagccacaaatgtggacaacgcctttgccgaagtgcttacacaaatttaccacatagtgagcaagaaggctatagaagctagcgatgatgctgctgcatcagccgttctagcgaaaggggagaaaatcgatatcagtaaggacgtctctgaggtaaagaaaggcggttgttgttccagctagactaccaatctctgaagttgctgcagcagcctgaaggtcatctcgttgctcgacatctattttacattttgttttacatatagtacaccgtggccgtgtgaaatttttttccatagaggtagggggattcatggggattgatttgatgtatcttactgttttgattacttatattttaacttctgatgccaaaaatatgcttaagctttatactcaattgacttcggggaattacagttttatactcctttgactttgagggctttgtatccaagtacagaattgttgtggctcttagtttcagaactccaaggtttctcttatctcttgtgtgaactat

SEQ ID NO: 10612 - DNA, 660 bp, Eucalyptus grandis
aatggcgggttacagagccgaagacgactacgattacctgtacaaggtggtgctgatcggggactccggggtgggcaagtccaacctcctctcccgcttcaccaagaacgagttcaacctcgagtccaagtccaccattggcgtcgagttcgccacccgcactctcactgtcgacggcaaggtcgtcaaggctcagatttgggacaccgccggtcaagaaaggtcgtgccatcactagtgcttactatcgtggagctgtaggtgcactccttgtgtatgatgtcactcgccatgcaacatttgaaaatgtggatagatggctgaaagaattaaggaaccacacagatccaagcattgtcgtgatgcttgttgcgaacaagtctgaccttcgtcatcttatagcagtctcaacagaagatgggaaatcctatgctgagagggaatcgctgtacttcatggaaacctctgcactagaggcaacaaatgtagaaaatgcctttgcagaagttctaacgcagatctaccgtaccactagtaagaagacagtggaaggagatgatggatctgctgctgcattcccttctcaaggagaaaagataaatatcaaggatgatgtctctgctttgaagaaagttggctgttgctcaacttaaggttgga

SEQ ID NO: 10613 - DNA, 918 bp, Arabidopsis lyrata
aaatctcagtttacacctttacactgctgcgtctctctctctctctctctttctatttctcagattaatcgctgagaagaagcaaccacctgagacggcggagatggctgggtacagagtggaagatgactacgattacctcttcaaagttgttcttataggcgattctggagtcggcaaatccaatctcctttccagattcaccaaaaacgagttcaacctcgagtctaaatccaccattggcgtcgaattcgctactcgtaccttaaaagtcgatggtaaagtcatcaaagctcagatttgggacactgctggtcaggagaggtaccgtgccatcaccagtgcatactatcgtggagctgtgggcgcactcctagtatatgatgtaacccgccgtgcaacatttgagaacgtagaccggtggttaaaggaactcaagaaccacacagatccaaacattgtagtgatgcttgttggtaacaaatctgatctccgccacttactagctgttcctacagaagacggaaaatcctacgcggaacaagaatcgctctgcttcatggaaacatctgcccttgaagctaccaatgtcgaggacgcatttgcagaggttttgacacagatttatcgcatcacaagcaagaagcaagttgaagctggtgaagatgggaatgcctctgtcccgaaaggtgagaaaatagaagttaaaaacgatgtctctgctctgaagaaactcgggtgctgctcaaattgaaggctttttttttttttttttgtttctgttgagagagaattataacccccatggtccattgttcgcttctgttcttgttttgtaacactatcgacattaatataagttttagactacacattatataatgtttctgtaactgtatttcaaaaattgttggtgaa

SEQ ID NO: 10614 - DNA, 538 bp, Flaveria ramosissima
atcataatcgtaaaaaccagaacatacaacctccgttgcacctcatctgagctacagacacaaaaaagatgcagatattcgtgaaaaccctaaccgggaaaaccataaccctagaggttgaaagcagcgacaccatcgataatgtgaaagctaagatccaggataaggaaggtatcccaccggatcagcagcgattgatcttcgccggaaaacagcttgaagatggccgaactcttgctgattacaacattcagaaagaatctactcttcatttggttttgaggctgaggggaggaatcattgaaccttctttgatggcattggctaggaaatacaatcaagacaagaccatctgccgcaagtgctacgctcgtttgcacccaagggctgtaaactgcaggaagaagaagtgtggtcacagcaaccaattaaggaccgaaaaagaagatcaagtgaagatgtgtgtatgtcttttactgctggaagaagattatgtgttgtttatttttagaacatttgcatctgttttagacatatt

SEQ ID NO: 10615 - DNA, 489 bp, Helianthus annuus
aggtggtatgcagatctttgtgaagtacgttgactggaaagaccatcactttggaggttgagagttcggataccattgacaacgtcaaggcgaagatccaagataaggagggtatcccaccggaccagcagaggctcatctttgctggaaagcagctggaagatgggcgtaccttggcggattacaacatccagaaggagtcgacccttcatttggtgttgaggcttcgtggtgggattattgaaccgtctttgatggctttggcgagaaagtataaccaggataaaactatctgccgcaaatgttacgctcgtctccatccacgtgctgttaactgcaggaagaagaagtgtgggcacagcaaccagttgaggccaaagaagaagatcaagtagatgatgatgatgatgttatggtactttgttttgaaggttgtttaaggttgtaaggatggtgcttacatttttgaatttgaatgttatgttttag

SEQ ID NO: 10616 - DNA, 530 bp, Flaveria ramosissima
acacaagcaaattaggggttctgaaaatcggctgaagggaaaatgcagatcttcgtgaagacattgacggggaagacaatcacgctcgaggtcgaatcgagcgatacgatcgacaatgttaaagctaagattcaggacaaagaagggattccaccggatcagcagcgtttgatcttcgccggaaaacaacttgaggatggaaggactctcgccgattacaacatccagaaagagtctacgcttcatttggtgttgaggctccgtggaggtattattgaaccatctttgatggctttagccaggaagtataaccaggataaaaccatctgccgcaaatgttatgctcgtctccatcctcgtgctgtcaactgcaggaagaagaaatgtgggcacagcaaccagttgaggccaaagaagaagatacaagtagacgatgttactatgcatgtttttgaaagaaagatggtttacatacatgtatgggtggtgcttttgttttacaccatttttgaatgtttctggatgatttt

SEQ ID NO: 10617 - DNA, 2043 bp, Cucumis melo
ctccatctccttcctttcgcttccaactaccgttctcgagctccagatcgatggcacaaatggcttccttcgcactcagcccctcctgcttcggatccttcaccgcggccgcatccaacaaggcttcctcttcttcttctccggcggctttcaagccactcaaacttcctctcttttggccatggcagaaggtttgttttcatccgacatttctattcattatccaaattgaaccgcttccaaattcaattcaatggcgctcctaggtaaaaatgggccctctgagtgtttcccctatgggatttggaacttgggcgtgggggaaccaactcttgtgcggctaccaggaatctatggactctgagcttcaacacattttcaatttggctgtggataatggaattaatctcttcgacactgcggattcttacggcactggaagattgaatggccaaagcgaaaagctacttggaaaatttatccgacaatctcaagttaaaaatgagattgtgatagccaccaagtttgcagcatatccatggcgcctaacacctgcacagtttgtcaaagcttgccaggggtctttggagcgaatgcagatggagaaaatcggtataggacaattacattggtcaacagcaaattatgctcccttacaggagatggctctttgggatggactagtggcaatgtatgataagggattagttcaagcagttggagtaagcaactatggaccgaagcaactagtaaggatatatgactacctaaaagaccgaggagttcccttatgcactgctcaggtgcaattttctttactgagcataggcgatgatcagttggaggttaagaagatatgtgattctttgggcattcgcctaatagcttacagtcctttgggattgggaatgcttacaggaaaatactcaccctccaaacttccatctggacctcgaggtttgctattcaggcaaattctaccaggattggaaccactactgactacacttggagacatcgcagagaagagacgcaaaacaataccacaagttgccataaactggtgcatatccaaagggaccatacccatacctggagctaagacattaaaacaagctcaggaaaatttgggtgctctaggctggaaccttacccaagaggaattgaacctgttggacaatggagctcaagagtcccctcggaaaatgatacagaatattttccagacaaggtaaacttagctgcaccaagaggtgcccgaggagaagctggtgcatatagctcacaagggctgtagatgagttcaaattggatattgatgtgagaataataaattaacacgtttcatcaataaaatagattcaaaaagaaaataagaccatctcataatcaatgtaaaccaataaaaattctcaagttcgaaatacaaaaatagaattcttaacaaatgagcacataatctaagagtctacggggcgcattgaagtgatatataaggaaccacaacatttcatccttaaaatcagccgtctacttgattttcttctttggcctcagctgattgctgtgaccacatttcttcttacggcagttgacagcgcggggatgcaggcgcgcataacatttgcggcagatcatcttgtcctggttatatttcctggccaatgccatcaaagatggttcaataatcccaccacgaagccttagaaccaaatgtagtgttgactctttctggatgttgtagtcggcaagagtgcgcccatcctcgagctgctttccggcaaagataagccgttgctgatcggggggaataccctccttatcctggatcttggccttgacattgtcaattgtgtcgctggactcaacttccagcgtaatggtcttccccgttagggttttgacgaagatctgcattttcttaatcgtctctttttcctcgccgtctccgtgatgagttagggttttacgtttccgacttttgtcccccctctatctatatatagagagagagatttgcatcaaaatatataaactttcaaa

SEQ ID NO: 10618 - DNA, 492 bp, Picea glauca
attgttggcagcgagcaagatgcagatcttcgttaaagaccctgacgggcaagaccataaccttagaagttgaaagcagcgataccatcgacaatgtcaaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtgggggacattattgaaccctcgttgatggctttggcaaggaagtacaaccaggacaagatgatttgcagaaagtgttatgcccgtttgcatccgagggcagtgaactgcaggaaaaagaagtgcggacatagtaatcagctgaggcctaagaagaagatcaaataaagcgtcttgagtttgaagcagatagtttatctgcactaattttttgctgattttattttcattgcctttaagaagccaattgg

SEQ ID NO: 10619 - DNA, 540 bp, Heritiera littoralis
ggcaggccggttgaagaaaagaaagacaaggcaggaaaagatgcagatattcgtgaaaacccctcaccgggaagaccataactctcgaggtcgagagcagcgacaccattgacaatgtcaaggccaagatccaagacaaggaaggaatcccaccggaccaacagcgtctcatcttcgccggaaaacagcttgaagatggccgtaccttggctgactacaacattcagaaagaatcaacgcttcaccttgttttgaggttgagaggtggaattattgagccttctttgatggctttggctcgcaaatacaaccaagacaaaatgatttgccgcaagtgttatgctcgtctgcatccgagagctgtgaactgtcgcaagaagaagtgcggtcatagcaatcagttgaggcccaagaagaagatcaagtaaattatgaatgtggttatctcgtcatatttaccagaatccgaatatcagacctggaaaattttcccatatggttattttctgttctattttgttgaaatttaatatatggatt

SEQ ID NO: 10620 - DNA, 642 bp, Rosmarinus officinalis
cggccgggggagagcgtgcgctgcgaagtgcgttggcagagaaaatgcagatcttcgtcaaaaccctaaccggaaagaccattaccctagaggttgaatcctctgataccatcgacaatgtcaaggcaaagattcaagacaaagaagggattccaccggaccagcaggttgatttttgctggaaaacagctagaggatgggcgtacgctggctgattacaacatccagaaagagtccactcttcatttggttctgaggcttcgcggagggattattgagccatctttgatggctttggcaaggaagtacaatcaggataagatgatttgtcgcaagtgttatgctaggttgcatcctcgtgctgttaactgccggaagaagaagtgcgggcatagcaaccagttgaggccgaagaagaagatcaagtagacatgctgtttgctgcatgttattttgcattttgtagcttgtcttagtccaactcgtttctgctgttacagtttggaaagtggagtgttattgtatgtttgaattggctaaagagaatagttgttgttgatgttgggcaacagtgctggcttctaatagtcataattctgctattgttatggtgcttcgtttggtttgcggagggaaggggaa

SEQ ID NO: 10621 - DNA, 601 bp, Eschscholzia californica
gatcatcagggggaggcgcgcagctgagaagtagagagagagaggagggagagagagagagatgcagatatttgtgaaaacactgacagggaagacgataaccctagaggttgaatctagcgataccatcgacaatgtcaaagccaagatccaggacaaggaggaattcctccggatcagcaacgtttgatcttcgccggtaaacaactcgaagatggccgtaccctcgccgactataatattcagaaagaatcaacacttcatctggtattgaggcttcgtggtggtatcatcgaaccatcgttgatggcattggccagaaagtacaatcaggacaagatgatttgccgcaaatgctatgctcgccttcatcctcgtgctgtcaactgcaggaagaagaaatgtggacacagcaaccagttgaggccaaagaagaagatcaagtaggcttaaacgctcatcattttttaggcgaattagtaggacgagtttttagcagacattctactactaataccagtgaattggaacaactttttcatttgttggaaccttttgtttcatttgttcttggctatatgtgtcgattgttagatggttt

SEQ ID NO: 10622 - DNA, 685 bp, Arachis hypogaea
aaggatgcagatattcgtgaaaaccctaaccggtaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacattcagtaaggagtcaacgcttcatcttgtcctcaggcttcgcggtggcatcattgagccttctctcatggcttggcccgcaagtacaatcaagacaagatgatttgccgcaagtgctatgctcgccttcacccaagggcggttaattgccgcaagaagaagtgtggtcacagtaaccagttgaggccaaagaagaagatcaagtaaattctagattgtgctgttctcctgttgatgttggaatcggatcagtttttgatattatgttttctgttttagttaatgtcgaattgttttgagagtttattttggcaactaagaattatattgttatgatgatgacattatggtatcatttaagttcctgattgtgttttgtaatgcacttagtcacttaaacgtttagcggtacagagcaatataataacaccaagggacctgtttatcttgacaaaaaaaagaaaaaaaaacaaaagtactctgcgttgataccactgcttc

SEQ ID NO: 10623 - DNA, 1312 bp, Senecio madagascariensis
ctctactttcacaaaaatctttaaaatgatttcttccactagtgtttttctctttatactattgtctatttttcacatgtcattcgcaacgagacgactctccgagttagtccaggactcgtcgtcgactcttttacaatatcacaacggtgcattactcaccggtgatatctccgttaatcttatttggtatggaaactttaaaccttctcaaaaagccataattgtagattttattacttccatttcgcgaaaatcacaaacccaaccatctgttaccacgtggtgggaaacaactgataaatacttttccaaaacaaaaaaaccctcacttcgactcggtaaacaagtatccgactactcactcgggaaatctttaaaagacatacaacttaaacagttggctacaaagggtgaactaactaacgctattaacgttgtgttaacggctgatgatgtggcagttgacgggttttgttctagtcggtgtgggacccatgggtcatcttctttttcttccaaaaatattcttaaaaataaaaactacaagtttacgtatatttgggttggtaactccgagactaaatgtcctggttaatgtgcgtggccgtttcaccaaccgatatacggaccacaagttgcaccacttgtcgcacccaacaatgatgttggtgtagacgggatggttataaacctggctagccttatagacgcggggatagtcaaaaaaacaaagatgcagatcttcgtgaaaaccctaactgggaaaaccataaccctcgaggttgagagcagtgacaccatcgacaatgtcaagaccaagattcaggacaaggaaggcatcccaccagaccagcagcgattaatcttcgccggaaaacagcttgaagatggccgtactcttgccgattacaacatacagaaagagtcgactcttcatttggtgttgaggcttaggggtggaatcattgaaccatctttgatggctttggctaggaagtacaatcaagacaagaccatctgtcgcaagtgttatgctcgcctacacccgagggctgtaaactgcaggaagaagaaatgtggccacaccaaccaactaaggccaaagaagaagatcaagtgaagacttttctttgctttgtttttgttggaaacgaaatcatttggtttatctttagaacattttctttttgttatttttgttgttaagtaaaacttgttgacttgtttgttgatttttaagaagtactattcgtttgaaatctttttggtatcactatgatgaatcgattcttgatgcatcttatttgcg

SEQ ID NO: 10624 - DNA, 872 bp, Picea glauca
aagtggatctcgaaagacagactctggatcttgatcacgaacatcattacaatcatccttatctcgaaatggcttgctttttcccacagaaccctaaggttgaaaccctagaaacggactacaaaagcttcaaaagaaatgtattaagtgtttagtccacagttgtcgtggagaaattgttggcagcgagcaagatgcagatcttcgtaaagaccctgacgggcaagaccataaccttagaagttgaaagcagcgataccatcgacaatgtcaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtggggcattatagaaccttctttgatggcactggctaggaagtacaaccaagacaagatgatttgcagaaaatgctatgcccgtttgcaccctagagcagtcaactgcaggaaaaagaagtgtgggcatagtaaccagctgcgaccaaagaagaaaatcaagtaaaagttacgctgcattgagattttacatcctcttaatacattcatgttctattattccccatcattttaggttgttgtgccatgtcaaaagcatgacttttaaaccatactttgcttatagaaaaaccttcacgttttttgatattatatatgcattaaattaaattgggaatctttctcagaaggattttgatttgcagttcattatttctgtgttaaggttatgtattttttagcttttgttttactgatctctatttatattttaaaataccaattagtaaatttgtact

SEQ ID NO: 10625 - DNA, 601 bp, Picea glauca
gtccacagttgtcgtgggtatattgttgggagcgagcaagatgcagatcttcgtaaagaccctgacgggcaagaccatcaccttagaagttgaaagcagcgataccatcgacaatgtcaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtgggggcattatagaaccttctttgatggcactggccaggaagtacaaccaagacaagatgatttgcagaaaatgctatgcccgtttgcaccctagagcagtcaactgcaggaaaaagagtgtgggcatagtaaccagctgcgaccaaagaagaaaatcaagtaaaagttacgctgcattgagattttacatcctcttaatacattcatgttctattattccccatcattttaggttgttgtgccatgtcaaaagcatgacttttaaaccatactttgcttatagaaaaaccttcacgttttttgatattatatatgcattaaattaaattgggaatctt

SEQ ID NO: 10626 - DNA, 1289 bp, Utricularia gibba
gagttcccagatcatccctagaaagggttcagctcgagcaaattggaatcggccaactccactggtccacagctaattatgctcctcttcaagaaagggtcctttgggatggcttagtggcaatgtatgacaagggattggtaaaagctgtgggagtaagcaactacgggccaaagcagctactgaaaatacacaagtacctcaactcccggggagttcctctcagctctgcccaggtgcaattttcattgttgagcatggggagagatcagatggagatgaaagaaatatgcgactctctaggtgttcgtgttattgcctacagtcccctggggctcggcatgcttactggcaaatacaccccttcaaatcttcctccagggccacggagccttctattccggcggattttaccaggccttgagcccctgttacgttcactgaaagagatcggggtgaagcggaggaagaccgtgtctcaggtagctataaactggtgcatctgcaaaggcacgatcccgattcctggggtgaagacggtgaaacaagtagatgacaacttgggagcattaggatggcaactcagctcggatgaggtgctgcagctagaaaatagcagctctagaatctcccagtaaaatgattcagaacatttttcagacgagatagaatcacaaactgcatgaactttgacatagtttcatcaaaacacaaaatgggaactaactgagcttcatcagtgtattgacaacacaagaccaacacatgtcgaggagatgcgctcatgagagttagagaaaggaaagttcggagaacaatatgtgaataaaaaacgacggagccaatcgaaaattatgcccagcactctacttgatcttcttcttaaccctaagctgattgctatgtccacatttcttctttcggcagttgacagctcgtgggtgcaaacgcgcgtaacacttgcggcaaatcattttgtcctggttgtatttccttgccaaagccatgagagaaggctcaatgattccacccctgagcctcagaaccaaatgcagggttgattctttctggatgttataatcagcaagcgttcttccatcttcaagctgctttccagcgaaaatcagacgctgctggtcgggaggaattccttccttgtcctgaatcttggccttgacattgtcaatagtatcgctcgactcaacctcgagcgtaatcgtctttcccgtgagggttttcacgaagatctgcatctctcccctggcacgcctcttccggactcagccacc

SEQ ID NO: 10627 - DNA, 857 bp, Brassica oleracea
tttttttttttttttttttttttttttttttttggtcaaacaaaagtaaagaataataatcaaaagttgttgtgagttaaacgagtccgctcaatcatggtttgacatttcacatgtacataagtttgtgggcttacgaatctagagcccattcgaaaagcccacataaaaaaccctagaaatggaggaggtgactttaaatattcttctttctctcctctttgtaaccttttctgatactttgcggcggagaagaagaagaagtgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggaaaacagcttgaagatggtcgtaccttggctgactacaacatccagaaagagtcgactctgcatcttgtcctgaggcttaggggaggtatcatcgagccgtctttgatggctttggctcgcaagtacaatcaagacaagatgatctgccgcaagtgttacgctcgtcttcacccaagggctgtcaactgcaggaagaagaagtgtggccacagcaaccagttgaggccgaagaagaagatcaagtgatctgttttgtttgttcacaacaaacttatttatctgtgtgttttttttccttgaaagacatctctagtgttttgacacaaactcgtttcagtggattttaatcctacaagattttcgttagtaaatctgaattgtctttggctttttttttttctttacaaattccaactttttgtcatcttatttaatttgccaatagttgagtta

SEQ ID NO: 10628 - DNA, 521 bp, Allium cepa
tacggcctagttacggggataccgccgccgtctaactaattgcagatctttgttaaaaccctaacagggaagacaatcaccctagaagtcgagagcagcgacacaatcgataatgtcaaagctaaaatccaagacaaagaaggaattcctccggatcagcaaaggctgatttttgcaggaaaacagctcgaagatgggagaactctagctgactataacatccagaaagagtctactttgcatttggtgttgaggttgagaggtggacttatcgagccttctctgatggcacttgcaaggaagtacaaccaggataagacaatttgccgcaaatgctatgcaaggttgcatcctagggctgtcaattgcagaaagaagaaatgtggccacagcaatcagctaaggccgaagaagaagatcaagtaggcactttggcagttatttattgtgacggtgaaaaatatgatgggggaaccattcattttatctactttttatttatttactgaacaaaatatttt

SEQ ID NO: 10629 - DNA, 566 bp, Petunia hybrida
agtgagagagagcggcgcaaaaatgcagatcttcgtgaaaactcttactggaaaaacaatcactctggaggttgaatcgagtgacactattgacaatgtcaaagctaagattcaagacaaggaaggtatccaccggaccagcagcgattgatttttgcgggaaagcagctggaagatggacgtacccttgctgattataacatccagaaagagtcaacattgcatttggttttgaggctacgtggagggattattgagccttctcttatggctttggctaggaagtacaatcaggataagatgatttgccgcaagtgttatgctcgcttgcatcctcgtgctgttaactgcaggaagaaaaaatgtgggcatagcaaccagttgaggccaaagaagaagatcaagtaggcgtatgtgctgtttgcagttgctttgcatgatgtgtcatgcagttatatcgagttcttggtcttacagttttcagtcctgcttcaatttgaatgtcatggatagactagcatttgtcttaaacatctgatatattggacaagatttccgtgctgttt

SEQ ID NO: 10630 - DNA, 536 bp, Epimedium sagittatum
aggccgcggctgagacaggtgaagcgaaaaaatgcagatcttcgtgaaaaccctaacagggaaaaccatcaccctcgaggtcgaatcaagcgacaccatcgacaatgtgaaagctaagattcaggacaaggaaggtattcccccggaccagcagaggttgatctttgcaggaaagcaacttgaagatggccgaacactggctgattacaatatacagaaagagtcgactctgcatcttgtttgaggcttcgcggtggcattattgaaccttctttgatggctttggctaggaaatacaaccaagacaagatgatctgccgaaaatgttatgcccgcttgcatccacgcgccgttaactgtaggaagaagaagtgtggacactccaacctagttgaggcccaagaagaagatcaagtaaacttatttgcggatcctagacaacagcctgttggtgttggcttttttgttctgttttatttaaggaattgtactgttccgtgatacaaatctgttaactagacattttagctttatca

SEQ ID NO: 10631 - DNA, 586 bp, Avena sativa
cacaaccctcggccaaaatgcagatcttcgtgaagaccctcaccgggaagaccatcaccctcgaggtcgagagcagcgataccatcgacaatgtcaaggctaagatccaggacaaggagggaatcccgccggaccagcagcgtctgatcttcgcaggcaagcagctggaggatggccgtacccttgcggattacaacatccagaaggagtccaccctccatctcgtcctcaggctccgtggaggcatcatcgagccctccctgcaggcgctcgcccgcaagtataaccaaggagaagatgatctgccgcaagtgctatgcacgtctgcaccccagggctgtcaactgccgcaagaagaagtgtggccacagcaaccagctgaggcccaagaagaagatcaagaactagagtgcctctagtcagtttcatggaccggttgaatccattgccggtgtcagagattttatgctttattatcgtgtctggtcgtcgttgaacctttagttattttgctattatgctcttatcgttgtggtgatacttgacagtattggtatatggtagcaaactactcataattttgtgg

SEQ ID NO: 10632 - DNA, 1124 bp, Chenopodium quinoa
aattttgggttagggtttttccgctaatttccgacgtttttcgctcctaattcaagatgcaaatctttgtgaaaaccctgactggcaagaccatcaccctcgaggtggagacttctgatactattgagaatgtcaagaccaaaattcaggataaggagggtatcccaccggaccagcagaggctcatcttcgctggtaagcagttggatgatggcagaactctagctgactacaacatccaaaaggagtctaccctccacttagtcctccgtctgaggggtggtatgcagatctttgtcaagaccctaacaggcaagacgatcaccttggaagtcgaaacttctgacaccattgagaatgtgaagacgaagatccaggataaagaagggatcccaccggaccagcagaggcttatttttgctgggaagcagcttgaggatggccggactcttgcagactataacattcagaaggagtctactctgcatttggtcctccgtttgaggggaggtatgcagattttcgtgaagactctcactggaaaaaccatcaccctggaagttgaaagctctgacactatcgataacgttaagacaaagattcaggacaaggagggaattccaccagaccagcagaggctgatctttgccggaaagcagcttgaagatggccgcactcttgctgactacaacattcaaaaggagtctacccttcatctggttctgaggctacgtggtggaattattgagccttccctgatggccctggctaggaaattcaaccaagacaagatgatttgtcgcaagtgctatgctcgcctgcatcctcgtgctgttaactgcaggaagaagaaatgtggccacagcaaccagttgaggccaaagaagaagatcaagtagagcgaccagttgtttgcagctaatgtttgggcagcggtttccatggtgtcggtgttcggactaagctgtttaactatggctcgttggaggggtttactcaaattagctttaaaacatttgatcttttagttatagtattattactatatttatatctttaaataaggcgtacatcttccttagtagtcttatttgtccagaaatcagataattttgttgccttgg

SEQ ID NO: 10633 - DNA, 618 bp, Camellia sinensis
aaaaaaaaagttgagagagagagagagagagagatgcagatattcgtgaaaaccctaacggggaagacgataactctcgaggtggagagcagcgacaccatcgacaacgtcaaggccaagattcaagacaaggaaggaattccaccggatcagcagcgtctgatcttcgctggaaagcagcttgaagatggccgaaccctcgccgactacaacatccagaaagagtctacgcttcatcttgtattgaggcttagaggagggattatagagccttctttgatggctttggctcgcaaatacaatcaagacaagatgatctgcaggaaatgctatgctcgcctgcatccaagggctgtgaactgccggaagaagaagtgtggccatagcaaccagcttaggcccaagaaaaaagatcaagcgaacactagtgaaatttctgcatctagaggtggatccggagcatcaaattctaaacaaagcaagtacaaacttttatttcagcagacattatctccatattatgttttgtgattctccttgaagcattttacttgtaattggtaccggattggatcttgaatttaccatatatcatgatgttcctcaatttttgatgaa

SEQ ID NO: 10634 - DNA, 526 bp, Thalictrum flavum
gaagtatgcagatcttcgtgaaaaccctaacagggaagacgataacccttgaggttgaaagcagtgataccattgataatgtcaaagctaagattcaggacaaggaaggtattcctccagatcagcaacgattgatctttgctggaaagcaacttgaagatggccgaactcttgctgattacaacattcagaaagaatctactctgcatttggttctaaggcttagaggaggaatcattgaaccttcttgatggctttggctaggaagtacaatcaggacaagatgatctgcaggaagtgttatgctcggttgcatcctagggcagtgaattgcagaaagagaaatgtggtcatagcaatcagttgaggcctaagaagaaaatcaagtgagctcaggtgttttacattttgtacttgtcagactattttgaattgtaaggcatacatcatgtattgcattacaattgcttttgattgtgcgcaaattgttacttcagttttccaaatatatttgcttatgattttt

SEQ ID NO: 10635 - DNA, 662 bp, Nicotiana tabacum
ggccattacggccgggggatgagaaaactcctaaaccctaaaaatcaccaatataagcttcctgaaggaaaaaaaaggctgcaaccccatcgcggaagttccagttatgggagagataagatgcagatcttcgcgaaaaccctaacggggaagaccatcacccttgaagtcgaatccagcgataccatcgacaatgtcaaggccaagattcaggacaaggaaggtattccaccggaccagcagcgattgatctttgctggtaaacagcttgaagatgggcgtacactggctgattataatatccaaaaagagtcgactctgcatcttgtcctgaggctccgtggagggaatcattgaaccgtctcttatggccttggccaggaaatacaaccaggataagatgatttgccgcaagtgctatgcccgtctgcatcctcatgccgtaaactgcaggaagaagaaatgtggccatagcaaccagttgaggccaaagaagaagatcaagtaaacaggaggttgcatttgctgtctagatgctatgccaattgcatgattttgtagttctttgcttagctcacattttggtggctctattgttgtctgtttaactgcagcacacatttgtttcaacttcagtttcatttacaaaaagaatttagtgc

SEQ ID NO: 10636 - DNA, 1033 bp, Centaurea maculosa
ggttaaaactcctctcaattagatcagggaaaatcaatagcacatcaagcactatggcctgcatagtgttaaacctaacatacctactgaaattagggttcctgaccacaatgaagtaaagcgtcaggaacaccaggaatccgttgaaagggaagctcttgaaaaccctaattgcaggcaccaggggctggattagggtttggaggaaggagaactgagtgattacgtacttgccgtattggattccgtcgaagaacgggtagaagtagcagacggtggttgggtttgatttggatctggcgggaagctagggttttgagattgggggttgagatggaggaatggagatgagtagagaggtgtgggttttcggaaggagtatggagtcgtaggtgatgataataaggtgttggccatcgccatggccatggcgattttttggtggattttggagttgcagagtagagtgaagaagaagaagatgatgaaatggaagaatattctagaaaaccctaaccgggaagaccatcacccttgaggtcgagagcagcgacaccatcgacaatgtcaaggccaagattcaggacaaggaaggtattcctccggatcagcagcgattgatcttcgccggaaagcagcttgaggatggccgaactcttgccgattacaacatccagaaagaatcgactcttcatttggtgttgaggctcaggggaggaatcattgaaccttctttgatggcattggctaggaaatacaaccaagacaagaccatttgccgcaagtgttatgctcgccttcacccaagggctgtaaactgcaggaagaagaagtgtggccacagcaaccagctaaggcccaagaagaagatcaagtgaagagttacaagtggtttgtgcttgagaaaagtagaactgatattgttaaattttggaacatctgcatttattttgattagtcattttgtttgtaaggaccaatgaaagtaaacttgatgatgatttcatctaattcaggattggtttttcttttt

SEQ ID NO: 10637 - DNA, 379 bp, Helianthus annuus
aatgcagatcttcgtgaagacattgacgggaaaccatcacgctcgaggttgaatcgagcgataccatcgacaatgtcaaggctaagatccaagacaaagaaggaattccaccggaccagcagcggttgattttcgccggaaaacaactcgaggatggaaggactcttgcggattataatattcagaaagagtctacacttcatttggtgttgaggcttcgtggtgggattattgaaccgtctttgatggctttggcgagaaagtataaccaggataaaactatctgccgcaagtgttatgctcgtctgcacccaagggcagtaaactgcaggaagaagaaatgtggccacagcaaccaactaaggccaaagaagaagat

SEQ ID NO: 10638 - DNA, 626 bp, Vinca minor
tagcagatcttcgtgaaaaccctaaccggaaagaccataaccttagaggttgaatcctctgatactattgacaatgttaaggccaaaattcaagacaaggaagggattccaccggatcagcagagattgattttcgcgggaaaacagttggaggatggccgtactttggctgattacaatatccagaaagagtctactcttcatttggtgctgaggctgcgcggaggtattattgagccgtcactgatggctttggctaggaagtacaaccaagacaagatgatttgtcgcaagtgctatgctaggttgcatcctcgtgctgttaactgccgcaagaagaagtgtggacacaccaaccagttgaggcccaagaagaagattaagtagacgtgttgttcaacgcatgctctgtttcattttgtagctcgtcttagtataacttctttttgctgctaccgttcagaagatggattattattgtatgtttgaattggtttacgagaatagtttttttataacaatgtttttcatattccgcctggaccaaacacaaatgcttgagtggaacatatttcgaatctacctattttctatgggtttcataatccaagctctgtcgttagtac

SEQ ID NO: 10639 - DNA, 617 bp, Vinca minor
tagtatattggccgtagaaaatagcagatcttcgtgaaaacactcaccggaaagaccataacccttgaggtcgaatcctccgataccatcgacaatgttaaggctaaaattcaggacaaagaagggatcccaccggaccagcagcggttgattttcgcgggaaagcagcttgaggatggtcgtactttggccgattacaacatccagaaagagtcgactcttcatttggttctgaggctgcgtggaggaattatcgagccatctttgatggctttggccaggaagtacaatcaagacaaaatgatttgccgcaagtgctatgcaaggttgcatcctcgtgctgtgaactgcaggaagaagaagtgtgggcataccaaccagttgaggcccaagaagaagatcaagtagacgtgctgtttcatgcatgctgtgttgcattttgtagctcgtcttagtttaactgctttcttctgctacagtttagaaatttgaagtgagccttttatcagtattttggttaaattttactctggatgttacaatttgagtttgaattaaaattgttacaagttgcagataagatatgactctcaaattgaaagataggccaatgatca

SEQ ID NO: 10640 - DNA, 636 bp, Cucurbita pepo
ctagtagttgctaaccagagagagccttaacgacgacacgacaggatgcagatcttcgtcaaaacccttactgggaagacgattacgttggaagttgagtccagcgacaccatcgacaatgtcaagctaagatccaggacaaggaaggtattcctccggaccagcagaggcttatcttcgctgggaagcagcttgaggatgggcgaactctcgccgactacaacatccagaaggagtcaactctgcacttggtgctcaggcttcgtggtggtattattgagccttctttgatgctttggctaggaagtacaatcaggacaagatgatctgccgcaagtgctatgcccgcctgcaccctcgtgctgtcaactgcaggaaaagaagtgcggacacagcaaccagttgaggccaaagaagaagatcaagtagaccattgatttggagagaggaaacctatgcaaaagtttatgttttatttattttgggtgcatttatgctcagaactatttgcttaacactcattaggagttggaattgttgtaatttttgtttctgcgacattctcagttatggtatgttttgtttcttgactttgtagtaccaaatcttcggtcattttattttccatcaacagct

SEQ ID NO: 10641 - DNA, 521 bp, Nicotiana benthamiana
tagcgaagagaaccaaaaatgcagatcttcgtgaaaaccttaacagggaagaccataaccctagaggtcgaatcgagtgacaccattgacaatgtcaaggctaagattcaggataaggaagggattccaccggaccaacaacgtctgatatttgctggtaaacagcttgaagatggtcgtacgcttgcagattataatatccaaaaagaggccactttgcatcttgtgctgaggcttcgatgtgggattattgaaccgtctcttatggctttggcccggaagtacaaccaggataagatgatctgccgcaaatgatatgcccgtttgcaccctcgtgctgtcaactgcaggaaaaagaagtgtggccatagcaaccagttgaggccaaagaagaagatcaagtaaacaggtggttgcatttgctgtcaagacgctttataatttggcactcttttgttttttatttgcttgttgactttggtctgtccttcagcgtctgcttcactatattctacataact

SEQ ID NO: 10642 - DNA, 696 bp, Avena sativa
gatgcagatcttcgtgaagaccctgacggggaagaccatcaccctcgaggtcgagagcagcgacaccatcgacaatgtcaaggccaagatccaggacaaggaaggaatcccgccggaccagcagcggctgatcttcgcgggcaagcagctggaggatggccgcaccctggccgactacaacatccagaaggagtccaccctccatctcgtcctcaggctccgtggaggcatcatcgagccctcctgcaggcgctcgcccgcaagtataaccaggagaagatgatctgccgcaagtgctatgcacgtctgcaccccagggctgtcaactgccgcaagaagaagtgtggccacagcaaccagctgaggcccaagaagaagatcaagaactagagtgcctccagtcagtttcatggaccggttaaatcgattgccggtgtcagagattttatgctttattatcgtgtctggttgtcgttgaacctttagttactttgctattatggatcttatcgttttggtgataattgacagtgttggtatatggtagcaaactactataattttgtggtatctgctctgtttgctgtgatatcttgtggatctagtgttgttgtttggcttagcactgtcctatggtttttgtcatcgaaatctagtcggaattgccaatgtgaatgccataatttatctactgcc

SEQ ID NO: 10643 - DNA, 571 bp, Avena sativa
cagccgccatcatccaggatgcagatcttcgtgaagaccctgacgggaaagaccatcaccctcgaggtcgagagcagcgacaccatcgacaatgtcaaggccaagatccaggacaaggaaggaatcccgccggaccagcagcggctgatcttcgcgggcaagcagctggaggacggccgcaccctggccgactacaacatccagaaggagtccaccctccacctcgtgctccgcctccgcggcggcatcatcgacgccctccctccaggccctcgcccgcaagtacaaccaggagaagatgatctgccgcaagtgctatgcacgcctgcacccaagggccgtcaactgccgaaagaagaagtgtggccacagcaatcagctgaggcccaagaagaagatcaagaactagagctcaagccatcattgcctttgtgaaaccagtagacataaaacttcagtttttctgttctgttatgctgctctttgggtggtgtcagaatgtttgaacctgttaactgtatgcgagtactttgtcttgctgtaatgttaacatggtaacaatgtcgtcgcc

SEQ ID NO: 10644 - DNA, 623 bp, Avena sativa
cgccgggaaacctccgatctaagcgaagccaaggctctctcgtcctcctcctcaagatgcagatctttgtgaagaccctgaccgggaagaccatcaccctcgaggtcgaggcagcgacaccatcgacaacgtcaaggctaagatccaggacaaggaggggatcccgccggaccagcagcggctgatcttcgcgggcaagcagctggaggacggacgcaccctggccgactacaacatccagaaggagtccaccctccacctcgtcctccgcctccgtggaggcatcatcgagccctccctccaggcgctcgcccgcaagtataaccaggagaagatgatctgccgcaagtgctacgcacgcctgcacccaagggctgtcaactgccgcaagaagaagtgtggccacagcaatcagctgaggcccaagaagaagatcaagaactagagtgcctctagtcagtttcatggaccggttgaatccattgccggtgtcagagattttatgctttattatcgtttctggtcgtcgttgaacctttagttactttgctattatggatcttatcgttttggtgataattgacagtgttggtatatggtagcaaactactataattttgtgg

SEQ ID NO: 10645 - DNA, 533 bp, Flaveria ramosissima
cgtgaagacattgacggggaagacaatcacgctcgaggtcgaatcgagcgatacgatcgacaatgtcaaggctaagatccaggacaaagaaggaattccaccggatcagcagcgtctgatctttgctggaaaacactcgaggatggaaggactctcgccgattacaacatccaaaaagagtctacgcttcatttggtgttgaggctccgtggtggtattattgaaccttcgttgatggctttagctaggaagtataaccaggataaaaccatctgccgcaaatgttatgctcgtctccatcctcgtgctgtcaactgcaggaagaagaaatgtgggcacagcaaccagttgaggccaaagaagaagatcaagtagacgacgatgttactatgcatgtttttgaaagaaagatattttacatgtaagggtggtgcttttgttttacatcacttttgaatgtttctggaagatttttagacccttaaatattaagtctggtgtattttttataagctattgtaatgactttgatg

SEQ ID NO: 10646 - DNA, 811 bp, Fraxinus spp
ccgatagaggaaaatgcagatcttcgtgaaaactctaactgggaaaccaatcaccctcgaggtcgaatccagcgacacgattgataatgtcaaggccaaaattcaagacaaggaaggtattccaccggaccagcagcgattgatatttgctggaaagcaactggaagatggccgcactctcgctgattacaatatccagaaagagtcaacgttacatttggtctgaggttgcgtggagggattattgagccgtcctgatggcattggctaggaagtacaaccaggacaagatgatttgtcgaaagtgttatgcacgtctccatcctcgtgctgtgaactgcaggaagaaaagtgtggacacagcaaccagttgaggccaaagaagaagatcaagtagaagagatgtggagttgcttttagggagttattatcaagagatatgtcatgctgcagatgttggccaatttaaactgtctttctctctttgattgtttggggacataagaatcttattcaatttggatatttgagttataaaatgcctttctgtgctgttcattttagatagaatgttgtggttttaccatgaatctccttggtttgtcgtctactagtaattattttattagttatagtgcggttattttacttttgccctcctgaacaaacttgtatgtatcataaaatgaaccgagtcatttcacataatctgtgtgtataatttgctcaacaaacctacagtttgtgatactagcagtgcgttcaactcttttgtgatgactttatatcggatcttgggtgaattgttccc

SEQ ID NO: 10647 - DNA, 667 bp, Triphysaria pusilla
ttgcagatctttgtgaaaaccctgaccgggaaaacaattacactcgaggtcgaatcgagcgacaccatcaacaatgtcaaggccaaaattcaagacaaggaaggaattcctccggatcagcagcgtctgattttcgccggaaagcagctggaagatggacggacactcgcggattacatatccagaaagagtcgacgctgcatttggtattgaggctgcgtggaggaattatcgagccttcattgatggctttagctaggaagtataaccaggagaagatgatctgccgcaaatgttatgctcgtctgcatccgcgtgctgtgaactgtagaaagaagaagtgtggccacagcaaccagctgaggcccaaaaagaagatcaagtagactgttatgatgcttttcatgtattacagagatttttcttttagcagcctggctgcatatttggattctaattacattttctaccggcatgtattgcccaattatgtaccaaatatttgttgtgtgttgtattaggtaaatgctgaatttttatggtaatctgaatgattattttcaaaacaaaataaaaaagctaccaattctattacaaacccttatccttccccgaaattgcctcaaggaacacctcatcgagtttcgtttcccattggagctaaaca

SEQ ID NO: 10648 - DNA, 514 bp, Flaveria ramosissima
cgtgaagacattaacggggaagacgatcaccctcgaggttgaatcgagcgatacaatcgacaatgtcaaagctaagatccaagacaaagaaggaattcctccggatcagcagcgtttgatcttcgctggaaaacacttgaagatggaaggactctcgccgattacaacatccaaaaagaatctacgcttcatttggtgttgaggcttcgtggagggattattgaaccctcgttgatggctttagcgaggaagtataatcaggataaaactatttgccgcaaatgttatgctcgtctccatcctcgtgctgttattgcaggaagaagaagtgtgggcacagcaatcagttgaggccaaagaagaagatcaagtagatgatgatggtgatgatgttaatggcacttgctttttaaggttgtttgaatctgtaagagttgttgctttctttttagtaatctttttgtaagttttttaagttatgtttttggatcttaacatttatgtggtgattttg

SEQ ID NO: 10649 - DNA, 555 bp, Secale cereale
tcagccaaaatgcagatcttcgtcaagaccctcaccgggaagaccatcaccctcgaggttgagagcagcgataccatcgacaatgtcaaggccaagatccgagacgaagagggatccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgcaagaagaagtgtggccacagcaaccagctgaggcccaagaagaagatcaagaactagagtgctactagtcagtttcgtggaccggttgaatccatcaccgtgtcagagtttatgctttattattgtcgtcgaaccttattttactttgctttcagcctatcgatgtggtgatgataattgacaatattggtatatggtagcaaacctataatttt

SEQ ID NO: 10650 - DNA, 407 bp, Nicotiana benthamiana
ctcgtatcggagagataagatgcagatcttcgtgaaaaccctaacggggaagaccatcacccttgaagtcgaatcgagcgataccatcgacaatgtcaaggccaagattcaggataaggaaggtattccaccgaccagcagcgattgatctttgctggtaaacagcttgaagatgggcgtacactggctgattaaaatatccaaaaagagtcgactctgcatcttgtgctgaggctccgtggagggatcattgaaccatctcttgtggcagtggccaggaaatacaaccaggataagatgatttgccgcaagtgttatgcccgtctgcatcctcgtgccgtaaattgcaggaagaagaaatgtggccatagcaatccgttgaggccaaagaagaagatcaagtaaac

SEQ ID NO: 10651 - DNA, 469 bp, Flaveria ramosissima
cgtgaagacattgacggggaagacaatcacgctcgaggtcgaatcgagcgacacgatcgacaatgtcaaggctaagattcaggacaaagaaggaattccaccggatcagcagcgtttgatctttgccggaaaacactcgaggatggaaggactctcgccgattacaacatccagaaagagtctacgcttcatttggtgttgaggctccgtggtggtattattgaaccatctttgatggctttagcaaggaagtataaccaggataaaaccatctgccgcaaatgttatgctcgtctccatcctcgtgctgtcaactgcaggaagaagaaatgtgggcacagcaacagtgaggccaaagaagaagatcaagtagacgatgttactatgcatgttttagaaagaaagatggtttacatacatgtagtgggtggtgtcttttgttttacacctatttttgaatgtttctgga

SEQ ID NO: 10652 - DNA, 620 bp, Secale cereale
tcttcgtcaagaccctcaccggcaagaccatcaccctcgaggttgagagcagcgataccatcgacaatgtcaaggccaagatccaggacaaagagggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgtaagaagaagtgtggccacagcaaccagctgaggcccaagaagaagatcaagaactagagtgctactagtcagtttcatggaccggttgaatccatcaccgtgtcagagtttatgcttcattattgtcgtcgaaccttattttactttgctttcagcctatcgatgtggtgatgataattgacaatattggtatatctgtttgatctgcactcattggcaatctttctgtcaatgcttgtgcttcctttctctgcattgcggctactggacaggggttggttgcgatttctcagtt

SEQ ID NO: 10653 - DNA, 473 bp, Secale cereale
ttcgtcaagaccctcaccgggaagaccatcaccctcgaggttgagagcagcgataccatcgacaatgtcaaggccaagatcggaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgcaagaagaagtgtggccacagcaaccagctgaggcccaagaagaagatcaagaactagagtgctactagtcagtttcgtggaccggttgaatccatcaccgtgtcagtagtttatgctttattattgtcgtcgaaccttattttacttg

SEQ ID NO: 10654 - DNA, 810 bp, Secale cereale
atgcagatcttcgtcaagaccctcaccggcaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgcaagaagaagtgtggccacagcaaccagctgaggcccaagagaagatcaagaactagagtgctactagtcagtttcgtggaccggttgaatccatcaccgtgtcagagtttatgctttattattgtcgtcgaaccttattttacttgcttttcagcctatcgatgtggtgatgataattgacaatcttgtactatggtagcaaaacctcttaaagttttgaacccgtaaaaaaaaaaaattaaaaaaaaaaaaaaaaaaaacgaaagttactacgtacgtacgttagaactaccgaacgttacgtccgtttacgtaacggtaacgtaacgttaccggaccgtaaacgggtaccgtaaaccgtaaaccggggaaggggggttaaccgtaaggttccgagtaccgttaggacgtaactggacgtttaccaagacccgggtagtacccttaagacccttaggtccaaagggtttcgaaccg

SEQ ID NO: 10655 - DNA, 617 bp, Silene vulgaris
ggagcaggggcaagatgcagatctttgtgaagaccctgacgggcaagactatcacccttgaggtggagtctagcgacactatcgagaatgtgaagtcgaaaatccaggacaaggagggtatccctcctgatcagcagcgtctcatcttcgccggtaagcagctggaggatggcaggaccctggctgactacaacatccagaggagtccaccctccacttggtgctgcgtctgcgtggcggtatcattgagccatctctgcagatcctggcacgcaagtacaaccaggacaagatgatctgccgcaagtgctatgcccgcctgcacccccgtgccaagaactgcaggaagaagaagtgcggtcacagcaaccagctacgccccaagaagaagctcaagtaaacagcggcgtatcagaacagtccactgtgttataacagtcagtaacaagctgttgcatggacagctgtgacagtagtactgggacagccagtgtgacagcagcagctgcagtagcaggggtaacagttgtaaatggctgtgtgctggatcagctaggcggctgagaggcctattttcatgccatagcagctgtgtaactgtgggcggccgataacta

SEQ ID NO: 10656 - DNA, 508 bp, Helianthus annuus
atcttcgtgaagacattgacggggaaaaccatcacgctcgaggttgaatcgagcgataccttcgactatgtgcaggccaagatccaagacaaagaaggaattccgccggaccagcagcggttgatcttcgccggaaacaactcgaggatggaaggactcttgcggattataatattcagaaagagtctacacttcatttggtgttgaggctacctggtgcgattattgaaccgtctttgatggctttggcgagaaagtataaccaggataaaactatctgccgcaaatgttatgctcgtctccatccacgtgctgtgaactgcaggaagaagaagtgtgggcacagcaaccagttgaggccaaagaagaagatcaagtagatgatgatgttgttatggtactttggtttgaaggttgtttaaggttgtaaggatggtgcttacattttacaccacttttgaatttgaatgtcatgttttagactaaacatttatgatttgtgattttg

SEQ ID NO: 10657 - DNA, 420 bp, Sarracenia psittacina
ggagccatgcagattttcgtgaagaccctgacgggcaagaccatcacgctcgaggtcgagagctctgatactatcgacaatgtgaagacgaagatccaagacaaggagggcatcccccctgaccagcagcgtctcatcttcgccggcaagcaacttgaggatgggcgcactctcgccgactacaacatccagaaggagtcgacgttgcacttggtgctgcgtcttcggggtgtatcattgagccatcgcttatggctttggccaggaagtacaaccaggagaagatgatctgccggaagtgttacgctcgcctccaccccgcgctgtgaattgccgtaagaaaagtgacggacacagcaaccagcttcgacccaaagagaagatacaagtagaggttaagcttcgccgttgtgcatccct

SEQ ID NO: 10658 - DNA, 453 bp, Triticum aestivum
ccgcaaacatgcagatcttcgtgaagaccctgacgggcaagacaattaccctcgaggtcgagtcctctgacaccatcgacaatgtcaaggccaagatccaggacaaggagggcattcccccggaccagcagcgcctgatcttcgccggaaagcaactcgaggatggccgcacccttgccgactacaacatccagaaggagtcaacactccacttggtcctccgtctccgtggtggcatcattgagccctcgctcaaggcccttgcctccaagtacaactgcgacaagatgatctgccgcaagtgctacgcacgtctaccaccgagggctgtcaactgccgacaagaagaagtgcggtcacaccaaccacctccgccccaagaagaagctacaaatgacgattcgcttatattggcgtctggcgaagagagagtatcgggcacggtaggaaacg

SEQ ID NO: 10659 - DNA, 516 bp, Secale cereale
caagaccctgacgggcaagaccatcaccctcgaggtcgagagcagcgacaccatcgacaatgtcaaggccaagatccaggacaaggaggggatcccgccggaccagacagcggctgatcttcgccgggaagcagctggaggacgggcgcacgctggccgactacacatccagaaggagtcgacgctgcacctcgtgctccgcctgcgtgggggtatcatcgagccctcgctccaggccctcgcccgcaagtacaaccaggagaagatgatctgccgcaagtgctacgccaggctgcatccaagggctgtcaactgccgcaagagaagtgtggccacagcaaccagctgaggcccaagaagaagatcaagaactgaagccatcatcatcgccgctttcgttgtctggataaatcagtagacaaaaaatgttttcggttatcgttttgctgcccctcatgtcaggatgttgaaccttggttaactctagctgagtacttggccttgttttaattgtca

SEQ ID NO: 10660 - DNA, 619 bp, Vaccinium corymbosum
tgcagatattcgtgaaaaccctaacggggaagacgatcactctcgaggtagagagtagcgataccattgacaatgtcaaggccaaaaattcaagacaaggaaggaattcctcccgaccagcagaggctgatcttcgccggaaaacagcttgaagatggccgaaccctcgccgactataacatccagaaaagatcaactcttcatcttgtgctgaggcttagaggaggattatagagcctcgttgatggctttggctcggaagtacaatcaagacaagatgatctgcagaaatgtatgctcgcttcatcctagggctgtgaactgccgtaagaagaagtgtggccacagcaatcagctgaggcccaagaagaagatcaagtgagatactgagatggctacgttcttttgtgacttgatttggaactggagcatcaaattctagacaaactcagcgaagtactgtactttatatttgatacatttagtacgtattatttcccttttaaattgtgtttcaatttcgaccgaatgcatttctcgttaccaagatactattagttgctacaggattggatcttatggtcactatattttcttcttcaattttgatggatttgat

SEQ ID NO: 10661 - DNA, 555 bp, Sarracenia psittacina
tgcagatattcgtagaaaaccctaacgggtaagacgataactctcgaggtcgagagcagcgacaccatcgacaatgtcaaggccaagattcaagacaaggaagaattccaccggaccagcagcggctgatcttcgccggaaaacactcgaagatggccgaactctcgctgactataacattcagaaagatcgactcttcatcttgtattgaggcttagaggagggattatagagtccttctttgatggcttgctcggaatacatcaagacaagatgatatgcaggaaatgttatgctcgcctccatccaagggctgtgaactgccggaagaagaagtgcggacatagcaatcagctgaggcccaagaagaaaattaagtgaaggctcgaggactatgatacactatcgttgaggtggaagtagatcattgaattcttctctgtatggtgttttgattcccctcttttgcatttgacagtattgagattctgtagttgaagctggattggaacttcattttatttatctttttttggtgattatttttccataaag

SEQ ID NO: 10662 - DNA, 415 bp, Arachis hypogaea
agaagaagaagaagaagatgcagatattcgtgaaaaccttaactgggaaaaccatcactctcgaggtagagagcagtgacaccatcgacaatgtcaaaaccaaaatccaagacaaggaaggaatcccacctgatcaacagcgtctgatatttgctgggaagcagcttgaagatggaaggaccttagctgattacaacattcaaaaggagtctactctgcatcttgtgctgaggctccgtggtggtatcattgagcccttcttgatggctttggctcgcaagtacatcaagacaagatgattgccgcaatgctatgctcgccttcatccaaggccgtaaactgaccgcaaaaagagtgtggccatagtaatcagttgaggccaaagaagaagatcaagtaaactatgtctgttctt

SEQ ID NO: 10663 - DNA, 412 bp, Arachis hypogaea
gcagtggtatcaacgcagagtacggggggggcgcagagcatcaccctaaggatgcagatattcgtgaaaaccctaaccggcaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacatccagaaggagtcaacgcttcatcttgtcctcaggcttcgcggtggcatcattgagccttctctcatggcattggcccgcaagtacaatcaagcaagatgatttgccgcaagtgctatgctcgccttcaccaggcgttaactgccgcaagaagaagtgtggtcacagtaaccagttgagg

SEQ ID NO: 10664 - DNA, 527 bp, Humulus lupulus
cttagcaaagatgcagatcttcgttaagaccctgacgggcaagaccatcaccctcgaggtcgagtcctctgacaccatcgacaatgtgaagagcaagatccaggacaaggagggcattccccggaccaacagcgcttgatcttcgccggcaagcagctcgaggacggccgcaccctctccgattacaacatccagaaggagtctaccctccacctggtcctccgcctccgtggtggtatcattgagccttccctcaaggcccttgcctccaagtacaactgcgacaaggccatctgccgcaagtgctacgctcgtctccctccccgtgccaccaactgccgcaagaagaagtgcggtcacaccaaccagctccgccccaagaagaagctgaagtaaactactcgctctcggctggcgcgcattgttcgacagaggaagactcggacatgggagttgtttttggtggattactacggcgtcctcgtatgataggtagcgggaaatgccaactctgccatgtttgaatg

SEQ ID NO: 10665 - DNA, 550 bp, Chrysanthemum coronarium
tccccaccgaaagaatctctcaccgatcgaaatcgaagcgaagcctctctcgtcctcaagatgcagatctttgtgaagaccctcactggcaagactatcacccttgaggtggagtcttctgacaccatcgacaatgtcaaggccaagatccaggacaaggagggccatccccccagaccaacaacgactgatcttcgccggcaagcagctcgaggatggccgcaccctgagcgactacaacatccaagaaggagtccaccctccacttggtcctccgtctccgtggaggcatcatttgagccctcgctcaaggtccttgcctcaaaatacaactgcgacaagcagatttgccgcaagtgctacgctcgtctccctccccgtgccaccaactgccgcaagcgtggctgcggtcactcgtctcagctccgccccaagaagaagctgaagtagtggttgtgcggcgtctggaggattccggtgtgcgactggcgtgggctttcatgtactattcacatgcagttttatgacatggcctctcactttctgcatc

SEQ ID NO: 10666 - DNA, 417 bp, Arachis hypogaea
agtggtatcaacgcagagtacgggggacggcgcagagcatcaccctaaggatgcagatattcgtgaaaaccctaaccggcaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacatccagaggagtcaacgcttcatcttgtcctcaggcttcgcggtggcatcattgagccttctctcatggcattggcccgcaagtacaatcaagacaagatgatttgccgcaagtgctatgctcgccttcaccagggcgttaactgccgcaagagagtgtggtcacagtaaccagttgaggacaaaga

SEQ ID NO: 10667 - DNA, 465 bp, Picea glauca
ctcagctagtggccggccgcaaagatgcagatcttcgtgaagactttgacggggaagaccatcactcttgaggtcgagcccagtgacactatcgaaaatgtcaaagccaagattcaggataaggaaggaattcctcctgatcagcagcgtctgatcttcgctggcaagcagctggaggatgggcgtaccctctcggattacaacatccagaaagagtcaaccctgcatctggtgctccgtctgcgtggtggcatcattgagccttccctcagaatgcttgcccagaagtacaactgtgacaagatgatctgccgcaagtgctatgcccgcctccaccccgtgctgtcaactgccgcaagaagaagtgcggacacaccaacaacctgcgccccaagaagaagctgaagtagatttttgtacttctagctcttcaacccgtggtgtgttaaaataaacgttaaaaaa

SEQ ID NO: 10668 - DNA, 1833 bp, Fagus grandifolia
gctgaattagatgggaaactgaagctagctggctattttcctgaactaatatggggggacttaggctgagctgcttacataagctagctgggtatgacgccacaactgggttaggtttgatgccaaaactaatgactataaggtggtgaggttcgtgactcctcagtataaaggcaaaaagggaaagactaccacctgaagtggaggtttactcacttgccgactggcgaatggagaaggttactgctttggctcccattggtgctgcacgtcgtcaagaacgactagactttttcgaatggggctctgcattgggtactgtgaggaggctgtctgataaggattgattaatttatatggtactcgatttgggggacgaggtcttccacgagatagcgctgccgaaactttcggaagaagatgattacttggcacaggggtctctttcagcttatggcaattcccttgccctgtttctgaagagtaagcacggtctcaatatatgggtgatgaaggagtatggcgttgagtcctcgtggaccaaagtttgcacttatgctgtttcgggatttgaatatcacgcactagcttttaggagaagtggtgaggttatattggaagatctaaaagaacagctcgtctcgtgtgaccttgagagtcaaaagagtaaggatcttggcattactggatatgggtatacctttgctgattcttatgttgagagtttagttttgcttgacaaacccaaccgtgcagttacttactgaggaaaaagaaagaggaacaacaacaggagctcgtgctttcatggttggcgatgagctgtaaataactaacagactttgactcagcaaaagaaaagattacaaagctttttgatggtctttagtttcctagtattggcattagtttataatgttaaaggagtttattatgttaaaatcttttgtggtacactattcttatgttagtatttctggatgatttgcagtttggtttcagtgtgtttacaaaaatgattaagcacttaattgtgtctgtcatgcttgcattgtgtgtgttaaatttgtccttgatctgtcaactgggtaggagttatacctatctaatgggttgaaaggtatatacggtaaaaatatatatatttgtcatttaatcataggatgtttacatctaagatgatagtagaaagttaaaaggagttaaaaaaaaattgcatacgacattttaccatcaatctaataagggctttactggatagtccaaattgcaacatatgttctttaatttaattttttaccattaaggtttggactattacgattcactaacaagaattttaaaaatatctaatatctaaccgggaagaccataactctcgaggtcgagagcagcgacaccatcgacaatgtcaaagccaagatccaagacaaggaagggattccgccggatcagcagcgtttgatcttcgctggaaagcaactcgaagatggccgaaccctagctgactacaacattcagaaagagtcaactctacatcttgtgctgaggcttcgtggtggaatcattgagccttctttgatggctttggcacgcaaatacaatcaggacaagatgatttgccgcaaatgttatgctcgtctgcacccaagggctgtaaactgcaggaagaagaagtgtggccatagcaatcagctgaggccaaagaaaaagattaagtagactctggaccattattgcgctttatgtctcggattgtaattgaaatattatgttagaaccaagatatttagtatgtggtttacatcataatggattatttcctgtcatcaa

SEQ ID NO: 10669 - DNA, 386 bp, Secale cereale
ggcaagaccatcaccctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctccgcgcggcatcatcgagccctcgctccaggccctcgcccgcaagtacaacccaggagaaagatgatctgccgcaagtgctacgccaggctgcatccaagggctgtcaactgccgcaagaagaagtgtcggccacagcaaccagctgaggcccaagaagaagatcaagaactagaagccatcatcatcgccgctt

SEQ ID NO: 10670 - DNA, 531 bp, Sarracenia psittacina
gacgataactctcgaggtcgagagcagcgacaccatcgacaatgtcaaggccaagattcaagacaaggaaggaattccaccggaccagcagcggctgatcttcgccggaaaacaactcgaagatggccgaactctcgctgactataacatccagaaagaatcgactcttcatcttgtattgaggcttagaggagggattatagagccttcttgatggctttggctcggaaatacaatcaagacaagatgatatgcaggaaatgttatgctcgcctccatccaagggctgtgaactgccggaagaagaagtgcggacatagcaatcagctgaggcccaagaagaaaattaagtgaaggctcgaggactatgatacactatggttgaggtggaagttgatcactgaactcttgtctctgtatggtgttttgattcccctcttttgcattcgacagtattgagatactgtagttgaagctggattggaacttcattttatttatccttttgttggtgattatttttccataaag

SEQ ID NO: 10671 - DNA, 738 bp, Avena sativa
gcgacacacaatcaacgtagagttggacgccaccatgcaaatcttcgtcaagacactaacgggtaaaaccaatcaccctccgaggtagaatcttcggacaccatcgaaaatgtcaagtccaagattcaagacaaagaaggcattcctcctgaccaacaacgattaattttcgctggcaagcaactcgaagatggtcggactctactcgactacaatatccaaaaggagtcaactcttcacctcgtgcttcgccttcgtggtggaatgattgagccctccctaagagctctcgcatcaaaattcaactgtgaaaagatgatttgccgcaaatgctacgctcgcttaccccctcgggctacgaactgccggaaaaagaaatgtggacacacaaatcagctccgacccaagaagaagataaagtcgtgatctacttgaatctcctaaaaattcgtcctcaacaagatccgttttcatgagaacggacatatggcatgtcaaatataattaaagaacgcggaacacttggaaactagcggatgtaaattcagaggtaatggtatgtgccttgccttaaatgaaaacaacaaatcatgtatcagacgcaataatcaaaaaactattggcaaatgtctagtatggaggatacatagatttaagtcaaacctaatacctgttattaatgctctcataacaccgggctgcccgtaaaacaccaattatacacacaaatcagatgcc

SEQ ID NO: 10672 - DNA, 487 bp, Amaranthus tuberculatus
ttcgtatactccgaaattacttgcggaaaactttggtctgcgcacaactgaaagaacacatcaacatgcaaattttcgtgaaacccttacagggaagaccatcacccttgaggtcgagtcttctgacactatcgaaaatgtcaaagctaaaattcaagataaagaaggtatcccacccgatcaacaacgtttgatcttcgccggcaagcagcttgaagatggacgtactttgtcggattataacatccaaaaggaatctacattgcatttggtattacgtctgcgtggtggtgttattgagcccactcttcgtttgttggcccagaaatacaactgtgataaaatgatatgccgcaaatgttacgctcgtcttcacccaagagcaactaactgccgtaagaagaagtgtggacacactaacaacttgcgcccaaagaagaagttgaagtaatcgcattttgcttgtactccgaggaacactacgaac

SEQ ID NO: 10673 - DNA, 390 bp, Sesamum indicum
cgagtgctcaatttgcgaaaatgcagatcttcgtcaaaaccctcaccggaaagacaataaccctcgaggtcgaatcgagcgacaccattgacaatgtcaaggccaaaattcaagacaaggaaggaattccaccggaccagcagggttggatttttgctgggaagcagctcgaggatggccggaaactcgcggactacaatattcaaaaagagtcaaccttgcatttggttttgaggcttcgtggggggattatcgagccatcgttgatggctttggctaggaagtacaacagaacaaaatgatctgccgcaaatgttatgcccgtctgcatcctcgtgctgttaattgtaaaaaaaaaaagtgtgggcccagcacccagctgaggccaaa

SEQ ID NO: 10674 - DNA, 1026 bp, Rosmarinus officinalis
ataaaccctcgttttcgcattgatcttcgttcatcattgtcaccagctgcaaatcatttcttcatatctcttcattctacaaccttcttcgttccgtttcgccaagatgcagatctttgtgaaaaccctcaccggcaagaccatcacccttgaggtggagagttccgacaccatcgataacgtcaaggctaagatccaggacaaggaaggcatccctcctgaccagcagaggcttatcttcgccggtaaacagcttgaggacggccgcacccttgccgactataacatccaaaaggagtcaaccctccacttggtcctccgtctccgcggtggaatgcagatcttcgtcaagaccctcacgggcaagaccatcaccctcgaggtcgaaagctctgacaccatcgacaacgtcaaggctaagatccaggacaaggaaggcaaccctcctgaccagcagaggcttatcttcgccggcaaacagcttgaggacggccgcgcccttgccgactataacatccaaaaggagtcaaccctccacttggtcctccggctccgcggtggaatgcagatcttcgtcaagacccttacgggcaagaccatcactcttgaggtcgagccctcagattccattgagaatgtgaaggctaagattcaggataaggaaggtatccccccagaccagcagcgtctcatcttcgctggcaagcagcttgaagatggcaggacattgtctgactacaatattcagaaagaatctactcttcacttggtgctgcgtctccgtggtggtgtcattgagcccactctccgtatccttgccatgaagtacaactgtgacaagatgatctgccgcaagtgctatgcccgtcttcaccctagggcaactaactgccgcaagaagaagtgtggtcacacaaacaacctccgccccaagaagaagctgaagtagactattattgttttatttgtgtttgggaggtgttccatctgtcatactcaatgttctattttaaattcaataaaaca

SEQ ID NO: 10675 - DNA, 626 bp, Hordeum vulgare
gatctcagcatttagaaggggacgagccatgtcgatgcaaattttcgtcaaaacccttacgggtaaaaccatcacattggatgtggaatcctctgattccattgaaaatgtcaaacaaaagatccaagacaaggaaggaatcccccctgatcaacaacgtttaatctttgccgggaaacaattggaagatggacgtaccttagcggactacaacatccaaaggaatccactcttcacttagtgcttcgtcttcgaggtggtgtcatcgaacctgccttgatggaattggcacgtaaatacaactgtgaaaagaaaatctgccgaaaatgttatgctcgtctccacccccgtgccaccaactgccgcaaaaagaaatgcggtcacacgaaccaactccgtgtcaagaaaaaactcaaataagcgtccgattatgcatcatcattgtgccgtggatggacacgggcagtgcgccgcgtgtacttgttcgtcccttcacgtatgtgtgggtgcgtatgtagggcttctacagcttgtcttgacatgggttcaggcatgacgctccacatactcatcctcaccgcaccaatcaatggcacacccatttgtcgtcccaaaaaaaaaaaaaa

SEQ ID NO: 10676 - DNA, 482 bp, Cedrus atlantica
cgggcgatgcagattttcgttcaagaccctgacgggcaagactatcacgttggacgtggagtcttcggactccatcgagaacgtgaagaccaagatccaggacaaggaggggcatccccccggatcagcagcgcctcatcttcgccggcaagcagctggaggatggccgcaccctggctgactacaacatccagaaggagtccaccctccacctggtgctgcgcctggtcgctggtgtcatcgagcccgccctgatggagttggcccgcaagaccaactgtgacaagaaggtgtgccgcaagtgctatgcccgcctgcacccgcgcgccaagaactgccgcaagaagaagtgtggccacagcaaccagctgcgccccaagaagaagctcaagtaaacagcccacctccgtgtggctgctctctgcttcctcgagcgctgctacctctgccgctgcctcctcttccgtccctcgcgccgtcct

SEQ ID NO: 10677 - DNA, 583 bp, Picea glauca
tcagctagtggccggccgcaaagatgcagatcttcgtgaagactttgacggggaagaccatcactcttgaggtcgagcccagtgacactatcgaaaatgtcaaagccaagattcaggataaggaaggaattcctcctgatcagcagcgtctgatcttcgctggcaagcagctggagatgggctaccctctcggattacaacatccagaaagagtcaaccctgcatctggtgctccgtctgcgtggtggcatcattgagccttccctcagaatgcttgcccagaagtacaactgtgacaagatgatctgccgcaagtgctatgcccgcctcaccccgtgctgtcaactgccgcaagaagaagtgcggacacaccaacaacctgcgcccaagaagaagctgaagtagatttttgtacttctagctctcaaccgtggtgtgttaaaataaacgttaaaaaagatattcctggtttactcttcttttggtggggggaggaaaaacaactatcattcatggcttcaactacttggttggtctcccaatgaggcattagacatcatttgaggtatgaggattgcttatg

SEQ ID NO: 10678 - DNA, 738 bp, Triticum aestivum
aagacactcactggcaagaccattactctggaagttgaaccctcagattctattgagaacgtaaaggccaaaatccaagacaaagaaggcatccccccagatcagcagcgtttgatcttcgctggaaagcaactcgaggatggtcgtactctgtctgactacaatattcagaaggaatccaccctccatcttgtcctccgtctgcgtggtggaatgcagatctttgtcaagacactcactggcaagaccattactctggaagttgaaccctcagattctattgagaacgtaaaggccaaaatccaagacaaagaaggcatccccccagatcagcagcgtttgatcttcgctggcaagcagcttgaagatggcaggacattgtctgactacaatattcagaaagaatctactcttcacttggtgctgcgtctccgtggtggtgtcattgagcccactctccgtatccttgccatgaagtacaactgtgacaagatgatctgccgcaagtgctatgcccgtcttcaccctagggcaactaactgccgcaagaagaagtgtggtcacacaaacaacctccgccccaagaagaagctgaagtaaactactcgctctcggctggcgcgcattgttcgacagaggaagactcgaacatgggagttgtttttggtggattactacggcgtcctcgtatgataggtagcgggaaatgccaactctgccatgtttgaatgaaagcca

SEQ ID NO: 10679 - DNA, 488 bp, Chrysanthemum coronarium
acgtggacaacgaccatccaccctgaagtcgaagctctgatactattgacaatgtcaaggccaagatccaggacaaggaagaatcccacctgatcagcagaggttgatctttgctggaaagcagctggaagatggtcgtactcttgctgactacaacatccagaaagagtcaactcttcatttggtgttgaggttgagaggaggaatcattgagccttccttgatggctttggcaaggaagtacaaccaagacaagaccatttgtcgcaagtgttatgcgcgtctccatccaagggctgttaactgcaggaagaagaaatgtggtcacagcaaccagctaaggccaaagaagaagatcaagtaggcttgtgagcgttttctgtgttggagagcagcttgtctagctatgtttagagctttatttccagtcttttttattttctgctgttaagtacctatggaaaacttatgaattctactttttaatt

SEQ ID NO: 10680 - DNA, 383 bp, Amaranthus tuberculatus
gcaataattcgtcaagactctcaccggaagaccatcacccttgaggtagagagttctgataccatcgacaatgtcaagactaagatccaagacaagagggaattcccccagatcagcaaagattgtatcttcgctggaaagcagcttgaagatggccgtactcttgctgattacaacattcagaaagaatcaactcttcatttggtgttgaggcttagaggaggaattattgagccttcattgatggctttggcccgtaaattcaaccaagacaagatgatttgccgcaagtgctatgctcgtttacaccccagggtcttgttgtaatttgtccgttaagaagaagtgtggtcacagtaaccagctgaggcccaagaaaaaga

SEQ ID NO: 10681 - DNA, 493 bp, Fagus grandifolia
tataggaattaatttccataaaaaatgcaaatcttcgtcaagacccttacgggtaagaccattaccctcgacgtcgagtccagcgactccattgaaaacgtcaaggccaagatccaagacaaggaaggcatcccacccgaccagcaaagactcatcttcgccggcaagcaactcgaggacggaagaactctttctgattacaacatccagaaggaatccaccctccacttggtccttagattgagaggcggtgctatcgagcccactgtcgctgccctggccagaaagtataacgctgataaaatgatttgccgtaagtgctacgccagactcccattgaaggcccacaactgcagaaagagaaaagtgtggtcactccaaccagctcagacccaagaagaagcttaagtaagaagcatatagagatttcatggctgttgtatgttatctgttttgcgcgagtcatgctaattttctaattgatatggtattg

SEQ ID NO: 10682 - DNA, 462 bp, Sciadopitys verticillata
cgtaaagaccctcacgggcaagaccatcacgctcgaggtggaatcgagcgacaccatcgacaatgtcaagagcaagattcaggacaaggaggtatccaccggaccagcaacgcttgatcttcgccggcaagcagcttgaggatggccgcacgctcagtgattacaacattcaaaaggaatccacgctccatctcgtactccgccttcgtggaggtatcatcgaaccatccctcaaggcgctagcctccaagtacaactgcgataagatgatctgccggaagtgctacgctcggctccctccacgtgcaaccaactgccgcaagaagaagtgtggacacacgaaccagctccggccgaagaagaagctgaagtagatgctacgaggaaacggtgcggtacgaagcgatcgcttggtgatgattttgctgcaatgctatggctcaattgttgggctggtggtca

SEQ ID NO: 10683 - DNA, 546 bp, Sesamum indicum
gggggcgatcgtcagccagcaacaacgaaaaatcgcaaccatgcagatgtaggtttccctcgtactccgcacccatattgaacctttaaacccgccgatgcgacccagaaccggctgcgaaagatatgaaatgaacgatgacgggggaaacgttgctgacaagattccgatgatagtttcgtcaagaccctcacgggtaagaccattaccctcgacgttgagtcgagcgacaccatcgacaacgtcaaggccaagatccaggacaaggagggtatcccccccgaccagcagcgtctgatcttcgccggtaagcagcttgaggatggccgcaccctgagcgactacaacatccagaaggagtccactctccacctcgtcctccgtctccgtggtggtatcatcgagccttcccttaaggccctcgcctccaagtacgactgcgagaagaacatctgccgcaagtgctacgcccgccttccccctcgtgccatcaactgccgtaagaagaagtgcggtcacaccaaccaactccgccccaagaagaag

SEQ ID NO: 10684 - DNA, 554 bp, Silene vulgaris
tgccatgtcgatgcaaattttcgtaaaaacccttacgggtaaaaccattacattggatgtggaatcctctgattccattgaaaatgtcaaacaaaagatccaagacaaggaaggaatccccccagatcaacaacgtttgatcttcgctggaaaacaattggaagatggacgtaccttggctgactataacatccaaaaggaatctactcttcacttagtgcttcgtcttcgaggtggtgtcattgaacctgccttactggaattggcacgtaaatacaactgtgaaaagaaatctgccgaaaatgttatgcccgtctccacccccgtgccaccaactgccgcaaaaagaatgcggtcacaccaaccaactccgtgtcaagaaaaaactcaaataagcgtccaattatgcatcatcgtgccgtgggcgggttgtgcgcgacctgtgcgtcggttcgcgttcgtgttcatgttcgtgttcagcagtttgtcttgacatgtgttctggcatgaccaccctcactcctcaccgagacccaccccacccaccgcaccaa

SEQ ID NO: 10685 - DNA, 512 bp, Picea glauca
cgaccaagctttaactgcttgattcacttctacaagagaccagcagagatgcaaatcttcgtgaagacccttacgggcaagaccatcaccctcgaggtcgagccaagcgactccatcgagaatgttaaggctaagatccaagacaaggagggaatccccccagatcagcagaggttgatcttcgctggcaagcagctggaggatggcaggactctgtccgattacaacatccagaaggagtccacccttcacttggtgctccgtctgcgtggaggagttatcgagccctccctgcgtctgctggcccagaagtacaactgcgacaagatgatctgcaggaagtgctacgccaggcttcacccccagggccaccaactgccgcaagaaggcatgtggacacacctccaacctcagacccaagaagaagctgaagtaagctgcgactctgcatctggtcaggaggcctcttgcttgctggaaagtcttctgattagttgattgtctttgcccag

SEQ ID NO: 10686 - DNA, 713 bp, Secale cereale
tcagccagagtccagagcccggagtccagaccacccatcaccgtctccctcccgccttctgtccggagagctcgggaaggaggaagcagggacaggcgaagcggaggagcgacgagatgcagatcttcgtgaagacgctgacggggaagaccatcaccctcgaggtggagagcagcgacaccatcgacaacgtcaaggccaagatccaggacaaggaaggcatccctccggaccagcagcgcctcatcttcgccgggaagcagctggacgacggccgcaccctggccgactacaacatccagaaggagtccacgctccacctcgtgcttcgcctccgcgggggcgctgcatgatcgagcccaacctcaaggccctcgctcagaagtacaaccagggcaagctcatctgccgcaagtgctattcacgcctgcctcccaaggccaagagttgccgcaagaagaagtgtggccacagcaaccagctgaggtcaaagaagaagtgtaggtactgctgaagtgccatgaatgatcagttgaatcggctgactacctgtttaagcttgccagaactgtcagagtttaaagtatcttaatgtaatgttcctgctgatgttgagcgctgtatctttcgaaaacttggtttaaggttccggtgcatgcttgagacatgattgtaatatgacagcttagctcttttggctggagggagcattt

SEQ ID NO: 10687 - DNA, 815 bp, Solanum lycopersicum
caatttcttattataaataaactgagtgttatagagtgaaacttggagaaagtttctaaaacttatcctaaatatttctaaaaatatttcagaatttataacacttgctaagtatagtaattatgcgaactagaggggaggtgaatgtttcgtgagcccacatcactataagccctcccctgtaacaaaacccactctagcctcggatttgcttgacactccattgaagaagacgcagatcttcgtgaaaaccctaacagggaagactataacccttgaggttgaatccatcgatacaatcgacaatgtcaaggctaagattcaggataaggaaggcatccctccggaccagcagcgtttgatatttgctggtaagcagcttgaagatggacgtacgctagcagattataatatccaaaaaaggtctagtccactctgcaccttgttctgaggcttcgcagtgggattattgaaccttctcttatggctttggcccggaaatacaaccaggaaaagatgatttgccgcaaatgctatgcgcgtttgcacccttgtgctgtcaattgcaggaaaaagaagtgtggccatagcaaccaggccaaagaagaagatcaagtaaacaggttctcagcacaatggaagggagaaagatcaactgtgaataaagttcctcctattctctgcacacaaccttggctccattaatgtgagtaagaaaacatagacttttttgttgatcgaagttctacctgtttactcctttgaaagtattgatgtatatgttgagttcacaattcccaccacttagaattttc

SEQ ID NO: 10688 - DNA, 497 bp, Amborella trichopoda
cggaaatgacggtccggccataactggctctttttttaggttgggtttagtggtagcacgttgtctgaacaataaaaccaccatgcagattttcgtgaaaaccctcactggtaaaaccattactctcgaggtagaagcctctgataccatcgaaaatgtgaaagccaagattcaggataaagagggaattccaccagatcagcagcgacttatctttgctggaaaacagctggaagatggacgtactctctctgattataacatccaaaaagatccactctccatctcgtacttcgtcttcgaggggtgtaattgaacctactttgcgtatacttgcacagaaatataactgtgacaaaatgatatgtcgcaaatgttatgctcgtcttcatcctagagcaactaattgccgtaagaaaaaaatgtggtcatacaaataacattcggccaaagaagaagttgaagtaaactaaatacccaagtttccatttcatgtg

SEQ ID NO: 10689 - DNA, 556 bp, Amborella trichopoda
accggcggaaatgacggtccggccataactggctcttttttaggttgggtttagtggtagcacgttgtctgaacaataaaaccaccatgcagattttcgtcaaaaccctcactggtaaaaccattactctcgaggtagaagcctctgataccatcgaaaatgtgaaagccaagattcaggataaagagggaattccaccagatcagcagcgacttatctttgctggaaaacagctggaagatggacgtactctctctgattataacatccaaaaagatccactctccatctcgtacttcgtcttcgaggaggtgtaattgaacctactttgcgtatacttgcacagaaatataactgtgacaaaatgatatgtcgcaaatgttatgctcgtcttcatcctagagcaactaattgccgtaagaaaaatgtggtcatacaaataacattcggccaaagaagaagttgaagtaaactaaatacccaagtttccattttcatgtggaaatggaaatttatatttcttatatctggaatcaataaactttgactggtaaaa

SEQ ID NO: 10690 - DNA, 488 bp, Amborella trichopoda
ttaggttgggtttagtggtagcacgttgtctgaacaataaaaccaccatgcagattttcgtcaaaaccctcactggtaaaaccattactctcgaggtagaagcctctgataccatcgaaaatgtgaaagccaagattcaggataaagagggaattccaccagatcagcagcgacttatctttgctggaaaacagctggaagatggacgtactctctctgattataacatccaaaaagatccactctccatctcgtacttcgtcttcgagggggtgtaattgaacctactttgcgtatacttgcacagaaatataactgtgacaaaatgatatgtcgcaaatgttatgctcgtcttcatcctagagcaactaattgccgtaagaaaaatgtggtcatacaaataacatccgaccaaagaagaagttgaagtaaactaaatacccaagtttccattttcatgtggaaatggaaatatatatttcttatat

SEQ ID NO: 10691 - DNA, 492 bp, Amborella trichopoda
cttttttaggttgggtttagtggtggcacgttgtctgaacaataaaaccaccatgcagattttcgtgaaaaccctcactggtaaaaccattactctcgaggtagaagcctctgataccatcgaaaatgtgaaagccaagattcaggataaagagggaattccaccagatcagcagcgacttatctttgctggaaaacagctggaagatggacgtactctctctgattataatatccaaaaagaatccactctccatctcgtacttcgtcttcgagggggtgtaattgaacctactttgcgtatacttgcacagaaatataattgtgacaaaatgatatgtcgcaaatgttatgctcgtcttcatcctagagcaactaattgccgtaagaaaaatgtggtcatacaaataacatccggcaaagaagaagttgaagtaaactaaataccaagtttccattttcatgtggaaatggaaatatatatttcttatat

SEQ ID NO: 10692 - DNA, 630 bp, Panax ginseng
caactccggggtccaacaccatgcagatcttcgtcaagaccctcaccggcaagacgatcaccctcgaggtggagtcgtccgacaccatcgacaatgtcaagtccaagatccaggacaaggaggggattccccggaccagcagcgcctgaatcttcgccggcaagcagctcgaggatggccgcaccctgtccgactacaacatccaggaaggagtcgacgctccacttggtcctccgtctccgtgtggcattccatcgagccctgctcaaggccctggcttccaagtacaactgcgataagatgatctgccgcaagtgctacgcacgtctaaccaccgagggctggtcaactgccgcaagaagaagtgcggccacaccaaccagctccgccctaagaagaagctcaaataagcgtatcgctcccaaatcggcgtttggcgagtttcggggcaagtggaaacgaatgcgacgaatgcatgcgacgcacatgagggcgtggtctcggtcacttgggcacagcacatcatcggcgtgcttattgcgggtttcagcaccataccattcgggcatgtagagtgaatcgatcataccttttcctttcgtgcaaagagtagtgccatacgggctcgag

SEQ ID NO: 10693 - DNA, 452 bp, Eucalyptus grandis
tcggcagccggtggaggaagagaggaggaggatcgggagcgagagaagatgcagatcttcgtgaagacactgaccggcaagaccatcaccctcgaggtcgagtccagcgacaccatcgacaacgtcaaggccaagattcaggacaaggaaggtgcgctcatggggtgaacgatcaggaatcccgccggaccagcagagactgatctacgccgggaagcagctcgaggatggccgcacgctcgccgattacaatatccagaaagaatcaactttgcacttggtgctgaggcttcgtggtggcatcatagagccgtccttgatggcatttggctaggaaattcaaccaggacaaaatgatatgccgcaaatgctatgtgcgcctgcaccctcgtgctgtcaactgcaggaaaaagaagtgcgggcacagcaatcagctaggcaattgcttgaac

SEQ ID NO: 10694 - DNA, 473 bp, Sarracenia psittacina
agaaatgaataatttgtaaacgaggtttcgtattcttgagaaaaattggtgtctcacatcaagatgcagattttcgtgaaaaccttgaccggtaaaacgatcacgctcgaagtcgagccttcggattcgatcgaaaatagtgaagcaaaaatccaagataaggaaggaattcctcctgaccagcaacgtttgatcttcgccggtaaagcaattggaagatggcaggactctgtccgattacaatattcaaaaagaatcaactctacatctggtgttacgtttacgtggtggtgttatcgagcctacccttcggcagttagctgaaaaatacaattgtgagaagatgatttgtcgcaagtgttacgccagacttcacccgcgtgctacaaattgccgtaaaaagaagtgtggacacaccaataacttacgtccgaagaagaagctcaagaagtaataatatagtttcactcgtg

SEQ ID NO: 10695 - DNA, 449 bp, Amborella trichopoda
aaaccaccatgcagattttcgtgaaaaccctcactggtaaaaccattactctcgaggtagaagcctctgataccatcgaaaatgtgaaaagccaagattcaggataaagagggaattcaccagatcagcagcgacttatctttgctggaaaacagctggaagatggacgtactctctctgattataacatccaaaagaatccactctccatctcgtacttcgtcttcgagggggtctaattgaacctactttgcgtatacttgcacagaaataaactgtgacaaaatgatatgtcgcaaatgttatgctcgtcttcatcctagagcaactaattgccgtaagaaaaaatgtggtcatacaaataacatccgaccaaagaagaagttgaagtaaactaaatacccaagttccaattttcatgtggaaatggaaatatatatttcttatat

SEQ ID NO: 10696 - DNA, 463 bp, Amborella trichopoda
taggttgggtttagtggtggcacgttgtctgaacaataaaaccaccatgcagattttcgtgaaaaccctcactggtaaaaccattactctcgaggtagaagcctctgataccatcgaaaatgtgaaagccaagattcaggataaagagggaattccaccagatcagcagcgacttatctttgccggaaaacagctggaagatggacgtactctctctgattataacatccaaaaagatccactctccatctcgtacttcgtcttcgaggaggtgtaattgaacctactttgcgtatacttgcacagaaatataactgtgacaaaatgatatgtcgcaaatgttatgctcgtcttcatcctagagcaactaattgccgtaagaaaaaatgtggtcatacaaataacattcggccaaaagaagaagttgaagtaaactaaatacccaagtttccattttcatgtg

SEQ ID NO: 10697 - DNA, 511 bp, Amborella trichopoda
ggtccggccataactggctcttttttaggttgggtttagtggtagcacgttgtctgaacaataaaaccaccatgcagattttcgtcaaaaccctcactggtaaaaccattactctcgaggtagaagcctctgataccatcgaaaatgtgaaagccaagattcaggataaagagggaattccaccagatcagcagcgacttatctttgctggaaaacagctggaagatgggacgtactctctctgattataacatccaaaaagatccactctccatctcgtacttcgtcttcgagggggtgtaattgaacctactttgcgtatacttgcacagaaatataattgtgacaaaatgatatgtcgcaaatgttatgctcgtcttcatcctagagcaactaattgccgtaagaaaaatgtggtacatacaaataacatccggccaaagaagaagttgaagtaaactaaataccaagttccatttcatgtggaaatggaaatatataattcttatat

SEQ ID NO: 10698 - DNA, 364 bp, Secale cereale
agatcttcgtcaagaccctgacgggcaagaccatcaccctcgaggtcgagagcagcgacaccatcgacaatgtcaaggcacaccggagagagagggccgcgcagcagcgctgatcttcgccggaagcagctggaggacgggcgcacgctggccgactacaacatccagaaggagtcgacgctgcacctcgtgctccgcctgcgtgggggtatcatcgagccctcgctccaggccctcgcccgcaagtacaaccaggagaagatgatctgccgcaagtgctacgccaggctgcatccaagggctgtcaactgccgcaagaagaagtgtggccacagcaaccagctgacggcccaagaagaagatc

SEQ ID NO: 10699 - DNA, 672 bp, Capsicum annuum
aaacaaaaggttcagttcttactattttagagataagatgcagatcttcgtgaaaactttaacggataagacaataacacttcaattgaattcagcgatatcatcaataattacaaggccaagattcaaggaaaggaaggtattccaccggaccagcagcgactgatctttgctggtaaacagcttgaagatgggcgtacactggcggattataatatccaaaaagagtcgactctgcatcttgttctgaggctccgtggtgggatcattgaaccatcgcttatggcattggcaagggaatacaatgaagaaaagataattttcttcaagtgctatgcacgttttcatcctcgcgccgtgaactgcaagaagtaaaaacacagtcacagcaaccagttgaggccaaagaagaagatcaagtagacagtcaattgcatttcctaataggatgtaatgtcaattggatgattttgaagttcttatgtttagctcacatttttgtggatctattgttgtctatttgattgtggcacatttgtttcaattctagtttcaattataaaaagtgtagtgctcgttttgagttttttttatgattaaaaaaagaaattcaattttactctttcatttcaaaaaatccattttggaggtccattttgaccctaactttaa

SEQ ID NO: 10700 - DNA, 499 bp, Amborella trichopoda
cttttttaggttgggtttagtggtggcacgttgtctgaacaataaaaccaccatgcagattttcgtgaaaaccctcactggtaaaaccattactctcgaggtagaagcctctgatccaccgaaaatgtgaaagccaagattcagggattaaaagaggggaatttccaccagatcagcagcgacttatctttgctggaaaacagctggaagatggacgtactctctctgattataacatccaaaaagaatccactctccatctcgtacttcgtcttcgagggggtgtaattgaacctactttgcgtatacttgcacagaaatataactgtgacaaaatgatatgtcgcaaatgttatgctcgtcttcatcctagagcaactaattgccgtaagaaaaaatgtggtcatacaaataacatccgaccaaagaagaagttgaagtaaactaaatacccaagtttccattttcatgtggaaatggaaatatatatttcttatat

SEQ ID NO: 10701 - DNA, 665 bp, Secale cereale
caagaccctcaccgggaagaccatcaccctcgaggttgagagcagcgataccatcgacaatgtcaaggccacacacgggagtaggaacggatccgcgacagcagcggctgatcttcgccggcaagcagttggaggacggccgcacccttgccgatacaacatccagaaggatcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgtaagagaagtgtggccacagcaaccagctgaggcccaagaagaagatcaagaactagagtgctactagtcagtttcatggaccggttgaatccatcaccgtgtcagagtttatgcttcattattgtcgtcgaacctattttactttgctttcagcctatcgatgtggtgatgataattgacaatattggtatatggtagcaaacctataattttgccgtatctctgtttgatctgcactcattggcaatctttctgtcaatgcttgtgcttcctttctctgcattggggctactggacaggggttggttgcgatttctcagtttggtgatggtaaataatgctaacgctagtct

SEQ ID NO: 10702 - DNA, 505 bp, Secale cereale
caagaccctgacgggcaagaccatcaccctcgaggtcgagagcagcgacaccatcgacaatgtcagcagatcccgacaagagggagtccgccggaccgagcagcggctgatcttcgccggaagcagctggaggacgggcgcacgctggccgactacaacatccagaaggagtcgacgctgcacctcgtgctccgcctgcgtgggggtatcatcgagccctcgctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcgttgtctggataaatcagtagacataaaatgttttcggttatcgttttgctgcccctcatgtcaggatgttgaaccttggttaactctagctgagtacttggccttgttttaa

SEQ ID NO: 10703 - DNA, 350 bp, Utricularia gibba
cagccatgcagatcttcgtgaagactctcaccgggaagactatcacgctcgaggttgagagcagcgacaccatcgataatgtgaagactaagattcaggataaggaaggaacttccccccgaccaacagcgcctcatttttgctggaaagcagctcgaggatggcagaactctggctgactacaacattcagaaagagtccacacttcacttggtgctcaggctgagaggaggcatcattgagccctctttgatggccttggcgaggaagtacaatgctgagaagatgatctgccgcaagtgctacgctcgtcttcaccccagagcaaccaactgcagaaagaagaagtg

SEQ ID NO: 10704 - DNA, 463 bp, Pinus taeda
acgtgcgaccttggctgtcactcagattagataattgggttttgaagtaatttacttgcataagatttttcaacctagctcctagtaaaacggtgacacattcaatatgcaaattttcgtaaaaaccctaacgggtaagactattaccctagaagttgaatcttcggatactatcgaaaatgttaaagcaaaaattcaagacaaagaaggaatcccacctgaccaacaaagattgatttttgccggcaaacagctcgaagatggacgtacactttcggactacaacattcaaaaagatcaacattgcatttggtattgcgtctccgaggtggtgtcattgagcctaccttacgtttgttggctcagaagtacaactgtgacaagatgatctgtcgtaaaatgttacgcacgtcttcatccgagagcaactaattgccgcaaaaagaaatgtggacataccaac

SEQ ID NO: 10705 - DNA, 1182 bp, Oryza sativa
gcaacatgcggccatgcaagaattgcagttgcagggggatccgatccgatccgatccaacgcgcgcggggtacgtgtggccgctgatctcgccgatgatgccatgcatgcactcgattaatccggcaaccgttccgccgccgcccgcctcttcctcctcctgcgcctgcgcagctagggttttgcttgtctctcgtaaccctataaaaactctcgatcatcagctcatctcatccacaggccgcgccacacacttgttgccacaccaccgatatcgaattagccaaaagtttgttagtaccactgccttgcgagatccacgtctctgcaagatgcagatcttcgtgaagaccctgacggggaagaccatcaccctcgaggtcgagagcagcgacaccatcgacaatgtcaaggccaagatccaggacaaggaagggatcccgccggaccagcagcggctgatcttcgccgggaagcagctggaggacggtcggacgctggccgactacaacatccagaaggagtcgacgctgcacctcgtgcttcgcctccgcggcggcggccgcccgggctacccgatgatcgagcccaacctcctcgccctcgcccgcagcaagatggagaagaagatgatctgccgcaagtgctacgcgcgccttccctacaaggctaccaactgtcgcaagaagaaatgcggccacaccaacgagctgaggccaaagaagaagctggtatccaagctttctgtttgagaccacaatttgccattgctaagcttgcatgcagactcattgttctatatatggggacgtatcgcgtatcgtcatgcatagccgaataactaaattatttattatctagtaatttattgcatgacacactctaatatcttcagacattgtacttaagaaaatgtcagtagtataatttttcaattaattatatagaagacttgcacactacttaaaaaatcatttttaacaccacccttttatttttattggcaaaattaaaaaatacaggcttgtaaaaatatattagagattctgatcaagtgctgttacttagaacaccgtaaaaaaattttgccatattttttaaaaaaagccacaaacgactcccacctcaccaattttctccgcaatatattagagattttgatcaagtgctgttacttagaaca

SEQ ID NO: 10706 - DNA, 858 bp, Curcuma longa
gtgaggccacctttgattgcctcatgaaaacctatgggcccttgacgcccgacttgtggttggacactcgcttcagcaaatctcccttccaggaatacactgacttgcttgctaagcctaccaaggcaattctcatcgaaagcaccgagaggatcgaagcttaggactttacggagtcaattctctctcccccccagccaccttactttgcacaagtatgctgaaataggacttaagtacttggtttttgtttctgttatctgctgaaatttatgttttgctttagtctttcttcttgctgtgacaatttcgctgttaagttatgtgctgccctcgtgccgaattcggcacgaggcgacaatgtcaaggccaagatccaagacaaggaagggatcccgccggaccagcagaggctgatctttgctggtaagcagctcgaggacgggcggaccctcgctgattacaacatccagaaagagtctacactgcatcttgtactgagactgagaggtggaatcattgagccttctctcatggcacttgctaggaagtacaaccaagagaagatgatctgcagaaagtgttatgcacgtctgcatccaagggcagtcaattgtcgaaaaaagaagtgtggccacagcaatcagttgaggcccaagaagaagatcaagtaaactacttggttgatttttatttggatccaagaggctttagaagaagacctgcaatatattggattttgactgttctgtagtagactagtagcaatattttggatctttggcgacttgttggatgtttccacaaataaatgagatttgactgccctcgtgccgaattcggcacgaggcgtcgtgc

SEQ ID NO: 10707 - DNA, 350 bp, Secale cereale
tcagcgagatgcagatcttcgtcaagaccctgacgggcaagaccatcacgctcgaggtcgagagcagcgacaccatcgacaatgtcaaggccaagatcggagacgagaggatccgcgacagcagcggctgatcttcgccgggaagcagctggaggacgggcgcacgctggccgactacaacatccagaaggagtcgacgctgcacctcgtgctccgcctgcgtggggtatcatcgagccctcgctccaggccctcgcccgcaagtacaaccaggagaagatgatctgccgcaagtgctacgccaggctgcatccaaggctgtcaactgccgcaagaagaagtgtggccac

SEQ ID NO: 10708 - DNA, 485 bp, Amborella trichopoda
taggttgggtttagtggtagcacgttgtctgaacaataaaaccaccatgcagattttcgtcaaaaccctcactggtaaaaccattactctcgaggtagaagcctctgataccatcgaaaatgtgaaagccaaaattcaggataaagagggaattccaccagatcagcagcgacttatctttgctggaaacagctggaagatggaggtactctctctgattataacatccaaaaagaatccactctccatctcgtacttcgtcttcagggggtgtaatgaaccactttgcgtatacttgcacagaaatataactgtgcaaaaatgatatgtcgcaaatgttatgctcgtcttcatcctagagcaacaattgccgtaagaaaaaaatgtggtcatacaaataacatccgaccaaagaagaagttgaagtaaactaaatacccaagtttccattttcatgtggaaatggaaatatatatttcttatat

SEQ ID NO: 10709 - DNA, 445 bp, Panax ginseng
atgcagatcttcgtgaagactctcacgggcaagaccatcacgctcgacgtggagccatcggacagcatcgacaatgtcaagaagaagatccaggacaaggaaggaatccctccagaccagcagcgtctgatctttgctggcaagcagctcgaggacggccgcaccctctcggactacaacatccagaaggagtcgaccctccacttggtgctccgccttcgtggtggtgccatcgagccaacgctcgcggcgctcgccaagaagaccaacactgagaagaagatctgccgtgtgtgctacgcgcgtcttcctccacgcgccaccaactgcagaaagaagaagtgcggccactcgccacagcttcgcttaagagaagctcaagtagattatgttcgctctttgcagcaagaacaactacgagaactacttgcgctactgatgcagc

SEQ ID NO: 10710 - DNA, 721 bp, Sorghum bicolor
cacgtactccttccgtccatagctgggggattgcataacctcgtaccaccacgtacgaaaccgataggagcggagggtgagacgacgcgatcgacgtgggcagcaaattaaagatgcagatcttcgtgaagacgctgacggggaagacgatcacgctggaggtggagagcagcgacaccatcgacaacgtgaaggcgaagatccaggacaaggaaggcatcccgccggaccagcagcggctcatcttcgccgggaagcagctggacgacggccgcaccctggccgactacaacatccagaaggagtcgacgctgcacctggtgctgcgcctccgcggcggcagcaggggcggctaccccacgaccatctcgcccagcctccgcgagctcgcgcagaagtacaacgagaacaagatggtctgccgcaagtgctatgcacggcttccgcccagggcaaccaactgccgcaagaagaagtgtggccacaccaacgcgctgaggtcaaagaagaggttcatgtctaagattggtggaacaaataaatgagcgttggagagccttgtcatgcatcagttaggaattttgggatgctattttactttcctttgctttttatgaataaagttgtggtaggagaaagtgtgctactcttggttaataagatgtttttatataaattattattactattattgttatattcattggttataagtgagata

SEQ ID NO: 10711 - DNA, 837 bp, Brachypodium distachyon
atgcagatcttcgtcaagacgctgacggggaagacgatcacgctggaggtcgagagcagggacaccatcgacagcgtcaaggcaaagatccaggacaaggaaggtatccccccagaccagcagcgtctcatcttcgcagggaagcagctggacgatggccgcactctggccgactacaacatccagaaggagtccacgcttcacctggtgctgcgtctccgcggtggcagcagaggcggctaccccaagtacctggccattgacctccgcttgcttgcccaaaagtacaatgagaacatgatggtctgccgcaagtgctacgcacgccttccactcaactctaccaactgccgcaagaggaagtgtggccacagcagcgagagcaaacaatcgagagctaagatgcagatcttcgtgaagacactgacggggaagacgatcacgctcgaggttgagagcagcgacaccatcgacaacgtcaaggccaagatccaggacaaggaaggtatccccccggaccagcagcgtctcatctttgcggggaagcagctggaggatggccgcaccctggccgactacaacatccagaaggagtccacgcttcacctagtactgcgcctccgtggcggcagcagaggccagtaccccaagaacctcgagcccaatctccgcatccttgctcagaaatacaatgagaacaagatggtctgccgcaagtgctatgcacgcctccccctcagagcgacccactgccgcaagaagaagtgtggccacagcaaccagctgagggaaaagaagaggtttatgtccaagtttgggtcggacagctgaatcaac

SEQ ID NO: 10712 - DNA, 526 bp, Chrysanthemum coronarium
caatcataaccgccgttttagagagagaaaatgcaaatcttcgtgaaaacattgacagggaagaccatcactctcgaagttgaatcatcagacactatcgataatgttaaggccaagattcaggacaaagaaggtatcccaccagatcagcagaggttgatatttgctggaaagcagcttgaggatggccgtacacttgctgactacaacatcctcaaagagtcgactctccatttggtcttacgactgaggggtggtggcatcaaagatccagcaaaggtgtacgctcctttcctgctggatcttgctcgggagtccaaccaatacaaaaaaatttgtaggaagtgctatgctcgtcttccaaagagggctctcaattgtaggaagaagaagtgtggccacagcaatcaactaaggccaaaaaccatgtttatgtccaaaggcggtgacaagcacacctagtttcttcctctagaggagcaaatggatgctgacttgggagtctttcagtctgctggagaaaaac

SEQ ID NO: 10713 - DNA, 499 bp, Chrysanthemum coronarium
agaaaatgcagatcttcgtgaaaacgttgacagggaagacaatcactctcgaagttgagtcatcagacaccatcgacaatgtcaaggccaagattcaggacaaagaaggtatcccaccagatcagcagaggttgatatttgctggaaagcagcttgaggatggccgtacacttgctgactacaacatcctcaaagagtcgactctccatttggtcttacgactgaggggtggtggcatcaaagatccagcaaaggtgtacgctcctttcctgctggatcttgctcgggagtccaaccaatacaaaaaaatttgtaggaagtgctatgctcgccttcccaaaagggctatgaattgcaggaagaaaaagtgtggccacagcaaccaactaaggccaaagactatgttttgtccaaggcggtgacaagcacacctagtttcttcctctagaggagcaaatggatgctgacttgggagtctttcagtctgctggagaaaaac

SEQ ID NO: 10714 - DNA, 674 bp, Artemisia annua
atcttcgtgaaaacattgaccgggaagaccataacccttgaagttgaatcatcagacaccatcgacaatgttaaggccaagattcaggacaaagaaggtatcccaccagatcagcagaggttgatatttgctggaaagcagcttgaagatggccgtactcttgctgactacaacattcagaaagagtcgactcttcatttggtggcataaaagaccctagcaaagtctatgctccaaatcttctggtgttgtctcggaagtacaaccaaaataaaaaagtgtgccgcaaatgctatgctcgtcttcctccaagggctctaaactgcaggaagaagaagtgtggccacagcaaccagctaaggccaaagaccatgttcttgagcaaatcccccaaagataaaaactagctgcttgttttggagaggaatggtgacctggggtgttttgtctcctcgagagaggaacttgcctttttatttttagaacttctgcatctttcttaagtcatctttgttttttaacttcctatgaaagtaaacttgctgaattgttgtttaagtcaagaagcattcttgatttgatatttgtttatttttatgcttggggattttgtggattttccttgcatagctcgcttggtagtgatgtggattttccttggaaatgtcgagcgt

SEQ ID NO: 10715 - DNA, 336 bp, Secale cereale
tcaagaccctcaccgggaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgccaccgaaggctgtcactgccgcaagaagaagtgtcggcc

SEQ ID NO: 10716 - DNA, 476 bp, Secale cereale
gcaaaatcttcgtcaagaccctcaccggaaagactatcaccctcgaagtcgaaggctctgactccatcgaaaacgtcaagcaaaagatccaagataaggaaggtatcccaccagatcaacaaagacttatcttcgccggcaagcaattggaagatggcagaaccttgggagactacaatatccaaaaggaatctactctccatttggtcttgagattgagaggtggtgtcattgaaccaaccctccaagtcttggcaagaaagtacaactgcgacaagatgatttgcagaagatgctatgcacgtttgccagctcgtgcaaagtcctgcagaaagagcaagtgcggtcactccaaggatttgagaatcaagaagaaactacaagtaaaccccattcctgctgcgttttccaatgtacaaacaggtacttgtccttttactctctcagaataaaaacttcgttactaactaaaaaaa

SEQ ID NO: 10717 - DNA, 725 bp, Panicum virgatum
tttttgctgtgagaatgaatcagcggaggaagcaagctccgcgacatcgtgtggtcgtgtcaaatctcagctccccatatccagagtctcaaagacatgtaatttgctttttattttttaaaaaaggacaagaaatttttaaaattttcggcccaacatcattttcttaccagtaagtgggccgaggagaacagcgtctccactctccacagcaaagcagacgttcagacactgcccgatttcaacggcccatttcgctttccctggtaccaaaccctaaaaagccgccgcaaccacgtataaaaacccgcacgcgccgccgccgccgccgcttcagtacccagagtagccgccgccgcgaacacaggaaggagcagcgggaacatccagggccggcaagatgcagatcttcgtgaagacgctgaccgggaagaccatcaccctcgaggtcgagagcagcgacaccatcgataatgtcaaggccaagatccaggacaaggaaggaatcccgccggaccagcagcgtctgatcttcgccgggaagcagctggaggatggccgcactctggcggactacaacatccaaaaggagtccacgctccacctcgtgctcaggctccgtggtgggattattgagccctcgctgcaggcgctcgcacgcaagtacaaccaggacaagatgatctgccgcaaatgctacgcacgcctgcacgcttgtctacact

SEQ ID NO: 10718 - DNA, 567 bp, Senecio madagascariensis
cgcagtcggtactccaacttttctgtactattttcatttgaacaaaaaaaagaagaagagaaaaatgcagatctttgtgaaaaccctaaccggaaagacgattacgctcgaggtcgaaagcagcgataccatcgacaatgtgaaagctaagattcaagacaaagaaggaattcctccagatcagcagagattgatatttgctggaaagcagcttgacgatggacgaactcttgctgactacaacattcagaaagaatcgactcttcatttggtgttgaggctaagaggtggtggaatcaatatgcctaaggttacgccctatttgaaggaattgggatggaaattcaatcagtacaggaagatttgtcgcaagtgctatgctcgtctgcatccaaaggctactaactgcaggaagaagaagtgtggccacagtaacattttgaggaagaagaccgatcttcatgtccaaagggaaaccaggtattagcaacgtcggaagaaatcaagttgaatagtttagtacgttaatagttagttagttttctttttaaagtacgtaaagtgaat

SEQ ID NO: 10719 - DNA, 521 bp, Amborella trichopoda
ggggacgacgacctccgacaacttagcaaagatgcagatcttcgttaagaccctgacgggcaagaccatcaccctcgaggtcgagtcctctgacaccatcgacaatgtgaagagcaagatccagggacaaggagggaattccccccagaccaacagcgcttgatcttcgccggcaagcagctcgaggatggccgcaccctttcgactacaacatccagaaggatctaaccctccacctggtcctccgtctccgtggtggtatcattgagccttccctcaaggcccttgcctccaagtcactgcgacaaggccatctgccgcaagtgctacgctcgtctccctcccccgtgcccaccaacctgcccgcaacgaagaaagttgcggtccacaccaaccagctccgccccaagaacgaagctagaagtaaactactcgctctacggctggcgcgcattgttcgacaggaggaagctcggacatagggtacgttggttttttgggtggtagttaccgttaaccgg

SEQ ID NO: 10720 - DNA, 659 bp, Eragrostis curvula
gcacgaggcgacaatgtcaaggccaagatccaggacaaggaaggcatcccgccggaccagcagcgtctgatcttcgccgggaagcagctggaggacggccgcaccttggccgactacaacatccagaaggagtcaaccctccacctcgtcctccgccttcgtggtggcatcattgaaccttccctccaggccctcgctcgcaagtacaaccaggacaagatgatctgccgcaagtgctatgcgcgtctgcatcccagggctgttaactgccgcaagaagaagtgtggccacagcaaccagctgaggcccaagaagaagatcaagaactgaagctttactcgtggatgggtagaatcattgatatcagagtttgagtcgtcgttgcataatgctgcttctattttggaagttagaaccttatggtgttcctgtttaggggtcctcggcatattttgctggcataattagtgaacaaaagtctgggttatatggtagcataacacttggttaaagttgttgctttggttgctctgtgtggtctttgttgttccttggccggctatttcgtggcgcatagcttgctcgggctatgatgcacatggttgactgcgttattgttcctggagcgacttggtcctcagaatattccgatgttttcg

SEQ ID NO: 10721 - DNA, 322 bp, Lippia dulcis
aaatgcaaatcttcgtgaaaaccttgaccggaaaaaccataacgctcgaggttgaatcgagcgatacaatcgacaatgtcaaggccaagattcaagacaaggaaggaatccctccagatcaacagcgtctgattttcgctggaaagcagcttgaagatgggcgaacacttgctgattataacatccagaaagaatcaaccctgcatttggttctgaggcttaggggtggaatcatagagcgtctctcatggctttggctaggaagtataaccaggacaaaatgatatgccgcaagatgttatgcacgctggcaccctcgtgc

SEQ ID NO: 10722 - DNA, 1375 bp, Nicotiana benthamiana
tgaattttactgatatttgatttcttacagagccaaagaagattgtccaatggagcagtaagggcaacaatggttgcatctccaggtgtaaccactagttctccagcaggaaagaaaaccttaagaaaaggatgtgtaattgtgactggagcttcttcaggatttggcctagccacagcaaaagcactatccgagaccggaaaatggcatgtaattatggcatgtagggactttctaaaagctgagaaagctgcaaaatcagtaggaatgccttacaccatcatgcatttagacctcgcgtctcttgacagcgttcgccagcgataacttcaagaggtccggtcgccctcttgatgtgttggttgctaatgcagctgtgtaccaacctactgctaaagagccttcatttacagctgaaggatttgagcttagtgttggcacaaatcatgttggacatttccttctttcaagattgttgcttgatgacttgaagcaatctgattacccttcaaaaagactcataattgttggttcaattacagggaacacaaacactttggctggaaatgtacctccaaaggcgaatcttggcgatttgaggggtatggcctggggtttaaatggaattaacagttcagcgatgatcgatggtggagaatttgacggtgcaaaagcgtacaaagacagcaaagtctgtaacatgctaactatgcaagaattccatcgtcgataccacgaagaaactggcatcacatttgcctctctttaccccggctgcattgcaacaacagggctattcagagaacatattcccttgtttaggctccttttccctccattccagaagtatattactaagggatttgtctctgagacagaagctggaaaacgacttgctcaggttgtaagtgatccaagcctgactaaatcaggtgtgtattggagctggaacaaagattcagcttcatttgagaaccagttgtctgaagaagctagtgatgtagagaaagcgcgtaaagtatgggaaatcagtgagaagctcgtcggtttagcttaatttttcggattaaccttaaccattgccaaacaagaaaagaagagttgatgagtgaaaatttgtatcggaatttctaggctgttgtaaagagcactgtcacctttagttaggattgaaaataaatgttatttcctgatgaaaaatgtcactaatttactttgaagttaattgaagtgatggctcatgagcatattgttaattcaatcatctgttttacttccctttatgtggccagaataaagtatatttcaagaattagaacttttgcagtcatatatagtgaagtgattcctactctagaaggataatttctgttgg

SEQ ID NO: 10723 - DNA, 1417 bp, Euonymus alatus
gggttttacctcacaagaggaaaaaataggctctccaagctgcttctttggttgcctcttccttcctcatccccaaagagggaaagtatggtgcagcctttaaggattccagtatctttggagtttcactctcagagcatgtcaaagctgacttcagctcatctgcattgaaatgcaagaggggattcagcagaagaaatggaggtgtcagagcccaaacattggctacaacaactccagcagtcaacatgacttctcctgaaaagaagaaaaccctaagaaagggcagtgttgtaatcactggtgcctcttctggtttaggtctagccacagcaaaggctcttgctgaaactggaaaatggcatgtgatcatggcttgcagggacttcttgaaggccgagagagctgccaagtctgctggcatgcccaaggaaaactacacaattatgcatttggatcttgcatcccttgacagtgttcgccaattcgttgatagcttcaggcgatctggaaggccacttgatgctttggtgtgcaatgctgctgtttaccagccaactgccaaggaacctgtattctctgctgaaggatttgagcttagtgttggaaccaaccatcttggtcacttcctcctttcgcggctgctgctcgaggacttgaacaaatcggactatccatcaaggcgtctcatcattgtcggctcgattacaggaaacacaagcactttggctgggaatgtacctccaaaggcaaatcttggggacatgagggggcttgcaggaggcttgaatgggctaaacagctctgccatggttgatggtggaaattttgatggtgccaaggcctacaaggacagtaaagtctgcaacatgctgacaatgcaagagttccataggaggttccatgaggaaactggtatcacatttgcctctctttatccaggctgcattgccacaaccggcttgttccgggagcacatacccttgttcaggcttcttttccctccattccagaagtacatcacaaagggctatgtctctgaagaggaatccgggagaagacttgcacaagttgtgagtgatcctagcttgacaaaatctggagtttactggagctggaacaaggactctgcttcatttgagaaccagttgtctcaagaagctagtgattcagacaaggctcgtaaagtatgggagatcagtgagaaacttgtcggcttggcctaatttcgaaacctcaaaagactgaggcaactgcatcctttgctgcgggagactgaagaatgagtccatttgtgagtctgagtttgggttagaatgctgtgttttttcctttttgaaaaaaattctgtagggtagatgagttctgaaagtttgacaataaggttgctcatattagaatctcaaaatgcaaatca

SEQ ID NO: 10724 - DNA, 1305 bp, Cirsium arvense
tctttcttagatatttactcaaaacactcttcacatttgcacctccaatggctctccaagctacttcatcttgtttctccatccacaaagggggggaaagccaatgcatctttgaaggattcaagcttatttggagcatcattttcatctcatcttaaagttgacctcaaatcatcactatcaagaaacatgacggaatttagccgaaggggtgcactcaaaatccaagccgtagccactacaacaccttccgtgaaccaagcctcgaccgacgcgaagaaaaccctacgaaagggcaccgtcgtcatcacgggggcgtcctcgggtttgggcctagccaccgcaaaagcgctagcggaaacgggaaagtggcatgtgataatggcttgtcgggactttctaaaggcggaaagatcggccaaatcggttggaatgccaaaggagaactataccgttatgcatttggacctcgcgtcgtttgacagcgtgaggcagtttgtcgccaatttcaagcaatcgggtcagccgctcgacgtgttggtttgcaacgcggccgtttattttccgaccgcaaaggagcccacgtatacggctgatgggttcgagctcagtgttgggactaaccatcttggccacttcctgcttgcaagattgttgcttgatgacttgaagcagtctgattacccatcaaaaagactaattattgttggctcaattacaggcaacacgaacacgttggccgggaacgtacctccgaaggctaacctcggggacatgaggggtctagctggtggactaaacgggctcaacagctcggccatgatcgacggaggagatttcgatggtgccaaggcatacaaagatagcaaggtttgcaacatgctcatgatgcaagaattccaccgacgttaccacgaagagaccggcattacgttcgcttccctgtacccgggttgtatcgcgactacgggcttgttccgggagcatattccacttttcagacttctcttccctccgttccaaaagttcatcaccaagggctacgtctccgaagaggaatccggcaaaagactcgctcaggttgtgagtgatccaagcttgacaaaatcaggagtttactggagctggaacaacaactcggcttcgttcgagaaccagttgtcagaagaagctagtgatgtcaccaaggctcgtaaagtctgggagataagcgagaaacttgtcgggttggcttaaccatgatagatttctattcggtttgatccgtctcggtgagaatgtgagtgtaggacatgagcaagggca

SEQ ID NO: 10725 - DNA, 1353 bp, Gerbera hybrid cultivar
aacgatcaacaatcttcctcagatattcacccaatggctctccaggctacatctgctttctccatctacaaagaagtgaagaagaacgctgcatctttcaaggattccagtctatttggaactcatcttaaacttgacttcaattcatcagcattaagaaacaggacggaatttagagcactcagaacccaagcggtagccaccaccactccgacagtcaccaagtcacccacagacgggaagaaaacgttgagaaagggtagcgtcatcatcaccggagcttcctccggtttaggtctagccacggctaaagcattagcggaaacggggaaatggcatatcattatggcttgcagagactttctaaaagcggaacgcgcggctaaatcagctgggatgcccaaagagaattatactgtgatgcatttagaccttgcctcattagacagtgtcaggcagtttgtaggtaacttcaagcagtcgggtcgaccccttgacgtattggtctgcaatgcagcagtttatttgccgaatgctaaagagcctacgtttactgctgacgggattgagcttagtgtcgggacaaaccatcttggtcatttcctgctttcaagactgttgcttgatgacctgaaacagtccgattacccgtcaaaaagactcatcattgtcggatcaatcacgggcaatacaaacactttcggctgggaatgtacctcccaaggcaaacctgggggacatgaggggtctagccgggggtctgaacgggctcaacagctctgccatgatcgatggaggagacttcgatggtgcaaaggcctataaagacagcaaggtctgcaacatgctcaccatgcaagagtttcaccgccgtttccacgaagaaaccggcattacattcgcctccctgtacccaggttgtattgccacaaccggcttgtttagagagcatattccccttttcagactcctcttccctccgttccagaagtacatcaccaagggctttgtctccgaggatgaatccggcaagagacttgcacaggttgtgagtgatccaagcttgacaaagtcgggagtttactggagctggaacaataactcggcttcctttgagaaccagttgtcggaggaagcgagcgatgttgccaaggctcgtaaagtatgggagataagtgagaaactcgtcgggttggcttaaacaagatagatccattacggattgttcgagttgatcaatgaggaagatttaggacatgtgtgcaagcagctttctattgtaaatttaggctagttcacatcagaatcgataataaaatccctcggcatttacttaaaaaaaaaaaaaaaaaa

SEQ ID NO: 10726 - DNA, 1383 bp, Brassica napus
aagctgcttctttggtctcctctgctttttctgtccgaaaagatggaaaactgaatgcttcttcatcatccttcaaggaatcgagtctttttggtgcctccattacagaacatggctctttctcatttagattcaagagagaacatagctcgaggaatgtgctcgcagttcgtgcccaaacagccgcaacttcaagcccctcggtcacaaaatcttcatctggcggcaagaaacgttgaggaaaggtaccgtggtggtcacgggagcctcgtcagggttaggtttagccacggctaaagctcttgcggagacaggtaaatggcacgtgataatggcgtgcagggactttcttaaagccgagagagccgctaaatccgcagggatgcctaaagacagctacacggtgatgcatctagacttagcttcgttggacagcgtgagacagttcgttgataacttcaggagatcagagatgccgctagatgttttggtctgcaacgctgctgtctatttcccgacagctaaagaacctacttacagtgcagaagggtttgagctcagcgttgcgactaatcatttaggacattttcttctctcgaggttgttgcttgatgacttgaagaaatctgattacccttcaaaacgtctcatcattgtcggatccattacagggaacacaaatacattggctggtaacgtaccacctaaagctaacctcggcgacttgagaggtttagcaggcggactgaacggtttgaacagctctgcgatgattgatggaggagatttcgatggtgcaaaggcttacaaagacagcaaggtctgtaacatgttgacgatgcaagagtttcacaggcgttaccatgaagaaacaggaatcgcattcgcctcgctttaccctggttgcatcgcctccactggtttattcagagagcacattccgcttttccgtacactcttccctccgtttcagaagtacatcactaaaggatatgtctccgagacagagtctggcaaaagacttgctcaggtggtgagtgatccgagcttgacgaaatcaggagtgtactggagctggaacaaggcttcggcttcttttgagaatcagttatcggaagaagcaagtgatgttgagaaggctcgtaaagtgtgggagatcagtgagaagctcgttggcttggcctaatagggcatgaaagcctctttctcttgatgagacctctctgttaccctaccaactggtgaatcctagagggtgttcgggatttttagattgtctgatattgtactgcgaatttttcattagtgcatgttgagtgtagatctgtttggcgtgtagccccagaaataatgaaataaagggtggtgtatctttaaatcctc

SEQ ID NO: 10727 - DNA, 1444 bp, Chelidonium majus
ataggttcaaatataagtaccagtctgaaaaatcaaccccaagtatctcaaagtttcagccatggcagcctcactcctttcatcatctctctccatccacaaagagggcaagtcaattctgtctcacaaggaacagtttcatgggtatttctgtttctgaacatcagaagtctgagttcaaccccaccgtcataaggagcaagagagaattcaaccaaaggactggatgtgtcagagccgagacagcagttacaacaactccagcaattaaccgtgctgcatcagataggaagaaaactctgagaaagggtagtgtagtgatcactggagcctcgtcgggacttggtctagctacagcgaaggctctagcagagacaggaaaatggcatgttataatggcctgcagagatttcctgaaggctgagagagcagctaaagcggctggcatgcccaaggaaaattacaccattatgcacctcgacctctcttcccttgacagtgtcaggcagttcgtggacaacttcaggcaatcgggtaggccactagatgtgttggtctgtaatgcagctgtctaccagcccactgcgacggagccaagtttcacagctgaagggttcgaattaagcgtcggaactaaccaccttggacattttctattatctcggttgttactcgacgacctgaataaatctgattacccatccaagcgcatgattattgtcggctctataactggtaacaccaacaccttggctggaaatgtacctccaaaggcaaatcttggggatctccgtggactcgcagggggattgaacggattgaacagttcagccatgatcgatggagggaacttcgacggtgccaaggcctacaaggatagcaaggtctgtaacatgcttataatgcaagaattccacaggcgttaccatgaggagaccggcatcacatttgcttctctctaccctggttgcatcgctaccacaggcttgtttagggagcacattccattgttcagactcctcttccctccattccagaagtatatcaccaagggctttgtctctgaagaagaatctggtaaaagacttgcacaggtggtgagcgatccaagcttaaccaaatcaggagtatactggagctggaacaaggattcagcttcgtttgagaaccagctctcccaagaggctagtgatgtcgagaaggcgcgaaaggtgtgggaggtcagtgagaagcttgtcggtttggcttgaaggagcaccttggcacaaagatcctcctgttgacacatcattaccatggaggagataccagaagaacatctggggttctgatgagtgtgcgctaactgtgctaatggacggctacttgtagcacaaggcagtttcttcttgtgaagtttgaaaatttgaattaattggaataataaaatcactcatcagttttc

SEQ ID NO: 10728 - DNA, 1385 bp, Brassica napus
aaaagatggaaaagtgaacgcttcttcatcatccttcaaggactcgagtctctttggtgcctccattaccgaacatggctcttcctcattaagattcaagagagaacatagctcgaggagtgtattagcagttcgtgcccaaaccgctgcaacttcaagcccctcggtcacaaaatcttcatctggcggcaagaaaacgttgaggaaaggtaacgtggtggtcacgggagcctcgtcagggttaggtttagccacggctaaagctctggccgagacaggtaaatggcacgtgataatggcgtgcagggactttcttaaggccgaaagagccgctaaatctgcagggatgcctaaagacagctacacggtgatgcatttggacttagcctcgttggacagcgtgagacagttcgttgatagcttcaggagatcggagatgcctctcgatgttttggtctgcaacgctgctgtctatttcccgacagctaaagagcctagttacagtgctgaagggtttgagcttagcgttgcaacgaatcatttgggacattttcttctttcgaggttgttgcttgatgacttgaagaagtctgattacccttcaaagcgtctcattatcgtcggatccattaccgggaacacgaatacattggctggtaacgttccaccgaaggcgaatctaggtgatctgagaggtttagctggcggattgaacggcttaaacagctcggcgatgattgatggaggagactttgacggagcaaaggcttacaaagacagcaaagtgtgcaacatgttgacgatgcaagaatttcacaggcgttaccatgaagaaactggagtcacattcgcttcgctttaccctggttgcattgcctccacgggtctattcagagagcacattccgcttttccgtacactgttccctccgtttcagaagtacatcaccaaaggatatgtctccgagacagagtctggcaaaagacttgctcaggtggtgagtgatccgagcttgacgaagtcaggggtgtactggagctggaacaaggcttcggcgtctttcgagaacgagttatcagaagaagcaagcgatgttgagaaggctcgtaaagtgtgggagatcagtgagaagctcgttgggttggcttaaatgacacttggaatctcttctttctgatgagatcacgttgtgccaagtgatgaaaactctagaggatgttctggatttttagatgtctgattctgttgaggaatttttcgttagtgtatgttgagtgtagatctgtttggcttgtagcccgtaataaagaaataaaagttggctagcaacaatcatacaccaacatctttgtgcatcaaaatttaaattaactcctatgtctggc

SEQ ID NO: 10729 - DNA, 1496 bp, Ipomoea nil
gggattttttccccatttccagacatttacaaaagatttctttggtgtagtaaagctctaataatggcactccaatcagcttcttttctcccctctgctctctccattcacaaagagggtaaatctttgaaggagacaaccttttatggagttgcattgccatgcaaccctaaagctcaatttagccattcttcttgcaccaaggaatggggaaggaagttagtagttggacctgtaagagcacaaactgctgtaactactccagtccagtctataccagaagagaagaagacattgaggaaaggctgtgtgatcatcacgggagcctcctcgggtttaggactagcgactgcgaaggctcttgctgaaacggggaagtggcatgtgatcatggcgtgcaggaattttctgaaggctgagacggctgctaaaaaagccgggatgccaaaagagaactacacggttatgcacctcgaccttgcttcacttgacagtgttcgccaatttgtagacaccttcaggcgttccgagaggccacttgacgtgctggtctgtaatgctgctgtctacttccccactgccaaagagccgacatttactgctgaagggtttgagcttagcgttgggactaaccacctcgggcatttcctgctttcaaggttgttgctggatgatctgaagcaatcagattatccacaaaagcggctcataattgttggctccatcacaggaaacacaaacacgttggctggaaacgtgccaccaaaagctaatcttggagatctaaggggactaaaaggggggttgaatggaacccaaagttcacccatgatagacgggggagaatttgatggcgcaaaggcctacaaagatagcaaagtctgcaacatgcttaccatgcaagaattccacaggcgttaccatgaggagactggcgtcgcctttgcttccctctaccccgggtgcattgctgaaaccggcctgtttagggaacacattcccttgttcaggctcctcttccctcccttccagaaatacatcacaaaaggatatgtatcagaagacgaggctggaaaaagactagcacaggtagtaagtgatccaagtttatcaaaatcgggcgtctactggagctggaattctaactcttcctcgttcgagaacaggctctctaaagaagctagcgatgcagagaaagcaagaaaactatgggaggtaagcgagaaacttgttggattggcttaaatgctacccagagcaggatatgagctagccaagacacccatatttcagaaactacagataccaaggaaaactgagaaatagctcaattataagtctagcttaatactgtaaggtcccttgtatgcaatttttcaggagttttaagagagtttctagctttcctagcttgtgtggaaggctattagtttgtctacttcagatagttgcctggtatattttgtgtagcatcagcagatacaaatcaaaataat

SEQ ID NO: 10730 - DNA, 2300 bp, Zea mays
tgcacaacagaacgacttattgtgttgtccataaccacatctcaacacatcatccactatatagaacataaggacatctacgtgttctgttaaaatacgatgcataaaaaaattgacaaacattatagctaatttaatgtttaatagtaactaatacctcgatgcccttcttatcctaaatcctcaattagctggaaccttcctgttaggctcaaagacatatttgatcaaagaatccttgatggacatcagttgagagaactcggccttcaatttcgacgcatccatctcattgttgcttctaggtgcgactatgaccttggattgctcttcgagtgtgaagttggtccacttaaaatcaggattgatgtatttcttgtacatctccagaatctcattgtggctgacaacgccagggttggtgaagttccatatgcccctgcagtcccgttttgccatctcaatggagatgggcagaagctcatccaaaattgtcatgctgttgggaatgttcaccaccttgtcgtaacgagctatctttgtgatgaagttacgaggattgtttagatctgatgatataggcatcctgaccctaagagtacagacattatcatactccttcaacagctcttccacctgcaccatgatgaacagcacagaaattagcttcaggcataatgaagtaaaagaaaaatgcttgacaaaaaaagaacatcatcccgaacttaccattgcttttgttttggaataaaaggaacccgtaaagttgggtgtgtcttcctctttaaagccaataccagacctttccgggtgcttggcatcatactcaaatatacaacctgtagcataattaatcattagcagaccttgctcgcgacagacatcagcaagattcaatatgcctacaacattggtgcggatggtgtcctgtttatgggtctcacaccaatcaacatttggtctcccagtgactccggcagcattaaaaacttgagttggcttcacatttctaatgtcctccaacagctgagagcgctcctccaagcgtcctttcccatattcatatggtatcccttgcttgtcacaaatcttcccaaggaggccaccaatccatccagtcctgccatagattaagaacttgtacaaaggcttttgaggggcagcagtggtccttttggcactggttgcaggagctgttgtgctagcttcagctggtgaagaagtcagagatttgatatcctcagtccagttatgcctttcaactccaggaatcatcaacatccttgggtgagggagcaaagcaccagtgacatctccccagtaatcaggattggtggtgtaccactcgattgtcttcttcaagccctcttcccatggtgtgcgctctgcccatcccagtctcttaagcttctgatcatccaagaagtacctctggtcattgaagggcctgttctcaacaaacctgattactttctcagtatccaagccaaagagcctgcaaatgtctttggccacatcaatcaccctcctctccttcacagtaccaatattatacacatgtccaacctcccctttgtgaagaacaacctcaaaagcttcagccacatcctcacaatataggtagctcctgacattggaaccatctccatgaattggaagaggcagacctctcatggccaaaagaatgaatttgggaataagtttctcagggaactgatttggcccatacacgttgttgccccgagtggttatcacaggaagaccataagatcttccatatgccatcacaagcatttcagccccagcttttgtagctgaatacggatttgttggaagcagctgtgaggcctcatgattaccaaccacagcatcttcatcagtttctccatagacctcatcagtactgacatgaataaacctcctgatctggccagtgaccttgcaagcctcaagaaggacgtgggtaccatatatattgttttttgtgaactcaaatgaattgccaaatgaattatctacatgagtctgagcagcaaagtgcatgatggtgtcaatcgactctgtgaccagaaggtggttcaccagatcagcacttgcaatgtcacccttgacaaacttcaaatttggtgaagcccgtgaggggttgaggttctttaggctggagcagtaatcgagcttgtcgaggacaacaatcttgtagtgcgggtagttcctaaccagacagttggtgacatgcgatgcaataaaaccagcagcaccggtgatgagaatgttcttgggctcgtaagtcgccatccttg

SEQ ID NO: 10731 - DNA, 2508 bp, Flaveria ramosissima
ctatcgatcaaggcgtctgttgccactcctcgactctcgcgataaatttcgtgatttccactcaaaatcaccattcgatcgagatctttatctctatcatacgcacaatctgccattgatcccgatccgattcaattttacctccagtatggctacttacgagccaaagaacatccttatcactggagctgcaggcttcattgcctctcatgttgctaatcggctgatcagaaactaccctgattacaagattgtggtgcttgacaagcttgattattgttccaatcttaagaacctcaacccctccagatcgtctcccaacttcaagtttgttaaggggatattgggagtgctgaccttgtcaactaccttctgatcactgaatctatcgataccataatgcactttgctgcacagacccatgttgataactcattcggcaacagttttgagttcacgaagaataacatttatggaactcatgtgcttcttgaagcctgcaaagtcactggccagattagaaggttcattcatgtgagcacagatgaggtctatggagaaacagaggaggatgctgttgttggtaaccatgaagcttcacaacttcttcctacaaacccatattcagccacaaaagcgggtgccgaaatgcttgttatggcttatggtaggtcatacgggttgcctgtgattactaccagaggaaacaatgtttatggcccgaaccaattcccagaaaaactaatccctaagttcattcttctggctatgagaggaaaaccgcttccgattcatggtgatggttctaatgtaaggagttacctgtactgtgaagatgttgctgaggcttttgaagtaattcttcacaagggagaagttggtcatgtttacaacatagggaccaagaaggaaaggagagtgattgatgtcgcaaaagatatgtgcaagcttttcaatacggatcctgattcaagcatcaagtttgtggagaacagaccattcaatgatcagaggtatttcttagatgatgaaaaattgaagagcttgggttggtctgaaagaaccacatgggaagagggtcttaaaaagacgatcgagtggtatacaagcaatcctaattggtggggagatgtctctggagcactattgcctcatccaagaatgttaatgatgcccggtggcgttgatagacatgttgatggacctgaaaatgctgaattggattcagctggtgtggcaatcaatacctctcagatcggtgtccagattcctagctcaaaaaccagtggcatttctgctaagaaacccgctttgaagtttctcatttatgggaaaacagggtggatcggtggtttacttggaaagctatgtgacaaacaacaaattccatatgaatatggaagaggtcgcttggaagaccgttcacaacttttggctgatattcaaactattaaacctactcatgttttcaatgctgctggtgtcactgggagaccaaatgttgattggtgtgaatctcacaagacagaaaccattcgtactaatgtctcgggcacactcaatctagcagatgtctgtagagaacatggactcttgatgatcaattttgctactggatgcatctttgagtatgatgctaaccaccctgaagggtctggaatcggttttaaggaagaagataagcccaatttcactgggtccttctattcaaaaaccaaagctatggttgaggagcttttgaaagaatatgacaatgtgtgcgcccttagagtccgaatgccaatatcatcagatctcaacaacccgcgtaatttcatcaccaagattgctcgttatgacaaagttgtaaacatacccaacagcatgaccatcttggatgagcttttgccaatttctatcgagatggcaaagcgggatctgaggggaatctggaacttcacaaatcccggggttgtaagccacaacgagattcttgaaatgtacaagaagtacataaatccagaattcaaatgggtcaacttcacactggaagaacaagcgaaagtgatagtcgccccacgaagcaataacgagttggatgcatcaaagttgaagaaagagttccccgagttgctatcaatcaaggagtcgttgatcaagtacgtattcgaacccaacaaaaaacagtaatgataatgatatgatgattctttatagaatttgtagaactcaagattcacttgtgtttggttactagttctttcttgtatggtttggattatacatctgtaatgtttaaagtcaactgagtcagtcacatttgttctagtatttgttcctagcatcacactgaggttataggaagcgaggccgattgtctcgactacggtctaggtctacggttagtttgttcaacagttacgacttattttccctttagttttaattaaaaaccgcatgcgggcttgtactattggtattttctataattatttttttatttcttggctataagaattatttgttaag

SEQ ID NO: 10732 - DNA, 2860 bp, Panax ginseng
atttttacgttcccagaattacaaatccatcgtcacttttcaactacattcattcgtacgcgtatctgtatttcttttctgtatatatatacacatatatatatatatacagaggacgctcagctctcctcacttctcgctgtggtggtctctttgttatcattcattatttccttgtttgagccatttctgtctctcctttattacaaagggctctgtttttctctctctctttgctttccttgattgatcgatcctgttccggacctggatcaaatttgtaagtttcgccttgatctctcttcttctgtaagaaactgctttggtatggctaactatacccccaagaatatcctcataaccggggctgctggatttatcgcatctcatgttgctaatcgtctcattcggagctaccctgactacaagattgttgtgcttgataagcttgattactgttcaaatcttaagaacctgaacccctctcgatcatctcccaactttaagtttgtcaagggggatattggcagtgccgatcttgtcaactaccttctcatcactgagtcgattgacacaataatgcactttgctgcccagacccatgttgacaattcctttggcaacagttttgagttcaccaagaacaacatttatggcacccatgtgcttttagaggcctgcaaagtgaccggccagatcagaaggttcatccatgtaagtactgatgaggtctatggggagacagaagaggatgctgttgtgggaaatcacgaagcttcgcaactcctccctacaaatccatattcagccacaaaagctggggctgaaatgcttgttatggcttatggtaggtcatatggtttgcctgtgataactactcgaggaaataatgtatatggccccaatcagtttcctgaaaagttaattccaaagttcatccttttagccatgagagggaagcaacttcctatccatggggatggtgccaatgtgcggagttatctctattgtgaggatgttgctgaagcttttgaggtcattcttcacaagggagaagttggtcatgtttacaatattgggacaaagaaggagaggagagtgattgatgttgccaaagatatatgtaaacttatctcaattgatcctgaaacaaacattaatttgtggagacagggccatttaatgatcagaggtacttcttagatgatcagaagttgaaaaacttgggctggtctgagcggactacgtgggaagagggattgaagaagactatggattggtacactagcaaccctgattggtgggagatgtctccggagcattgcttcctcatcctagaatgctgatgatgcctggtggaattgagagacactttgatgggtctgctaattgtgactctgaatcttctcataaagcagataaatatactcagtcccaagtggtggtttcgaactccaaaagcagcagctctcctcagaaaccatccttcaagtttttgatttatggtaggactgggtggattggtggtctacttggaaaactaagtgaaaagcaaggaattccatacgagtatggaaagggacgtcttgaagatcgctcacaacttttggccgatattcagactgttaagccctcacatgtttttaatgctgctggtgtgactggcagacccaatgttgattggtgtgaatctcataagacagaaacaattcgtaccaatgttgctggtacgctaaatttagctgatgtttgcagagaccagggactcctgatgataaatttcgctactggatgcatatttgagtatgatgctgaacatccagaaggttctggaattgggttcaaagaagaagacacacccaattttcatggttctttctattcgaagaccaaggccatggttgaagaactactgaaagaatatgacaatgtttgcacactcagagttcggatgcctatatcttccgacctcagcaacccacgcaacttcatcactaaaatcagccgttataataaggtggttaatattcccaacagtatgaccatcttggatgagcttctacctatttcaattgagatggcaaagcggaacttgagaggcatatggaactttaccaaccctggagttgttagccataacgagattctggagatgtacaagaagtatattgatccagccttccaatgggctaacttcactctggaagagcaagccaaggtgatcgtagcggctcgaagcaataatgagatggacgcgtccaagttgaagaaagaattccccgagttgctatcaatcaaagagtcgttgatcaagtacgtctttgaaccaaacaaaaaagcttagtaggcattctagagtagtaaatttgagccttcctctgcattatcagttaggctatatgatctttaattacctttgtaatgctagtcatgtcattagtcattcttagcttcagttcattattcttgtcattatatatctatcttgaatgtttattagagtggttctgctctgctagaggcttttccatatatttttcgcccattacaatcaattatcagtctcagtgatgctccattccggagaaacttgtttagtagggcattctctccagacgaatgttctctattcaagctagcaggatttctaacatttttattctattatagtgaatttgtttgctaattattctccaaactgcaaatattagccttgttttatttctcccccgcatctcattaataatagactggtttaccgtgtgattgatctgccatctgaaaatggcttgaaaggtggtagaaatttgtggaaatcttgtttccttattattagttgagaacataagaaataattact

SEQ ID NO: 10733 - DNA, 2339 bp, Ambrosia trifida
agtctctcgtaattcttctcaataataataatcacctttctttctggtctctctctctctcatcccgatccatatcacaattacaatttatatccagtatggctacatacgagccaaagaacatccttatcactggagctgcgggcttcattgcctctcatgttgctaaccggctgatcagaaactaccctgattacaagattgttgtgcttgacaagcttgactattgttccaatctcaagaacctgaacccatccagatcgtctcccaacttcaagtttgtcaagggggatattgggagtgctgacctcgtcaactatctgctgatcactgagtcgattgataccattatgcactttgctgcacagactcatgtcgataactcgtttggtaacagtttcgagttcacaaagaataacatctatggaacgcatgtgcttctagaagcctgcaaagtcactggtcagattagaaggtttattcacgtgagcacagatgaggtgtatggagaaactgaggaggatgctgttgttggtaaccatgaagcttcacagcttcttcctacgaacccgtattcagctacaaaagctggtgcggaaatgcttgttatggcttacggtaggtcgtatgggttgcccgtgattaccactagaggaaacaatgtttatggtccgaatcagttcccggaaaaactaatcccgaagttcatactcttggcgatgagaggacagccgcttccaattcatggtgatggttcgaatgtaaggagctatctctactgtgaagacgttgctgaggcttttgaagtaattcttcacaagggggaagttggtcatgtttataacattgggaccaaaaaggaaggagagtgatcgatgttgcaaaagatatgtgcaagctttttaatatggatcctgattcaagcatcaagtttgtggagaacagaccatttaatgatcagaggtatttcttagatgatgagaagttgaagagcttgggttggtctgaaaggaccttatgggaagagggtctgaaaaagaccatcgagtggtataccagcaacccgaactggtggggagatgtctctggagcacttctgcctcatccgagaatgttaatgatgccaggtggcgttgacagacttgttgacgggcctgaaaatgctgaatttgattcagctggtgtggcgattaatacttctcagattggagtccagattcctagctcgaaagccagtggcgtttctgctaagaaaccggctttgaagtttctcatttatgggaaaacagggtggatcggtggtttacttgggaagttatgtgaaaagcaacagatccaatacgagtatggaagaggtcgtttggaagaccgttcacaactgttgactgatattcaaatgatcaaacctactcatgttttcaacgctgctggtgtcacgggcagaccaaatgttgattggtgtgaatctcacaagacagaaaccattcgtaccaatgtctcgggcacactcaatctagctgatgtctgtagagaacatggactgttgatgatcaattttgctactggatgcatctttgagtatgatgctaaacacccggaaggttctggaatcggttttaaggaagaagatacgcccaatttcaccgggtcattctattcaaaaaccaaagctatggtggaggagcttttgaaagaatacgacaacgtgtgcacccttagagtccgaatgccgatatcatcagatctcaacaacccacgcaacttcatcaccaagattgcacgttacgataaagttgtaaacatacccaacagcatgacaatcttggatgagcttttaccaatttcaatcgagatggcaaagcgtaatctgaggggaatatggaacttcacaaacccaggggtggtaagccacaatgagattctcgaaatgtacaagaagtacataaacccggaattcaagtgggaaaatttcacactggaagaacaagcaaaagtgattgtggccccacgaagcaacaacgagttggatgcatcaaagttgaagaaagagttcccagagctgctatcaatcaaggagtcgttgatcaagtacgtatttgaacccaacaaaaaacagtaaaacaataacgatgatatgatgattctttatagaatttgtagaactcaagattcacatgtgtttggttacttgctagtttggtttggattatacatctgtaatgtttaaagtcacccgagtcagtcacattcgttctagcgttttgtttcctagcgtcattacacagaaattatagaaggcgaggccgatcctctaggcatattttataatcaaaaaagaa

SEQ ID NO: 10734 - DNA, 2546 bp, Panax ginseng
ttttttttatttctttctgtagtttaccttttgtagattggattcctaaattgagctggctactgttattttgcttcttgcgttatattgttcgtggtgctgttatatgatatgttattcttcataaattatgtgaaaacgtttcttattttttgtagacggtcatcagccattagttcaagctagttgttcctgttttatcttgttagatttcactttaatttggggattgtgggggcgttgtttgattgtaaaatgatctaaaaatagtctattttcttattagtaactgctttggtatggctacttatactccccaaaatatcctcataactggggctgctggcttcatagcatctcatgttgctaaccgtctcattcggagctaccccgattacaagattgttgtgcttgataagcttgattactgttcaaatcttaagaacctcaatccctctcgatcatctcccaacttcaagtttgtcaagggggatattggcagtgccgatcttgtcaattatcttctcatcactgagtcgattgatacaataatgcacttcgccgctcagacacatgtcgataactcctttggtaacagttttgagtttaccaagaacaacatttatggtacccatgtgcttttagaggcctgcaaagtgactggccagatcagaaggttcatacatgtaagcactgatgaggtctatggggagacagaagaggatgctgttgtgggaaatcatgaagcttcacaactcctccctacaaatccatattcagccacaaaagctggggctgaaatgcttgttatggcttatggtaggtcatatggattacctgtgataacaactcgagggaataatgtatatggccccaatcagtttcctgaaaaactaattccaaagttcatccttttagccatgagaggaaagcaactccctatccacggggatggtgctaatgtgcgtagttatctctactgtgaggacgttgctgaggcttttgaggtcattcttcacaggggagaagttggtcatgtttacaatatagggacaaagaaggagaggagagtgattgatgttgccaaagacatatgtaaacttttctctattgatcctgaagcaaacattaattttgtcgataacaggccatttaacgatcagaggtacttcctagatgatcagaagctgaaagacttgggctggtctgaacgcactatgtgggtagaggggcttaaaaagactatggattggtatattagcaaccctgattggtggggggatgtctctggagcattgcttcctcatcctagaatgctgatgatgcctggtggaattgagagacactttgacgggtcagataattgtgactctgaatcttcgcattttgcagataaatcttccaagtacccaaatggtggttccgagtcccaaaagcagcaactctcagaaaccatccattaagtttttgtatttatggtaggtctgggtggattggtggtctacttaggaaaattaagtagaaaaacaagaaattccatatgaatatggaaagggacgtctagaggatcgctcacagcttttggccgatattcagactgttaagcccacacatgtttttaatgctgctggtgtgaccggtagacccaatgttgattggtgtgaatctcacaagacagaaacaattcgtaccaatgttgctggtacactaaatttagcagatgtgtgcagagagaatggactcctgatgatgaattttgctactggatgtatatttgagtatgatgctgcacatcctgaaggttctggcattgggttcaaagaagaagacaagcccaattttcacggttctttctattcaaagaccaaggccatggttgaggaactcttgagagaatatgacaatgtctgcacgctcagagttcggatgcctatatcttcagacctcagcaatccacgaaatttcatcactaaaattagtcgttataataaggtggtcaatatacccaacagtatgaccatcttggatgagcttctacctatttcaattgagatggcaaagcggaaccttaggggcatatggaactttacgaatcctggagttgttagccataatgagattttggagatgtacaagcaatatattgatccagctttccagtgggctaactttacactggaagagcaagcaaaggttatagtagcagctcgaagcaataatgagatggatgcatccaagttgaagacggagttccccgagttgctatcaatcaaagagtcattgatcaagtatgtctttgaaccaaacaaaaaatgctaagcagagtagagtggtaaatttcaggctgcctctgcattatcagttaggttgtatggtcttgattacgttggtaatgttagtcatgtcattatttattcttagtttcattccattgttcttatcattacagatcttgatgtaggttggcatgattctgggagttttgttttccatttacaatcaaatatcagtgattttctgattgtcctccccctgatgaacttgtt

SEQ ID NO: 10735 - DNA, 2597 bp, Elaeis guineensis
tctccctctttctttgatttaattcatccccacacctaccccccattctctcttttgccagcgctcttatattcccacccccgtccaaagaaaagatcaccactttctcccgcgatcctcttctcgtctctctcgatccctgattgattttggcaacaaaaaagatggcgacatttacacctaaaaacatcctcatcactgggcggctggctttattgcatcacatgttgccaatcgcctcatccgaaactaccccaattacaagatcgtggttcttgataagcttgactactgctctaatctgaagaatctccttccttcccgttcatcacccaacttcaagtttgtcaaaggtgatattgcaagtgcagatcttgtcaacttcctcctcatcaccgagtctattgataccattatgcactttgcggctcagacgcatgttgacaactcctttggcaactcttttgagttcacgaagaacaacatctatggtacacatgtgctccttgaggcctgcaaggtcactggccagattagaaggttcatccatgttagcacagatgaggtctatggtgagactgatgaggatgccgtggttggaaatcatgaggcatctcagctgctcccaacaaacccatattctgctaccaaagcaggggctgagatgcttgttatggcatatggaagatcctatggtcttcctgttattaccacacggggaaacaatgtatatgggcccaatcagtttcctgagaagcttattcctaaatttatcctcttggctatgagaggacagccactcccaattcatggagatggatctaatgtcaggagctatctctactgcgaggatgttgcagaggcatttgaggtcatccttcaccatggagaagttggacatgtttataatattgggacaaagaaagagaggagggtgattgatgttgcgaaggatgtttgcaagcttttctcattggaccctgacaaagttatcaagtttgtggataataggcccttcaatgatcaaagatactttctggatgatcagaagctgaagaatttggggtggtcagagaggacaacatgggaagagggtttgaaaaagacgatggaatggtacacagccaattctgattggtggggtgatgtctccggggcgctgttgcctcatccaaggatgctgatgatgcccggaattggaaggcaatttgatggttctgaaaataccaagaacatagtttctcagatgactaataattttagtcagttgaagatggtaattcccaattcaaagaacactggtggttcatctccgaagccatctttgaaattcttgatttatggtaggactggatggatcggtggccttcttgggaagatatgtgagaagcaaggtataccatttgagtatggaaagggtcgcctggaagagcgttcctcactcattttggatattcagactgtgaagccaacacatgtttttaatgctgctggtgtgactggtaggcctaatgttgactggtgtgagtctcacaagccagagacaattcgaaccaatgtcgtgggtactttgactctagcagatgtctgcagggagcatgggttgttaatgatgaattatgctactggatgtatatttgagtatgatgtagtacatccagaagggtcaggcatcggcttcagggaggaagacaagccaaattttattggatcattttattcaaagactaaagcaatggttgaagaacttttgaaagaatacgacaatgtttgcactctaagagtccgaatgccaatatcttctgatcttaataatccacgcaacttcattacaaagatctctcgctataacaaagtggtgaacattccaaacagcatgactgtcttagatgagctcctaccaatatcagtggagatggcaaagagaaactgtaggggcatatggaatttcaccaatcctggtgtcatcagccataatgagatcttagagatgtacaagaggtatattgatcctggctttaattgggtcaattttacacttgaggagcaggccaaagttattgttgcacctcgaagcaacaatgagatggatgcatcaaagctgaagaatgagtttcctgaattgctgtatatcaaggattcacttattaagtatgtttttgaacccaacaggaaggttcctttaggtgtagctaattgaagcttcgagtgactgcagaattcagttactaacctttgcattctgcattagctagtacaaccttgttctccatcattctgtgggccgttttagttattacatgtcaggatgttcatcagtgtgagctctattattattgcgttgcagttagggcaatttgttaggttgccgcaacttttgtttttcacattctttttgtagtcctgcatcctttgtctgttcttgttttcatgaggcatttggtttaccttagaatggatgtcctgtccaattaggcttgcatgttatctattgaacttttataaattaaggttaatctcctgtaaaacttaaattccctactgctgctgtcatcaagttctctaccattacaaagtctcatttttatcaaaaaaaa

SEQ ID NO: 10736 - DNA, 2457 bp, Chrysanthemum coronarium
ccctcccgcttaacaataacacacaataacacatttctcgtgatctgatcataataataacaaactttctggtctgatctcgtttctctttattcaattctacgtccgggatggctacttacacgccaaagaacatcttaatcacgggggctgctggcttcattgcctcacatgtcgctaatcgcctcatcagaagctaccctgattacaagattgttgtcctcgacaagcttgattattgctccagtcttaagaaccttaacccgtctagatcatcgcctaactttaagtttgttaagggtgatattgggagtgctgatctagttaactaccttctgatcactgagtctattgatacgattatgcactttgctgcacagactcatgtagataactcatttggcaacagttttgagttcacgaagaataacatctatggtactcatgtgcttctcgaggcgtgtaaggtcactggtcagattagaaggtttattcatgtgagtacggatgaggtttatggggaaaccgaggaggatgctattgttggtaaccatgaagcttcacaacttcttcctacaaacccgtattcagccacaaaagctggtgcggaaatgcttgttatggcttgtggcagatcatatgggttgcctgtgataacaactcgaggaaacaatgtttatggcccaaaccagtttccagaaaaactaatcccgaagtttattcttttggctatgcaaggaaagccacttccgattcacggtgatggttctaatgtaaggagttacctctactgtgaggatgttgctgaggcgtttgaagtgattcttcacaagggtgaagttggtcatgtttacaacatcggcacgaaaagggagaggagagttattgatgttgcaaaggatatgtgcaagcttttcaatatggatgctgatgcaagcatcaagtttgttgaaaaccgaccctttaatgatcagaggtactttttggatgacgagaagttgaagagcttgggttggtctgagagaacccgatgggaagagggtctgaagaagaccatcgagtggtacacaagcaatcctaattggtggggcgatgtctctggagcgctgcttcctcatccaaggatgttgatgatgcctggtggagttgatcgacttgctgatggacccgatcactctgaatttgatgcagctgatccagcaatcaacactgcacagatcggagtgcaagttccctcaaagaccagtagcaacgctcctaaaaaaccagcattgaagttcctcatctatggtaagacagggtggatcggtggtttacttgggaaactgtgtgagaaacaagggattcaatacgagtatggaaaaggtcgtttggaagaccgctctcagcttttgtctgatattcagactattaaacctactcatgttttcaatgctgctggtgtcactggcagacctaatgtcgattggtgtgaatctcacaagacggaaactattcgtgtcaatgtgtgtggcacattgaacctagctgatgtctgcagagaacaaggtctcttaatgatcaatttcgctactggatgcatttttgagtatgatgctaaacaccctgagggttctggtatcggttttaaggaagaagacacacccaacttcacagggtcgttttattcaaagaccaaagctatggttgaggagctcttgaaagaatatgacaatgtctgcacacttcgagtccgaatgccaatatcatcagacctcaacaacccacgaaacttcatcacttaagattgctcgttacaataaagttgtgaacatacccaacagcatgacaatcttggatgaacttctaccaatttcaatcgaaatggcaaaaagaaacctaaagggaatctggaacttcacaaatcctggggttgtaagccacaacgagattctggaaatgtacaaaaagtacataaacccagaattcaaatgggcgaacttcacattggaagaacaagcgttagtgatcgtggccccacgaagcaataacgaattagatgcatcaaagttgaagaaagagttccctgagttgctttcaatcaaggagtcattgatcaagtacgtattcgaacccaacaaaacacagtaataatgattcttttttagcatttgtaaactccagattcacttgtgttctcgttacttactagttactgtatggtttgcattatacatctgtaatgtttaagtcaaagtcaaagacagagtcagtcgatggcagttatcgtaccacatttgttctagtctttgtttcctagtatgatcacactgagattatagggggccatttgtctaggtattttatattcatcatattccgttacaacctttgtttaacagttgttacgaatattttccctttggttttgttaaaaaccgcacgcagggttgtaatatcggattctctataagattt

SEQ ID NO: 10737 - DNA, 2291 bp, Trigonella foenum-graecum
ggtatatatataaatcaacagagaaagagtatagactccaaatctaaatctgcgtagatttcgacttcaccttctactttgtctcaactatctctctttcacttcatcttctcttaccaatttaagttgcttgatatggcaacgcacaccccaaaaacatcctcattacgggggcagctggattcattgcatctcatgttgccaaccggctcatccggaactatcccgactacaaaatcgttgtcctcgacaaactcgattactgttctaatctgaagaacctcattccttcaaaatcatctccaaacttcaagtttgtgaagggggacattggaagtgctgaccttgtcaactaccttctcatcaccgagtctatcgacacaattatgcactttgctgctcaaacccatgttgacaactcttttggtaatagctttgagttcaccaagaacaacatatatggtacacatgtcttattagaagcctgcaaggtaactggccagatcaaaagattcatccatgttagcactgatgaggtctatggagagacagatgaggatgctattgttggaaaccacgaggcttctcagctacttccaacgaatccgtactctgcaacaaaagctggagcagaaatgcttgtcatggcgtatggtaggtcgtatggattacctgtgatcacaacacgtggaaacaatgtctatggcccaaatcagtttcctgaaaagttgattccaaagtttatcctcttggcaatgcaaggaaaagttcttccgattcatggcgatggttcaaatgtgaggagttatttatattgtgaagatgttgcagaggcttttgaagttattcttcataagggagaggttggacatgtttacaatattggaactaagaaggaaaggagagttattgatgtagccaccgatatatgcaaactcttctcaaaggatccggaaactagtataaaatttgtagagaacagaccgtttaatgatcagagatactttcttgacgatcaaaagttgaagcttttgggttggtcagagagaacaacgtgggaagaaggcttgaagaaaaccatggactggtatatcaacaatcctaattggtggggtgatgtgagtggtgcattgcttcctcatccgaggatgctgatgatgcctggtggtatggagagacatttcgacggatctgaagaagaaaattctgcaccagttgtctcaagtactaatactcgattgttggttccaacaacaaagaacattagctcttcacagaaacctcctctaaagttcttgatctatggaagaactggttggatcggtggtttgcttgggaaattgtgcgagaaacagggaattccttatgaatatggaaaagggcgtcttgaggatcgttcatcactcgtggctgatattcagaacgtgaagccaactcatgttttcaatgcagcaggcgtgactggaagacctaatgttgattggtgtgaatctcataaagccgaaaccatccgcgccaatgttgctgggactttaacattggctgatgtaagcagagagcataaccttttgatgataaactatgctaccgggtgcatatttgagtacgatgaagctcatccagaaggttcaggcattggttttaaggaggaagacacacctaattttgccggttctttctattccaaaactaaggctatggttgaagagctcttgaaagaatatgacaatgtatgcactctgagagttcgcatgccgatttcatctgacctaagcaatccacgcaatttcatcaccaaaatttcgcgttacaacaaagtagttaacattccaaacagcatgactattttggatgaacttcttcctatttcaattgagatggcaaagaggaacctaagcggtatctggaacttcacaaatcctggcgccgtgagccacaacgagattcttgagatgtacagagattacattgatccaaacttcaagtgggctaacttcacacttgaagaacaagccaaagtgatagttgctgcaagaagcaacaatgaaatggatgcatccaaattgaagaatgagttcccagaattgcttcccatcaaagaatcacttatcaaatacgtctttgagccaaacaagaaaagtgcttaaaacaatattaagttgcttaacgcattcggacatcatttgctaccaagtttttgtgttttggctacttagattattactctcattatttcattgctagttccatactgttgttgttgtgtttagaggatgatattgataatttat

SEQ ID NO: 10738 - DNA, 2379 bp, Catharanthus roseus
cgaaattttctctctcttccatcttcattcggattcggcctgattgatcttgatctggattcaattttaggccactaaaaaggcaacacacaccccaaagaatattcttattactggagctgctggatttatcgcatctcatgttgcaaaccggctgatccggaactaccccgaatacaagattgttgtcctcgacaagcttgactactgctcaagtctgaagaacctccttccttcccagtcatcccctaacttcaagtttgtcaagggagacattgcaagtgctgatctcgtcaactaccttctcattaccgagtcaatcgacacaattatgcactttgctgcacagacccatgttgataactcatttggtaatagctttgagttcaccaagaacaacatttatggcacacacgtgctattggaggcctgcaaagtgactggtcagatcaaaaggtttatccatgtaagcacagatgaggtttatggagagacagatgaagatgctgttgttggaaatcatgaagcctcacaacttctgcctacaaacccatattcagccaccaaagctggagctgaaatgcttgttatggcatatggcagatcatacggattacctgtaattacaaccagagggaataatgtttacggtcccaatcagtttcctgaaaagttgatcccgaagtttatccttttggccatgagagggaagactcttcctattcatggtgatggttctaatgtgcgcagctatctttattgtgaggatgttgcagaagcctttgaagttattcttcatagaggagaagttggtcatgtttacaacattggtacaaagaaggagagaagagtaattgatgttgccaaagacatatgcaaactttttaacatggatcctgaaactaacattgagtttgtggagaataggccgtttaatgaccagagatatttcctggatgatcagaagctgaagaacttgggctggtcagagaggacaacatgggaagaaggattaaaaaagactatagagtggtacactaaaaatcctaattggtggggtgatgtttcaggagctttgcttcctcatccaagaatgttaatgatgcctggtgggatagaaaggcttcttgatggatctgataagtatgactctggatcttctgaattctcggggaattctaaacaggaccgtatggttgtcccacctcctaagagtccacctaagccatccttgaaattcttgatctacggtagaactgggtggattggtggtctgctggggaaattgtgtgaaaaacaggggattccatacgagtacggaagggggcggctggaagaccgctcacaacttttggctgacatccaaattgttaagcccacccatgttttcaatgctgctggtgtgactggtagacccaatgttgattggtgtgaatcacacaagaccgaaacaattcgtacaaatgttgctggtaccctgactttggcagatatctgtagagagcatggtctgctgatgatgaattttgctactgggtgtatatttgaatatgatgcagcacatccagaaggatctggtattgggtacaaggaggaagacacgccgaacttcactggatctttctattcaaagactaaggccatggttgaggagttactaaaagagtatgacaatgtttgcacccttcgtgtacggatgcctatatcttcagacctcagtaacccacgaaatttcatcaccaagattgctagatacaataaggtggttaacattcccaacagcatgaccatcttggatgaacttctgcctatttccattgagatggcaaaaagaatctgaggggcatttggaacttcacaaatcccggggttgttagccataatgagattctggagatgtacaagaaatacattaatccagaatttaaatgggccaactttacgctggaagagcaagcgaaggtgataattgccccacgaagcaataatgagatggatgccaccaagctgaagaaagagttcccggaattgctacctatcaaggaatccttgataaagtatgtctttgaacctaacaagaaaacttctgcttgaataagagtttagaagaggggctacattttgcagttttgtatctcacaggttatatgatcgtgtgttatgttagtcaatgcctcagctcattcttttctattgtttttagaatctggatagcgatttagttgttggctctattagtcagtctaccctcaagtattaattagagttcagcagtaaaatttcaggtgctcattattacaggctacccccattaggtttgttacatctgttgttcccagtacgcaggattgtataatttggagcgtattaatattaatt

SEQ ID NO: 10739 - DNA, 2525 bp, Ananas comosus
ctacatttaaataccctctgtaacctcctcttcctttcccgtgagcgctcatcgtggctcataaacacccctctcccttctccccctcttctccttcgcctcacgcgatcgatcccctcctcagatccattttgaaaacagaaaaagaatggcgacgtacacaccgaaaaacatcctgatcactggtgcagcaggcttcatcgcctcccatgttgcgaaccgccttgtccgcaactacccggattacaagattgtggtcctcgacaagcttgactactgctccaatttgaagaacctccttgcttctcgttcatctcccaatttcaaattcgtcaaaggcgatatagcaagcgctgaccttgtcaacttccttttaattactgaatccatcgacaccatcatgcactttgcggcccagacccatgtcgacaactcctttggaaactccttcgaattcaccaagaacaatatctatggcacccacgtccttcttgaagcttgcaagaccacgggccaaatccgacggttcatccacgttagcactgatgaagtttatggggaaactgatgaagatgctgttgttgggaatcacgaggcatctcagcttttacccaccaatccatactctgctacaaaagccggggcagagatgctcgttatggcctatgggagatcgtatggattacctgtaatcactactagagggaacaatgtatatggtcctaaccaattccctgagaagcttattccaaagtttattcttttagcaatgagaggacagcctctacctattcatggggatggatcgaatgttaggagctatctttactgtgaggatgtggcagaggcctttgaggttattcttcatagaggagaagttgggcatgtttataacatcggaacaaagagagaggagagtaatagatgtggcaaaggatatatgtaagcttttctcattagaccctgatgatatgataaaatttgtggacaataggcctttcaatgatcaaaggtactttcttgacgatgaaaaattgaagtatcttgggtggtcggagagaactatatgggaggagggattaagaaagactatggagtggtacacgagcaatcccgattggtggggggacgtatcaggtgcattattgcctcatccaaggatgctaatgatgcctggaaactttgattcttccgacgagaataagggaatcgtctatgaatttaccaaagataatcagttcacaaataatcagatgagagtggtggtcccaacatcaaagaacagcttgcagcaaaagccctcaatcaaattcttgatttatggtaggacagggtggatcggggggcttctggggaagatatgtgaaaagcaagggattccattcgagtatggaaagggccgcctcgaagatcgtgctcagcttgtattggacattcagaccgtgaagccaacgcacgtattcaatgctgctggtgtgactgggaggcctaatgtcgactggtgtgagtcccacaagccggagacaatccggacaaatgttgtgggtacgttgaatctggccgatgtgtgcagggagcatggactgttgatgatgaattatgctactggttgcatttttgagtatgatgatgtgcatccagaagggtcaggcattgggttcaaggaggaggacaagccgaattttaccgggtcattctactcaaagaccaaggcaatggttgaagagcttctcaaagagtacgataacgtctgcactcttcgagtccggatgccgatatcctctgatttgacgaacccacgcaatttcatcacaaagatctctcgctataacaaagtagtaaacattccgaacagcatgaccatactagacgaactgcttccaatatcggttgaaatggcgaagaggaactgcaggggaatatggaacttcaccaaccccggcgttgtaagccacaatgagatattagaaatgtacaagaagtacatcgatccaaactttgagtgggccaattttaccctcgaagaacaggctaaagtaattgtcgccccgcggagcaacaacgaaatggacgcctcaaaattgaaaaatgagtttccggacttgctgtcgatcaaagattcgctgatcaagtatgtgtttgagcccaacaggaaggtcgctgtgggcgaagctgctaactgaaccaacccaatatctcaaagcattcgatctctaaccttttacattctacattagctagtataatgtcgatcacactcttcttacggttggccgtaataagttaggatattcatcattcttagttccattgtcactgcattattactaccttttagatgttttagttgctatgttttctctctttttaatcttattatattttagtacaatggcatcatcgatctggttttgcctagaaatggatgttcatgtccatttgagatttgcatataatctatttggtatgtgttgtgttaatggaacttctttattgaatgaaaataatattcttttattttgatt

SEQ ID NO: 10740 - DNA, 2132 bp, Eucalyptus grandis
agattgcgtcttggaatatgtgattgcattttattttcagttgacccgaggatctgaattactcttgccatggttgatttgcagaggttgctaggtgatggctaattataccccgaagaatatcctcattactggggcggctgggttcattgcatcccatgtcgctaaccgcctcattcgtaattaccctgaatacaagatagttgtgctcgacaaactcgactattgctccaacctgaaaaacctgagtccttcacaatcatcccccaacttcaagtttgtgaagggagacatcggaagtgctgaccttgtgaactaccttctcatcacggagtctattgacaccataatgcattttgctgctcagacccacgtcgacaattcctttggcaacagctttgagtttaccaagaataatatttatggtactcatgtcctcttagaagcctgtaaggtgacagggcagatcaggagattcatccacgtgagcactgatgaagtttatggagaaacggatgaggatgcggcggtaggaaatcatgaggcatctcaactcctccccacaaatccttactcagcaacaaaggctggagcggagatgcttgtcatggcatatggcaggtcatatgggttacctgtcataacgacccgtgggaacaatgtttatgggccaaatcaatttcctgaaaagttgatcccaaagtttatccttttggctatgagagggaagcctcttcccattcatggagatggatccaacgtccgtagttacctctactgtgaggatgttgctgaggcttttgaggtagttcttcacaagggtgaggttggtcatgtctacaacatcggcacgaagaaggaaagaagagtaattgatgtggctagggacgtatgcaaacttttctccatggactcagaaaccagcattaagttcgtagagaataggccatttaatgatcagaggtactttttggatgatcagaagctgaagaacataggctggtcagagcggactacgtgggaagaggggctgaagaagactatggactggtacattaataatcctgattggtggggtgatgtttctggagcgcttctccctcatccaaggatgctgatgatgccgggtggtattgaaaggcattttgatgattctgaaggaggcgaatctccatcaaacgtccccacagcttctaatcagtccaagatggttgttccaccttcaaaaaatgcgacttcagccaagaaaccttccttgaagttcctgatatatggtaagaccggttggattggaggtctacttgggaggctatgcgagaatgaaggaatcccatttgagtatggaaaagggcgccttgaggagcggtcacagcttgtggcagacatacagaatgttaaacccacccatgttttcaatgctgctggtgtaactggtaggccgaatgttgattggtgcgaatcccataagaccgaaaccatccgcaccaatgttgctggaaccttgactctggcagatgtctgtagggagcatgggcttttgatgatgaattatgccacaggctgtatatttgagtatgatgctgcacacccagagggctcgggcattggctataaggaggaagacaaacccaattttactggctccttctattccaagacaaaggccatggtaagttgaaggttgaagagcttttgaaggaatacgacaacgtttgcacactcagagtccgtatgccaatatcctctgacctcaacaacccccgcaatttcattaccaagatttcgcgctatagcaaggtggttaacattccgaatagtatgaccattttggatgagctgcttcccatctcaattgagatggcaaagcggaacttgaggggaatatggaacttcacaaatcctggagtcgtgagccataatgagattttggagatgtacaagcagtatattgatccccaattcaagtggatgaactttacattggaagagcaagcgaaagtgattgttgccccccgaagcaataacgagatggatgctactaagttgaagaaagagtttccagatttgctaccgatcaaggagtcactgatcaagtacgtgtttgaaccgaacaggaagaactaagcagatga

SEQ ID NO: 10741 - DNA, 2451 bp, Ambrosia trifida
gtaattcttctcaataataatattcacctttctggtcggtctttactttctctctctctctcatcccgatccatatcacaattacaattatatccagtatggctacatacgagccaaagaacatcctatcactggagctgcgggcttcattgcctctcatgttgctaaccggctgatcagaaactaccctgattacaagattgttgtgcttgacaagcttgactattgttccaatctcaagaacctgaacccatccagatcgtctcccaacttcaagttgtcaaggggatattgggagtgctgacctcgtcaactatcttctgattactgagtcgatcgataccattatgcactttgctgcacagactcatgtcgataactcgtttggtaacagttttgagttcacaaagaataacatctatggaacgcatgtgcttctagaagcctgcaaagtcactggtcagattagaaggtttattcacgtgagcacagatgaggtgtatggagaaactgaggaggatgctgttgttggtaaccatgaagcttcacagcttcttcctacgaacccgtattcagctacaaaagctggtgcggaaatgcttgttatggcttacggtaggtcgtatgggttgcccgtgattaccactagaggaaacaatgtttatggtcctaatcaattcccggaaaaactaatcccgaagttcattctcctggcaatgagaggacagccgctaccgattcatggtgatggttcgaatgtaaggagttatctctactgtgaagacgttgctgaggcttttgaagtaattcttcacaagggggaagttggtcatgtttataacattgggaccaaaaaggaaaggagagtgatcgatgttgcgaaagacatgtgcaagctctttaatatggatcctgattcaagcatcaagtttgtggagaacagaccgtttaatgatcagaggtatttcttagacgatgagaagttgaagagcttgggttggtctgaaaggaccttatgggagagggtctgaaaaagaccatcgagtggtataccagcaacccgaactggtgggagatgtctctggagcacttctgcctcatccaagaatgttaatgatgccaggtggcgttgacagacttgttgacgggcctgaaaatgctgaatttgattcagctggtgtggcgattaatacttctcagattggagtccagattcctagctcgaaagccagtggcgtttctgctaagaaaccggctttgaagtttctcatttatgggaaaacagggtggatcggtggtttacttgggaagttatgtgaaaagcaacagatccaatacgagtatggaagaggtcgtttggaagaccgttcacaactgttgactgatattcaaacgatcaaacctactcatgttttcaacgctgctggtgtcacgggcagaccaaatgttgattggtgtgaatctcacaagacaggaaccattcgtaccaatgtctcgggcacactcaatctagctgatgtctgtagagaacatggactgttgatgatcaattttgctactggatgcatctttgagtatgatgctaaacacccggaaggttctggaatcggttttaaggaagaagatacgcccaatttcactgggtcattctattcaaaaaccaaagctatggtgaggagcttttgaaagaatatgacaatgtgtgcaccctaagagtccgaatgccgatatcatcggatctcaacaacccacgtaacttcataaccaagattgcgcgttacgataaagttgtaaacatacccaacagcatgacaatcttggatgagcttttaccaatttcaatcgagatggcaaagtgtaatctgaggggaatatggaacttcacaaacccaggggtggtaagccacaatgagattctcgaaatgtacaagaagtacataaacccggaattcaagtgggaaaatttcacactggaagaacaagcaaaagtgattgtggccccacgaagcaacaacgagttggatgcatcaaagttgaagaaagagttcccagagctgctatcaatcaaggagtcgttgatcaagtacgtatttgaacccaacaaaaaacagtaaaacaataacgatgatatgatgattctttatagaatttgtagaactcaagattcacttgtgtttggttacttgctagtttggtttggattatacatctgtaatgtttaaagtcacccgagtcagtcacattcgttctagcgtttgtttcctagcgtcattacacagaaattatagaaggcgaggccgatcctctaggcatattttatattcatcattttgtctacagttagtttgttcaacagtcgtttacaaatgttttcctttggtttcgttagaaaccgcacgcggcatacaggcttgtactattggattctctatgatatttgttatttcttta

SEQ ID NO: 10742 - DNA, 2886 bp, Cajanus cajan
tttttttttttttttcttttaagagagagaagtgtcaccatcataactaaacgaccagcaatctaaagggggacttaatagtacgacagatcaaaacgaaaattcaattcaattaaatatcaaatgggcagtgggccccacgtaaattaacgaaatttggagggtattttggtcactttgcacgatcctctggctccccttaactgtctcaaacacagagttgatcaaattttcatacttaaccgcctgtgtgtataatatatatacaaagtgtgtagagtccaaatctaaatctgggaactatcatttttcgattccatttcttccctgtctgaacgacttctctagcttgtcttcgtcttttctccgcttcatctcccaccaatttcaagtgcgggccatggctacgcataccccaaaaaatatcctcattactggggctgctggattcattgcatctcatgttgccaaccgccttatccgaaactatccacagtacaaaattgttgttcttgacaaacttgattattgttcaaatctgaagaacctcattccttcaaaatcgtctcccaacttcaagtttgtgaagggagatattggcagtgctgacctagtcaactaccttctcatcactgagtccattgacacaataatgcattttgctgctcaaactcatgttgacaactcgtttggcaacagcttcgagttcaccaagaacaacatatatggtactcatgtcctattagaagcctgcaaggtaactggccagatcaaaaggttcatccatgtgagcactgatgaggtctatggagagacagatgaggatgctgttgttggaaaccatgaggcttctcagttacttcccacaaatccatattctgcaacaaaagctggggcagaaatgcttgtcatggcatatggcagatcatatgggttgcctgtgatcacgacacgcggaaacaatgtttatgggcctaatcagtttccggagaagttaaaattccaaagttcattctccttgctatgcaaggaaagaatcttccgatccatggggatggttctaatgtgaggagttatttatattgtgaagatgttgcagaggcttttgaggttatccttcacaagggagaggttggacatgtttacaacattggtactaagaaggaaaggagagttatcgatgttgccaaagatatatgcaggcttttctcgaaggacccggatacttgtataaaatttgtagagaacaggccatttaatgaccagagatactttcttgatgatgaaaagctgaagatcttgggttggtctgagaggaccacttgggaagagggcttgaagaaaaccatggactggtatatcaacaatcctgattggtggggtgatgtcagtggtgcattgcttcctcatccaaggatgctgatgatgcctggtggattggagagacattttgatggatctgatgaagaaaaaccttcaacatatgtctcgactaatactcggatggtggttccatcatccaagaatgttggctcctcacagaaacataatctcaagttcttgatctatggcagaacaggttggattgggggcttgctggggaaattgtgtgaaaagcaagggattccatatgaatatggaaaagggcgcttagaggaccgttcatcactcgtggctgacattcagaatgtgaagccaacacacatttttaatgcagcaggagtgactggcagacccaatgttgattggtgtgaatctcataaaactgaaaccatccgtgccaacgttgctgggactttaacattggctgatgtcagcagagagcatggactcttgatgataaattatgctactgggtgcatatttgagtatgatgaggctcatccagagggttctggcattggttttaaggaggaagacaaacccaatttcattggttctttctactccaaaactaaggctatggttgaagagctcttgaaagaatatgacaatgtatgcacccttagggttcgcatgccgatttcatccgacttgagtaatccacgcaacttcatcaccaagatttctcgctacaacaaagtagtcaacattccaaacagcatgactattttggatgaacttctgccaatttcaattgagatggcaaagcgaaacctgaggggcatctataacttcacaaaccctggtgctgtgagccacaatgagattctagagatgtacagggattacattgatccaaacttcaagtgggttaacttcacacttgaagagcaagccaaggtgatcgttgctccacgtagcaacaacgagatggatgcatccaagttgaagaaagagttcccagagattctttccatcaaggaatcactgatcaagtatgtctttgagcccaacaagaaatctgcatagttaagtagtttcatgttttagacatcacagactatgcatttttgtggcgggctacatagatcactcattaattcattgttatttcatttggtttgataagaaccacaccacaaaaacagctagccatgtagttcttgctcttttagctataagtaattccagtttcaacatatagttccagcatgtactgtgtttagagggtgacaagtattatgatttggaccagatgtggttctaagttaacatttctgcctcattattctagtttatagtgtcctctgttatgagcaaaccttagatagggttttgttaccaaaaaacttactagcatcttttgcatcctggaagacatgtattcttttatttctcatatatatccttttttgtgggacatgcagttatgcttttatcgtatttgcattgtatatttttatttgtctgagaatcgaattcggtaccaaagagatttacaat

SEQ ID NO: 10743 - DNA, 2184 bp, Vinca minor
gcttctcgctctaatcactggatcgatttctttcccaattatctctctcctccatcttcattgccctgattcatctcgatctcgattcaaatttgggccactaaaatggcaaaacacacaccaaagaatattcttattactggtgctgctggatttattgcatctcatgttgcaaaccggcttattcgtaactatcctgaatacaagattgttgtcctcgacaagcttgactactgctcaaatttgaggaacctccttccttctacttcatcccctaacttcaagtttgtcaagggggatattgctagtgctgatcttgtcaactaccttcttattactgagtcaattgacacaataatgcacttcgctgcacagacccatgttgataactcatttggtaatagctttgagttcaccaagaacaacatttatgggacacacgtgctattggaggcttgcaaagtgacgggtcagatcaaaaggttcatccacgtaagcacagatgaggtctatggagagacagatgaagatgctgttgttgggaatcatgaagcctcacaactccttcccacaaacccatattcagccactaaagctggagctgaaatgcttgttatggcatatggcaggtcatatggattacctgtaataactactcgagggaacaatgtttatggtcccaatcagtttcctgaaaagttgattccaaagtttatccttttggctatgagagggaagactcttcccattcatggagacggttcaaatgtgcgcagctatctctattgtgaggatgttgcagaagcatttgaagttattcttcatagaggagaagttggtcatgtttacaacattggtacaaagcgggaaagaggagtaattgatgttgccaaagatatatgcaaactttttaacatggatgctgaaactagcattaagtttgtggagaataggccatttaatgatcagagatatttcctagatgatgagaagctgaagaacttgggttggtcagagaggacaagatgggaagaaggactaaaaaagactatggagtggtacaccaagaatcctgactggtggggtgatgtttctggagcattgcttcctcatcccagaatgttgatgatgcctggtgggatagaaaagcttcttgatggatctgataagtatgactctggatctcctgagttctcagggaaatctaaacaggactctatggccatcccacctgctaagggctcacctaagccatccttgaaattcttgatctatggtaagactgggtggattggtggtctgctagggaaattgtgtgagaaacaggggattccatacgagtatggaagggggcggctggaggaccgctcacaacttctggttgacatccaaattgttaagcccacccatgttttcaatgctgctggtgtgactggtagacccaatgttgattggtgtgaatcacacaagactgaaacaattcgtacaaatgttgttgggactctgactttggcagatatctgcagagagcacgctctcctgatgatgaattttgcaactggatgtatatttgaatatgatgctgcacatccagaaggatctggtattgggtacaaggaggaagacacgcctaatttcactggatctttctattcaaagaccaaggccatggttgaggagctattgaaggagtatgacaatgtttgcaccctacgggttcgtatgccaatatcttcagacctcagcaacccacgaaatttcatcaccaagattagccgttacaataaggtggttaacattcccaacagcatgaccatcttggatgagcttctgcctatttccattgagatggcaaaacgaaatctgaggggcatttggaacttcacaaatcctggggtcgttagccataatgagattctggagatgtacaagaaatacatcgatccaaaatttaaatgggccaactttacgctggaggaacaagcaaaggtgattgtcgcccccgaagcaataatgagatggatgcctccaaactgaagaaagagttccccgagttactatctatcaaagagtcattggtaaagtatgtctttgaacctaacaagaaaacatctgcatgaacaagcctttagagagtaagactatggggatatatgttgcagttttgtacacacgtgtgttggt

SEQ ID NO: 10744 - DNA, 2411 bp, Chenopodium quinoa
ccctatcccctgtgtgccttgcctcccacgactaaaacgtacgttttctctttattgtgttcttgaatctagtatgctctgaaattctccattgaagtggcttttcagctttctctcctccattgaagcagcttctaagaaggtggtgcaatcatgtcttcatacaccccaaagaatattcttattactggtgctgctggattcattgcgtctcatgtcgcaaaccgactcattaggagttaccctgattacaagattgtcgttcttgacaagcttgattactgctcaaaccttaaaaatttacgtccttctcaatcatcccctaattttaagtttgtcaaaggggacattgctagtgccgaccttgtaaactaccttctcatcaccgagtccattgatactattatgcactttgctgcacaaacccatgttgacaattcttttggtaatagctttgagttcaccaagaacaacatttatgggacccatgtcctcctagaagcctgtaaggtcaccgggcaaattaggagattcatccatgttagtactgatgaggtttacggggagacagatgaggatgctgttgtgggtaatcatgaagcttctcagcttcttccaacaaatccatactctgctacaaaagctggtgctgagatgcttgtcatggcttatggaagatcatacggtttgccagttattactacccgtggaaacaatgtgtatggccctaaccagtttcctgagaaattgatcccaaagttcattcttttggccatgagaggaaagcctcttccaattcacggagatgggtctaatgtgagaagctatctctactgtgaggatgttgctgaggcctttgaggtcattctccacaggggagaggttggccacgtgtacaacattggaaccaaaaaggagaggagagtcattgatgtggccacagatgtatgcaaactgttctcaatggatccagatgcaagcatcaagtttgttgagaacaggccgtttaatgaccagaggtacttcctagatgatgagaaattgaagatcttagggtggtcagagcgcaccacttgggaagagggcctgaggaagacaatggagtggtataccagtaaccccgattggtggggtgatgtctcaggagcattgcttcctcacccaaggatgctgatgatgcctggtgggatcgagaggcattttgaagaagcagacaatgagaatgctgcttcttctgaattttccaactacccagtctaaatcggtggtacccctaccaaaagtgtcagttctcctcgtaagccatctttcaagttcctgatctatggtagaactgggtggattggtggtcttcttggccagttgtgtgagaagcaaggtattacatttgagtatggaaagggccgtttggagaaccgagcatctcttattgctgatatccagaatgtcaagcctactcatgtctttaatgctgctggtgtgactggtaggccgaacgttgactggtgtgaatctcacaaagcagagacaattcgcgccaatgttgctggtactttgactttggctgatgtctgcagagagcatgggcttttgatgatgaattttgctactggttgcatctttgagtatgatgctgcacatcctttgggttctgggattggcttcaaggaagaggatacaccaaacttcactggttctttctactcaaagaccaaggctatggtggaggagcttttgaaagagtttgataatgtgtgcacccttagggtccgaatgcccatttcttctgacctcaacaacccacgaaacttcatcacaaagatctctcgctacagtaaggtggttgacattcccaacagcatgactgttttggacgagcttctacccatttccattgagatggcaaagaggaatctcaagggcatctacaacttcacaaacccaggggtggttagccacaatgagattctcgagatgtacaagattacatggacccagaattcaagtgggcgaatttcacacttgaagagcaagccaaggttattgttgctccaagaagcaataatgagatggacgcctccaaattgaaaaaggaattccctgaattgctgcatattaaggactcactaatcaagtatgttttcgagccaaacaagaagacaaactattctgcttgagcgaacttttctgcagaattaagagatgctgtagtaagcaggattgcaatttttttccagtaggcattgcggttgcatagcgttactccattgggtcttgggcaaaacattcatttattttagcttcatattgtgctgtttttatatacctagattgcctgttcgtagagtttttattaggtgttcacatttccatcttttaccattttacgtcttctgtttaaacgtgattac

SEQ ID NO: 10745 - DNA, 2257 bp, Chrysanthemum coronarium
attcgaatcttcattttatatagtgttacgatatgactagttatacgccaaagaatatcctcataaccggggcagctggatttattgcctctcatgtcgctaatcggcttgtgagaagctaccctgattacaagattgttgtgctcgacaagcttgattattgctcgaatcttaagaatcttaaccccgtctagatcgtctcctaattttaagtttgttaagggggatattgggagtgctgatctggtgaattatcttttaattaccgagaatattgatacgattatgcactttgctgctcagactcacgttgataattctttcgggaatagttttgagttcactaagaataacatttacgggacgcatgtgttgttggaggcgtgtaaagtgactcgtggtcagattagaaggtttattcatgttagtacggatgaggtgtatggtgaaacggaggaggatgctgttgtggggaaccatgaagcgtcacagcttcttcctacgaatccgtattctgccaccaaagctggggcggaaatgcttgttatggcttatggtaggtcatatgggttgcctgtgattaccactagaggtaacaatgtgtatggcccaaatcagtttcctgaaaagttgatcccaaagttcattcttttggctatgagagggcagccacttccgattcatggtgatgggtcgaatgtgaggagttatctttactgtgaagatgttgctgaggcttttgaagtcgttctccacaagggtgaagtcggtcatgtttacaacattggaaccaaaaaggaaaggcgagttaatgatgttgctcatgatgtctgtaatctgtttaatatcgatcctgaatcaagcatcaagtttgtggagaacaggccgtttaatgatcagaggtacttcttggatgatgagaagcttaagtgtctgggttggtccgaaaggaccacatggcaagagggtctaaaaaagaccatggagtggtacaccagcaatcccgattggtggggtgatgtctctggtgctctgcttcctcatccacgaatgctgatgatgcctggtggagtcgagaaagtcattgacgtccctgaaaacgttcaatctgattcacctcatgcagctgttaactcttctcagtttcaaaaagtggtttctgctgcaaaaaccagtaccaactctgctactaaaccatctttcaagttccttatctatggtaaaacagggtggatcggtggtttacttgggaaaatatgcgagaaacaagggattcagtacgagtatggaaagggtcgtttggaggaccggtcatcgattgttgctgatattaagaatgttaagccaacccatgttttcaatgctgctggtgtcactggcagacccaatgttgattggtgtgaatctcacaagaccgaaaccatccgtacaaacgtctcgggcacactcactttagcagatgtttgcagagatcaagggattttggtgatgaacttcgccactggatgcatatttgagtatgatgctgcacatccagaaggttcagggatcggttttctggaagaggacacgcccaatttcactggttcattctactccaaaaccaaggctatggttgaggagctattgaaagaatacgacaatgtatgcaccctgagggtccgaatgccaatatcatcagacctcaacaacccacgtaactttgtcaccaagattgctcgttacgataaagtggtcaacattcccaacagcatgaccatcttggacgagcttctgcctatttccatcgaaatggcaaagagaaacctcaagggaatctggaactttaccaacccaggtgttgtgagccataacgaggtcctggagttgtacaaacaatacatcaacccagaattcaaatggaaaaacttcacactcgaagaacaagcccaagtgatagttgccccacgaagcaacaacgagttggatacatccaagttgaagaaagagttccctgaattgctatcgattaaagaatcattggttaagtacgtatttgcccccaacaaaaaagcttagtgagtgtcgaaatccctattggcgtgttatataggtttggatattattacgggtgtgatatgtttaaacacgaaatttacttgtgatgtttgttcctagtagtaagtaagatgaataccgagagagattatagaaaaggccgagagttcattacatttgttaaaactatagcatattgctattcttgattttattaccg

SEQ ID NO: 10746 - DNA, 2461 bp, Amsonia hubrichtii
cctgagtcctctcctttcttcttctactactcaaccccttgctctgaacttgcttctgtaaatcagattttactctgaagctattactctgggatttccagaaagtttgaaattttggggtcttgtaatcttgaaactttgcttttcgtaccaagaaatagatcttgctgtaaacgataccagtcaagatggaaacttacacaccaaagaatattctcatcactggtgcggcgggattcattgcatgccatgttgctaatcggctcatccgcaactatcccggctacaagatcgttgttcttgacaagcttgattactgttcaaatctgaagaatctcaacccttctcggtcatctcctaacttcaagttcatcaagggagacattggtagtgcagaccttgttaatttcatccttgtcaccgagtcaattgatacaatcatgcactttgcagctcagacacatgtagacaattcatttgggaacagctttgagttcactaagaacaatatttacggcactcatgtccttcttgaggcctgcaaagtgaccggtcaaattaagcgatttatccatgtcagcacagacgaggtttacggagagacagatggggatgctgttgttggaaatcatgaggcttctcagctccttccaactaatccatattctgcaactaaagctggggctgagatgcttgttatggcatatggacggtcctatggtttacctgtaataaccacaagaggaaacaatgtctatggtccaaaccagtttcctgagaagttaattccaaaattcatcctcttggccatgaaaggacaacctcttccaattcatggtgatggatccaacgtgcgtagttatctttattgtgaggatgttgcagaggcatttgaactcattctgcacaaaggtgaagtgggccatgtctataacatagggaccgataaggaaaggagagtccttgatgtagccaaggatatctgcaagcttttctctttggacccaaacaacgtgatcaaatttgtggaaaaccgtccatttaacgaccagagatattttctagatcatcaaaagctgaaaaaattgggatggtcagagcgcacttcatgggaagaaggtctaaggagaacaatggaatggtacgtccaaaatcctgattggtggggagatgtatctggtgctctcatacctcatccaaggatgctaatgatgcctggtatgggcagaaatggttctgatgtcggttctactgctgcatctaacaaactaaataagtcagctcaggagagaatggtggtccctgtcacaaaaaatcctaacgagaagcctcccttgaagttcttgatttatggcagaactgggtggattgggggtcttcttgggaagttatgtgagaaacaaggaatagcctttgagtatggtaaagggcgcctgcaggaaagatcacagctgctatctgatattcagagcgtgaagccaacccacgttctaaatgctgctggtgttactggcagacctaatgtggattggtgtgagtcccataaacctgagacaattcggactaatgttgttggtaccctaaccttggcagatgtttgtagagagcatgggctacttatgcttaactttgccacaggctgcatatttgagtatgattctgaacatcctcttggctcaggcgttggatttaaggaggacgataagcccaacttcattggatctttctactcgaaaaccaaggcaatggttgaagaacttctgaagaatatgacaatgtatgcaccttgagagttcgaatgccaatatcatctgatcttcagaaccctcgtaacttcatcacaaaaattgcacggtatgacaaagttgtgaacattccgaacagcatgaccgtgctggatgagctcttgcccatctcaattgagatggctaagaggaacttgaaagggatatggaacttcacaaatccaggtgttataagccacaatgagatactggagatgtacagggattacattgaccctaagtttaagtggacaaacttcaccctggaagaacaggccaaggttattgttgcgcctaggagcaataacgaaatggatgcatccaagttaaagaaagagtttccagaactattgtctatcaaagaatcactgatcaaatatgtctttgaacccaacaagaaaaaggtcactgcttgaattgcaacaagcattttgattgaacttagacatatcgattgatgttatgctctagaaaagaaaagagggttgagtcaaatttatgattagttgtatcttaggatgctttattgtcttcatgttatactattgtcaatttatatttgttgcatttatgtgtcatatagtttggtacaagtgaaggattagttttggatgtaataataccttagccctttatatacattattaagttgtataacttaatgagaagcatttttc

SEQ ID NO: 10747 - DNA, 2572 bp, Panax ginseng
cgagttttatcaccgttatgtgatacatctatccatactgatacacattttgtatatttatttctctgtgtataaataaatactatagtattgctgtagtgctctctgttcatcattctttctttgtccgagtcttttctatatctccttcctttcaaagggttctcccttttcaatctcctaaccgtgattgacctggatcaaatttaaactgctttggtatggctacttatactcccaaaaatatcctcataactggggctgctggcttcatagcatctcatgttgctaaccgtctcattcggagctaccccaattacaagattgttgtgcttgataagcttgattactgttcaaatcttaagaacctcaatccctctcgatcatctgccaacttcaagtttgtcaagggggatattggcagtgccgatcttgtcaactaccttctcatcaccgagtcgattgatacaataatgcacttcgctgctcagacacatgtcgattaactcctttggtaacagttttgagtttaccaagaacaacatttatggtacccatgtgcttttagaggcctgcaaagtgactggccagatcagaaggttcatacatgtaagcaccgatgaggtctatggggagacagaagaggatgctgttgtgggaaatcatgaagcttcacaactcctccctacaaatccatattcagccacaaaagctggggctgaaatgcttgttatggcttatggtaggtcatatggattacctgtgataacaactcgagggaataatgtatatggccccaatcagtttcctgaaaaactaattccaaagttcatccttttagccatgagaggaaagcaactccctatccacggggatggtgccaatgtgcgtagttatctctactgtgaggacgttgctgaggtcttttgaggtcattcttcacgaggggagaagttggtcatgtttacaatatagggacaaagaaggagaggagagtgattgatgttgccaaagacatatgtaaacttttctctattgatcctgaagcaaacattaattttgtcgataacaggccatttaacgatcagaggtacttcctagatgatcagaagctgaaagacttgggctggtctgaacgcactacgtgggtagaggggcttaaaaagactatggattggtatattagcaaccctgattggtgggggagtgtctctggagcattgcttcctcatcctagaatgctgatgatgcctggtggaattgagagacacttcgacgggtcagataattgtgactctgaatcttcgcattttgcagataaatcttccaagtcccaaatggtggttccgagtcccaaaagcagcaactctcagaaacgatccattaagttttttatttatggtaggtctgggtggattggtggtctacttggaaaattaagtgaaaaacaagaattccatatgaatatggaaggggacgtctagaggatcgctcacagcttttggtcgatattcagactgttaagcccacacatgtttttaatgctgctggtgtgactggtagacccaatgttgattggtgtgaatctcacaagacagaacaattcgtaccaatgttgctggtacactaaatttagcagatgtgtgcagagagaatggactcctgatgatgaattttgctactggatgtatatttgagtatgatgctgcacatcctgaaggttctggcattgggttcaagagaagacaagcccaattttcacggttcttctattcaaagaccaaggccatggttgaggaactcttgagagaatatgacaatgtctgcacgctcagagttcggatgcctatatcttcagacctcagcaatccacgaaatttcatcactaaaaattagtcgttataataaggtggtcaatattcccaacagtatgaccatcttggatgagcttctacctatttcaattgagatggcaaagcggaacttgagaggcatatggaactttaccaaccctggagttgttagccataacgagattctggagatgtacaagaagtatattgatccagccttccaatgggctaacttcactctggaagagcaagccaaggtgatcgtagcggctcgaagcaataatgagatggacgcgtccaagttgaacaaagaattccctgagttgctatcaatcaaagagtcgttgatcaagtacgtctttgaaccaaacaaaaaagcttagtagtaaatttcagccttcctctgcattatcagttaggctatatgatctttgattacctttgtaatgctagtcatgtcattagtcattcttagcttcacttcattattcttgtcctattttgaatgtttattagagtagttctgctctgctagaggctttttcacccattacaatcaattatcagtcgggcattctctctagacgaatgttctattcaagctagcaggctttctaacatttttattctattatagttattatagtgaatttgtttgctaataattctccaaactgcaaatattccctcatctcattaataatagagactggtttacc

SEQ ID NO: 10748 - DNA, 2274 bp, Chenopodium quinoa
agaaggtggtgcatcatgtcttcatacaccccaaagaatattcttattactggtgctgctggattcattgcgtctcatgtcgcaaaccgactcattaggagttaccctgattacaagattgtcgtgcttgacaagcttgattactgctcaaaccttaaaatttacgtccctctcaatcatcccctaattttaagtttgttaaagggatattgctagtgccgaccttgtaaactaccttctcatcactgagtccattgatacgattatgcactttgctgcacaaacccatgttgacaatttctttggtaatagctttgagttcaccaagaacaacatttatgggacccatgtcctcctagaagcctgtaaggtcaccgggcaaattaggagattcatccatgttagtaccgatgaggtttacggagagacagatgaggatgctgttgtgggtaatcatgaagcttctcagcttcttccaacaaatccatactctgctacaaaagctggtgctgagatgcttgtcatggcttatggcagatcatatggtttgccagttattacaacccgtggaaacaatgtgtatggccctaaccagtttcctgagaaattgatcccaaagttcattcttttggccatgagagggaagcctcttccaattcacggagatgggtctaatgtgagaagttatctctactgtgaggatgttgctgaggcctttgaggtcattctccacaggggagaggttggccacgtgtacaacattggaaccaaaaaggagaggagagtcattgatgtggccacggatgtatgcaaactgttctcaatggatccagatgcaagcatcaagtttgttgagaacaggccgtttaatgatcagaggtacttccttgatgatgagaaattgaagattttagggtggtcagagcgcaccacttgggaagagggcctgaggaagacaatggagtggtataccagtaaccccgattggtggggtgatgtctcaggagcattgcttcctcacccaaggatgctgatgatgcctggtgggatcgagagacattttgaagaagcagacaatgagaatgctgcttcttctgaattttccaacacccagtctaaaatggtggtacctcctaccaaaagtgtcagttctcctcgtaagccatctttcaagttcctgatctatggtagaactgggtggattggtggtctccttggccagttgtgtgaaaagcaaggtattacatttgagtatggaaagggccgtttggagaaccgagcatctcttattgctgatatccagaatgtcaagcctactcacgtctttaatgctgctggtgtgactggtaggccgaatgttgactggtgtgaatctcacaaagcagagacaattcgcgccaatgttgctggtactttgactttggctgatgtctgcagagagcatgggcttttgatgatgaattttgctactggttgcatctttgagtatgatgctgcacatcctttgggctctgggattggcttcaaggaagaggatacaccaaacttcactggttctttctactcaaagaccaaggctatggtggaggagcttttgaaagagtttgataatgtgtgcacccttagggtccgaatgcccatttcttctgacctcaacaacccacgaaacttcatcacaaagatctctcgctacagtaaggtggtcgacattcccaacagcatgactgttttggacgagcttctacccatttccattgagatggcaaagaggaatctcaagggcatctacaacttcacaaacccaggggtggttagccacaatgagattctcgagatgtacaagaattacatggacccagaattcaagtgggcaaacttcacacttgaagagcaagccaaggttattgttgctccaagaagcaataatgagatggacgcctccaaattgaaaaaggaattccctgaattgctgcatattaaggactcgctaatcaagtatgttttcgagccaaacaagaagacaaactattctgcttgagcgaacttttctgcagaattaagagatgccgtagtaaacaggattgcaatttttttccagtaggcattgtggttgcatagcgttattccattgggtcttgggcaaaacattcatttattttagcttcatattgtgctgtttttatatacctagattgcctgttcgtagagtttttattaggtgtttacattttcatcttttacctttttacgtcttctgtttaaacgtgattacac

SEQ ID NO: 10749 - DNA, 2518 bp, Gossypium hirsutum
aatacacatataaatgaagtctcctcaatttccctctccgtcaaaagattcatctcccctactctaaatttctctcttttccttcttctatcaatactttctatctctgtaatttttttttcgatttctgtctctggattttgattgatttctctccaacttaattgaatatggcttcttataaacccaagaatatcctgataactggggctgctgggtttattgcatctcatgttgccaatcggcttgttcggaactaccccgagtacaagattgttgtacttgataagcttgattactgctcaaacactaaaaacctccttccttccaagttatccccaaactttaagtttgtgaagggggacattgaaagtgctgatcttgttaactatcttcttatcacggagtctattgacacaataatgcactttgcagcacaaactcatgttgataattcatttgggaacagtttcgagtttacaaagaacaatatttatggcactcatgtcctacttgaagcttgcaaagtcacaggtcagattaggaggttcatccatgttagcaccgatgaggtttacggggagacggacgaggatgcagttgtaggaaaccatgaagcttcccaacttctcccaacgaacccgtattctgcaacaaaagcaggtgctgaaatgcttgttatggcatatgggaggtcatatggattacctgtaattacgacccgtggaaacaatgtttatggtcccaatcagtttccggaaaattaattcccaagtttatcttattggcaatgagggggaagactcttccgattcatggggatggttctaatgtgaggagttatttatactgtgaggatgttgctgaagcatttgaagtcattcttcacaagggtgaagttggtcgtgtttataatattggcacgaagaaagaaaggagagtgattgatgtagctagagatatatgcaaacttttctcgatggatcctgagacaagcattgagtttgtcgaaaacagaccgttcaatgaccagaggtattttcttgatgatcagagattgaagaacttgggatggtccgagcgaactgtatgggaagacgggttgaagaagaccataaaatggtacactcaaaaccctgattggtggggtgatgtgactggtgcgttgcttccgcacccaagaatgttgatgatgcctggaagtacacacttcgattccgaggacggcaaagagacatcatatgtaagtggtcctaatcaggcccgaatggtggttccaacccccaagggcggtagctctccccaaaaacaatccttgaagttcttgatctatggcaggactggctggataggtggtttacttggtcagttatgcgagaaacaaggtattgccttcgaatatggaaaaggacgcttggaagatcgttcatcactcaatgcagatattcaaaatataacgccgacccatgtgtttaatgctgctggtgttaccggcagacctaatgttgattggtgtgaatctcacaaaacagaaacaattcgtgccaatgtggctggtactttaaccttggcagatgtttgcagagaccatgggctgttgatgatgaatttcgctaccgggtgtatatttgagtatgatactgcacatcctcagggctctggcattggatttaaagaggaagataaacccaatttcatcggttccttctattcaaaaaccaaggccgtggttgaagagctgttgaaagagtatgacaacgtctgcacccttagagttcgaatgccaatctcatctgacctaaacaatccacgcaacttcatcaccaagatttcacgctacaacaaggtggtcaacattcccaacagcatgacagtcttggacgaacttctaccgatatcgatcgagatggcaaagaagaacttgaggggtatatggaacttcacaaaccctggggttgtgagccacaatgagatcctcgagatgtacaagacttacattgaccccaagtttaagtgggaaaacttcacattagaagaacaagccaaggtgatcgttgcaccccgaagcaataacgagatggatgcatccaagttgaagaaggagttccctgagttgttatccatcaaagaatcactgattaagtatgcctttgaaccgaacaggagaacctgagcttattaagcaggtttcagcttatagattctatactttctgcacctaatattatatgatcaggaatatcttttaagctccactcttttgctaccgttatcttccaccaaattagtttacttgagctacaaggtattaacctatgttgcttagattcttccattttttggagtatacatgtccaatccatattttgaagtataaatatctatacccaatgctcagatttgagttctgtaggtatcaggtcaggtgtactattttttgtattttgttagttgaaatttttttggcttttaacactcttgaactggtttctaatggaagaatttgctttattgcata

SEQ ID NO: 10750 - DNA, 2288 bp, Panax ginseng
gttcatcattctttctttgtccaagtcttttctatatctccttcctttcaaagggttctcccttttcaatctcctaaccgtgattgacctggatcaaatttaaactgctttggtatggctacttatactcccaaaaatatcctcataactggggctgctggcttcatagcatctcatgttgctaaccgtctcattcggagctaccccaattacaagattgttgtgcttgataagcttgattactgttcaaatcttaagaacctcaatccctctcgatcatctgccaacttcaagtttgtcaagggggatattggcagtgccgatcttgtcaactaccttctcatcaccgagtcgattgatacaataatgcacttcgctgctcagacacatgtcgataactcctttggcaacagttttgagtttaccaagaacaacatttatggtacccatgtgcttttagaggcctgcaaagtgactggccagatcagaaggttcatacatgtaagcactgatgaggtctatggggagacagaagaggatgctgttgtgggaaatcatgaagcttcacaactcctccctacaaatccatattcagccacaaaagctggggctgaaatgcttgttatggcttatggtaggtcatatggattacctgtgataacaactcgagggaataatgtatatggccccaatcagtttcctgaaaaactaattccaaagttcatccttttagccatgagaggaaagcaactccctatccacggggatggtgctaatgtgcgtagttatctctactgtgaggacgttgctgaggcttttgaggtcattcttcacaggggagaagttggtcatgtttacaatatagggacaaagaaggagaggagagtgattgatgttgccaaagacatatgtaaacttttctctattgatcctgaagcaaacattaattttgtcgataacaggccatttaacgatcagaggtacttcctagatgatcagaagctgaaagacttgggctggtctgaacgcactatgtgggtagaggggcttaaaaagactatggattggtatattagcaaccctgattggtggggggatgtctctggagcattgcttcctcatcctagaatgctgatgatgcctggtggaattgagagacacttcgacgggtcagataattgtgactctgaatcttcgcattttgcagataaatcttccaagtcccaaatggtggttccgagtcccaaaagcagcaactctcagaaacgatccattaagtttttgatttatggtaggtctgggtggattggtggtctacttggaaaattaagtgaaaaacaagaaattccatatgaatatggaaggggacgtctagaggatcgctcacagcttttggtcgatattcagactgttaagcccacacatgtttttaatgctgctggtgtgactggtagacccaatgttgattggtgtgaatctcacaagacagaaacaattcgtaccaatgttgctggtacactaaatttagcagatgtgtgcagagagaatggactcctgatgatgaattttgctactggatgtatatttgagtatgatgctgcacatcctgaaggttctggcattgggttcaaagaagaagacaagcccaattttcacggttctttctattcaaagaccaaggccatggttgaggaactcttgagagaatatgacaatgtctgcacactaagagttcggatgcctatatcttcagacctcagcaatccacgaaatttcatcactaaaattagtcgttataataaggtggtcaatatacccaacagtatgaccatcttggatgagcttctacctatttcaattgagatggcaaagcggaaccttaggggcatatggaactttacgaatcctggagttgttagccataatgagattttggagatgtacaagcaatatattgatccagctttccagtgggctaactttacactggaagagcaagcaaaggttatagtagcagctcgaagcaatatgagatgatgcatccaagttgaagacggagttcccgagttgctatcgaatcaaagagtcattgatcaagtatgtctttgaaccaacaaaaatgctaagcagagtagagtggtaaatttcaggtcttgcctctgcattagtcagttaggttgtatggtcttgattacgttgtaatgttagtcatgtcattattattacttagtttctattccgttgtttcgttatcgtattacctagatctctgtatgtgtgtctgcccc

SEQ ID NO: 10751 - DNA, 2743 bp, Gossypium hirsutum
agccttttctcttctcctctgaaatctcgctctaagatttcgtcgtttatctttctccatctggattttgattgagctctctcttctttcgtcttaattggtttcactatgtcttcttatacccctaagaacatcctcataactggggcagctggttttattgcgtcacatgtcgctaaccggctcataaggaactacccagactacaagattgttgtgcttgacaagcttgattactgctcgaacctgaaaaacctccttccttccaagtcatctccgaactttaagtttgtgaaaggtgacattggtagtgctgaccttgttaactacctccttattaccgagtctatcgacacaataatgcactttgcagcccagactcatgttgataactcgtttggaaacagctttgagtttaccaagaacaatatctatggcactcatgtcttgcttgaagcttgcaaagtcactggtcaaatcaggaggttcatccatgtcagcactgatgaggtttatggtgagacggatgaggatgctgttgtaggaaaccatgaggcttcccaacttctcccaacaaacccgtactctgctacaaaagctggtgctgaaatgcttgttatggcgtatggtaggtcatatgggctgcctgtgataacaacccgtggaaacaacgtttatggtcccaaccagttccctgaaaagttgattccaaagttcattctcctagcaatgaggggaaagactttaccaattcacggtgatggttctaatgtgaggagttatttatactgtgaggatgtggccgaggcatttgaagtcattcttcacaagggtgaagttggccatgtttataatattggaacaaagaaggagaggagagtgattgatgtggccaaagatatctgtaagcttttctcgatggatccagagaccagcatcaagtttgttgaaaacagaccattcaatgaccagaggtattttcttgatgatgagaagctgaagaacttgggatggtccgagcaaactgtatgggaagaggggctgaagaagaccattgaatggtacactcagaatcccgaatggtggggcgatgtgtctggtgcattgcttcctcaccctagaatgctgatgatgcctggtgggagacacttcgattctgaagagggaaaaggtacatcatctgcaagtggacctaatcagacccgaatggtggttccaaccttcaaaactagtagcagcacgcaaaaaccagccttgaagttcttgatctatggtaggactggctggattggaggtctgcttggtcagttatgtgagaacaaggtatccctttgaatatggaagaggacgcttggaagatcgttcatcccttatggcagatattcagaatataaagccaacccatgtttttaatgctgctggtgtgactggtaggcccaatgttgattggtgtgaatctcacaaaacagaaacaattcacaccaatgtggctggaaccttgaccttagcagatgtttgcagagaacatgggcttttgatgatgaattttgctacagggtgtatattcgagtacgatgcaggacatcctgagggctccggcattgggtataaagaggaaaacaaacccaatttcactggttccttctattcaaaaaccaaggctatggttgaagagctgttgaaagaatatgaaaacgtctgcactctcagagttcgaatgccgatctcatctgacctaaacaaccctcgtaactttattgccaagattgcacgctacaacaaggtggtcaacattcccaacagcatgacaatcttggatgaacttctgcctatttctatcgagatggctaaaaggaacttgaagggtatctggaactttacaaaccctggggttgtaagccacaatgagatcctggagatgtataagacttacattgacccaaagtttcagtgggtgaacttcacattggaagaacaagccaaggttatagttgcccctcgaagcaataatgagatggacgcatccaagttgaagaacgagttccccgatctgctaccaatcaaggaatcactgattaagtatgtctttgaacccagcaagagaacctgagccttttgagcagcagtttacaggaatagaattcggtattatcctatgttttttcttcattgagttattgcctggaatatctttgcagtttaattcatttgttataatcttgtcttccacctcattaattttcactagataactcttaaggtattactattagatttaaaccattcattgttactagctgcaccaagctgtatcctagtttgtccgtccattcttgaagaaactatctataggtgctttacaaattgtcatttgcaggctgacaggtgtattatttggcattacattagttgaatgttatgactttcaacagtcacctactggtctataatggaggaaattgcatctatctcttattactcagatgagtgaattatttatgtatttgagtctctcaattgtctcttgtgcaactacattatattacttaccagtcctttgactgaaataagagtatatatttacttttcacttttttgccccttttcttattaacttttccaaagttgcaattgcaatcatattattgatgtttatgcaattccataagaacatgtgttctttacaattaaacacgtttgtacttgttacctttgttaagaacgaatggagattttttttttg

SEQ ID NO: 10752 - DNA, 2077 bp, Tabernaemontana elegans
ttgctcctgcaaatcagattttgctctgaagtttttgctctgaagtgggatttctatactgatagagatggcaacatacactccgaagaatattcttatcactggtgctgccggatttattgcatgccatgttgctaatcggctcatccgcaactatcctgactacaaaatagttgttcttgataaacttgattattgctcaaatttgaagaatcttaacccttctcagttatctcccaacttcaagttcatcaagggagacattggcagtgcagacctagttaatttcatccttgtcactgaatcaattgacacgatcatgcactttgcagctcagactcatgtagacaattcatttgggaacagctttgagttcactaagaacaatatttatggcactcatgttcttctcgaggcctgcaaagtcactggtcaaattaagcgattatccatgtcagcacagatgaggtttatggagaaacagatggggatgctgttgttgggaatcatgaggcttctcaacttctcccaactaatccatattctgcaacaaaagctggtgctgaaatgcttgttatggcatatggacggtcctatggtttacctgtgataaccacgagaggaaacaatgtgtacggtccaaaccagtttcctgagaagttaattccaaaatttatcctcttggccatgaaaggacaacctcttccgattcatggtgatggatccaatgtccgtagttatctgtattctgaggatgttgcagaggcattcgaaatcattctccacaaaggagaagtaggccatgtctataacatagggactgataaggaaagaagagtccttgatgtggccaaggatatctgcaagcttttctctttggacccaaataatgtgatcaaattcgtggaaaaccgtccatttaatgaccaaaggtattttctagatcatcaaaagctgaaaaatttgggatggtcagagcgcacttcatgggaagaaggcctaagaagaacaacggactggtatgtcaaaaatcctgattggtggggagatgtatctggtgctctggtacctcatccaaggatgctaatgatgcctggtatggggagaagtaacactgatgttggctctacagctgcatcttatgtactaaatgagtctgctgctgagaagggaatggtggtgccagtactaaagagtactaatgagaagccttccttgaagttcttgatttatggcaggactgggtggattggaggtcttcttgggaagttatgtgagaaacaaggtatagccttcgagtatggtaaagggcgccttcaggaaagatcacggctactatctgatattgagagcgtgaagccaacccatgttctgaatgctgctggtgttactggtagacctaatgtggattggtgcgagtcacataaacctgagacaattcaaactaatgttgttggtactctaaccttggcagatgtttgtagggagcatgggctagttatggttaactttgccacaggctgcatatttgagtatgattctgaacatccccttggctcaggcattggatttaaggaggaagataagcccaattttactggatctttctatcaaaaccaaggcaatggttgaagaacttctaaaagaatatgagaacgtgtgcaccttgagagtccgaatgccaatatcatctgatcttcaaaaccctcgtaacttcatcacaaaaattgcacggtatgacaaagttgtgaacattccaaatagcatgaccgtgttggatgagctcctacccatctcaattgagatggctaagaggaacttgaaaggaatatggaacttcacaaacccaggggttataagccacaacgagatactggagatgtacagggagtacattgaccccaagtttaagtggaccaacttcaacctggaagaacaggccaaggttattgttgcgcctaggagcaataatgaaatggatgcatccaagttaaagaattgagtttccagaattattatctatcaaagaatcactgaaaaaaatatgtctttgaacccaacaaggtcactgcttgaa

SEQ ID NO: 10753 - DNA, 2238 bp, Phalaenopsis aphrodite
tttcaccaaccagaaagcaatggaatcctataagcctaaaagcatcctcatcaccggggctgctggtttcattgcatcgcatgttgccaataggctcatccgcaactaccccaattacaaaattgtggtccttgacaaactcgactactgctccaaccttaaaaacctttccccttctggatcctccaccaacttgaagttcgttaagggtgacatcgccagtgctgatcttctccactaccttctcatcacagagtccatcgacacgataatgcactttgcggctcagactcacgtcgacaattctttcggcaactcctttgagttcactaaaaacaacatctatggaactcatgttttgcttgaggcctgcaaggtctccggtcaaataaggagattcatccatgtcagcacagacgaagtttatggggagaccgatgagaatgccattgttggcaaccacgaagcctctcagctcctccctacgaacccatattctgccaccaaagccggagctgaaatgcttgtgatggcttatggaaggtcctatggcttacccgtcataaccacccgtggtaataatgtctacggacccaatcaatttcccgaaaagctgattccaaagttcatccttctagcaatgagaggacaaacccttccgattcatggagatggttctaacgttcgaagctacctctattgtgaggatgttgccgaggcttttgaggttattcttcatagaggggagatcggccatgtttataatattgggacaaaaaagagaggagggtgattgatgtagcaaaagatatctgcaagcttttcgcgcgggatcccaccaccgcaattaagtacgtcgacaacaggccgttcaacgatcaaagatactttctggatgatcagaagctaaaaattttgggttggtcagaaagaactacttggcaagagggattgaaaaagactatggattggtacacaaacaatccagattggtggggagatgtctctggagcacttttaccacatccaagaatgctaatgatgccgggcactgaaaggcattacgatggccctgaagtgataattaagagcatgttgtcttcgccaaacaatattaacattccaagccaaatgataacaccacccgtttcagaaacctcatcttttggtaccaaaatgcagtctttgaagtttttgatatacggcaaaaccggatggatcggcggccttctcgggaagatatgcgagaagcaagggataccgttcgagtacggaaaaggcagattagaatgtcgatcccagctccaatcggatattcataatgttaagccgacacatgttttcaatgccgctggtgtcaccggcaggccgaatgtcgactggtgcgaatctcatcgacaagaaactatccgcaccaatgttattggaaccttgactctggctgatgtttgctccgagaatggtttgttgctcatgaattatgcgactgggtgtatctttgaatatgatgctaatcaccccgaaggctcaggctatggattcaaggaggaagatagcccaaacttcattggttcctactactcgaaaacaaaggccatggttgaggagcttctgaaggagtacgacaacgtctgtattttaagagtccgaatgccgatatcatctgatctaaacaatcctcgtaacttcatcacgaagatcagtcggtacaacaaggtggttaatatcccaaacagcatgactgtattggatgagttgcttccaatatcgatcgagatggctaagagaaactgcaggggaatatggaacttcacaacccaggtgttgtgagccacaatgagatcctggagttgtacaaggcttatattgatccaggcttcagtgggtaaactttacactcgaagaacaggcgaaggtgatcgtcgcgcctcgcagcaataacgaattggatgcttcgaaattgaagagcgagttccggagctgctgcctattacagaatctctcataaatatgtgtttgagcccaacaggaagcagggaaaatgatgcattgtgttgagtgctatggagggggtaatctttttcttttgaaatgaaaggaaatatttattcttagaatgaatttggtagttagcctatgttttgatcagcatgacctcaaagatgatgactttattaactagagtatttgtttatgttttaagaaatatttggttggaatttattatgcatgttcaaa

SEQ ID NO: 10754 - DNA, 2056 bp, Flaveria ramosissima
aaactatcctgattacaagatagtcgtgcttgacaagcttgattattgttccagtcttaagaacctcaacccctcgagatcgtctcccaacttcaagtttgttaagggggacattgggagcgctgacctcgtcaactacctcctgattactgaatctattgataccatcatgcactttgctgcacagacccatgttgataactcattcggaaacagttttgagttcacgaagaataacatctatggaactcatgtgcttcttgaagcctgcaaagtcactggccagattaggagatttattcatgtgagcacagatgaggtctatggagaaacggaggaggatgctgttgttggtaaccatgaagcttcacaacttcttcctacaaacccgtattcagccacaaaagcgggtgcagaaatgcttgttatggcttatggtaggtcatacgggttgcctgtgattactaccagaggaaacaatgtttatggcccgaatcaattcccagaaaaactaatccctaagttcattcttctggctatgagaggaaaaccacttccgattcatggtgatggttctaatgtaaggagttacctctactgtgaagatgttgctgaggcttttgaagtaattcttcacaagggggaagttggtcatgtttacaacatagggaccaagaaggaaaggagagtgattgatgtcgcaaaagatatgtgcaagcttttcaatatggatcctgattcaagcatcaagtttgtggagaacagaccatttaatgatcagaggtatttcttagatgatgagaaattgaagagcttgggttggtctgaaagaactacatgggaagagggtttgaaaagacgatcgagtggtataccagcaacccgaattggtggggagatgtctctggagcacttctgcctcatccaagaatgttaatgatgccgggtggcgttgatagacatgttgatggacctgaaaatgctgaactggattcagctggtgtggcaatcaatacctctcagattggtgtccagattcctagctcaaaaaccagtggcgtttctgctaagaaaccagctttgaagtttctcatttatgggaaaacagggtggatcggtggtttacttggaaagttatgtgacaaacaacaaattccatatgaatatggacgaggtcgtttggaagaccgttcacaacttttggctgatattcaaactatcaaacctactcatgttttcaatgctgctggtgtcactggaagaccgaatgtagattggtgtgaatctcacaagacagaaaccattcgtaccaatgtctcgggcacactcaatctagcagatgtctgtagagaacatggactcttgatgatcaattttgctactggatgcatctttgagtatgatgctaatcaccctgaagggtctggaatcggttttaaggaggaagacaagcccaatttcattggatccttctattcaaaaaccaaagctatggtggaggagcttttgaaagaatatgacaatgtgtgcacccttagagtccgaatgccgatatcatcagatctcaacaacccacgcaatttcatcaccaagatcgctcgttatgataaagttgtaaacatacccaacagcatgacaatcttggatgagcttttgccaatttcaatcgagatggcaaagcgtaatctaaggggaatctggaactttacgaatcctggggtcgtaagccacaatgagattcttgaaatgtacaagaagtacataaacccagagttcaagtgggtaaatttcacactggaagaacaagcgaaagtgatagtggccccacgaagcaataatgagttggatgcatcaaagttgaaaaaagagtttcccgagttgctatcaatcaaggagtcgttgatcaagtacgtattcgaacccaacaaaaaacagtaatgataatgatatgatgattctttatagaatttgtagaactcaagattcacttgtgtttggttactagttccttcttgtatggtttggattatacatctgtaatgtttaaagtcaactg

SEQ ID NO: 10755 - DNA, 2119 bp, Panax ginseng
tacaagattgttgtgcttgataagcttgattactgttcaaatcttaagaacctcaatccctctcgatcatctccaactttaagtttgtcaagggggatattggcagtgccgatcttgtcaactaccttctcatcactgagtcgattgacacaataatgcactttgctgcccagacccatgttgacaattcctttggcaacagttttgagttcaccaagaacaacatttatggcacccatgtgcttttagaggcctgcaaagtgaccggccagatcagaaggttcatccatgtaagtactgatgaggtctagtggggagacagaagaggatgctgttgtgggaaatcacggagcttcgcaactcctccctacaaatccatattcagccacaaaagctggggctgaaatgcttgttatggcttatggtaggtcatatggtttgcctgtgataactactcgaggaaataatgtatatggccccaatcagtttcctgaaaagttaattccaaagttcatccttttagccatgagagggaagcaacttcctatccatggggatggtgccaatgtgcggagttatctctattgtgaggatgttgctgaagcttttgaggtcattcttcacaagggagaagttggtcatgtttacaatattgggacaaagaaggagaggagagtgattgatgttgccaaagatatctgtaaacttatgtcaatggatcctgaaacaaacattaattttgtggagaacaggccatttaatgatcagaggtacttcttagatgatcagaagttgaaaaacttgggctggtctgagcggactacgtgggaagagggattgaagaagactatggattggtacactagcaaccctgattggtggggagatgtctctggagcattgcttcctcatcctagaatgctgatgatgcctggtggaattgagagacactttgatgggtctgctaattgtgactctgaatcttctcataaagcagataaatctactcagtcccaagtggtggtttcgaactccaaaagcagcagctctcctcagaaaccatccttcaagtttttgatttatggtaggactgggtggattggtggtctacttggaaaactaagtgaaaagcaaggaattccatacaagtatggaaagggacgtctagaagatcgctcacaacttttggccgatattcagactgttaagcccacacatgtttttaatgctgctggtgtgactggcagacccaatgttgattggtgtgaatctcataagacagaaacaattcgtaccaatgttgctggtacgctaaatttagctgatgtttgcagagaccagggactcctgatgataaatttcgctactggatgcatatttgagtatgatgctgcacatccagaaggttccggaattgggttcaaagaagaagacacacccaattttcacggttctttctattcgaagaccaaggccatggttgaagaactactgaaagaatatgacaatgtttgcacactcagagttcggatgcctatatcttccgacctcagcaacccacgcaacttcatcactaaaatcagccgttataataaggtggttaatatccccaacagtatgaccatcttggatgagcttctacctatttcaattgagatggcaaagcggaacttgagaggcatatggaactttacaaccctggagttgttagccataacgagattctggagatgtacaagaagtatattgatccagccttccaatgggctaacttcactctggaagagcaagccaaggtgatcgtagcggctcgaagcaataatgagatggacgcgtccaagttgaagaaagaattccccgagttgctatcaatcaaagagtcgttgatcaagaacgtctttgaaccaacaaaaaagcttagtaggcattctagagtagtaaatttgagccttcctctgcattatcagttaggctatatgatctttaattacctttgtaatgctagtcatgtcattagtcattcttagcttcagttcattattcttgtcattatatatctatcttgaatgtttattagagtggttctgctctgctagaggcttttccatatatttttcgc

SEQ ID NO: 10756 - DNA, 2244 bp, Brassica rapa
atattattatagctctcgcatcacaatgactacatataagcccaagaacatcctcataaccggagccgccggtttcatcgcctcccacgtggccaacaggctagtccgcacctaccccgactacaaaatcgtggtcctcgacaagctcgactactgttccaacctcaaaaaccttaacccttccaaatcctcccccaacttcaagttcgtcaagggcgacatcgccagcgacgacctcgtcagctaccttctcatcacctagaacatcgacaccatcttgcgcttcgccgctcagacccgcgtcgacaactccttcggcaacagcttcgagttcaccaagaacaacatctacggcacgcacgtgcttttagaagcttgcaaagtcactggacaacagatcaggaggtttatccacgtgagtacagatgaggtctacggagagactgatgaggatgcttctgttgggaaccatgaagcttctcagctgcttccgactaatccttactccgctaccaaggctggtgctgagatgcttgtcatggcgtatgggagatcttatggtttaccggttataactacgcgtgggaataatgtttatggtccgaatcagtttcctgagaagttgattccaaagttcatgttgttggctatgaatgggaagccgcttcctatccatggggatggatctaatgtcaggagttatttgtattgtgaagatgttgctgaggcgtttgaggttgttctacacaaaggtgaagttaaccatgtttataatattgggacgacgagagagaggagagtgattgatgtggcgaatgacatctccaagctctttggaactgaccctgactctacaattcagtttgtggagaaccggccgtttaatgaccagaggtacttcctcgacgaccagaagctgaagaaactgggatggtcggaacgaaccacttgggaagaagggctgaggaagacgatggagtggtacactgagaaccctgattggtggggagatgttactggagcgctcctgcctcatccaaggatgctgatgatgcctggtgatagactctgtgatagctgtgacgacgagcacaaggatgttgcagatggtaatcagacgttcactgtggttactccttctggagacaacaaaacaccctttaagtttcttatatacggcaggaccgggtggctcggtggtcttctagggaagctatgtgagaagcaagggattgcatacgagtatgggaaagggagactagaggatagagcttctgtaatggcggatgttcgcagtgtcaaacctactcatgtattcaatgccgctggtgtaacggggagacccaatgttgactggtgtgagtcacacaaaactgagacgatccgagccaatgtcgctggcactttgactctagcagatgtttgcagagagaacggtttattgatgatgaacttcgctactggttgtatatttgagtacgacgctgcgcatccagaaggctcagggattggtttcaaggaagaagacaaaccaaacttcaccggctccttctactcaaagacaaaggcgatggtggaagagcttctaagagaatacgacaacgtatgcacgttgagagtacgcatgccaatctcatcagacttgaacaacccaaggaacttcatcactaagatctcgcgttacaacaaagtggtgaacatcccgaacagcatgaccatactagacgagctcttaccgatctcgatcgagatggcgaagaggaacctgaggggggtttggaacttcaccaatccgggagtggtgagccacaacgagatactggagatgtacaagagctacatcgagccgggtttcaagtggtccaacttcactttggaggaacaggctaaggtcattgtggcggcaaggagcaacaacgagatggatggtgccaagcttagtaaggagtttccggagatgctttccatcaaagagtcgttgatcaaatacgtctttgaacccaataagagaacgtaaaaacgctccttaaccacacatacacttcctctttttttttctcttctttgttatattatactgcaggtagcttcactataatgtgattctactgtttttttatttgttttcatcatgtgattcatttactctcatttttggcactgtactacgaaacatatcttttcttttttaaatcatatctttgttacattaacattattacagaaatgaatttatttcagttt

SEQ ID NO: 10757 - DNA, 3384 bp, Brassica rapa
aacagatccttgcgtcttctctcgaattcgtatctacttcttctccgattctttagtttcgagatcctttgattgattgttctttttgtggtcttctacagattccgttcctccatcgttgttcttcctcgctctccctctctctctcggaatcgcagtgtgttttgtagatctcttcagaactttctaggtttaccgtcctgaaaaatcgctttatctcgtcgtgatcgatcagtaacgattatcacagcaatcgtgcgtagcagcttgagatatacttatattagaggttgacatgaggtgcaacgcctgctggagggaactgcaaggccgtgccatttccaccacatgtggtcacttattatgtactgaagatgctagcaagattctcagtaatgatggggcctgtcccatttgtgatcaagtactctccaagagatggtgatggctggaatttctccacaaatactgatgaagagtgcataccgaagtgtaatgtagtgtaatgttttacatctcgcaaagagacttagagatgcagtacaagatgaatagagttgttgcgcagtgtcgtcagaaatgtgagggcatgcaagcaaattttaacgagaaaatggagcaggtacatacagcatatcagaagatgggaaagaggtgtcagatgatggagcaagaggtagaaaacttgaccaaggataaacaagaggttgtagctgaaggatcaaattcaagtgttttgaacctgagtggatataagcactaatggtcacaaccagtaagtgactctttgttttttataagcttactgtcttagtaagtaaaatcttaggagaaagctagtatttgagaaattgaagaactctcgtctctataaatagtaatgataaatcatatattttagtagaatcaatatagtgaaactacttacaaggatgtaagatgcgagcaaatataaaaagacatttttgtaaaaagaaagccaaaaaaaaacagttataggtaagcacttgtggcaaatagtgtattgttcactgagggctcaggttctcttgtttggtccaaaaacgtatttgatcagtgcctctttaataggtagcatctctgggaactccttgcttagtttagcaccatccatttcattgttgcttcgaggtgcaacaatgaccttagcttgttcttcaactgtgaagttggaccatttaaatccaggctcgatgtaactcttgtacatctccagtatctcgttgtggctcaccacccctgggttggtgaagttccatatccctctcaggtttctctttgccatctcgatggagattggaagtagctcatctagtatggtcatgctgttcgggatgttcaccactttgttgtagcgtgatatcttggtgatgaagtttcgtgggttgtttaggtctgatgagattggcatccggactctcaaagtacatacattgtcaaactctctcaaaagctcctcgacctgaacattaccatggctttggttttggagtagaaagaaccagtgaagttgggcttgtcttcctccttgaagccaagaccagaaccctcaggatgtgcagcatcgtactcaaagatgcaaccggtggcgaaattcatcatcaagagaccactctctctacaaacatctgcaagagtcaacgtaccagcgacattgacacgaatggtctcggctttgtgagattcacaccagtcaacgttaggtctcccggtcaaaccagcagcgttaaacacatgagtcggcttgatgctacgaatatcagcaataagagaagctctgtcctccaaacgtcctttcccatactcatatgtaatcccttgcttctcacatagtttccctagaagaccaccgatccacccagtcttaccatagatcaaaaactttaacgaggctttgtcattagaaccagcagtcttgttgttaggtgttacgaccgtgaatgtctgaacggtgttgctcgacgcgtctttcttctcatccgaaacatccgagagtcttccaccaggcatcataagcatcctcggatgaggaagcaaagctccagagacatcaccccaccactcagggttctgagtgtaccattccattgtcttcttcaacccatcttcccacccggttctctccgaccaacccagattcttcagcttctgatcatcaaggaagtacctctgatcattaaaaggtcgattctccacaaactgaatgcttgattcaggatctttccctagaagtttgcagatgtctctcgccacatcaatcactcttctttctcgctttgttccgatgttgtacacgtgaccaacttctcctttgtgaagaacaacctcaaaggcttcagctacgtcttcacagtacaagtaactcctgacgttagatccatctccatggatcggaagcggcttaccactcatagctaacaacatgaacttaggaatcattttctccggaaactggttaggcccataaacattgttcccacgggtagtgataacaggcaatccatatgatcgaccataagccatcacaagcatctcagcaccagccttagtagctgagtatggattcgtcggtaaaagctgagaagcttcatggtttccaacagcagcgtcctcatctgtttctccatagacttcatcggtactcacatggataaacctcctgatctgtcttgttactttacaggcttcaagaagaacatgagtaccgtatatattgttcttggtaaactcaaagctgttaccgaaggagttgtcaacatgggtttgagcagcaaagtgcatgatggtatcgatgttttcagtgatgagaaggtagctaacgaggtcatcactagcgatatctcctttgacaaacttgaagtttggagaagaatgcgaagggttgagattcttgagatctgaacagtaatcaagcttgtccaagacaacgatcttgtaatctggatagctacggattagtctgttggcaacatgagaagcaataaatccagcagctccagttatgagaatgttcttgggcttatatgtagtagccattttaaaatgaaatacctgtaacaacaacaaaaacaacaagaaagaaaaagagagaaacatttcacgtaccgacacaagtcagataaccttaggacgaaagatcctaagagatagagagagagatcaaaaagaaagaacagtatggaggaagaagaggaagaagagaaagaaggaaaatctacggtccacggagcgtctctggacactgcgcctcttatattctcagacagttacggagaaccgtaggagcgaattgacggttttaccctaagttgtcttactttttacagttttcacttgagtttagcgtccgacataaagaaactc

SEQ ID NO: 10758 - DNA, 2745 bp, Picea glauca
gtcaacaagaaaacaccccttacttcattcgagtgttagctgcattttccccagcaagatcctaggctaaacatcatttgggtattctttcacctggatcttgcgcatttgggtttgttttgggggagatctggttgtgtccttgacccaataaattgaataaaaatggctcctgagagctatacccccaagaatattctcatcaccggtgcggctggattcattgcttctcatgtagcgaataggctggtcagaaaatatccccaatataagattgttgtgcttgataagctggattattgctccaatttgaagaatctgttgccatcgaagtcatccccgaacttcaaatttgtgaggggagatattgcgagtgcagatctggtgaattatcttctaattacagagggaatagacacgatcatgcattttgcagcacagacccacgttgacaattcgtttgggaacagcttcgagttcacgaagaataatatctatggaactcatgtcctgttggaggcttgtaaagttacggggcagattaggcggttcattcatgtgagtacggatgaagtttatggagagactgaacaggatgcccttgtgggtaaccatgaggcctcccagctccttcctacgaatccttactctgcaactaaggctggagcagaaatgcttgtcatggcctatggaagatcttatggcttgccggtgattactactagaggtaacaatgtctatgggcccaatcagttccctgagaagcttattccaaaattcattcttttggccatgcaggggaagccccttcccattcatggagatggatcgaatgttcgaagctatctctactgtgaggatgtggcagaagcctttgaggttgttttgcacagtggcgaagtaggaaatgtttataacatcggaacaaagaaagagaggagagttattgatgtggctaaggatatatgccaacttttttctctcaatcatgaaaaggttattaaatttgttgacaacaggcctttcaatgatcagaggtacttcctggatgatcagaaactaaaggacttgggttggtctgagcgcacgacttggcaagatggactgaaaaagacaatggactggtacacaggtcatccagattggtggggtgatgttacaggtgctctgctacctcatcctcgaatgctcacgatggctggagttgggagactctctgatggcctagagatgatggctggagtcgagagacactctgatggcctagatgagaatgtctcagctctctctcctgaagttaataattcgaaacaggaccgcatgctcattccctcgaaaagtttctctcagaaaccggccttgaaatttttgatttatggtcgcactggatggattgggggccttcttggtcagatatgtgagaagcagggtatttcatttgagtatgcgaatggcagattggagaatcgggctcagattcagatggatatccagaatgtgaagcccacccatgtttttaatgctgcaggtgtgactggcaggcctaacgttgactggtgtgaatctcacaagccagagactatccgtaccaatgtagtaggaactttgaatctggcagatgtctgcagggagcaagggcttttactcatgaactttgctactgggtgtatatttgaatataatgatgctcacccagagggcagtggtattggattcaaggaggaagacagtccaaactttactggatctttctattctaaggcaaaggccatggttgaagagctgctgaaggaatttgagaatgtttgcacccttcgagttcgaatgcctatctcatctgatctgagcaaccctcgcaattttattacaaaaatcacccgttacaataaagtggttaatataccaaacagcatgactgtccttgatgagttgttgccaatttcaattgagatggcaaaaagaaattgcagaggcatatggaacttcacaaatccaggtgctgtcagccacaatgagattttggagatgtacagggactacatcgatccagacttcaagtgggtaaattttaaccttgaagaacaggctaaagtgatagttgcccctcggagcaacaatgaactggataccttcaaattgaagggagagttcccagagctgttgtcaatcaaggactcacttttgaagtatgtatttgagcctaacaagaagaacaggcttgcaaatggagcatagtcattagttggtatttgtttagtgccaatttatttaggttatttggcttccttgtttcattgagcttccgagattagaagtttcccagcttagatccaggcagcattttttcttggcttaaatatattctttatgagaatattggacagtcggcagtatttgtatcaaagctatttttcagctgaggaacatcactatagatgacgcttcaattcattcgttcattgaaagttgtaggacaatctgctgataaatctgccatgtgctaccatttgtcctgtaagtccaatactgataaagttgtagttttggcagtatttacttgtatgtaggaaatgataccaagtttctcctttccattgtgtttgcaagattacaggaattaattcaattcttacaacttttatattgcttaaaataagtatgctgtacaaactgattaagctgtgatttgccacaaatttgctttgtaagacttgtgctgattaatgttattcaggattactcaaa

SEQ ID NO: 10759 - DNA, 2808 bp, Pseudotsuga menziesii
gtggaagacgccagagggacagtgggtatttctttcttttattgttcgttgtgagggcatattaaagacagtgtgtcagatgcacgtgtgtttatctgggattggcttaattgaaataaatttctcaccaaaatcaaaatgtaaggggagccagctaactggctcattcctatatatatagaaaggaaggggacttgcatcatcctgcatcaatcggaggggagccaacaaactgaataattcctctatatatattaagagaggggttcgcatcatcctgcgtcaatctttgggccataggtattggcagtaggcgaaatttgaggtcacccacattcttgagttcctgtttctgtgggcctctggattgcattgcacctgtcgaggctggtgttgtcagtccaagatctaggcctatttgcatctgggtattctcattttcttttcttctgattggctgttattcatactgttggaaaaatggagaatgtcaatgggggatatgtccccaagaacattcttattactggtgctgcaggattcattgcatctcatgtagccaacaggctggtaagaaaatactcacaatacaagatcgtggtgttggacaagctggactattgttccaatctgaagaatctcttgccctccaggccttctcccaatttcaagtttgtgaagggagatattgggagtgcagatctggtaaattatctgctgatcactgaacagatcgatactataatgcattttgcagcacaaacccatgtggacaattcatttgggaacagcttcgagttcaccaagaacaacatctatggtacccatgtccttcttgaagcatgcaaggtgactggattgatcagaagatttattcatgtgagcactgatgaagtttatggtgaaacagagaaggatgccattgaaggcaatcatgaagcctgtcagcttctacccaccaatccttactctgcaaccaaggcaggagcagaaatgctggtcatggcctatgggagatcttacgatttgcctgtgatcaccacaagaggtaacaatgtatatgggcctaatcagtttcctgaaaaactgatacccaagttcattcttctggcaatgcaaggtaagacgctcccaatccatggtgatggatctaatgttaggagttatttgtactgtgaggatgtagctgaggcttttgaagttgttctgcataaaggtgaagtggggcatgtgtacaatattggtacacagaaggagagaagggtcattgatgtggccaaggatatctgtaggctcttttcattggatgcagagaaggttataaagtttgtagataacaggcccttcaatgatcagagatattatctggacgataagaaactcaaggatctggggtggtctgagaggactaaatgggaagaaggcctaaagaaaacaatggattggtacattagccaccctgattggtggggtgatgtgtccggtgctctgcttcctcatccaaggatgctcacaatggcaggagttgagaggtattcagaaacccatgatgtggttgacacgaagtctccagtgctagagaatgacatccatcagaatcacatgctagagacctccaacggccatattcagaaatctgccttcaagttcttgatctatgggcgaaatggctggattggagggcttcttgggcagatatgccaaaagcagggcataacctatgaatatggaaatgggagattggaggataggtctcagatccaaatggacatacagaacatcaagcctactcatgtttttaatgctgcaggtgtgacaggtcgtcctaatgtggattggtgtgaatcccacaaaccggagactattagaaccaatgtggctggaactttgaatttggctgatatttgcagggagcatggtcttctgcttatgaattttgcaactggctgtatttttgaatattgtgatgtttatcctgagggcagtggtattggatttaaggaggaagacaaacccaacttcactgggtccttctattcgaagaccaaggccatggttgaagagctcctacacagttttgaaaatgtttgtactcttagggttagaatgcctatctcctcggacctgaataacccccgcaatttcatcacaaagatcactagatatgagaaagtggtaaatataccaaacagcatgacagtccttgatgagttgctgccaatctcgattgaaatggcaaaaagaaattgcactggcatatggaactttacaaacccaggtgttgtgagccataatgaaatcttggagatgtacagagaatatattgatcctactttcaagtggacaaatttcaatcttgaagaacaggcaaaagtcatagttgctcctcgaagtaataatgaattggacgctaccaagttgaagacggaatttccacagttgctgtcaataaaagattcattattgaagtatgtctttgagccaaacaggaagaacaagttagcttatggagtgtagtccttgtttaagatcatttttttaatttgttgtagttgagttttgctatggataggcaggcaaagcatccatatgcttagttgggggactattcactactgcattatttttaggtcaccaatggaggagcttattaggtagggtattctaaatatgttctacgattcttcttctgttttactttttacattttagctcaccaatggaggagcttactggctaggatattctagataggttatattattcttcttctgtctttattttttgcattccttctatgaatgtaag

SEQ ID NO: 10760 - DNA, 2477 bp, Cephalotaxus harringtonia
ctgcgatcccgcgtctctattctacaatggagaattatagcagcagcagcaatggatatgtgcccaagaacatactcatcacaggggcagcaggcttcatagcctcccatgttgccaacatgcttgtgagaaaatacccacaatacaagattgtggtgttggacaagctggactactgctccaatctgaagaacctgaaaccatcaaggacttcacccaatttcaagtttgtgaagggagacattggcagtgcagatctggtgaattacttgctcatcactgagaaaattgacaccatcatgcattttgcagctcagacgcatgtggacaattcttttggcaacagttttgagttcaccaagaacaacatctatggcacccatgtccttctagaagcatgcaaggtcactggacagattacaaggttcatccatgtcagcactgatgaagtatatggcgaaacggagaaggatgccattgagggtaatcatgaggcttctcagctgttgcccacaaatccgtactctgcaaccaaggcaggagctgagatgctggtcatggcctatgggagatcgtatggcttgcctgtgattacgacaagagggaataatgtgtatgggcccaatcagtttcctgagaagctcatacccaaattcattcttctggcaatgcaaggtaagtcgcttcctatccatggcgatggatccaatgtaagaagttatttgtattgtgaggatgtagctgaggcatttgaggttgttttgcataagggcgaagttgggcatgtctataacattggtacaaagaaggagaggagagttatagatgtagctaaggatatctgtaagcttttttctttggacgcacagaaggttattaagtttgtagacaataggcctttcaatgaccagaggtattatttggatgacatgaagctgaaggagctggggtggtctgagaagacaaaatgggatgaagggctgcagaaaacaatggagtggtacattagcaaccctgattggtggggtgatgtttctggggctcttttgcctcatccaagaatgctgacaatggcaggagttgagaaatatacagaagggcatgatggggttgaaatggtttccaccaatcctagtcagcgaagtggcatggttgatccctcaaagagcctaattcagaagcctgccttgaagtttttgatctatggacgcaatggctggattggtggcctactagggaagatatgtgagaaacaaggcataacatatgagtatggaagtggcagattggagaatcggtctcagatccagacggacatagagaatgttaagcctactcatgtcctgaatgctgcaggtgtgacgggtagacctaatgttgactggtgtgaatctcacaagcctgaaaccatccggaccaatgtggcaggtactttgaatttggctgatatttgcagggagcatgatcttttacttgtgaattttgcaactggctgtatttttgaatatgatgatgcccaccctgagggaagcggtattggattcaaggaggaagacaaacccaacttcattggctccttttattccaaaacgaaggccatggtagaagaactcttgcataattatgagaatgtttgcacactccgggttcgaatgcctatctcatcagacctgagcaatccccgcaattttattacaaagatcagccgatataacaaagttgtgaatataccaaatagcatgacaattcttgatgagttgctgccactgtcaattgagatggcaaaaaggaattgcactggcatatggaactttacaaaccccggtgttgtaagccataatgagattttggagatgtacagagattatatagatcctagtttcaagtggacaaacttcagtctcgaagaacaggcaaaagtgatagttgctccccgaagtaataacgagctggatgcgactaaactgaagacagaatttccacagttgctgtcaataaaagattcgcttttgaagtatgtctttgagcccaacaagaagaaagagttagcaaatggagtttagaaatgtttcgtctttattgtttccaaagatgggggctattgacaaggtcctgtggttcttgaattattttttccacttctcgatcgaagcagcttaactaattggagacatctaggcaggttcttctattcttgcaccgtactactttctaaaatcattaggtaatttacatgttcatgtcactgaagccttcattttaggcatttttagggtatgttcagttttttaacagtaagtttattttgtggaggaagtcctcgttgcttagtaacttttttaggtaactggataagatcttgtatgggatcatattcctttattgttttattgttcaagacagattctatctggtcctacgcaacatttgccgaaattaaggccattgatgttttattcgtatttagtaaatgcgcc

SEQ ID NO: 10761 - DNA, 3331 bp, Oryza sativa
cgtccgtcccatgcgttcgcagcagcagcagcaaccatcagccaaccacgcgtccacggacgcaaaccgattcggcgcacgcgcgtgcgcgagcgcgcgccggtcaaaatctgctccgctattgtagcttttgctcgctttgcttagctttgctcctcaccaaacccccccgatcgaacgagtccaccacacgacacaacatcacacaacccctccaactccagaggcaaccgcgacgcgggtgcgcgcggcttatatttttcgtgcgtttcctcgcgctcccagcctttctttgcacacgccacacaccgagcaagcagaggaggagtattatattcttcgcggggccgagccgattcaacgcgcagtgctcgctcgcgcgcgcgcgggagcgtctcggggttggacaccggccggcccagcttcctgtgaaggatataagctccctgcctcgttgttcaactgctcggcgtcgatcacgcagcgcgggagatcgcgcaaagaaccgagaagagctcatctcatccaccatcactcgcgcagagagatcgatagccacagcgcacaagcaacgcgccgccaatcacatgcgcgcggcggtgcaggggcgggcacatgcgtggacgacgacgacgacgacaccgccgggcgcgatgagaggccgggcgctggtcctcgtggccgcgctgctgctgcagctgcttctcctcgccgctgccggtggcgcgggcgcggcggcgacggagaggaaggcgcacaactacgaggacgcgctgcggaagagcctgctctacttcgaggcgcagcggtcggggcggctcccgcacaaccagcgcgtcgcgtggcgcgaccactccggcctcaccgacggcctcgagcaaggggtggatttggtgggaggctactacgacgccggcgaccatgtcaagttcgggctgcccatggcgttcacggtgacgatgctgtcgtggagcatgatcgagtacggcgacgacgtcgaggccgccggcgagctcggccacgcgctcgaggccatcaagtggggcactgactacttcatcaaggcgcacaccaagcccaacgagctctgggctgaggtcggggacggcgacacggatcactactgctggcagcggccggaggacatgacgacgtcgaggcaggcgtacaaggtggaccgggagcggccgggctccgacgtcgccggcgagacggcggcggcgatggccgccgcgtccatcgtcttccgcaagtccaacccgcactacgcgagcctcctcctgcaccacgcccagcagctgttcgagtttgccgacaagtacagagggaagtatgacagcagtatcgccgaggtgaagagctactacgcgtcggtgagcgggtacaaggacgagctcctttgggccgcattgtggctgcaccgggccaccggcaaggcccattacctcgactacgtcgtggacaacgccgactgcttcggtggcaccggctgggccatcaccgagttcagctgggacgtcaagtacgccggcgtccagatcctcgccgcaagactgctgctgagaggagagcacgaggagcggcacaggagcacgctggagcagtacagggcgaaggcggagcactacgtgtgcgggtgcctggggcggaacgcggacggcggcgcggacgcgaacgtggagcggagcccgggcgggatgctgtacgtgaggcagtggaacaacatgcagtacgtgaccaacgcggcgttcctcctcgcggcgtacgcggactacctgggcgacgacgcggacggcgccgtgtcgtgcgcgggcggcgagacggcgggcgcgggcgaggtggcggcgctcgcgagggcgcaggtggactacgtgctgggcaccaacccgagggggatcagctacctggtcgggtacggcgccaagtacccgaacagggtgcaccaccgcgccgcgtccatcgtgccgtacaagcacagcaaggagttcatcgggtgcacgcaggggttcgaccactggttcggtcgccggagctccaacccgaacgtcctcgtcggcgccatcgtcggtgggccggaccggcgggacaggttcagggacaaccgggagaactacatgcagacggaggcgtgcacgtacaacacggcgcccatggtcggcatgttcgccaagctgaacaggatggcccggcaggagagggagcaggaggaggtggcggctccggcgaggagtacggcggccgatgtgtaaatagattaggttatagagggggggctgtacaattttccccattcttttgttcatttttcttctccttctttggagatcttcttttcacacagattggaaaaattcattttgtatacaaaaagagaaagggacgggtggaggcattcgcatgcaaatgtaaattcgccaccggtacatacgaagaaaaagaattttatcatttggcttccctgtacgtgtgttccatcggtgattttgttatgaaaatagatgcacaagggagtgcgtcgacggcggattacggcggcggcaaccagcggggagggaagagggaaaaggcgacgaggtcacgaggggccgattcccggcggcgagagcatctatgcggctacgggaatccgccccttgctccggattaggaggaaacgcatcgagggaggccggcgacgagaggcgcttccgagctcgggcggcgacggcggcgagcacacggcgagcgacggcaacggtcggggcggcgccggctagctacggggaggctactcgtgctactacccgagtctaaggggaggagatggattgaggagggagaacggggagatgcactaccgagatgaggcggggcgctgtgacgagaggccgacggcgcgggagtaatctctccggcctcaggccggggaagaggaaggagagggcgcgcccgaagtccccttccgcgtcctcgctcgtgccggctcctccgacacgcgcaacgacgaacggcgacggcgaaacagaggggcggcaacaatggagtggaggcgataggacaacgagaggagaagagagggagggcgcctgggctttaaagggcggcaatgtcggtttggaaactgactttgggcggtcaaggcgcgagctggcgctccggctagcggccaaatcggcgacagggcggagggaggatgacgccggcgggaggaaaaagggggaaaaaggagggagagaaagggggcttgccccttgcctctttgggaaaaggaggaggggagcgggggcgacgcggtagagggaggagggggctctgcctccgtcccttgacggcttgcgcgcggagtggtggg

SEQ ID NO: 10762 - DNA, 2185 bp, Hordeum vulgare
gctcctctcttctcttgctatccacctcctgagttttatattccccccgtcccggccccggcccggccgccgaaccagttcaacgcgctgcgcgtgcgtgcgccggacctggacgccggccgcgaatataagcgcgccaagccacgcccctcaggttggaggacactgccctgctcgccacacagcctagcccacaacggcggcagagatatatacgcagatcatcacacacacaccaacacctacgctcgcacacaggctaagctagcagagccggcagagggcgcgctccgggcgcatgcgaagttgccaacgatccgaggagcatcttcttgcgccatgagatcggggaggggcaccgcagccgcggcatgtctccgggccgcgctgctgctaccggcgctgctgacgatgctgatcgcggcggcgtcgtcttcggcggcggaggggggcaagagcgggagcggcaaggcgcacaactacgaggaggcgctgcggaagagcctggtctacttcgaggcgcagcggtcggggcggctgccgcacgggcagcgcgtgccgtggcgcgaccactcgggcctcaccgacggcctggagcaaggggtggacctggtgggcggctactacgacgccggcgaccacgtcaagttcggcctgcccatggccttcaccgtcaccatgctgtcctggagcatgatcgagtacggcgccgacgtcgcggcggccggcgagctcgcgcacgcgctcgaggccatcaagtggggcaccgactacttcatcaaggcgcacacgcagcccgacgagctgtgggccgaggtgggagacggcgacacggatcactactgctggcagcggccggaggacatgacgacgtcgcggcaggcgtacaaggtcgaccgcgaccacccgggctccgacgtcgccggcgagacggccgccgccatggccgccgcctccatggtcttccgcaaatccaacccgcactacgcccacctcctcctccaccacgcccagcagttgttcgagttcgcggacgggtacaggggccaatacgacagcagcatagcggaggtgaagagctactacgcgtcggtgagcgggtacaaggacgagctgctgtgggccgccctgtggctccaccgcgccaccggcaaggccagctacctcgactacgtcgtcgacaacgcccacgacttcggcggcaccggctgggccatcaccgagttcagctgggacgtcaagtacgccggcgtccagatcctcgccgcaaggctgctgctgaggggagagcacacggcggagcagaagaggacgctggagcagtaccaggccaaggcggagcactacgtgtgcgcgtgcctgggccggaacgcggccggcggcgaggacgccaacgtggagcggagcccgggagggatgctctacatccggcagtggaacaacatgcagtacgtgaccaacgcggcgttcctgctctccacctacgccgactacctggcgggggccggcgtggggacggtggcctgcgccggcggcgagacggcgggcgccggcgaggtggccgcgctggccagggcgcaggtggactacgtgctgggcagcaacccgaggggggtgagctacctcgtggggtacggcgccaagtaccccgccagggtgcaccaccgcgcggcatccatcgtgccctacaagcacagcaagcagttcatcgggtgcacgcaggggttcgaccactggttcggccgccggagctccaaccccaacgtgctcgtcggcgccatcgtcggcgggcccgaccggagggacaggttcagggacaaccgggacaactacatgcagacggaggcgtgcacgtacaacaccgcgcccatggtcgggatgttcgccaagctcaaccggatggccagggaggagaaggtggcggccgaggtgtaaatggattagataggggttataggtccagggggctgtacaattttccccattcttttgttcatttttctctccttctttggaggtttcttgatacacaggaaggatggagatgggtgtagaaatacgaggaaaaaacaaagggtggaggcattcacatgtgacatgcaaatgtaaattcgctgcctgtacatacgagaaaaggaaaatgagaattcaagttatacatcggtgattctatcgagtttgctta

SEQ ID NO: 10763 - DNA, 1003 bp, Secale cereale
ccccattcctcaccagccgctagggacgctataatctccccagcacccgcgtccttcgccgactaacaaattccccaaatctcctccctcccggcatcgcatttcttgaccactagcaggtgatcggaagaggagtagggcgagatggggctcgcgttcgggaagctcttcagccggctcttcgccaagaaggagatgcgtatcctcatggtcggtcttgatgccgccggaaagaccaccatcctctacaagctgaagcttggagagatcgttaccactatcccaaccatcgggttcaatgttgaaactgtcgagtacaagaacattagcttcactgtttggatgttgggggtcaggacaagatcagacctctctggaggcattacttccagaacacacagggtcttatctttgttgtggacagcaatgatagggaccgtgttgttgaagccagagatgagctccacaggatgctgaatgaggatgagttgcgcgatgctgtgttgcttgtctttgccaacaagcaagatcttccaaatgctatgaatgctgctgaaattactgataagcttggattacattcccttcgccaacgtcactggtacatccagagcacatgtgctacatccggtgagggtctgtatgagggcctggactggctatctagtaacattgccagcaaggcttgaggcttggaattttgattgtggagctggctagagctgtggatgtatcacttcatacttaagacgaattatatgttcgaatctgttatgtgcctttggtcaagctcagtacttttcttaatgatgtcccacgttaaatagcttccttatggatgctctttcttacttgttgatattttgtcacaatgatttctaaataatcatatgtttttgtactagttatcatgtccaattagttatacaaatgaggccaaaatattatttatttgatatgacgagcagcaatttattgtattgatgttaggcttctttcttga

SEQ ID NO: 10764 - DNA, 933 bp, Avena sativa
gacctcctgtttccgcccaccttctccggctccggcgccggcgaacccaccgcggatcgagcgattcctccgatcaggagaggccagccgggaggaagagcacctacgcgggaggagaggagatggggctcacgttcaccaagctgttcagccgcctgttcgccaagaaggagatgcggatcctgatggtgggtctcgacgccgcgggaaagaccaccatcctctacaagctcaagctcggcgagatcgtcaccaccatccccaccatcgggttcaatgttgaaactgtggagtacaagaacatcagcttcactgtctgggatggtcgggggtcaggacaagatcaggccactggtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcaccccttcgccagcgacactggtacatccagagcacttgtgctacaacaggggagggactgtatgaaggcctggactggctgtccagcaacattgccagcaagtcctaaattttcgtcaagattttgaaggagctaggagcgctttggatggacgattgaatcaccgggtacctagggagttgtgttgggatgggatggtgctatgctattcccgtatgtactgtgtattttcctgagatcaacagttactgagccagctccggctgtggtttcactgtcatactattgttttattgtatttgagccctaagatgtttctgaagtaaacagctaaagagagtcctgttcaatttcgtaataagtgttcaagca

SEQ ID NO: 10765 - DNA, 759 bp, Fraxinus spp
aaaaaattattaatctctcgcgctaatctcaggcagctcactcactgcctctctcatcagatccatctctcagggatcaaaaagctagaaagagaaatggggctgacattcacaaagctgttcagccggctttttgccaagaaggaaatgcgcattctgatggttggtcttgatgctgctggtaagactaccatcctgtacaagcttaagctcggagagatcgtaactaccattcctaccataggttttaacgtggagactgttgagtacaaaaacatcagcttcacggtttgggatgttggtggtcaggacaagatccgtccattgtggaggcactactttcaaaaacacccaaggggctcatatttgtggtggacagcaatgacagggatcgagttgtggaggcaagggatgaattgcacaggatgttgaatgaggatgagctgagagatgctgtattacttgtatttgcgaacaaacaagatcttcccaatgcaatgaatgctgctgagataactgacaaacttggcctgcactcactgaggcagcgtcactggtacatccagagcacctgtgctacatcaggagaggggctttacgaaggtcttgactggctctctaacaacattgctagcaaggcataaattgtgagttgatgcattgccggatgtgagctgggatcttatcttagtatagtttgtgtgtttatgagttttacttttcaagtctcttggtttcgtttaggacttcttgtgctat

SEQ ID NO: 10766 - DNA, 1016 bp, Amorphophallus konjac
tctggtgcgatttggtgggggtagcggtgggcggtgcccctctgagacctctctccctctctcctcctcctcccagcgccgccggcgctcgtcccctcactctcccctcttccccggagacacaaagatggggctgtctttcaccaagctctttagcaggctttttgccaagaaggagatgcgcatacttatggttggtcttgatgctgctggtaagactactattttgtacaagttgaagctgggggagatcgtcaccaccattcctaccatcggtttcaatgttgagacagtagaatacaagaacattagctttacagtgtgggatgttggtggtcaggacaagatccgtcctttgtggaggcattacttccagaacactcaggggcttatcttcgtggttgatagcaatgaccgagaccgtgttgttgaggctagagatgaacttcacagaatgctgaatgaggatgagctgagagacgcagtgttacttgtatttgccaaacaaacaagatctcccaaatgccatgaatgcagctgagataactgacaagcttggcttgcattcccttcgtcaacgccactggtatatccagagcacatgcgccacatccggggaaggtctatacgagggactggactggctctcaaacaacatcgctagcaaggcctagatgtgccgcctccagcgtcagatatctcgttttcgcaaccaggttcagaagagtgctgctatttgggggctttgttctgccattatatagggagagaggggggaggtgggggaggagaagaaagggtcggagagttgtccttagctcgtcaactcatgtctgtgctcaagttaatacaacaaagtggccttttagtatctatctggaacactataataatatggaaatctgtttctttcactcgttggattttcatattttggaactggaatacccttgtcatttgcttttatacataagagctacgaatcaccgtttaattatcctatttcttgtgtcgat

SEQ ID NO: 10767 - DNA, 931 bp, Cichorium intybus
atctgaagcccttaaatactacgctcccctctgcatctccttcgtatatctcacggatttcgtcggtgatcgacggtctccatttcaaacgatcccgtcacttcctgcaatcgccggccgatcataacaagatggggttgtcattcaccaagctttttagccgcttgtttgctaagaaagagatgcgtattttgatggttggtctcgatgcagctggtaaaacaacaatcttgtacaaactcaaattgggagagattgtaaccacaattcccactattggatttaatgtggagactgttgagtacaagaacatcagctttacagtgtgggatgttggaggtcaggacaagatccgaccattgtggaggcactatttccaaaacacacaaggccttatctttgtggttgatagcaatgatcgcgaccgtgttgttgaggctagagatgaactacacaggatgctcaatgaggatgaattgagagatgcagtgttgcttgtgtttgccaacaaacaagatcttccaaatgccatgaatgctgctgagatcactgataaacttggcctccattctctcagacaacgacactggtacatccagagcacatgtgccacctctggagaaggtctatatgagggactcgattggctttccaacaatattgctaacaaggcataaacaggacttggattgtcttgagttatagatgttggtgaaagtcggtgttagtttgttttgagtttaagatttttttttttcttgttaatgttgggaatgaaatgttgttgactggtgtttaaatttaaatatacaatgaattaagatggttggaattgtgtaaatctaaattgcctacttttaaatacttttttaataattaaggatctttgattaatcccgatgaatcctcgcatacgtcgattaatcttttg

SEQ ID NO: 10768 - DNA, 1879 bp, Plantago ovata
gtggtcattggccatgtcgactctggaaaatctaccaccactggtcacttgatctacaagttgggaggtattgacaagcgtgtcattgagaggttcgagaaggaggctgctgagatgaacaaaaggtcattcaagtatgcctgggtgctcgacaagcttaaggctgagcgtgaacgtggtatcactattgatattgccttgtggaagtttgagaccaccaagtactactgcacagtcattgatgcccctggacatcgtgatttcatcaagaacatgattactggtacctcacaggctgactgtgctgtcctcattattgactccaccactggaggttttgaagctggtatctccaaggatggccagacccgtgagcatgcgttgcttgctttcactcttggtgtcaagcaaatgatttgctgctgtaacaagatggatgccaccacacccaagtactccaagtctaggtacgatgaaattgtcaaggaagtgtcctcctacctaaagaaggttggatacaaccccgacaaaattgcattcgtgcccatttctggatttgagggagacaacatgattgagaggtccacaaacctcgactggtacaagggacccacccttcttgaggctcttgacaacatctctgagccaaagaggccatcagacaagccccttcgtctacctcttcaggatgtttacaagattggtggtattggaactgtgcctgttggacgtgtggagactggtgtcatcaagcctggtatggtggtcacattcggccccactggtttgactactgaagttaagtccgttgagatgcaccacgagtccatgccagaggctcttcctggtgacaatgttgggttcaacgtcaagaatgttgctgtcaaggatctgaagagaggttacgttgcctccaactccaaggatgaccctgccaaggaagctgcattcctttctctcccgtaccaaattctctctctctctaacctttcaccagatctatcgtcttcagggttcaaaagtaaggtgaaatggggcttacgttcacaaagctttttagccgccttttcgcaaagaaggagatgcgtatactgatggttggtctcgatgctgctggtaagaccaccattctgtacaagctcaagctaggagagatcgtgactactattccaacaattggtttcaatgttgagactgttgagtacaagaacatcagcttcactgtgtgggatgtcgggggtcaggacaagatccgtcctttgtggaggcattacttccagaacacccagggtctcatttttgtggtggatagtaatgatagggatcgtgttgttgaggcaagggatgaattgcataggatgttgaatgaggatgaactgagagatgctgttctacttgtatttgctaacaaacaagatcttcccaatgcgatgaatgctgctgaaatcactgacaagcttggcctgcattctctcaggcagcgccactggtatattcagagcacctgtgctacctctggagaggggctctacgaaggacttgattggctctctaacaacattgctaacaaggcataaagcttatgaagttgtttgctggatgcggccggggtttctatctagtctttcctttagtctgtatgttatttccccccatgcaagtatttttgttcggtataggatcttcctattggttgtaacagagtgtactgttccatatgcattcgcaatgccctttagtttctatattgttacaatattcaattcatacctgaagactatataacgtgttgttggatcacccaacttatcctttaaaattttaatatctttatgagccttggagattatttttagtgatgaaatgtatttttgtcttc

SEQ ID NO: 10769 - DNA, 1031 bp, Rosmarinus officinalis
cggccggggggctccgaaaattgttattagtatctcgcgttgttctcaggcagctccacatttctctctctggcaccagcagggacatcctttctctctctagcgttcgcaccaaatctatcgttccaagagatcaaaagcaagaaagggaaatggggttgacattcacaaagctttttagccggctttttgccaagaaggagatgcgcattttgatggttggtcttgatgctgctggtaagaccaccatcttgtacaagctcaagctcggagagattgttaccactattcctaccattggcttcaatgtggagactgtcgaatacaagaacattagcttcaccgtttgggatgtcgggggtcaagacaagatccgcccattgtggaggcactacttccagaacactcagggtctcatattcgtggtggatagcaatgatagggaccgtgttgtggaggcaagggatgaactgcataggatgttaaatgaggatgagctgagagatgctgtattacttgtatttgccaacaaacaagatcttcctaatgcaatgaacgctgctgaaatcactgacaagcttggcctacactcgctcaggcagcgccactggtacatccagagcacttgtgccacctcaggtgaggggctctatgagggactcgattggctctccaacaacattgctaacaaggcttaaagcttttctggagttgtttacgcgagagctaatactggaaactgtcgaagttttatctagttttttcttaaccatatattgctttgaaacaaatattatttttttcatttatgtttaggaccttcaaaatgtcgttatatcagacaatggtttgttttatatgttttcctacatttgcgtagttttgaatgtaatattcagactcgcagactagggttttgcattattatttgtttaccaacgcttctctctacttgtaaactgcatgatctctacgactttagtgctgaaaacgcttaattttatcatatctctacaattttttcttcattg

SEQ ID NO: 10770 - DNA, 1216 bp, Panicum virgatum
atctcatattgtttcacggagttgtggtggcatgaatcgaattttctctataaaataggcgagacgcgcacctccgccagaagcaacaaccacccgagcgcctctccttccccgcctccggccggtgcctcccccgtccccggctgcgtcgccggcgatctcaccgcgaatcggatccgccgaaaaggcgagagggaagagatggggctcacgttcaccaagctgttcagtcggctgttcgccaagaaggagatgcggatcctcatggtggggctcgacgccgccggaaagaccaccatcctctacaagctcaagctcggcgagatcgtgaccaccatccccaccatcggattcaatgttgaaactgtggagtacaagaacatcagcttcactgtctgggatgtcgggggtcaggacaagatcaggccgctgtggaggcattacttccagaacacacagggtctcatcttcgttgtggacagcaacgatagggaccgtgttgttgaagccagggatgagctccaccgaatgctgaatgggatgagttacgcgatgctgttttgcttgtgtttgctaacaagcaagatcttccaaatgctatgaacgctgctgagattactgataagcttggactgcattcacttcgccagcgtcactgtacattcaaagcacctgtgctacaactggtgagggattgtatgaaggcctggactggctgtccagcaacattgccagcaagtcctaagttgtcaagaggtttggatcatctaggagcttttggatgatatttctggatattaggttgggttgctattcccgtatgtaaggtgtatgccctgagctcaatagttattgagctttggttaagatttaacagttaaattgtttttgtgtaatttgggtcttgagatgtttcgaaccaaacagctaaaagagttccgttgagctaattggttggaggaatgcgtgccagtatgcagtatcacgttgcgttacgagatttttttcgtgctccctaatgtttttgagattcttcattcttccatactccatatgtgtcctggaaaaaaaatgtgcggctgcatgccacttcagcttgggtcacgtttctttcacctacataactgaagcaaaaatgcagcttttgccatgctaaatccaacacaaatctggcttgtaaagatttcgactgtaacaaggattgtcttggaaccaa

SEQ ID NO: 10771 - DNA, 2188 bp, Ambrosia trifida
ccgagcctctgttccatacccttctttcaggtcactcaagccatgggtgcaggcgggcgaatgtcgaacccagtcaacggtgaaaccaaacccgaatctaccccgctccaacgagtcccttaccaaaaaccgcccttcacggttggagacgtcaaaaaagccatcccgccccattgttttaaccgatccgttatcaaatcattctcatacgtcgtgtatgacctcaccattgcggccatcttttactacctcgccaacaattacatcgcgctcctccctagcccccttgcctatgtggcgtggcccgtttactggatttgtcaaggttgtatcttaaccggtgtgtgggtcatagcccacgaatgtggtcatcacgcgtttagtgactaccaatggctcgacgacactgtgggccttatcctacattccgccctcctagtaccttacttttcgtggaaatatagtcatcgtcgtcaccactccaacacgggctcaatcgagcacgatgaagttttcgtcccgaaactaaaatctagtgtgcggtcaaccgctagattactaaacaacccacccggccgaatcctcaccctactcgtcactctaaccctcggctggcctctatacctcatgttcaacgtttcaggccgatactatgaccgatttgcgtgccatttcgacccaaacagcccaatctactccaaccgcgaacgtgcccaaatattcatctccgacgctgggattttaaccattcttttcgtactcatccgtcttgcaacaaccaaaggactcacatgggtgctaacaatgtacgctggaccgttgcttgtggtcaacgggttcctagtcctgatcacattcttgcaacacacccacccctcactccctcactacgactcaaccgaatgggactggttacgtggggccctcgccaccattgaccgcgactatgggatcctaaacaaggtgttccataacattactgacactcatgtcacacaccatttgttctcaacaatgcctcattatcacgcgatggaagccacaaaggcgatcaagccaatcttgggcgaatattatcaattcgatgggacgtcgatttttaaggcaatgtatagggaaacaaaggagtgcatttatgttgataaagatgaggaggttaaggatggtgtgtactggtaccgtaacaacgtttgattcgacaaagagagtagtagtactaagagaatagcaaagcaaagcaaagcaaatctgtgttccttttggtgttgtttaggttatgtttggtttttgttatgtgtcgtttaagatggacatggagttgtaataagtgttgtacttgaacaatattttaccatccaaaaagaaaaaagtaagtagctgaatttgcattatcatataatagcattcgaacaaactacatggtaattctaaccaccacaaaaacttgacaacttcagattaaagaataatagccaacctaccaaacacatacttcaatccaaacaaacaatgtatattaaaagcaaattacccttacaaataacaacttccaaaaccaataccacaaactgccaacatccaccctcgttgcctcatgccttgtttgctatgttgttggaaagccaatccaatccttcgtaaagtccctctccagaggttgcacaagtgctctgaatgtaccagtggcgctgtcggagagagtggagaccaagcttatcagtgatttcagcagcattcatagcatttgggagatcttgtttgttagcaaacacaaggagaactgcatctctcaactcatcttcattcaacatcctgtgcaattcatctctcgcctcaacaactctgtccctgtcattgctatccaccacaaagataagaccctgggtgttctggaaatagtgcctccacaatggacgaatcttgtcctgacccccaacatcccacactgtgaagcttatgtttttgtactcaacagtctccacattaaaacctatggtaggaatagtggtgacaatctcgccgagcttgagcttgtacaaaatggtggtcttaccagccgcatcgagacccaccatcaaaatacgcatctctttcttggcaaagagccggctgaagagtttggtgaaagtaagccccatcctcttgctagcgaggatccctgagagaagcttgttggagagggatcgat

SEQ ID NO: 10772 - DNA, 4635 bp, Artemisia annua
gtgttgggtcaaagttaagccgcaagctccactcctggtggtgcccttccgtcaattcctttaagtttcagctttgcaaccatacttcccccggaacccaaaaactttggtttcccggaagcttccattcgagtcatgaaattagttactcagaatgatcgctggttggcatcgtttatggttagaactagggcggtatctgatcgccttcgaacctctaactttcgttcttgattaatgaaaacattcttggcaaatgctttcgctgtagtttgtcttgcgacggtccaagaatttcacctctagcgccgcaatacaaatgcccccgtctgtccctcttaatcattaccttggattcttaagaccaacaaaatagaaccaaggtcctattccattattccatgcaagatcattcaagttaaggtagtggtacgcatcatatagatggttgaccataccgtttttaggcacctctttcgaggttttggacgcctgctttgagcactctgattttttcaaggtaaaagtctcgatcgcttgaatcaacactcggtaaagagcattgatagcaaatatcgagcaagtctaaacactatgaatgtaaccaccaggaaagaggaatgaaggttcaagctagcatccgtagacacaagcaagaaacctaacatcaccatctaaccctttaatcagtggaccccataggttcgactgaaatccgcagcaactttaatatacgctattggagctggaattaccgcggctgctggcaccagacttgccctccaatagatcctcgttaaaggatttaaattgtactcattccaattaccatccccgtactgggattgtgtaagccttccttagatgtggtagccgtttctcaggctccctctccggaatcgaacatggtaggcgcataacctaccatcgacagttgataggccatacgatttgctcagttatcccgtcggagtactgcgttgaaccaccccgtcggagtaaaaatacatatataaaaaaaaaaacataaaggtatcaaaagattatatatatcatcagctctggagcctcctcctgtggctacctttgggttatgccgtttaaccttactacgtttggaaaagtattaattccctctgagacatggagcaagcgtgcccccggtcaaattgtttccagaatcaggttttctcattctacaaagtgctcgattggcgttcactcatccccagacgttttcttcttgtttcctttgtcaactgtacctagtgagcatcctgtatacgagcggttaagcgggactaatgcaagttttttataaaataggtgttggatcttaatagtgaactttgacgagtaagctgatttactttttgagaaggatctatattgggatttaattacgtaaataaaaagtgttttcatgtttgtgttgatgtcgtttcctgctgacaccagttcactgccgatacaatagtcacttcaaaattttcttgaacatcttctgagggctgaactttgcttgtaaatgatgaattttgcatacactataaattacagtatgagattatgtttctagcaatacatttctctgatgggtaccaattagatctactaaaaatattggcagaagattttgcaacaccatacttagggtaaaggaataatcataccgagtttgaggtagtatctggaggctttttttttacaacaaattttctgctcatataatcgtcaaagatgccctgcaattctcagttctctttgcattgtataccttgtcaatgtctgggtgtcattgatctggtgttcagtataaataaggctgcgaagcccatccatcagaagtgtactgatcttttgcttatgcgtcaagaaagttgagggtggattcagctaagatcaggcaggctgatagtttatttttttatctagttattatagttttctagaggttaagtccgttatttcttcttctacgtgtgtgtctcttcttcgtaaataaggtgctacaagcagttgcatatcaaaaaatggaaaggtacaagataattaaggaagttggtaatggaagtttggggttgtttggcgagcattaaataagcagaatggtgaagtggttgcgattaagaaaatgaagaggaagtattattcatgggaagagtgcataaatttgagagaagtcaagtcactgcgtaagatgaatcatccaaatgttgtgaagctcaaggaagtcatcagggaaaatgacattttgtactttgtatttgagtatatggaatgcagtctctaccaacttatgaaagatagagtgaagcttttcttggaaagtgaaattaaaaactggtgctttcaagtgttccaaggtcttgcatacatgcatcagcgtggttacttccatcgtgaccttaagcctgagaactttcttgttaccaaggatgtaataaaaatagctgattttggtcttgctcgtgagatcgtttcccaaccaccatacaccgagtatgtttcaacacgctggtatcgtgctcctgaggttcttctccagtcaccaacatatggttctgcagttgatatgtgggcaatgggagcaataatggccgaattgtttactcttcgaccactttttccaggttcaagtgaagcagatgagatctataaaatttgcagtgtgataggcagtccaacaaaaagctcatgggctgagggacttgcgcttgcacgtggtatcaattatcagtttccagagcttgctggcgtaaagctttctgcactggtaccatctgcaagcaaggatgcagttaatctaattgcattactttgttcgtgggatccgtgtaagaggccaacagcatctgaagttcttcagcatcctttcttccagagttgctactatgttccaccttctcttcgccctaaatctactgttgcgagccctaaatctaccatttctaggacgcctccacctgctggaataagcgggaggaaggttgtggagcagaaatgtgccaagaagttacccggaactttgcctaactcaaagccagctggcaccattataacatctgccaaaatgcattcatcactaaattcaggcgttcaacgtttggaaatgaatcgacaggatggagcaaatgacaagacaaataagaatgctgccaggcaaccaaaataccaaccacccatcaaaaacagtccaagaggaatgtacatggggaaggggagaggcgttggcgacacaactgaaaagctgggaaatatgacacttagcacaggaagagttggtgcacccaagcaggtgcatccaccactacaaatgaaagccggagtgacaaatactagatctgacttgtataatggaagatctcaaggatatagcagtaaggtggctggatgaccacattataccctacggttctacgaaaatgtgtgcttttgtaagaaaagtcgtgttctagtgtgagtatgttacatggtctgatctttaaaccatatagtggggggagggtctagtaataagtgttttgggtatactttttaacggtgtttgtctgtcttattggtcctattttactttgtttcttacatcgtgtgggaactttcttatactgtgtttgactaacaaggaacttcagtattttatacatgaaatgacacggaacatttactgattcttgtacgaaaaatctcgatttaaacaatagcttaaaaaaaacatatataaacatgcaacattaatgtctctcaacactttaggttatatgaatcaaaagctacaaacatgacatatacctttgcaaatacttgcaatccacaaaacattgtatcatacatgcccctatatatcaaatgcaaaaagcctttttaacaaacaaagttccataactgctcgcaccagccacaagaacgacagatgcgaaagtgacctgaccaaatgaaaagcaaaacttgccgctggtattccaacctcatgatacaatttaatcatgccttgttagcaatgttgttggagagccagtccaacccctcgtaaagtccttcaccagaagtagcacaggtgctctggatgtaccagtggcgctgtcgaagagagtggagcccgagcttatcagtaatctcagcagcattcattgcattaggcagatcttgtttgttggcaaacacaagaagaactgcatctcttagctcgtcctcattcaacatcctgtgcaactcatctcttgcctcaacaactctatccctatcattgctatcaaccacaaagataagaccctgtgtgttctggaagtagtgcctccatagtggacggatcttgtcttgacccccaacatcccagacagtgaagctgatgttcttgtactcgacagtctccacgttaaacccaatggtaggaatggtagtgacgatctcgccgagcttgagcttgtacaaaatggtggtcttaccagctgcatcgagacccaccatcaaaatacgcatctccttcttggcaaaaagccggctgaaaagtttggtgaatgtgagccccatcctgtgtctgatgaggattcctgagagagaatagaagagaagagaagatttgttaggttggtttaatttttgatttgatttgaaaattagttccccgttggagta

SEQ ID NO: 10773 - DNA, 860 bp, Gossypium hirsutum
agatcttcgttcaaccacgcctaataaccgctcggatttttctcagacgtgaaaaaatggggctgtctttcaccaagctattcagccggctatttgccaaaaaggagatgcgcatactgatggttgggcttgatgctgctggtaaaaccaccattctttacaagctgaagttgggagagattgtcactactattcccaccatcggtttcaatgttgagaccgttgaatacaagaacatcagcttcactgttttggggatgttggcggccaggacaagatccgaccattgtggagacactatttccaaaacacgcaaggacttattttcgtggttgatagcaatgatcgtgaccgtgtggttgaagctagagatgagttgcacaggatgttgaatgaggatgagttgagggatgctgtgctgctagtattcgcaaacaagcaagatcttccaaatgctatgaatgctgctgagattactgacaagcttggccttcattcactccgccagcgccattggtatatccagagcacatgcgctacctccggtgaaggactgtacgaggggctggactggctctcaaacaacattgcaaacaaggcataggtgtgacattactgagttggcagtcttacaacccttttggattttatgaatgtctgcccccgttttatgtgttatttttttatggtttttcacgtttgttgcaaacactgccatttgttacttatagttttaagaataattgacaaagtttgggaccgttatttcctagcgggaattgatggttagccagtttaattactcttttaatgtaaaatatacattatatatacaaatatttttttccttcaaaaaaaaa

SEQ ID NO: 10774 - DNA, 882 bp, Flaveria ramosissima
cggcccctttattcattttacatactccattttcctctccgtctctctcttccaatcgatcgattgatccctttttcaacaagctttttctcagggatcctcactagcaagaggatggggctaactttcaccaaactcttcagccggctctttgccaagaaagagatgcgtatattgatggtgggtcttgatgcagctggtaagacaaccattttgtacaagctcaagcttggtgagattgtgactacgatccctaccataggttttaatgtggagactgttgagtacaaaaaacataagcttcactgtgtgggatgttgggggtcaggacaagatccgtccactaatggaggcactacttccagaacacacagggtcttatctttgtggttgatagcaacgatagggacagagttgttgaggcaagagatgaattgcacaggatgttgaatgaggatgagctaagagatgcagttctcctcgtgtttgctaacaaacaagatctccctaacgcaatgaatgctgctgaaatcactgataagctcggtctccactccctccgacagcgccactggtacatccagagcacttgtgcaacctctggagaaggactttatgagggattggattggctttccaacaacatagcaaacaaggcatgaggcgaatgattgattatgtgggtggatgtttctgttgctggttttgtaacttgtttgtttgaaaaaggtatttcgcttttgacatacagttgaatacattgtttggattgcaagtatgttctaggtaggttgtcatttcaagttgtaagaggttaagtttttgtggtggttagaagttggatactcgatgtagtttgttatccgtctatttgataagaca

SEQ ID NO: 10775 - DNA, 2171 bp, Vitis vinifera
ctggcctgcaactaaagagaaaaagaaaatatgggtggtgattatctgccttttctggccatgtttcttgtccaaatgggctatgctggaatgaatatctttgtgaagctggccatggattctgggatgaaccccttcatcctcgtcgcttataggcaaatctttgccactgtggccatgattccttttgcttattttcttgagaggaaaacaagacccaagattacaagaattgttctattccaagccttcttgtcttccattttcggggcaaccttgaaccagatcctttacttcattgggctaaaacattccaacccgacactaggctgcgcatttaacaaccttttcccagccatgactttcctccttgctgtccccttcaggcttgaaacagtgggaattaagacaaggccaggtcaggctaaggtgctgggaacagtagtatgtataggaggggccatgatactgacattttacagaggacacgccatcaatatcggtgaatccggcatccattggaagtatgcagagcagctaaaaactagagattctcagagtggggccaacttcatcttgggaccttttcttctgatcaccagctgtatttcttgggccatatggttcataattcaaggaagaatgtgtgtgaagtttgcagctccttacacaagttccactctgatgtgcttcatggccagcattgagtgtggagtcattggcttgtttgttgaccaccaaccttcagcatggtcattaaatgattccatcaggcttattgcagctctttactcggcaattgtgtgtactgcactagcattttgcctcatgtcctggactatacaaaggaaaggtcctctctacgtgtcagtcttcagccccttgctccttgtcattgtggccattctcagctgggcccttcttcgcgacaaactacactttgggactgttgtagggtctctgtttgttgttttggggctctatgctgttctatggggaaagggtaaggaggagaaccagaggggcagcagggaagaggcagaagaggggaaggaagacttggagttgcagataaatgggaagctttacatcagaaaggatcctaacccagaccaacggcgtctaaacgtccgtcacattcgaccatctataaatgctagagtctcctatcaattccttctcctctcgtttgggcagcttctcgagatctgccctctacgtttcccaaaattactattctgtccttaccagacgcaaaacatggggttgtctttcaccaagcttttcagccggctctttgccaagaaagagatgcgaattcttatggtgggtcttgatgctgctggtaagaccaccattttgtacaagctcaagctgggagagatcgttaccaccattcccacaattggatttaatgtggagactgtggaatataagaacattagctttactgtctgggatgttggtggccaggacaagattcgtcctttgtggagacactacttccagaacactcagggtctcatcttcgtggttgatagcaatgatcgtgaccgtgtagtcgaggctagggacgagctacacaggatgttgaatgaggatgaattgagggatgcagtgctgcttgtttttgcaaacaagcaagatcttccaaatgccatgaatgctgctgagattactgataagctcggtctccactctctccgtcaacgccattggtatatccagagcacatgtgccacttctggagaagggctgtatgaggggcttgactggctctccaacaacattgctaacaaggcttagaagccgtggtaattgccatcaacattttgcattgccaacattgtcgtaatggagagatgttaccatgttgttctggcgttttgagatttatggtttactgttgctactgcgtgttgcgagtatcatctgcttgttttacttagttccttgttattatagtagaaatttggaatctgtcctgtagattcagaataatttgtgtaatttgctgttttctgagttgatattattcttgagtgttcttccttgtttgggttagttgaagggaaaagcaaagagaggtagagaaattctccttgaaaaactgctttttgcccaactgtagaactcacattttcattcaaatctacatcatagtttctagc

SEQ ID NO: 10776 - DNA, 1578 bp, Hordeum vulgare
aaatctgcaatgcttgaattgaatcttactcatataccagaatatcgaatcgtatacgagcaaaatagtggagccgacgaggcccgcacgccagtggaagcaccggaggaaggtgcccatgcggtgcgggctgcgtgcgactgggcgcggtgtaaaggccacgtgagaatgggcctcgcgcccttctatatagccccgccatcgggccgcccggtctctccaccgcaccgcactgcacgacagccatcttcatcttccgtgcggttcccaggctccaactcccacgcccgtctcccccgagatcaggcggagcacgcccgggagcgccgagaccccgagagcctccgtctccaccaccccggagcagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggttttaatgtcgaaactgttgaatacaagaacatcagcttcactgtttgggatgtggggggccaagacaagatcaggcccctgtggaggcactacttccagaatacgcagggcctcatttttgtcgtcgacagcaatgatagggaacgtgttgttgaggctagagacgagctccacaggatgctgaatgaggatgagctgcgtgacgctgtgttgcttgtatttgcgaacaaacaagatcttcctaatgcgatgaatgcggctgaaatcactgacaagcttggcctgcactctctgcgccagcggcactggtacattcagagcacttgcgcgacatctggtgaagggttgtacgagggacttgactggctctccaacaacattgccaacaaggcttgaagcatatcgaggactgcttcgaggaatgaacgatgctggatgtctcgacaactcactactaccattttacatattgtgatatatatacactgtacaacagatagtatgtgtgcgtatgtgacaggcagaagctcccttctttaagtgagctagtatcaggtcaggttttttttttgtatggatattatcagtatttctgtgccgtggttttacaaggtttactttgtcaacattgtgtgtatgaacccctgtctttttgaattttagtaagattgaggtgcggttgccaatgttggttggttcaattgagtgatgtggatggtaacattatttttactagttctgtatacgatctagtactggttcggattggttctgcccttttggtctggctgtcggtatcgttgcacgccatcgatacttatggagatcaactcaggcactcggtgatgggtgcatacgccataatgggatgttcattgttgcatacggtgaatatacatgcgggtatgtagttatatacttatatttctttttgcgggaagtatacttatttgttggaccatcatatctaacgaacatttgcgaggaacggttggcgttttgaacgattttcatctttgctctatgtaattaaaaaagacatcaaagtctcatttgaaa

SEQ ID NO: 10777 - DNA, 1096 bp, Hordeum vulgare
cacagacggacccacctaacagctggcccacgctgccttctatgcgccttccacgaagaaatccggccccacctgccggtgaccctccaagcacgtccctatatagacttcctcgtgtgcggccatctcggtctctctctctctctctcctccattcctctcctcctcctcctcctgccaccgatcccaaaccagggaggaacccggcgcgaggagggcaaaggaagagaagaggagaccacccagccgaccgcgcgaccgcacgcacagggcagcagccgtcgcgatcccgcgcaggagcggacatggggctcacgttcactaagctgttcagtcggctcttcgccaagaaggagatgaggatcctcatggtcggtctcgatgcggctggtaagaccaccatcctctacaagctcaagctcggagagatcgtcaccaccatccccacaatcgggtttaatgttgaaactgtagagtacaagaacattagtttcaccgtttgggatgttgggggtcaggacaagatcaggcccctgtggaggcactactttcagaacacccagggtctcatttttgtcgtggacagcaacgacagagagcgtgttgttgaggccagagatgagctccaccggatgctgaatgaggatgagctgcgtgatgctgtcctgctggtgtttgcaaacaagcaagatcttcctaatgccatgaatgctgctgaaatcactgacaagcttggcctgcattccctgcgtcagcgacactggtacatccagagcacatgtgctacctctggggaggggttgtatgaggggcttgactggctgtccaacaacattgccaacaaggcttgaagcatctcggcaggggcttctatggatctggataagctggatattcggactaatgctgcctttacgtattataaactatatagtcttgacagataatgtgggtgttttggaaggataaagctctttgtgaaagagctagctatcagattgttttcgtgggtgtttaattgtctggtgctgtttgttttccccatcgtggtctttactatgtcagctctgtattcgccactccgacagacttgaga

SEQ ID NO: 10778 - DNA, 2340 bp, Beta vulgaris
aaatatatcactaacagttgtgaaaacattagtactttaagaaactcttgccagttgttaaacaatgtaactgctactgtccgtggatcgtcctgttactacaaaatgctgaatgcatcatccaaatgcacaaggccaacaaaactactaggcaaatgaatattgtgggtaccatattaaaggatagcaataccacctcactaaactgaatcactactaccaggagccaggatttaacttcacttgcatctatgcattacagaaatggtaacccaaagaattttggagtgcaggcaacgctcaaccactatttagtaacatatatccatatccaaagctctaagcaaaaagcttatcacttccattcacaaaattacaaccacaaactgatttttctaggtaacgatggttaaaaaaacaaatgcgacttagataatcttcacccctgcatccaggacaaactgtgcatgacaaacgcccaattcatcaagccttgtttgcaatgttgttagaaagccaatcaagtccttcataaagtccctccccagaggttgcacaagtgctctggatataccagtgacgctgtcggagagagtgcaggccaagtttgtcagtaatttcagcagcattcattgcattaggaagatcctgcttgttagcaaaaacaagcagcactgcttcacgcagctcgtcctcattcaacatcctgtgcaactcatcccttgcctcaacaacacggtctctatcattactgtcaaccacaaaaatgagcccctgtgtattttggaagtagtgcctccacaatggacggatcttgtcttgacccccaacatcccagactgtgaagctgatgtttttgtattcaacagtttccacattaaaaccaatagtgggtatagttgtgacgatctctccaagcttgagcttgtagagaatggtggtcttaccagccgcatcgagacccaccataagaattctcatttccttcttcgcgaacaagcgactaaacagctttgtgaatgtaagccccattttaccagttgactatgtcactaacctctgtaaagagtagtgagagaaagaagagagagagagatagcctcctctctaaacccatcacttctcttctctaaccctaacactttaccccaaattcctacattatttacactttctgctatccgttcaccccaattacgattctaccctctgtccagcactcaccggagctccattcgccggttaccggtagtatcgggaaccctaacggttgactctccgacctcgtacgccggcgataaacacgggaagaagcttcttctagaagttaaggatctcaccgctgttattgccgaatctcagcagaccattcttaatggcgttaatctcactgtttttgaaggagaggttcatgcaatcatgggaaagaacggttctgggaagagtacattctcaaaggttcttgttggtcatccagactatgaagttactggagggaccatgatttttaaaggtcaagacctacttgagatggatgcagaggaaaggtctctatcaggtttatttatgagtttccagtcaccagttgcaattcctggagtgagcaatgcagattttcttaatatggcatataatgctcgacaaagaaaacttggtcttccagagttgggtccaatagagttcttcagccatgtatatagcaagcttgatttggtgaacatgaagatggattttttgaatagaaatgttaatgaaggatttagtggtggagaacggaagaggaatgagattttacaacttgcggttttgggggctgacttggctatattagatgaaattgactctgggttagatgtcgatgctctccaagatgtagcaaaagcagttaatggtcttctgacgccaaataattctgtgttgatgatcactcattatcagcgtcttctagattatatcaagcctgcttatatacatattatggaaaatggaagaattgtgaggactggagacatatctctcgcatcagaattggaaaagggagggtacaaggcaataacaactgcataaacattgttcaaatgatttgactctgaaaggtcagaactgcagctcttcagcttcagtgacaaatccagtaccagctgatacctgatgtgcacaactactgcagaagtgatcgctacatgatcaggtttctaaggctgaaaattttgcataggacctgttgctgtaataccgatataatttacttgtatggcagtggcttctttttgctgctattggaggcttattggtctggtccacctttagatgttaaattctttgaacaatgtttatgca

SEQ ID NO: 10779 - DNA, 808 bp, Brassica napus
aaaaaaaaaaaaatcaaatcgtgaaacgttctcgcaggccatttgcgtagacgaaccatcggcatcagagagaggttagatctcgcgcggcgttgtttcttcgatggggctgtcatttgggaagctgttcagcaagctgtttgcgaagaaagagatgcggattctgatggttggtctcgacgctgctggtaagaccaccatcctctacaagctcaagcttggtgagatcgtcacaaccattcccaccattggtttcaatgttgagactgttgaatacaagaacattagctttaccgtctgggatgtcgggggtcaggacaagatccgtccattgtggaggcactacttccagaacacgcaggggcttatctttgttgtggacagcaacgatcgtgaccgtgttgttgaagccagggacgagcttcacaggatgctcaacgaggatgaactgagggatgcagttctgctgtttttgctaacaagcaagatctacccaacgcaatgaatgctgctgagattactgacaagcttggccttcactctctccgccaacgtcactggtacattcagagcacatgtgccacctctggagaaggactctacgagggacttgactggctctccaacaacatcgcaaacaaggcgtagaaagaggagatagcaggattcatctttgcttgttttgttatatacatcaaagtaaggggtctgtttctctagcactacaaaacgaaaccaagtttttattatgttatacattcttcttcgtctgttctttaaccattagtactttccttgaataaatcat

SEQ ID NO: 10780 - DNA, 977 bp, Brassica napus
atttttctctctcttaaaaaaaagaatcaaatcgtgaaacgttcgcaggccattttgcttggacgaaccatcggcatcagatagagagagagagagcttagatctcgcgcggcgttgtttcttcggtttggattttaaaataaaatggggctgtcatttgggaagctgttcagcaagctctttgcgaagaaagagatgcgtattctcatggtaggtctcgacgctgctggtaagaccaccatcctctacaagctcaagcttggtgagatcgtgacaaccattcccaccattggtttcaatgttgagactgttgaatacaagaacattagcttcaccgtctgggatgtcgggggtcaggacaagatccgtccattgtggaggcactacttccagaacacgcagggacttatctttgttgtggacagcaacgatcgcgaccgtgttgttgaagccagggacgagcttcacaggatgctcaacgaggatgaattgagggatgcagttctgctgtttttgctaacaagcaagatcttcccaacgctatgaacgctgctgagattactgacaagcttggccttcactctctccgccaacgtcactggtacattcagagcacatgtgccacctctggagaaggactctacgagggacttgactggctctccaacaacatcgcaaacaaggcgtagaagggagatagcgggattcatctttctttgcttgttttgttatatacatcagagtaaggggtctgtttctctagcactacaaaacgaaaccaagtttttattatgttatacattcttcttcgtctgttcttcttcaacaatttagtactttcctttaataaatcataagccttttctttttgcattttctttctgaagtgagtacattcttttcttttaatcagttttttccttgtatccagtttcttcttttgagtaaacagatctttactgtccgataattaatat

SEQ ID NO: 10781 - DNA, 905 bp, Panax ginseng
atctgataggtgttcggtggtggacgacagctccattcgagatctctgattcttttgctcgtatcgctcacctcattatacaaagatggggttgtctttcaccaagcttttcagtcgcctgtttgctaagaaagaaatgcgtattctaatggttggtctcgatgctgctggtaaaaccacaattttgtacaagctcaagttgggagaaatcgtcaccactatccctacaattggctttaatgttgagactgttgagtacaagaacattagtttcactgtgtgggatgttggtggtcaggacaagatccgaccgttgtggaggcactacttccaaaacacacaggggcttattctttgtggttgacagcaatgatcgagaccgtgtggttgaggctaaagatgaactgcacaggatgttgaatgaggatgaattgagagatgctgtgctccttgtgtttgcaaacaagcaggatcttccaaatgccatgaatgctgctgagatcactgacaagcttggtttgcattctcttcgacagcggcactggtatattcagagcacatgtgccacatctggagaaggtctatacgagggactggattggctttcaaacaatattgctaacaaagcttagtggactactctgatggttcagttggtactttatgaagtgtatgggtgtggttgtgtgtgggtataggtgttgctacaattattatttctataattggttttgatgttttggattctctttttccatgttgtgctgcaattacatataggatttattgttcctttttgagttgtaaagctttatgccagattgccagggctctggtggattgctattaaagtagttatacaacaagctactgggtttatatcagttttttatccatttagtatt

SEQ ID NO: 10782 - DNA, 745 bp, Panax ginseng
ttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttggtctcgattgccgctggtaaaacctacaattttgtacaagctcaagttgggtgaaattgtcaccactatccctacaattggctttaatgtggagactgttgaatacaagaacattagcttcactgtgtgggatgttggtggtcaagacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaattt

SEQ ID NO: 10783 - DNA, 932 bp, Pinus taeda
atctcagatctgacccttcaacttgggatatctaacaagtggtcatgattgtacggagacatggactaggactgggaatggggctgacattcatagtatcttcccctcccctttttagttgcagagctaggtgttcgagagacgtctcagatctctttgcgaggagccattcttgttccctcgaatctcagatctaatccttcaactcgggatctctaacaggtggtcaagatgggactcacttttaccaagctttttagtcggctcttcgcaaagaaggaaatgcgcattctgatggttggtctcgatgccgctggtaagacgaccatcttgtataagctgaagctgggagaaatcgttacgaccatccctaccatcggattcaatgtggaaaccgtcgagtacaagaacatcagcttcactgtgtgggatgttggggggtaggacaagatccgtccactatggagacactacttccaaaatactcagggtctcatctttgtggttgatagcaatgatagagaccgtgttgtagaagcaagggatgaactacatagaatgctgaatgaggatgaactacgtgatgctgtattgcttgtgttcgcaaataagcaagatcttccaaatgctatgaatgctgcagagataactgacaaacttgggctgcattcccttaggcagcgccactggtatatccaaagcacttgtgccacttctggcgagggcttgtatgagggcttggattggctctctaacaacattgcaaacaaggcttgaagaaatatggtgaactgggttcctggaattttgtagggcaatgtcgtcttatttcatttttgtcagagacagtttgaagaaataagtgcagtcaaactgacttttgactactattcaatttcttctatgggtttgatattggaattgttatggag

SEQ ID NO: 10784 - DNA, 1442 bp, Rosmarinus officinalis
cggccggggggactactactcagaaaaagaaaatagaaagttataatctttcgcgttgttctgaagcagctccgtatttatccgcgtacctctctaccacctccccagtcccagatctatcgttttttgggacctactcaccttagtagaaaacagaaatgggcctaacttttacaaagctgtttagccggctttttgctaagaaggaaatgcgcattttgatggttggtcttgatgctgctggtaagaccaccattctgtacaagctcaagcttggagagattgtcaccaccattccgaccattggtttcaatgtggagactgtcgaatacaagaacattagcttcactgtgtgggatgtcggggggtcaggacaagatccgcccattgtggaggcactacttccaaaacacacagggtctcagatttgtggtggacagcaatgacagggaccgtgttgttgaggcaagggatgaattgcataggatgttgaatgaggatgagctgagggatgctgtattactcgtatttgcaaacaagcaagatcttcccaatgcaatgaatgctgctgaaattactgacaagcttggcctgcactcactcaggcagcgtcactggtacatccagagcacctgtgctacctctggtgaggggctatatgaagggctggattggctctctaacaatatcgctaacaaggcaaggacttcagattctattaaataaactagtgtttgtgcggacttgatgaccttatttgatcaatttctgactctggttgttacaggcttaaatgttgttgggagttgcttggataatgcgtgcagctgtgtttttcatagccttatactagtctgtgtggaatgatttcgtttcaaattttttggaagttctttttgtaccctgtgaaatggatgtgtaaaactttatgaaattgtttcatatgtttgcggtatactagttctaatgtaatgctatattcattcataaacactattatcaatattgtctgcattcactactcgactaatgagtaacatattcttccggccggtcatcgtatggtgggtataacatcgtttatggttgagttttggcatctttgcttgatatatcaattagaatgatctttgtattgtaagaaggcccaatctcgggctgtctgtaactgtatccttgctcttctttaccttaattcttggtttgtttaattttacatcctatattttaaatgttttgacgtggtttgcagctcaaattggttgaatgcacttggcttatgttgagtttagaagaattttaactaatgtagttgtagtaatcacggtatgcaggggggtagatagatcataccgcactgctctgtgaaatcactgaagaagtgagctgctgcttctgcttctactggctgcttcttgtccgggaaaaccttttttacttgt

SEQ ID NO: 10785 - DNA, 1715 bp, Glycine max
gaaagaacctttactttgaagagagaattaatggcgagtagtgttattccactgttggccatgattattgtacaattgggctatgcagggatgaatattacctcaaagcttgcaatacaatctggcatgcaccctcttgttctcgttgcttatcgccaaatttttgcaactatttcccttgctcccttcgctttttggttagaacggaatacggctccccgaatgacaaagcacattgcgttccagatattactatcttccttaacaggagtaacaggaaatcagattctatacttcttggggcttaaatattcaacccctacaattgcatgtgcactaaacaacttgctaccagcattcacttttattcttgctgtcctctccagacaagagtatttgagaatcaagactagggcaggggtagcgaaggccttagggacagtccttagtgtgggtggagcagtgcttttatcattttaccatggaaaagtacttggtctaggtgaatcaaagattcactggagatatgcagaaaacatgcaaagagaatcctcttcttctggtggtggaagaaaccatcttctgggccctgttgctgtaattgttagtgctcttgtttgggcagtatggttcatagttcaaaaaaacatgagcaagagctatccagctccttacactagcactttctacatgtgtttgatggcaagcattcagtgtgtggtcattgccttggctgctgaacacaatgtctcagcttggtcactccacagtactataagactaacctctgctctttatgcggggactatttctactgcgctagcgtatgtgctccttgcgtggaccattgagaggaaaggtcctctctatgtgtctgtgttctcccctttgctgcttgtcatcattgctgttgctagctgggcttttcttcacgagcaattatacgttggcactgtcatagggtctctgctgatagtgttggggctgtattttgttctgtggggaaagaacaaagagatgaataagatagacgttgttgaagttgaaggcacggtcatggaggcaataaaggatagcgagaaggatgaggtgaaagacctggaattgcaaccctatgaatatgatccttccaacgttaacgagatggggttgtctttcaccaagctttttagccggctctttgccaagaaagagatgcgtattctcatggtaggtcttgatgctgctggtaagactaccatcttgtacaagctcaagctgggagaaattgtcacaaccattcccacaattggatttaatgtggagactgtggaatataagaatattagctttactgtatgggatgtgggtggccaagataagattcgtcctttatggagacactacttccaaaacactcaggggcttatctttgttgtggatagcaatgatcgtgaccgtgttgttgaggctagagatgagctccaccggatgttgaatgaggatgagttgagagatgctgttctcctggtatttgccaacaaacaagatcttccaaatgctatgaatgctgcagaaatcacagacaagcttggtcttcattctcttcgccaacgccactggtatatccagagcacatgtgctacctctggggaaggactatatgaaggactggagtggctctccaacaatatagctaacaaggcttagggacattttgtggaatgccgctattt

SEQ ID NO: 10786 - DNA, 1055 bp, Picea glauca
tcgactgcagcgctaggtgttcgagaggcaccagagatctctttgcggggagccattcttctcccctggaatctcagatctgactcttcaactcgggatctataacaggtggtcaagatggggctcacttttaccaagctttttagccggctcttcgcaaagaaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggataagatccgtcactatggagacactacttccaaaatactcaaggtctcatctttgtggttgatagcaatgacagagatcgtgttgtagaagcaagggatgaactacataggatgctgaatgaggatgaactacgtgatgctgtattacttgtgtttgcaaataagcaggatcttccaaatgctatgaatgctgcagagatcactgataagcttggtctgcattctctgcgacagcgccattggtatattcagagcacttgtgcaacttctggtgaaggactgtatgaaggcttggattggctttcaaacaacattgcaaacaaggcataatgttgaagcatagtaatgatgctgtgatgcctttcagaatgggttggattctgtgctattttgagtattggttggattactttctgcgatgtagtggacgtgtttcatgcttctcctagtaattgaagtagataataggttaaggggggttgaggatctattctgtggtgtactgatccttagtttacttgttttgttgtttgaaattttgcatgtctacaattgtttcataatcaactatgaattcttccagtgggttcctcaggatttcagtgtgcaatttattgccctgtgcccccctctttttgtccttgttttgtggattcaaaagtactgttactgaaattccaaagttacatattcttttgaatttatatatattgcatgttatgc

SEQ ID NO: 10787 - DNA, 713 bp, Picea glauca
gttcatctcaggcctctgcagaaacgaactcttcatcagcggggtctgcgattttacaggatatttgattttctctcaagtttggcaagatggggctcacgttcaccaagctctttcagcgtctgtttgccaagaaggaaatgcgtattctgatggtgggtcttgatgctgccggtaagaccaccattctgtacaagctgaagcttggagaaattgtcaccacaattcccactattggtttcaatgtggagactgtcgagtacaagaatattagcttcactgtttgggatgtcggaggtcaggacaagatccgaccactatggagacattactttcagaatacccagggtcttatatttgtcgtggatagtaatgacagggaccgtgttgttgaagcaagagatgaattgcatagaatgctgaatgaggatgagctacgagatgctgttcttcttgtatttgcaaacaagcaggatcttccccaatgcaatgaatgctgctgagataactgataagcttggcctgcattctttacgtcagcgccattggtatatccagagtacttgtgctacttctggtgaaggactgtatgaaggcttggattggctttctaacaacattgcaaacaaggcataatgttgaagcatagtaatgatgctgtgatgcctttcagaatgggttggattctgtgcattttgagtattggttggata

SEQ ID NO: 10788 - DNA, 1487 bp, Panicum virgatum
cggcactctagccagggcgggccgcctgaagcgtcgtatccaactagcagcccagatcaaaccaaacttgcccacttcccggcccgccgaataaagcgcggctgagattgatcgaatccgcgctacgccacacgcccactagcccattttgtctagcctccatttgggcccatgcctggaagcccccacacgtcagactcacagcggagcgtcccggtcaggagctggctccacctgcccgcagcccgcccgccccgggtcgattcggccgggccccgcgcgagcgcccctcctctctattttatcgcagcccgcctcgggccagccgctcggaccgcacgcagggccgcagccagccacaggctcccgtcgcattcgctcgctcgcgtcgtcgctcccgcctccgccgatccgcgcacgcagatcgccgaagcccggcggcgcaggggcgaaggggagcgaggggagggagggagctcgcgcggcggcggaggaggaaggcgttcgccaccgtctcgaggaagagatggggctctcgttcgggaagctgttcagccgcctcttcgccaagaaggagatgaggatcctcatggtcggccttgatgccgccggtaagaccaccatcctctacaagctcaagctcggcgagatcgtcaccaccatccccaccatcggattcaatgttgaaactgtagagtacaagaacattagcttcactgtttgggatgttggtggccaggacaagatcaggcccctgtggaggcactacttccagaacacgcagggtctcatttttgttgtggacagcaatgacagggagcgtgttgttgaggctagggatgagctccacaggatgctgaatgaggatgagctgcgtgatgctgtgctgcttgtgtttgcaaacaaacaagatcttcctaatgctatgaatgctgctgaaattactgacaagcttggcctgcattccctgcgccagcggcactgtacatccagagcacttgtgctacatctggtgaagggttgtacgaggggcttgattggctttccaacaacatcgccaacaaggcttgaagcttttcggcagggctcccaggaagaggaagatgtctgaacaacttattgctgccttattacatattataagattatacaatctacaatagatagtgtgggtgtttgtgaagaaaaagaaactagttctcttttgaggtgctagtgccagatttggttatgtttttgcttttggctcggtattatcgcctgtccagtttcacaaaactgactctgtcaatcatgtgtacttatgctcggagatgtgtggtaaattaaatttacatgctttgccatagatctttgccgatacattgctatgtcagatgtggattgctcgattttttttgttggattacatatccgagatgctttgctcacattgccgctcactgctgcatcttggtgggtatgtaccgcaaacatcctgttctttt

SEQ ID NO: 10789 - DNA, 865 bp, Camellia sinensis
ggggaaaggatgaacaacaatttggccaggtcataatagcagcggagagggttgtttctctctctaactctatctccgccttcttccattcgatctttctgcgaagctttcgagagtgcccagtgacaggccatagactaaacgacaaagagatggggttgacctttacgaagttgttcagcaggctctttgccaagaaagagatgcgaattcttatggtaggtcttgatgccgctggtaagactaccatcttatacaaactcaagcttggagaaatgtcacgacaatccctaccataggatttaacgtggagacagtggagtacaagaacattagcttcactgtttgggacgttggtggtcaggacaagattcgcccattgtggaggcattacttccagaacacacagggtcttatatttgtggtggatagcaatgatagggatcgagttgttgaggcaagggacgagttgcataggatgttgaatgaggatgagttgagagatgctgtcttgcttgtgtttgctaacaaacaagatcttcctaatgcaatgaatgcagcagaaataactgacaagcttggtcttcattcactccgacaacggcactggtacatccagagcacatgtgcgacttctggagaaggctttatgaagggctggattggctttccaacaacattgctagcaaggcatgaatgagtatgtcaaggattttgggtgctggtgctgctggaattttttgttgatgcatgattagatgccatctgggattttcataagatattggcaattcctagagacaaaatacttttatcttgaatacttgggtgatggaattgtaatggcagagatgatttgcttgat

SEQ ID NO: 10790 - DNA, 896 bp, Triphysaria pusilla
attcgcatcagcctcaggcacctccatatttctctctttccaaaaccagcaacaacactctcaacattttaccaaatctatcgttctcaggtataagaaacaatggggttgacttttaccaagcttttcagtcggcttttgcaaagaaggagatgcgtattctgatggtaggtcttgatgcagctggtaagacgacaattttgtacaagctcaagctcggagagattgtcactaccattcctactattggcttcaacgtggagactgttgagtacaagaacatcagcttcactgtttgggatgttgggggtcaagacaagatccgtccattgtggaggcactactttcagaacacccagggtctcatattcgtggtggatagcaatgacagggaccgtgtcgttgaagccagggatgaattacataggatgttgaacgaggatgagctgagagatgcagtattacttgtgtttgcaaacaaacaagatcttcctaatgcgatgaatgctgctgaaataactgataagctcggcctacactcactcaggcagcgccactggtacattcagagcacctgtgctacctccggtgagggtctctacgagggactggattggctctccaacaacattgctaacaaggcttaaagtgcttcatggagctgttgaagtgagctgatgcaaaatgcaggcgagtttttatctagtattacacctcttttctggcttatatatacataagaatttgttggcgttgtgcttttacgtttaggacctttgtattggctgtatagcagacaattgtttgtttcctatatttgcaatcatttgcttattttttatactttttcttattgtaatacacagtgattaagactatggtgggtattgaatttt

SEQ ID NO: 10791 - DNA, 915 bp, Valeriana officinalis
tagggttcccctctttctttgttgtgtcctcctttcagagatctgcttgtagggggagatctctgctttgcttcttgcaattcatcaggagaaacaaagatggggctttcattcacgaagttgttcagtcggctgtttgccaaaaaggagatgcgaatactgatggtgggtctcgatgcggctggtaaaaccactattttgataagctcaaactcggagagattgtcaccaccattcctaccataggatttaatgtggagactgtggagtacaagaacatcagcttcactgtttgggatgttggaggccaggacaagatccgtcctttgtggagacattacttccaaaacactcagggactcatctttgtcgttgatagcaatgatcgagatcgtgtggttgaagctagggatgagctccaccgaatgttgaacgaggatgaattgagagatgcggtgctgctggtattcgccaacaaacaagatcttcctaatgcaatgaatgctgctgagataaccgataaactcggtcttcattctctccgccaacgccactggtacattcagagcacctgtgctacttctggtgaaggcttgtacgagggcctcgactggctctctaacaatattgcaaacaaggcataataagcgcgactgctgatataaatgagatcggaaagagaagagcagcagctgcggatagagtatttgaatttctttattgtttcggaatgtgtaccctttgttaattttcttgttacttgatgctgagttttgcttttatatgtttttatgtaaattcagaatttaatccataaatgtgttgttatgtttgttttcattcaaaatgtgttgattatacatctatatttcatatacacaattcattatataataaattaagaactaacagtta

SEQ ID NO: 10792 - DNA, 961 bp, Avena sativa
acccgcacgacagccacaccctcccgttgcatccgtgcgagttccaagctcgccccgtctccgccgagatcaggagacgagcccagcagcggagcggagcgagctcgaagccgtcgtcgccacctcgagcaggagcagagatggggctcacgttcggcaagctgttcagccgcctcttcgccaagaaggagatgaggattctcatggttggtctcgatgcggctggtaagaccaccatcctctacaagctcaagctcggagagatcgtcaccaccatcccaaccatcggatttaacgtcgagactgtcgaatacaagaacatcagcttcactgtctgggatgtggggggtcaagacaagatcaggcccctgtggaggcactacttccagaatacgcagggcctcatctttgttgttgacagcaatgatagggagcgtgttgttgaggctagagacgagctccacaggatgctgaatgaggatgagctacgtgacgctgtgttgcttgtatttgcaaacaaacaagatcttcctaatgccatgaatgcggctgaaatcactgacaagcttggtctgcactccctgcgccagcggcactggtacattcagagcacttgtgctacatctggtgagggattgtacgagggacttgactggctctccaacaacattgccaacaaaggcttgaagcgtctcagacaacgcctcaaggaacaaaggcactcgtggtctcaagaactcactgctaccattttacattttgtgatatatatatacactctacaacagatagtatgtgtccttatgtgaggacaaaagctctcctttgggtgggctagtatcagattgtttcttcgtgtgggtattatcagtgtttctgttcgattttacaaggtttactgtgtcaaccatgtgtatgtacccctatgttttcgagatatagtaaaattgcggtgtcgttg

SEQ ID NO: 10793 - DNA, 812 bp, Ambrosia trifida
ctacctcccgtgtgtctcggtcgggtactcacgacgacgacggaccgaccgtaagtactaacgaccgacgagtaacgtaccgggacggtaccgtatacctcccttccttcctaaacaaaaaacctaaacctactctctctctctctcagggatcgtcatcagaaaaaggatggggctcacatttaccaaactcttcagccggctctttgccaagaaagagatgcgaatactgatgtgggtctcgatgcagctggtaagacgactattttgtacaagctcaagctcggggagattgtgactaccattcctaccattggttttaacgtcgaaactgttgagtacaaaaacatcagcttcactgtgtgggatgtggggggtcaggacaagatccgtccactatggaggcactacttccagaacacacagggtcttatctttgtggttgatagcaatgatagggatagagttgttgaggcaagagatgagttgcacaggatgttgaacgaggatgagttaagggatgcggttcttcttgtcttcgccaacaaacaagatctgcctaatgcaatgaatgctgctgaaatcactgataagcttggccttcactctctccgacagcgccactggtacatccagagcacctgtgccacatctggggaaggactttacgaggggctggactggctctccaacaacattgctaacaaggcatgaggtgatgattgacttgttcttccctgaggttatggaattaagtttgtttgttaaacaggcatttgatttgatatatataggacattgtgtgatacagt

SEQ ID NO: 10794 - DNA, 1310 bp, Cannabis sativa
ttgatccaaaagggccgaaacggcatccattaatgtgcaataaaacgacgtcgtttgcatacaacaccaatcggattttaaccgccagagaaagaattgggggagttcactttaaaaaatcgtggcctctgttcctcatttctttttcttctgttccttcttctccacccagaatttagagctaagaaaagggtgaacatacagaacatacacattcagaaatggggctgacattcacgaagctcttcagcaggctctttgccaagaaagagatgcgaattctgatggtgggtcttgatgccgctggtaagaccaccatcttgtacaagctcaagcttggagaaatcgttaccaccatccccactattgtaatgtagagacagtagagtacaagaacattagcttcacagtttgggatgttgggggtcaggacaagatccgcccactgtggaggcactatttccagaatactcaaggtcttatttttgttgttgatagcaatgatagggatcgagttgttgaggcaagagatgagttgcaccgaatgttgaatgaggatgaactgagagatgctgttctgctcgtatttgccaacaaacaagatcttcctaatgcaatgaatgctgcagaaataacagacaagcttggtctccattctcttcgccaacgccattggtacatccagagtacatgtgcaacctctggggaaggtctttacgaagggttggactggctctccaataacattgctagcaaggcataaggtttgagacagttctaagattttcgtgttttgccagccacctatgggaaggatggttttctttaattaagtgaatattgtaatagcagacagtttggctaaactttggattatgtaattcaagttcaggttttataaccatcacctttagctttactttttacttgtttagttgtaagcaaaagctgctattttataatggaattatgtgagtcgtgttcaggacaaggtacaagttcatcttgtttactcttttcatgcctgtttgcttttaaattgtttgaggctgtaaaatttctacacataggctactatctctctccttgaattataaggttctgaactgtggtgtatgcgagctttcatacataccaataatttgacataagaaggggtttgaatttctgattctcccacagattaaaccataaattttggtttgctaaaacgcagcaatatatgtttctatgtgtgattaacttctcgagtctttttcccaaataaagtttcggagaccgatagtgagcaaatgcaaactgtgttcaat

SEQ ID NO: 10795 - DNA, 1001 bp, Citrus clementina
cgcaaaccattttgaattcgacaaagctctttcttttgacttgaccatcaacggcaaaatctaaatccatcacaagttaattaacaacagagatgggattgacgttcacgaagctgtttagtcggttatttgcgaagaaggagatgcgaattctgatggtgggtctcgacgccgccggtaagaccactattttgtacaagcttaagctcggtgagatcgtcaccaccatccctacaatcggttttaatgtggagacggttgaatacaagaacattagcttcacggtttgggatgtcggaggtcaggacaagatccgtccattgtggaggcactattttcagaacactcaggcctcatttttgtggtggatagcaatgacagggatagagtagtgagggcaagggatgagttgcaccgaatgttgaatgaggatgaattgagggatgctgttctgcttgtatttgctaacaaacaagatcttccgaatgcaatgaatgctgcagaaataactgacaagctcggtcttcattctcttcgccagcgacactggtatatccagagcacatgtgcaacctctggagagggtctttacgaagggttggattggctttccaacaacatcgctagcaaggcttgaatgaagcagtgaagattctggctcctcttttagatttcgttatggcttatacctattctaggtattctgaagaagatagtttcccttttgttcagtcacttctataacagcataatgtttgttgaaaatctactgctatgtgaagtatggattttgtataatcctacataactattaagatgatgatgcatctgttcggaaatggttgtttcgataccatggcttcacataagtgtcgttttgataggcatataattttgtaagttcttattaattttgctgccatttgaattcgacactttgaaatttctgacccctcttcggctcgccataagaggtctcgaacttcagaatgaatcactca

SEQ ID NO: 10796 - DNA, 784 bp, Lippia dulcis
ccttccgaaaattgttattagcatctcgcgttgttctgaggcagctccacatttctctctcgcgcgagcaggaacatactttctctctctagcgcgtctaccaaatctatcgttccaagagatcaaaagcaagaaagggaaatggggttgacattcacaaagctttttagccggctttttgccaagaaggagatgcgtattttgatggttggtctcgatgcggctggtaagaccaccatcctgtacaagctcaagctcggagagattgttactaccattcctaccattggcttcaatgtggagactgtcgaatacaagaacattagcttcacagtgtgggatgttgggggtcgaggacaagatccgcccattgtggaggcactacttccagaacactcagggtctcatctttgtggttgatagcaacgacagggatcgtgttgtggaggcaagggatgaattgcataggatgctgaatgaggatgagctgagagatgctgtattacttgtatttgcaaacaaacaagatcttcccaatgcaatgaatgctgctgaaatcactgacaagcttggcctacactcgctcaggcagcgccactggtacattcagagcacgtgtgccacctctggtgaggggctctatgagggactggactggctctccaacaacattgctaacaaggcttagagctgttctggaggtgtttacgcaagagctaatactggaaactgtcgaggttttatctagctttttcttaaccatatattgctttgaaactatgtt

SEQ ID NO: 10797 - DNA, 2793 bp, Ananas comosus
cgtgtgctcttaatcttcttacaaggccttgatgtctaaagacgtgagaaacaggaattgctggcttaagatttgtttcggcatataaattttcagaaaaggaggagaaaatggcaaccaaaaggggcagtcgaggtgagagcatcagcaagctccaagaacatccttataatgggaggcaccagattcattggtgtgttcttgtccaggctccttgtcaaagaaggacaccaggttacattatttactagagggaagacacccataacccaacaattaccgggggaatctgaccaagactatgccgatttctcatccaaaatactgcatttaaaaggggataggcaagactttgaatttgtcaagacaaaccttgcagctaagggattcgatgttgtttacgacattaatgggcgtgacgctgctgaggtagagcctatattggatggcttgcccaagctagaacagtacatatattgctcttcagctggagtgtatcttaagtccgatattctgccgcactttgagactgatgcagttgatccaaagagtaggcacaaaggaaagctcgagactgagaacttgctggactctcgcggtgtgaattggacctctcttcggccggtttacatttatgggcccttgaattacaatcctgtagaagaatggttcttccatagattgaaagccggacgaccaattccgatccccaattcaggaaatcaattaacccagcttgggcatgttaaggatttagcgagggctttcgtgattgttcttggcaactcaaaagcaagcaggcaagtctacaacatctctggatcaaagtatgtcacctttgatggcttagcaaaggcatgtgcaaaggccgcgggttttccggaaccagaaatcgttcactataaccctaaagaatttgattttgggaagaagaaagctttcccattccgagatcagcatttctttgcatcgattgagaaagctacaaaggaattaggttggaccccagaatttgggttgatcgatggccttgcggattcatacaacctcgactttggccggggaacgtaccggaaggaagctgacttctccacagatgatataatcctcaacaagaaactggtccttacataagatagtttttctttgtaaattttggcatcagatcaaggccatatatatcgttcattcaaacaagttacacagccttgtaatttttcgcaaggaccagcattgaattggccaccaaggtacctaaacttccagttcacagttaattaaagcacatcggacaatccacctttgaggttgataatttaggcaccagcattaacattttaaggcaactaaatatggtcttcaaataaatttcaatacagcacaaataataccatcatctagcagaacaagttccagcttattcatgttctaaccagcggcaattttttgagtctataaaagtaaaaagtacaagaggatctaatgctcgatattgatacagctctctcactctctccaaagataatggatttcattagcaaaagaaacatgacaagcaagaagaatccttttgagtaacatctaagccttgttagcaatgttgttggagagccagtccaacccctcatacagaccttctccagatgtagcacatgtgctctgaatgtaccaatggcgttggcggagggaatgaaggccaagcttatcagtgatttcagcagcattcatggcatttgggaggtcttgtttgttcgcaaacacaagcagcacagcatctctcaactcatcctcattaagcatcctatggagttcatctctagcttcaacaatacggtccctgtcattgctgtcgaccacaaagatcaggccttgagtgttctggaagtaatgcctccacaaaggtcgaatcttgtcttggccaccaacatcccaaacagtgaagctaatgttcttgtattccacagtttcaacattgaatccaatggttggaatcgtggtcacaatttcccccagcttcaatttgtacagaatagtggtcttaccagcggcatcaagacccaccataagaatcctcatctccttcttggcaaaaagccggctgaataacttggtgaaggacagccccatctcgacaactatcaatttgagacaattgaacccacttcaaacaggtgcaacattaacagcattatcatgttaaagatgttaaagatgcttcaagggaccaaaactagataatttcattacggcctctcattcaactctcaagattggatggatctcaaaaaagaatgatattaaaccaagaactattatgttgaatttttcaccttgcaaacatctcaagttgcgcaattttagtttactttccatgacaatgtatccttctatccccccccccccccccccccccccccccccccccccccccccccccccccccccccccccccccccccccccccccgtgacatcatcatagcatgccatcagggacaacaggaagagaacttgtacaacatcaattgggacgacaaggccgacatggcatcttatttcagaaagtagactaataggacttaatgttacccaaaacagccaccggggccagatagttgcaattgaaacttcaaaaatgcaattaaaatcagatcaaacttcaatgacttaattcataatgaaccacacaatgcaggagacagaaaggttttactaacaatccgaggatctggtgctcgctacagataatataagtaatcgcgcccagacgaggcttacaagaaaatggaggag

SEQ ID NO: 10798 - DNA, 2178 bp, Primula obconica
ctctctctctttctctctctagatccctctgcatagaaccttcttacagggttcaaccaacaggaaagagacatgggattgacgttcaccaagcttttcagtcggctgtttgccaaaaaggagatgcgtatcctgatggtaggtcttgatgcggctggtaagaccaccattctctacaagctcaagctcggtgagattgtgaccacaatccctactatcggatttaatgtcgaaactgtagagtacaagaacattagctttaccgtgtgggatgtcggaggtcaggacaagatccgtccattgtggaggcactatttccagaacactcagggtcttatttttgtggtggatagcaatgacagagaccgtgttgttgaggcaagagatgagttgcaccgcatgttgaatgaggatgagttgcgagatgcagtactgctggtctttgctaacaaacaagatcttcccaatgctatgaacgctgctgaataacagacaagcttggtctccactctcttcgacagcgccactggtacatccagagcacttgtgcaacatctggcgagggtctgtatgaggggttggattggctctccaacaacatagctaataaggcttgagtacggtgattcatcctgtgggagtaacactggatatgcagctttcttatctagtctgtttcgttcccttatatttcttgtccgaaaatttgttgttatcgatttaattttgtaagtgtttttttctgattaagaattttgcggctctctattacaatggggtttgttgaaatcatgatgcaccatcaaaattctgcagatttgactatgaatgcatgtgatatgtagtacctttgtttttttgtgctatcgatatggttaaatgattttcatttccaggattttttttcaagttacaagaagtataggaattacattaaagcaccaaatcgtttacaacgcatacggcactaccccaaataactacgaaaccaacaacttcacacagagagacacacaagtattccaccccacgaggcacctactactcccaacaacgttacggatcagtagcagcaaatcgcccgattagtttgttatcttattaacataaaaagtagtacaaacatagacacatatacttgatactattaatatgaaactttggcgatttcaatacttgtggtcttgaactttattgtgaagggattaacaggtgcaagggttgcacttgcagttatcaccgcacttgcacccatttcctccttcagctccgaaactattctcagccccatcggaatacatcccattacggccgaaaatcaacccaaatttgctccacacataaacacacacagatacacatatttatacatatatatatatagagagagtgataagcgaattgagctaaaacatgagtacagcagccttagaagacgagttagctcaaattaccgaacaattcagctccaacctaaagatcgaatctccaccgtcggatgaagaaccgatcgaatccccaccgtccgatgccgaaaccgaagaattctcgttctcctccgcacgtttcgaatccgtctcggccgacgacgtgttcaccgacggccagatctttcccatcttcggccaaagcccgccgccggtgaaaaccatcatggtggaaactccggcgggaaactaccgcgagttcgccggaaaaccggtcggagactcgccggagacctgcgaaaagagcaactcgaccggattctcgaacatgtggagatttaaggaaatgggtcaccggagtaacagcgacgggagggacgcattcgtgtttatgaagagagagaaagctccggcgaaggggcaaaagggtaatattagtaaaaaggggaagggtaaaacggcggcgttttcggatcattatgtggagagtagagaaaggagagagaaagataagatgcggacgtacctaccgtataagcctgggtttttcgggatttttacaagcttacatggcggactcaccaaaaatgttcacccgtattaaataaaagcattagatttcaattatttgagtttatgatgttaatactcttattagcgtttgggtttttttttttaaatgagtatatagattaaaaccaagtcaaaagaaagtgacaaccatgactaggagtatctccacacaatgttg

SEQ ID NO: 10799 - DNA, 904 bp, Centaurea maculosa
tcaaatcgatcgattcatccatctccaacaagctttttcgtcagggttcctcaccaacaagaggaggatggggttaactttctaccaaactattcagccggctttttgccaagaaagagatgcgtatattgatggtgggtctcgatgcggctggtaagacaaccattttgtacaagctcaagctcggcgagattgtgaccacgatcccaaccataggttttaatgtggagactgttgagtacaaaaacattagcttcacagtgtgggacttgggggtcaggacaagattcgtccactatggaggcattatttccagaacacacagggacttatctttgtggtcgatagcaatgacagggacagagttgttgaggcaagagatgaattgcacaggatgttgaatgaggatgagttaagagatgcagttcttcttgtgtttgctaacaaacaagatctcccaaatgcaatgaatgctgctgaaatcactgataagctcggcctccactccctccgacagcgccactggtacatccagagcacctgtgccacctccggggaaggactttatgaggggttggactggctttccaacaacattgcaaacaaggcataaggtgacaattgaatttgtattttgagggtggattctggaggcaagttttgctttatttggtgtagccactttttcctgttctcgttcttcatcgtctgaggtgcaagtgggtattaaaaactttgttgcttaaaaaaaagggttttttgcatttgataatataggacatcatgtatgatacaacgtttggttgggttgcaagtatttttaaaaaggtatgatgtgtcttcttcttcttcttgtttgtaggttttgattcatgtaacctaatgttgcaagacagatttatta

SEQ ID NO: 10800 - DNA, 914 bp, Chenopodium quinoa
ccccccccccctatcccctgtgtgccttagcctcccacgaccgttagctttaaaaaaaaaaaaacttgataaacgggcagcttattcaagatctgcccgccgtcccttgttcaagccctagctcaattttctctctctactttatttgaaggaaaaatggggctttcattcacaaagctgttcagtaggttatttgcgaagaaagagatgagaatattgatggtgggtctcgatgcggctggtaagaccaccattttgtataagctcaagctgggtgagatagttaccaccattcctaccattggattcaatgttgagaccgtggaatacaaaaacattagctttacagtgtgggatgttggaggtcaggacaagattcgacctttgtggagacattatttccaaaacacccaaggactcatctttgtggtggatagcaatgatcgtgatcgtgtggttgaggcaagggatgagctgcataggatgttgaatgaggatgagttgaggatgccgtccttttggtctttgccaacaagcaagatcttccaaatgcaatgactgctgcggagattactgataagcttggtctccattcccttcgtcagcgtcactggtatatccagagcacatgcgccacttctggtgaaggtctttacgagggattggactggctgtccaacaacattgccagcaaggcctagatgaaggatctgcctggctgagcttaggatgattatatggtggattttgaagcacctgtttatgtgggagataatattgagcttttggcctttgttttttgtttgctatgttaaaaaagatcacaagagtggttgtgttaatgtgattatgcttatgaaggttttgttatgatcatagaaattgctatatgatatcaatacttttgtagattc

SEQ ID NO: 10801 - DNA, 813 bp, Triphysaria pusilla
caacatttgtgtctcccaggcagcctctctctctctctctcagcaaaatctgcccttctaatcttcattcttcttaaatccccgattccaatcgccaagagaaaaatggggttgtctttcaccaagcttttcagccgtctgtttgccaagaaagaaatgcgaattcttatggtaggtctcgatgctgctggtaagaccaccatattatacaaactcaagcttggagagattgtcacaaccattcctactattggatttaatgtggaaacagtggaatacaagaacattagcttcactgtctgggatgttgggggtcaagacaagattcgaccattgtggagacattactttcagtaacactcaagggttgataatttgtggttgatagtaatgatcgtgatcgtgttgttgaggctagggatgagctccacaggatgttaaacgaggatgaactgagggatgcagtgcttcttgtatttgcaaacaaacaagatctcccaaatgctatgaatgctgctgagataaccgacaagcttggacttcactctctccgtcaacgccattggtatatccagagcacatgtgctacatctggggaagggctgtacgaggggctcgactggctctccaacaacattgctaacaagggataaacaatgatgtttgaagaatttaggtatctcgatgcttgttggaatcaattaaagcatgtttggaatcagttttccgataaactttgaagaatgaagagtccatttagttttttttggagatgtttgatgacttttatatcaatgctcttgaaataatcac

SEQ ID NO: 10802 - DNA, 690 bp, Eschscholzia californica
ccgaagctcttcgaaagtttggaggattcacagttaaagagagatggggctgacattcacaaagctttttagtcggctttttgccaagaaagagatgcgtatcttgatggttggtcttgatgcagctggtaaaaccactattttgtacaagctcaaacttggagagattgtcaccacaattcccacaattggatttaatgtggagacagtcgaatacaagaacatcagcttcaccgtttgggatgtcgggggtcaggacaagatccgtccattgtggagacactatttccaaaacacacaaggtttaattttgtagtcgatagcaatgacagagaccgtgttgtagaagcaagggatgagttgcacaggatgttgaatgaggatgagttacgagatgccgtgttgctcgtatttgctaacaaacaggatcttcctaatgcaatgaatgcagctgagataactgacaagcttggtcttcactctctccgacaacgccactggtacatccagagtacatgtgcaacatctggtgagggtctctacgagggtttggattggctttcgaacaacatagcaaacaaggcttgatgcaattaaatatccgagttttgagctcttcttcaggttcgaagatatacagcgtcaacgggtgtggtaggttatttcagtaggcgaaaggtttcatcttct

SEQ ID NO: 10803 - DNA, 748 bp, Fagus grandifolia
ctctagtctgattcaatctctcaggggcagcttctctcagatctgcccaatcccttttcacatcttcaccatcttgagataaaagatggggctgtctttcaccaagcttttcagccggcttttgccaaaaaggagatgcgtattctaatggtgggtctcgatgcggctggtaagaccaccattttgtacaagctcaagctgggagagattgtcacaaccattccgaccattggtttcaatgtggagactgtggaatataagaacattagcttcactgtctgggatgttgggggccaggacaagattcgacctttgtggagacattacttccaaaacactcaggggcttatctttgtggttgatagcaatgaccgtgaccgtgtggttgaggctagggatgagctgcatcggatgttgaatgaggatgaattgagggaagccgtgctgcttgtatttgcaaacaagcaagatctaccaaatgccatgaatgctgctgaaataactgataagcttggtcttcactccctccgtcaacgccactggtatatccagagcacatgtgccacttcgtggggaagggctgtatgagggattagactggctttccaacaatattgctaacaaggcttaggggatcagtaaatcttcagtaaactgttttgggctgcaatctctgttgaaggagattttactgttgttatgtggtgtttatgtcgttttacattgatactgtcttgagaaagtatct

SEQ ID NO: 10804 - DNA, 917 bp, Cucurbita pepo
gcgattgattgcgaaggtcagcttctctcgtgtgcaggagagagagagagagatctatcgttctatcgttctatttggggccgatctctctaatccgaactcttcaagtccctttacttgaaaaatggggctgtctttcaccaagcttttcagccggctctttgccaagaaggagatgcgaattctcatggtgggtctcgacgcagctggtaagacaacgatcctttacaagctcaagctgggagaaattgtcaccaccattcctaccattggttttaatgttgagactgtggaatacaagaacatcagcttcaccgtctgggatgttggggtcaagacaagatccgaccattgtggaggcactatttccaaaacacccaaggacttatttttgtggtggatagcaacgacagggaccgtgttgttgaagctagggatgagctgcacagaatgttgaatgaggatgagctgagggatgcagtgcttttggtatttgccaacaagcaagatcttcccaatgccatgaatgctgctgagatcaccgataagcttggtcttcactccctccgacaacgtcactggtacatccagagcacatgtgccacatccggtgaagggttgtatgaaggacttgactggctctcaaacaatattgccaacaagggatagatgggtttcatttgaagtgggattgcttctggaaattgaaatgaaagtcattttgttggttgcagtccctgtgatctataaggatgttccgggtggatgattcctaggttgggtttgaattctgaataatgaaagaatttttgaagtattttgtggtgttatcgactcaatagcattgttttatgtaatgaattaatgatgcttcctaaatagatgtggatgtatttgtacgagaatcatgtttgcta

SEQ ID NO: 10805 - DNA, 951 bp, Fagopyrum esculentum
caaatccctttcacttctcagatctaatctcgtcctctctcgctctcttccgcacttctccaccagctcattggtaaggcaaaatggggttgtctttcaccaagctcttcagcaggttattctctaagaaagagatgcgtatacttatggtaggtctcgatgcagctggtaagactaccatcttgtacaagctcaagttaggtgaaattgtcacaaccattccaaccattgggtttaatgtcgagactgtggaatacaagaacatcagcttcactgtttgggatgttgggggtcaagacaagatccggccattgtggagacattacttccaaaacacccaaggacttattttgtggttgatagtaatgatcgtgaccgtgttgttgaagctagggatgaactccacagaatgctgaatgaggatgaattgagggatgctgttctgcttgtatttgccaacaaacaagatcttcccaatgccatgaatgccgctgagatcacagacaaacttggcctccactctcttcgtcaacgacactggtacattcagagcacatgtgccacttctggtgaaggactttatgagggtctagactggctctcaaacaacattgccagcaagtcatagaaggtcacattttgagctgtgggctattccctttacatcaaagacctcaaatatggattcttctatggtacccttgtcttcagaaattggtgaatcttttgcaatttgtgtctgatttttctttacatacataccaaatttgttcatttttttatagttgaatattttcatcaagcttagactctgttatcacttatcagtaacttccagtgtattcttttgttgtttagcattgcgagaaagctctgtatcttagggctacacttcttttcctgtcattgttggataccgttgcttttcttccatcctctcgccttctcttc

SEQ ID NO: 10806 - DNA, 832 bp, Fraxinus spp
aaaaattattaatttctcgcgttaatcttagccagttcccttactgcctctctcaccagatccatatctcagggatcaaaagctagaaagggagatggggctgacattcacgaagctgttcagccggctttttgccaagaaggaaatgcgcattctgatggttggtcttgatgctgctggtaagaccaccatcctgtacaagcttaagctcggagagatcgtaactaccattcctaccatcggttttaatgtggagactgttgagtacaagaacatcagcttcactgtttgggatgtcgtggtctggacaagatccgtccattgtggaggcactacttccaaaacactcaggggctcatatttgtggtggacagcaatgacagggatcgtgttgtggaggcaagggatgaattgcacaggatgttgaatgaggatgagctgagagatgctgtattacttgtatttgccaacaaacaagatcttcccaatgcaatgaatgctgctgaaataacagacaagcttggcttgcactcgctgaggcagcgtcactggtacatccagagtacctgtgctaccacaggagaggggctttatgagggtctcgactggctctcaaaaaacattgctaacacggcataatgctttatggaattgttgagttgaagccccgatgcaagttggtttttatctagtcttatacctatagtttgtgtaatagattttaatacgacacttttggtttttgtttaggacgacttatgctatatcacattttatatgattgcaaacatatgtttacttgtataatgctattgaaacctcatctgatttt

SEQ ID NO: 10807 - DNA, 827 bp, Panax ginseng
cggttttttggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaacccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgtgttgacagcaatgatcgagaccgtgtggttgaggctagagatgaactgcacaggatgttgaatgaggatgaactgagagatcgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagagaggaaaaagatgatgttaaaattccctttgacttatctgcttaataatatacatagtattacaa

SEQ ID NO: 10808 - DNA, 875 bp, Phalaenopsis aphrodite
cgaacgagtgaagacagggaggagaagcggagaaagctcgaaggcagaggagacggaccggctcctcacctttgctctttgatcaaccgactgatttaagaagccccagagaaaagatggggctgacatttacgaagctcttcagccggctttttgccaagaaggaaatgaggattctcatggttgggcttgatgctgctggtaagacgacaattctttacaagcttaagctcggagagatcgtcactaccattcctaccattggattcaatgtcgagactgtagagtacaagaacattagcttcactgtctgggatgttgggggtcaggacaagatccgaccattgtggaggcactatttccaaaatacccaaggccttatcttcgttgtagatagcaatgacagagatcgtgttattgaggcaagagacgagctccatagaatgcttaatgaggatgagcttcgagatgctgttcttctcgtgtttgacaaacaaacaagatctaccaaatgcaatgaatgctgctgaaatcactgataaacttaggtcttcattcccttcgtcagcgacattggtacatccagagtacctgtgccacttccggtgagggactgtatgaggggcttgattggctctctagcaacattgccaacaagggttaaagcttctgcgagatgtctagatggagaaacggggtgggagggttgtgtctctaaaattgtgtttgagtttggtggtgagtgttaagtctcggattattgaacttggtaaatggtttttgttaaatgcgcatggtgtctttctaaatttgtactcctatggcactaaaaaaaaggcttcagtttgctcaagtaaaaatctatatattttccc

SEQ ID NO: 10809 - DNA, 1029 bp, Rosmarinus officinalis
cggccgggggcctccgaaaattgttattagtatctcgcgttgttctcaggcagctccacatttctctctctggcaccagcagggacatcctttctctctctagcgttcgcaccaaatctatcgttccaagagatcaaaagcaagaaagggaaatggggttgacattcacaaagctttttagccggctttttgccaagaaggagatacgcattttgatggttggtcttgatgctgctggtaagaccaccatcgtgtacaagctcaagctcggagagattgttaccactattcctaccattggcttcaatgtggagactgtcgaatacaagaacattagcttcaccgtttgggatgtcgggggtcaagacaagatccgcccattgtggaggcactacttccagaacactcagggtctcatattcgtggtggatagcaatgatagggaccgtgttgtggaggcaagggatgaactgcataggatgttaaatgaggacgagctgagagatgctgtattacttgtatttgcaaacaaacaagatctgcctaatgcaatgaacgctgctgaaatcactgacaagctgggcctacactctctcaggcagcgccactggtacatccagagcacttgtgccacctccggtgaggggctctatgagggactcgactggctctccaacaacattgctaacaaggcttgaagcttttctggagttgtttatgcgagagctaatgctggacactgtcgaggttttatctagttttttcttaactatatattgctttgaaacaatgttgttttttcatttatgtttaggacttccaaaatgtcgctatatcagacaatggtttgttttatatgttttcctacatttgtgtagttttgaatgtaatattcagacacagagactagggttttgcattattatctttcgcttctctctctacttggtgaactgcttgatctccacgactagctaaagcgcagaaaacactcagctctattatatctccacaattttttcttcattg

SEQ ID NO: 10810 - DNA, 1110 bp, Picea glauca
ttcacatgcaacgccataactgtagcagactcatgtaaccacagtcaaccgtccgactggcaagcgaacgaagctatttcttcccatttcttcctcgatattctgccctccttctcgactgcagcgctaggtgttcgagaggcaccagagatctctttgcggggagccattcttctcccctggaatctcagatctgactcttcaactcgggatctctaacaggtggtcaagatggggctcacttttaccaagctttttagccggctcttcgcaaagaaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttggggtcaggataagatccgtccactatggagacattacttccagaatactcagggtctaatatttgtggttgacagcaatgatagagaccgtgtagttgaggctagaggtgaattgcaccggatgctgaatgaggatgaactacgtgatgctgtcttacttgtattcgcaaacaagcaagatcttccaaatgctatgaatgccgcagagatcactgataagcttggtctgcattctctgcgacagcgccattggtatattcagagcacttgtgcaacttctggtgaaggcctttatgaaggcttggattggctttcaaacaacattgccaacaaggcataatttggaatgcgtctaatatctatattgggcacgaagtttattagccatgaagtagattccttcagaattacaatgatcgacagctaccggcatggattttttaaagaagaccttgactctattcattttcttgatagcttgattgctatgtattttacaactagtcattattgtgtgagaatctgggatttttctgtctgccagttgtgctatattgactatattagctctgctacacatctaactattatcttttgattgagaagacttgtataattaaattttagtggattgtaaggcttttctatgttcaataggacaatataatgctgac

SEQ ID NO: 10811 - DNA, 749 bp, Camellia sinensis
taaccccataaatattgcgcgtggtctcaggcttttctctctctctagatccctctgcaaaaagcttccgctagggatccaccatcagaaagacaaatggggttgacgttcaccaaacttttcagccggctttttgccaagaaagagatgcgtatccttatggttggtttggatgccgctggtaagaccaccattttgtacaagctgaagcttggagagattgtgaccacaatccccaccattggttttaatgttgaaaccgtagagtacaaaaatatcagcttcactgtgtgggatgttggtggccaggacaagattcgtccattgtggaggcactatttccagaacacacagggtctcatttttgtggtggatagcaatgacagagaccgagttgttgaggcaagggatgaattgcatcgcatgttgaatgaggatgagctgcgagatgcagtgttgcttgtatttgctaacaaacaagatcttcctaatgcgatgaacgctgccgaaataactgacaagcttggactcaactctctccgacagcgtcactggtacatccagagcacctgtgcaactctggggaggggctctatgaggggctggagtggctctccaacaacattgctaacaaggcatgagggtaatgcggaatgttcttgtggggtgatcctggatgcagggtggtgtttatctagtctcttttttccttgtttcttcgttgcttctgtcagacactgcgtggttat

SEQ ID NO: 10812 - DNA, 1543 bp, Brassica napus
ttcgccggaaaggccgtgaaactttctccagcggcatcagaagtcctcggaagtggccgtgtgacaatgaggaagaccgtggccaagccaaagggaccatcaggcagcccatggtacggagccgagagagtcaagtacttgggtccattctccggcgagccaccgagctaccttaccggagagttcccaggagactacgggtgggacacagccggtctctcagccgatcccgagacattcgcaaggaaccgtgagctagaagttatccactgcaggtgggccatgctcggagccctaggctgcgtcttcccggagttgctggccaggaatggagtcaagttcggagaggcggtttggttcaaggctggctcacagatcttcagcgacggaggactcgactacttgggaaacccaagcttggttcacgctcagagcattttggctatttgggctactcaagtgatcttgatgggagccgttgaaggttacagagttgcaggaaacgggcccttgggagaggccgaggacttgctctacccaggaggcagcttcgacccattgggcttggctaccgacccagaggctttcgcggagttgaaggtgaaggaggtcaagaacggaagattggctatgttctctatgtttggattctttgttcaagccattgtcactggtaagggacccttggagaaccttgctgaccatcttgctgatccagtcaacaacaacgcatgggccttcgccaccaacttcgttcccggaaagtgagccaagtttttatcagtatttgcttcagtatgagtgtaataagagaaagagagagatgttgtttagatgtaaaacttgcaagtctttgtatgatttactaattaatcaaataactctttttccccaaaaaaaaacacagaacaataagaaaaccggaaagaaaaaaagttcagataatgtttgcccctgcatccagatttgctcagcaaaatcaactcaaccacgaaccttccctctacgccttgccggcaatgttgttggacaaccagtcaagaccttcgtaaagcccctcgcctgaagtggcacatgtgctctggatgtaccagtgacgctgacggagagagtggagaccaagcttatcagtgatttcagctgcgttcatggcatttggaagatcctgtttgttagcaaacacgagcagaacagcatcacgcagctcatcctcattaagcatcctgtgcagttcatctctggcctcaacaacacggtctctgtcattgctgtcgaccacaaagatgagaccttgagtgttctggaagtagtgcctccacaagggacggatcttgtcttgacccccgacatcccacacagtgaaactgatgttcttgtactccacagtttccacattgaacccaatagtgggaatggtggtgacaatctcaccgagcttgagcttgtacaaaatggtggtcttaccagcagcatcaagaccaaccatgagaatcctcatctccttcttggcaaaaagcctgctaaacagcttggcgaaagacaa

SEQ ID NO: 10813 - DNA, 805 bp, Panax ginseng
cctctcgttcattcgctctcttctttaggatcaaagatggggctgtctttcaccaagctcttcagtcggctgtttgccaagaaagagatgcgcatactgatggtgggtctcgatgcagctggtaaaactccattctttacaagctcaagctcggagagatagtcacaacaattcctaccattggatttaacgtggagactgtggaatataagaacattagcttcaccgtttgggatgttggtggccaagacaagatccgtcctttgtggagacattacttccaaaacactcagggcctcatctttgtggttgacagcaatgatcgagatcgtgtgattgaagccagggatgagctgcacagaatgctgaatgaggatgagttgagggatgctgtgctacttgtatttgcaaacaagcaagatcttcccaatgcaatgaatgctgctgagattactgataaacttggccttcactctcttcgtcagcgccactggtatatccagagcacttgtgccacttctggtgaagggttgtacgaggggctggactggctctcaaataacattgcgaacaaggcgtagacggcttatctgagtttggatcgtcaccacagccaaattagagtttttcgtgctttttttttgttcagaaatctgtaccatgttgatgtttacctcttttactatttttgaggtcccatttccagatattgatatttgtttccttcagtttcagaataattcacattatttttgttttattcgccatatttctccatatctttgatattctatgcaagtacaat

SEQ ID NO: 10814 - DNA, 1034 bp, Panax ginseng
aagcagtggtatcaacgcagagtacatggggtcagtatttcacgcctattattattattcaatcagctcattgtgcgagatccatccctagggagagagataaaacatccactctggttttcctctcgttcattcgctctcttctttaggatcaaagatggggctgtctttcaccaagctcttcagtcggctgtttgccaagaaagagatgcgcatactgatggtgggtctcgatgcagctggtaaaactccattctttacaagctcaagctcggagagatagtcacaacaattcctaccattggatttaacgtggagactgtggaatataagaacattagcttcaccgtttgggatgttggtggccaagacaagatccgtcctttgtggagacattacttccaaaacactcagggcctcatctttgtggttgacagcaatgatcgagatcgtgtgattgaagccagggatgagctgcacagaatgctgaatgaggatgagttgagggatgctgtgctacttgtatttgcaaacaagcaagatcttcccaacgcaatgaatgctgctgagattactgataaacttggccttcactctcttcgtcagcgccactggtatatccagagcacttgtgccacttctggtgaagggttgtatgaggggttggactggctctcaaacaacattgcgaacaaggcgtagacggcttatctgagtttggatcgtcaccacaaccaaattagagtttttcgtgcttcttttttgttcagaaatctgtaccatgttgatgtttacctcattactattttgaggtcccatttccagatattgatatttgtttcctttagtttcagaataattcacattatttttgttttattcaccatgtttctccatatctttgatattctatgcaagtacaatcctaaccttagagaaactattcccctccctcccaaatggaattattgtagtactgaaacaattctttactaatatttgcagaccgagtcgtagggaggcaaggcacacgg

SEQ ID NO: 10815 - DNA, 1104 bp, Triticum aestivum
ccatcatcctccgtgcggttccaagctccaactcccacgcccgtctccccctagatcaggaggagcacgccgcaccggagcgccgagacctcgaagccttcgtctccacctcggagcagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggattcaacgtcgaaactgttgaatacaagaacatcagcttcactgtttgggatgtgggggccaagacaagatcaggcccctgtggaggcactacttccagaatacccaagggctcatttttgttgttgacagcaatgatagggaacgtgttgttgaggctagagatgagctccacagaatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgcgcgacgtctggcgaagggttgtacgagggtcttgactggctctccaacaacattgccaacaaggcttgaagcgcctcgacaagcgcttcatcaagaaacaaacgtgctggatgtctcaacaactcactgctaccattttacatattgtgatatatatacactgtacaagagatagtatgtgtgcgtatgtgacaggcagaagctcccttctttaagtgagctagtatcaggtcaggttgtctttttttgcatggatgttatcagttgctgttcggtggttttacaaggtttaatgtgtcgacaatgtgtgtctgaacccctatcgttttgagttttagcaagattgaattatggttgccaatgttggttggttcagttgagtgatgtggatggtacatgttgcgaacatacttatgtgagcgatgttttcagtagttctgtatacgatccagtcggtgctggttctgctctttcggtctggctgtcggtatcgtttgcacgccaccg

SEQ ID NO: 10816 - DNA, 771 bp, Humulus lupulus
gggctgaccttcaccaagcttttcagccggctttttgccaagaaagagatgcgaattctgatggttggtcttgatgcagctggtaagacaaccatcctctacaagctcaagctcggtgagatcgtcaccacaattcctaccattggtttcaacgtggagactgtggaatacaagaacatcagcttcactgtttggatgtggggggtcaagacaagatccgtcccttgtggaggcactacttccaaaacacgcagggtctcatatttgtggtggacagcaatgacagagatcgtgttgttgaggctagggatgaattacataggatgttgaacgaggatgagctgcgcgattgctgttcttcttgtttttgctaacaaacaagatcttccaaacgcaatgaatgcagctgagatcactgataagctcggtcttcattctctcaggcagcgccactggtacatccagagcacatgtgcaacttcaggagagggattgtacgagggtctggattggctctccaacaacattgccaacaaggcataatccctatgtggacaagcaattctggatgcaggggtgaatattatctagttttttttcttttcttttttgtcgagacaattgaattgttgtgtgtattgtcgtttgggcaatcaattaggattttctaatggttatattgtaatagaagaatggtcggttggatatatgccattgagcttttgtttgggatttaaatacaatgctgagttgtagtcaaactaattcgac

SEQ ID NO: 10817 - DNA, 852 bp, Olea europaea
ctcccgaaaaactaatcaatttatcgcgttaatctcaggcagttcactcactgcctctctcgccagatccatctctcagggatcgaaaactagaaagagaaatggggctgacattcacgaagctcttcagccggcttttcgccaagaaggaaatgcgcattctgatggttgccttgatgctgctggtaagaccaccattctgtacaagcttaagctcggagagattgtaactaccattcctaccatcggttttaacgtggagactgttgagtacaagaacatcagcttcactgtttgggatgtcggtggtcaggacaagatccgtccattgtggaggcactacttccaaaacactcaagggttcatatttgtggtggatagcaatgacagggatcgtgttgtggaggcaagggatgaattgcacaggatgttgaatgaggatgagctgagagatgctgtattacttgtatttgcgaacaaacaagatcttcccaatgcaatgaatgcagctgagataactgacaagctcggcctgcactcactgaggcagcgtcactggtacatccagagcacttgtgctacatcaggagaggggctttatgagggtcttgactggctctctaacaacattgctaacaaggcataaattgtgagttgatgcattgccggatgcgagctggatcttatctagtcttatacctatagtttgtgtgtttatgagttttacttttcgagtcttttcgtttttgtttaggactacttgtgctatatgacagagcttcgttttacatgattgcaaacatatgttgtagttatataatgctatgaaaaccttttgtgattttaattaaa

SEQ ID NO: 10818 - DNA, 919 bp, Phalaenopsis aphrodite
cgagtgaagacagggaggagaagcggagaaagctcgaaagcagaggagacggaccggcagacttccatcctcaccttcgctctttgatcaaccgactgatttaagaagccccagagaaaagatggggctgacatttacgaagctcttcagccggctttttgccaagaaggaaatgaggattctcatggttgggcttgatgctgctggtaagacgacaattcttacaagcttaagctcggagagatcgtcactaccattcctaccattggattcaatgtcgagactgtagagtacaagaacattagcttcactgtctgggatgttgggggtcaggacaagatccgaccattgtggaggcactatttccaaaatacccaaggccttatcttcgttgtagatagcaatgacagagatcgtgttattgaggcaagagacgagctccatagaatgcttaatgaggatgagcttcgagatgctgttcttctcgtgtttgcaaacaaacaagatcttccaaatgcaatgaatgctgctgaaatcactgataaactaggtcttcattcccttcgtcagcgacattggtacatccagagtacctgtgctacttccggtgagggactgtatgaggggcttgattggctctctagcaacattgccaacaagggttaaagcttctgcgagatgtctagatggagaaacggggtgggagggttgtgtctctaaaattgtgtttgagtttggtggtgagtgtcaagtctcggattattgaacttggtaaatggttttgttaaatgcgcatggtgtctttctaaatttgtactcctatggcactaaaaaaaggcttcagtttgctcaagtaaaaatctatatatttttccccttttctattcatcttatcatcacactccttgttgatctgctg

SEQ ID NO: 10819 - DNA, 740 bp, Phalaenopsis aphrodite
caagcagccctaaccctcattagaccgtctctttcctccgaacgagtgaagacagggaggagaagcggagaaagctcgaaagcagaggagacggaccggcagacttccatcctcaccttcgctctttgatcaaccgactgatttaagaagccccagagaaaagatggggctgacatttacgaagctcttcagccggctttttgccaagaaggaaatgaggattctcatggttgggcttgatgctgctggtaagacgacaattctttacaagcttaagctcggagagatcgtcactaccattcctaccattggattcaatgtcgagactgtagagtacaagaacattagcttcactgtctgggatgttggggtcaggacaagatccgaccattgtggaggcactatttccaaaatacccaaggccttatcttcgttgtagatagcaatgacagagatcgtgttattgaggcaagagacgagctccatagaatgcttaatgaggatgagcttcgagatgctgttcttctcgtgtttgcaaacaaacaagatcttccaaatgcaatgaatgctgctgaaatcactgataaacttggtcttcattcccttcgtcagcgacattggtacatccagagtacctgtgccacttccggtgaagggactgtatgaggggcttgattggctctctagcaacattgccaacaagggttaaagcttctgcgagatgtctagatggagaaacg

SEQ ID NO: 10820 - DNA, 1356 bp, Amborella trichopoda
gagtacggggtctggagggcagcttctctctggaagattttgcatctgacggagattgcctgaagaagaagaagctgctcctctgttccccttctaacagatccttaacaacaggcatttcctcgctttctctctgatatatctttcggcacaaagatggggctgactttcaccaagcttttcagtaggctttttgcaaagaaggagatgcgtatccttatggttggtttggatgccgctggtaagacaaccattttgtacaagctcaagctgggagagattgtcaccacaattcccactattggatttaatgtggagactgtggagtacaagaacattagcttcactgtgtgggatgttgggggtcaggacaagatccgtcctttgtggagacattacttccaaaacacgcaaggtctcatctttgttgttgatagcaatgacagagatcgtattgttgaggcaagggtgagctgcatcggatgctgaatgaggatgaattgagggatgctgtgctgctggtgtttgctaacaagcaagatctcccaaacgcaatgaatgctgctgagatcaccgataagcttggccttcactctctccgccaacgccactggtacatccagagcacatgtgctacctctggggaggggctttatgagggattagactggctctcaaacaacatcgctaacagggcttaaaattggtttatctcttatgatgattttggggtttgctggagtgttggagtagaaattgtgggtcttgctaagcatatgacagtcgattgagcattctgaggattctctcaatagtctatggattttttttctttgacccttgcacccccagaaaataactcaagactgttgttgcatctttcgtagctttgctgttttctttgttactttccatattatggcttgaaattcattgctcatgggttggttgatcggttacaaagtcacgagtctgtctctttctctctctctctctgtttgtttgctttgttgctgccttaaatttcattgagcctgaattgttgtatagtgaatgtaggattcaattatttcttgaaatgaaatccatagattacagttgcatttgggtggtaatgcaatttatattgggactatttaagcaaggggtgtagttttgacgttaaaaaatcttcaaatcgatcatcttttgagttgactattatagttgtaaaaaagaaaaaaaaagatttcaagtcctaaaaataatgaatattgttatacttacctagattgtctgttctgccttaaaataaatgtatatggattcatgagatatataccattttttttttcatatttcattctgtgttagaaa

SEQ ID NO: 10821 - DNA, 878 bp, Amsonia hubrichtii
gtcggtctcaggctctcattacttctcattttctcttcgctccgatccctcacctctctcgaaggccatctcagggatcatccataagaaagcaatatgggattaacgttcacaaagctgttcagccggctctttgccaagaaggagatgcgcattctgatggtaggtcttgatgcagctggtaagaccaccatcttgtacaagctcaagctcggagagatagtgaccacaattcccactattggttttaatgttgagactgttgagtataagaacattagcttcactgtttgggatgttggtggtcaggacaagatccgtcccttgtggaggcactacttccaaaacacacaaggtcttatctttgtggtggatagcaatgatagagaccgtattgtggaggcaagggatgagttgcataggatgttgaatgaggatgagctgcgagatgcagtgttacttgatttgctacaaagcaagatcttcctaatgcaatgaatgctgctgaaataactgataagcttggcctccactctctccggcagcgccactggtacatccaaagcacctgtgcaacttctggagagggactctatgagggtctcgattggctttccaacaacattgctaataaggcataagtgataaggagttattttgatgggttgatcctggatgctggcagctttttatctagtcttttacccttctgttatgaattgatgttttaagtcactatatctttataaatagctccttgtaatagagtgcttggtttaatgtaattgcaattattcgtctaggtatcaaatataagcgcaatgagatgtgaacttgtcaactggtatttaagttaatatgaaccttggttttgtaat

SEQ ID NO: 10822 - DNA, 741 bp, Fagus grandifolia
aacttgatccctctgcgaagctctccgaagggatccatagccagaaacagaaatggggctgacattcacgaagctcttcagccggcttttcgcgaagaaagaaatgcgaatactgatggttggtcttgatgcagctggtaagactaccattctctacaagctcaagcttggtgagatcgtcacaaccattcctaccattgggttcaatgtggagactgtggaatataagaacatcagcttcactgtctgggatggttgggggtcaggacaagactccgtccctggtggaggcactacttccagaacacacagggtcttatatttgtggtggacagcaatgacagagaccgaattgttgaggcaagggatgaattgcataggatgttgaatgaggacgaactgcgagatgcagtgttgcttgtatttgctaacaaacaagatcttcctaatgcaatgaatgctgcggagattactgataagcttggcctcaactctctccggcaacgtcactggtacatccagagcacctgtgcaacctcaggagaggggctttatgagggtttggattggctctcaagcaacattgcgaacaaggcatgaagctccgtggggagttgttttgttgtgcactgacaattctggatgcaggggtgaatattatctagttcttttaaagactaattggattgtggttatgtcctttttatttcgggaaaatgattctttttattaggtaacttt

SEQ ID NO: 10823 - DNA, 835 bp, Fagopyrum esculentum
caaatccctttcacttctcagatccgatctcgtcctctctcgctctcttccgcacttcttcgccagctcattggtaaggcaaaatggggttgtctttcaccaagctcttcagcaggttattctctaagaaagagatgcgtatccttatggtaggtctcgatgcagctggtaagactaccatcttgtataagctcaaagtgggtgaaattgtcacaaccattccaaccattggatttaatgtcgagactgtggaatacaagaacatcagcttcactgtttgggatgttgggggtcaagacaagatccgaccattgtggagacattacttccaaaacacccaaggacttattttgtggttgatagtaatgatcgtgaccgtgttgttgaagctagagatgagctccacagaatgctgaatgaggatgaattgagggatgctgttctgcttgtatttgccaacaaacaagatcttcccaatgccatgaatgccgctgagatcacagacaaacttggcctccactctcttcgtcaacgacactggtacattcagagcacatgtgccacttctggtgaaggactttatgagggtctagactggctctcaaacaacattgccagcaagtcataaatcacattttgagctgtgggctattccctttacatcaaagagctcaaagatggattcttctacggtgtactctggtcttcagaatttagtgaatctcctatgtttaccgcgtgagatttttgcaatttgtgtctggttttcttacatatataccaaatttgttcaaattttttatttatagtagaatattttcattaagcttagact

SEQ ID NO: 10824 - DNA, 677 bp, Panax ginseng
cagtggtatcaacgcagagtacatggggctcctcctccgcatctgatagacagagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgctattctcttcgacaacgacattggtatattcagagcacatgcgccacatctggagaaggtctatacgagggactggattggctttcaaacaatattgctaacaagg

SEQ ID NO: 10825 - DNA, 937 bp, Panax ginseng
tttctctgtgttgaaatcaattctcagtggattcttcaggcgaaggtttccagagaaaaattctcagcacaatatttctgtctcagtgttgagaaagttataagcagctgaggtacaagaaagatggggttgtctttcacaaagctgttcagcaggctttttgcgaagaaagagatgcgcattctgatggtaggtcttgatgctgctggtaagactaccattttgtacaaactcaagcttggagaaattgtcacaacaatccctactataggatttaatgttgagactgtggaatacaagaacattagcttcactgtttgggatgttggtggtcaggataagatccgtccactgtggaggcactacttccagaatacacaaggtcttatatttgtggtggatagcaatgacagagaaagagttgttgaggcaagggatgagttgcatgggatgttgaatgaggatgaactcagagatgcttgttttgcttgtctttgccaacaaacaagatttgcccaatgcaatgaatgctgcggagataacagacaagcttggtcttcattctctccgtcaacgtcactggtacatccagagcacatgtgccacctcgaggggaggttctttatggaagggctggattggtctttccaacaacatcgctaacaaggcatgaactgaatgtagtttggttgccggttgttacttttccctgtagacattgggtagatacttagtttaggtacgtttgtcaactccagccagagtattatgttcgttcttgatgcaagtaaaagttggttgcgttggtagaaagtctttatttgtcagtcttgatatcactgtcgtttggcttattacatagctaggaaaaaaatacttattttgttatgatggtaaattcattttcaatgaactacacatgttagtctattttcag

SEQ ID NO: 10826 - DNA, 665 bp, Panax ginseng
gatagacagagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttaggtctcgatgccgctggtaaaaccacaattttgtacaagctcaagttgggtgaaattgtcaccactatccctacaattggcttttaatgtggagactgttgaatacaagaacattagcttcactgtgtgggatgttggtggtcaagacaagatccgacctttgtggaggcactatttccaaaaacacacaagggctcatctttgtgttgacagcaatgatcgagaccgtgtggtcgaggctagagatgaactgcacaggatgttgaatgaggatgaactgagagatgctgtactccttgtgtttgcaaaacaagcaagatcttccaaatgccatgaatgctgctgagattactgacaagcttggtttgcattctcttcggacaacgccgattggtatattcagagcacatgcgccacatctggagaaggtctatacgagggactggattggctttcaaacaacattgctaacaaggcttaatgggctactctaccggctcactt

SEQ ID NO: 10827 - DNA, 657 bp, Panax ginseng
agagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaagacaagatccgacctttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgcattggtatattcagagcacatgcgccacatctggagaaggtctatacgagggactggattggctttcaaacatattgctaacaaggcttagtgggctactctaccggctcagttggtac

SEQ ID NO: 10828 - DNA, 760 bp, Humulus lupulus
acgtcgaaaaatttgtgcctcatttctctctgggcagcttctcagatctgccccttttctcagcttctctcgtaatcgtctttttcgcttgagccatccgagattaagaaatggggttgtctttcaccaagctcttcagtcggctttttgccaaaaaggagatgagaattctaatggttggtctcgatgccgctggtaagaccaccatcttgtataagctcaagctgggagagattgtggcgaccattcctacaatcggattcaatgtggagactgttgaatataagaacattagctttaccgtctgggatgtcgggggtcaggacaagattcgacctctgtggagacactacttccagaatactcaaggactcatctttgtggttgacagcaatgatcgtgaccgtgttgtcgaggctagggatgagttgcatcgtatgttgaatgaggatgagttgagggatgctgtgctgcttgtatttgccaacaaacaggatctcccaatgccatgaatgcagctgagatcacagacaaacttggtcttcactctcttcgccaacgtcactggtacatccagagcacatgtgccacatctggggaaggactctacgagggtctggattggctctccaacaatattgctaacaagtcttaaaaagacctgatctctgttgaaggatttcacgcagcaattggtgtcatcatgatgctgctccccttatatttggtgttgatggattcttttttatctttttttttt

SEQ ID NO: 10829 - DNA, 941 bp, Lupinus angustifolius
ttctgcaaaacagaaggaatgtgtaaagcaaattaagaaattagggtgagatcatgagaatgattgtctgatatcatgattcttaaaacatgagattcgatcaatggagaattgaccaattctgtgatttaaatttaaagacatgtgcatactcgttaagtcattatgacttttctgcatacagttgaaataagagatggggttgtctttcaccaaactctttagccggatgtttgccaagaaagagatgcgaattcttatggtaggtcttgacgctgctggtaagacaaccatcttgtacaagctcaaacttggagaaattgtgacaaccattcccacaattggatttaatgtagagactgtggaatataaaaatattagcttcactgtttgggacgtcggtggccaagataagatacgtcctctatggagacactacttccaaaatacacaagggcttatctttgttgtggatagcaatgatcgtgaccgtgttgttgaggctagagatgagctgcaccggatgttgaatgaggatgagttgagagatgcagttctccttgtatttgccaacaaaaagatcttccaaatgctatgaatgctgctgaaatcacagacaagcttggtcttcattctcttcgtcaacgccactggtatatccagagcacatgtgccacctctggggaaggactctatgaaggactggactggctctccaacaatatagccaacaagcaatcctggtcgagtttgttcgactaaggagcactttcgcatgcttagaccatatttttttgctaccatggcccctttacacatgttacaaacatgtatttattttgttaatttttggttttttggagttgtaaacggtgtacatttacaatacatatcattgtttaattagaggtaattaatatcaaaactttttgttattataa

SEQ ID NO: 10830 - DNA, 956 bp, Solanum tuberosum
gttattctcaagctctctctctctctctgtcctctcgtgctttctctcactagatccctctttcccaaactgttcttcagggatcattaagaagaaagagaaatggggttgacattcaccaagcttttcagtcggctatttgccaagaaggaaatgcgcatcctcatggttggactcgatgcagctggtaagaccaccatattgtacaagctcaagctgggagaaattgtcaccaccattccaactattggtttcaatgtggaaactgttgaatacaagaacatcagcttcaccgtttgggatgtcgggggtcaggacaagatccgtccattgtggaggcactatttccagaacactcagggtctcatttttgtggttgatagcaatgacagagaccgtgtagtggagatgaattgcacaggatgttgaatgaggatgagcttcgggatgctgtgctgcttgtttttgctaacaaacaagatcttcctaatgcaatgaatgctgctgaaataaccgataagcttggactccactccctcaggcagcgtcactggtacatccagagcacttgtgcaacttctggcgagggactctacgaggggcttgattggctttctaacaacattgccaataaggcctaagtcgaagtagagttgttgcggattgatcctggatgcaggcgggtttttatctaattccattttcttttattacgtcttttttcttcttcttttttcaaacattttctgaatctgtgtggttatggcatttgcttcttaggaggtcacttttgaaatgtttttgtaatacaatgtttgaatgtatgtaatttgcggattgtttaggttcgagtataaacgttattaacttgtaacaaatactagctcttttctggttatttgcagtcaatttaaaatgcttatcaaataccataatacaaaactgtggtatcaaaa

SEQ ID NO: 10831 - DNA, 867 bp, Solanum tuberosum
ctcaggtttctctctcaatagatccctccttcaaaaagctcttttcagggatcatcatcaaggaagcgtaatggggctcacattcaccaagctcttcagtcggcttttcgccaagaaggaaatgcgcattctaatggttggtcttgatgcagctggtaagaccaccatattgtacaagttgaagctgggagagatcgtgactactattcctaccattggtttcaatgtggagactgttgagtacaagaacatcagcttcactgtttgggatgtcgggggtcaggacaagatccgtccattgtggaggcactacttccagaacactcagggtctcatttttgtggttgatagcaatgatagagaccgtgttgtagagatgaattgcataggatgttgaacgaggatgaacttcgggatgctgtgcttctagtttttgctaacaagcaagatcttcctaatgcaatgaatgctgccgaaataactgataagcttggactgcactccctcaggcagcgtcactggtacatccagagcacttgtgcaacttctggagaggggctttacgagggacttgattggctttctaacaacattgctaacaaggcttaaagtgatgcagatttgttattgtgggttgatctggatgcaggcggagttttatctagttgttttttcttctcatgtcagtgtggttatgaatatcatgttgaaagcattttgtgtttccttagggctttttgtaatggctgtgtaatacaatggtcgaatatatgtaattgctgtttgattaggtatattgtcataaatttgtaaacaaagactagttttcatatttgttaatggttaaagtcttgcagtccccttttc

SEQ ID NO: 10832 - DNA, 876 bp, Camellia sinensis
ggagacagagtagtgattcacatcgcccccaaaatcgcatctcgatctctctctgtttgcactcttatttcattcgactttctgtggaactttcgagcgcgccaagtgataagccaatagctggagtgaaccagaaatggggctgaccttcacgaagctgttcagcaggctttttgccaagaaagagatgcgcattcttatggtaggtcttgatgctgctggtaagactaccatactttacaaactcaagcttggagaaattgtcacgacaatccctaccatcggattcaacgttgagacagtggagtacaagaatattagcttcacagtttgggatgttggtggtcaggataagatccgtccattgtggaggcattacttccagaatacacaggacttatatttgtggtggatagcaatgacaggatagagttgttgaggctagggatgaatgcataggatgttgaatgaggatgagttgagagatgctgtttgcttgtgtttgctaacaaacaagatcttcctaatgcaatgaatgctgcagaaataaccgacaagcttggtcttcattctctccgacaacgccactggtacatccagagcacatgtgcaacctctggagaagggctttatgaagggctggattggctttctaacaacattgctagcaaggcataaaggctgtcaagaattttgggtgctgctgggactttgttggtgcatggttattagatatctagggttttgtaacatcttgacaattcgtagagacaatactttcacttgaatacttaagtgacattgatatgtagaagacgattggcttgatatactttctgaaactatgttaggttgtatcacagctactttggctat

SEQ ID NO: 10833 - DNA, 876 bp, Nicotiana benthamiana
gctgctcttcaacgcatcggagggactacccatattcctaaatctgccctctcttcttccaaattagctactagctttttttcccacgcagttttaaagatggggttgtctttcactaagcttttcagtcggctatttgccaagaaggaaatgcgaattctcatggtaggtcttgatgcagctggtaagacaaccatattgtacaagctcaaactgggagagattgttaccactattcctaccattggatttttaatctggagactgtggagtacaagaacattagtttcactgtctgggatgttggtggtcaggacaagattcgaccattgtggagacattacttccaaaacacgcaaggactcatctttgttgttgacagtaatgatcgggaccgtgttgttgaggctagagatgagctgcacaggatgttgaatgaggatgaactgcgggacgctgtgctgcttctgtttgccaacaagcaagatcttccaaatgctatgaacgctgctgagattactgataagcttggtcttcactccctccgtcaacgtcactggtacattcagagtgcatgtgccacctctggggaaggactttacgagggacttgactggctctccaacaacactgcgagcaaggcttaggaggcatgatataatttttgcagttaatgtttttattttatgtaccttacgagatccttcttttgcacggagaattggcttattgcaaaactattgttttcttttcttttccctctttgtaaaaaacatgatggtaccttgtagtagctttaggttaatattcatgtactaatattttgcactctgactcgcatgatggcagccgcttgtctttccatacattatttta

SEQ ID NO: 10834 - DNA, 1025 bp, Picea glauca
actgcagcgctaggtgttcgagaggcaccagagatctctttgcggggagtcattcttctcccctggaatctcagatctgactcttcaactcgggatctataacaggtggtcaagatggggctcacttttaccaagctttttagccggctcttcgcaaagaggaaatgcgcattttgatggttggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggatagatccgtcactatggagacactacttccaaaatactcaaggtctcatctttgtggttgatagcaatgacagagatcgtgttgtagaagcaagggatgaactacataggatgctgaatgaggatgaactacgtgatgctgtattacttgtgtttgcaaataagcaggatcttccaaatgctatgaatgctgcagagatcactgacaaacttgggcttcattcccttagacagcgccattggtatatccaaagcacttgtgcaacttctggcgagggattgtacgagggtttggattggctttccaacaacattgcaaacaaggcttgaagaaatatggtgaactgggtttctggaattttgtagggcaatgtcgtcttatttcatttttgtcagacagtttgaagaaataaggttctaattgtgcagtcaaaccgacttttgactaacatttattcaatttcttccatgggtttgattgtgccaatctgctagcaatgaactaatttatatagctcactgagcttaaatggcaaagcatagtagttattattaaggtaggtgatgattatgatattgccttcgtgtggggagcatagacattactaagcatgctccagctgatttgaaacttatattcctattacaagctttattgtctcagattacactcaaattctattttgccagataataaa

SEQ ID NO: 10835 - DNA, 756 bp, Bupleurum chinense
ctctcttaaaatcggtgcttcgtgtgttttgacggtgaacggtagattcatctcgagatctgtgtagctctctcatcgtcgtatatcagacctcattatataaagatggggttgtctttcaccaagcttttcagtcggctgtttgccaaagagaatgaggatcctaatggttggtcttgacgcggctggtaaaactacaattctgtacaagctgaagctgggtgaaattgcaccaccatcccaacaattggttttaatgtggagactgttgagtacaagaacattagcttcactgtgtgggatgttggtggtcaggacaagatccgaccattgtggaggcactatttccaaaacacacaggggctcatctttgtggttgacagcaatgatcgagaccgtgtggttgaggccagagatgaattgcaccgaatgttgaatgaggatgaactgagagatgccgtactactagtatttgcaaacaagcaagatcttccaaatgctatgaatgcagctgagatcactgataagcttggtttgaattctcttcgtcagcgacactggtatatccagagcacatgtgccacatcaggagaaggtctctatgagggactggactggctttcaaacaacattgctaacaaggcttagtggactatgcggctcagctgagatttttgaaaatgtcttagtgcagttgatatggatataggtgttgcagcaagtattgcttctacgtataattgacttgtgtgtttt

SEQ ID NO: 10836 - DNA, 904 bp, Panax ginseng
tccatccctagggagagagataaaacatccactctggttttcctctcgttcattcgctctcttctttaggatcaaagatggggctgtctttcaccaagctcttcagtcggctgtttgccaagaaagagatgcgcatactgatggtggtctcgatgcagctggtaaaactaccattctttacaagctcaagctcggagagatagtcacaacaattcctaccattggttttaacgtggagactgtggaatataagaacattagcttcaccgtttgggatgttggtggccaagacaagatccgtcctttgtggagacattacttccaaaacactcagggcctcatctttgtggttgacagcaatgatcgagatcgtgtgattgaagccagggatgagctgcacagaatgctgaatgaggatgagttgagggatgctgtgctacttgtatttgcaaacaagcaagatcttcccaacgcaatgaatgctgctgagattactgataaacttggccttcactctcttcgtcagcgccactggtatatccagagcacttgtgccacttctggtgaagggttgtatgagggttggactggctctcaaacaacattgcgaacaaggcgtagacggcttatctgagtttggatcgtcaccacaaccaaattagagtttttcgtgtctttctttttggtcagaaatctgtaccatgttgatgtttacctctattactattttgaggtcccatttccagatattgatatttgtttcctttagtttcagaataattcacattatttttgttttattcgccatatttctccatatctttgatattctatgcaagtacaatcctaaccttagagaaactattcccctccctcccaaatggaattattgtagtactgaaac

SEQ ID NO: 10837 - DNA, 1000 bp, Secale cereale
ccgaggagcacgccccggacgcgccgagacctccgaagccttcgtctcaccccgagcagagatgggcgtcacgttcaccaagctgttcagccgcctctttgccaagaaggagatgaggattcttatgttggtctcgatgcggctggtaagaccacccatcctctacaagctcaagctcggagagatcgtcaccacccatcccaaccatcggatttaacgtcgaaactgtcgaatacaagaacatcagcttcactgtttgggatgtggggggccaagacaagatcaggcccctctggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcactgacaagcttggtctgcactccctgcgccagcggcactggtacattcagagcacttgcgcgacatctggagaagggttgtacgagggacttgactggctctccaacaacattgccaacaaggcttgaagcgtctcgacaagtgcttcatcaagaaacaaacgtgctggatgtctcaacaactcactgctaccatttttacatattgtgatatatatatacactgtacaagagatagtatgtgtgcgtatgtgacagacagaagctctcttctttaagtgagctagtatcaggtcaggttgtttttttgttatggatattatcagtattcccgcgtcgtggttttacaaggtttactttgtcgaccatgtgtgcatgaacccctatccttttgagttgtagtaagattgaattgtggttgccaatgttggttggttcagttgagtgatgtggatggtacatgttgctaacatacttatggtgagcgtattgtttcacgtatcgactcacgacacccagtg

SEQ ID NO: 10838 - DNA, 773 bp, Fagus grandifolia
gtaatcatgccagcccattaaataacgcaaagaaagaaaaatccacgtctctcaaaaaaatcgcggctctcattccttccttcctccaatccctccacaggtagctagagaggtagagcaagaatggggctgacatttacgaagctatttagcaagctttttgcgaagaaagaaatgcgaattctgatggtaggtctcgatgctgccggtaagaccaccatattgtacaagctcaagctcggtgaaatcgtaaccaccatccctaccatcggatttaatgtggagacagtggaatataaaaacatcagcttcaccgtttgggatgttggggtcaagacaagatccgtccactgtggaggcactacttccaaaacactcagggtctcatttttgtggttgatagcaatgatagggatcgaattgttgaggcaagggatgagttgcataggatgttgaatgaggatgaactcagggaggctgttttgcttgtatttgccaacaaacaagatcttcctaatgcaatgaatgctgcagagataactgacaagcttggcctgcattctctccgccaacgccactggtacatccagagcacatgtgcaacttctggagagggtctgtatggaggggttggattggctttccaacaacattgctagcaaggcataagcgaattaaagaattttggttcctagcgtatttgggagatgacgccttctcagtgactgttgtaatagcagaatgtttgtctagacttattattatttttggtt

SEQ ID NO: 10839 - DNA, 780 bp, Flaveria ramosissima
tttccagatcgctcgatccctctcctaaaaactcatctctcagggatcctcatcagagacaggatggggctcacattcaccaaactcttcagccggctttttgccaagaaagaaatgcgtatattgatggtgggtcttgatgcagctggtaagacaaccattctgtacaagctcaagctcggggagattgtgactaccatccctaccattggatttaatgtggagactgttgagtacaaaaacatcagcttcactgtgtgggatgtgggggtcgaggacaagatccgtccactatggcggcactacttccaaacacacagggtcttatctttgtggttgatagcaatgatagggatagagttgttgaagcaagagatgagctgcacaggatgttgaacgaggatgagctaagggatgcagttcttctggtatttgccaacaaacaagatctacctaatgcaatgaatgccgctgaaattactgataagcttggccttcactctcttcgacagcgccattggtacatccagagcacctgtgccacctctggggaaggactttacgagggtttggactggctttccaacaacattgctaacaaggcatgaggtgttgattgaactgtattcgagggtggaaaaaccagaggcaggttttgttttgtacggtcggtcactttcttgtactagttctcgttcttctgtgacggaggtgtgagtggttatgaaactttgttaaaaaaggcttttgtcattttatatatagtccttgtatgataaa

SEQ ID NO: 10840 - DNA, 983 bp, Phalaenopsis aphrodite
gccattacaagcagccctaaccctcattagaccgtctctttcctccgaacgagtgaagacagggaggagaagcggagaaagctcgaaagcagaggagacggaccggcagacttccatcctcaccttcgctctttgatcaaccgactgatttaagaagccccagagaaaagatggggctgacatttacgaagctcttcagccggctttttgccaagaaggaaatgaggattctcatggttgggcttgatgctgctggtaagacgacaattctttacaagcttaagctcggagagatcgtcactaccattcctaccattggattcaatgtcgagactgtagagtacaagaacattagcttcactgtctgggatgttgggggtcaggacaagatccgaccattgtggaggcactatttccaaaatacccaaggccttatcttcgttgtagatagcaatgacagagatcgtgttattgaggcaagagacgagctccatagaatgcttaatgaggatgagcttcgagatgctgttcttctcgtgtttgctaaacaacaagatcttaccaaatgacaatgaatgctgctgaaatcactgataaacttggtcttcattcccttcgtcagcgacattggtacatccagagtacctgtgctacttccggtgagggactgtatgaggggcttgattggctctctagcaacattgccaacaagggttaaagcttttgcgagatctctagatggaggaacggggagggttgcatctctaaaattgtgtttgagtttggtggtgagtgttaagtctcggattattgaacttggtaaatggtctttataaatttgtactcctatggcactaaaaaaaggcttcagcttgctcaagtaaaaatctatatattttccccctcttctattcatcttatcatcacacttcttgttaatctgctgcctcttattaattagggtgaaagaaaattgaaatgtg

SEQ ID NO: 10841 - DNA, 924 bp, Triphysaria pusilla
tctgctcttccccaaactgtttcttcattaatcaatagaaaatggggggttctttcacaaagcttttcagccgactgtttgcgaagaaggagatgcgaattcttatggtaggtcttgatgctgctggtaagacaaccatattgtacaaactcaagttgggagaaatagtgacaaccattcctacaattggattcaatgtggagacagtggaatataagaacataagcttcactgtttgggatgttgggggtcaagataagatccgaccgctgtggaggcattactttcagaacactcaagggctgatttttgtggttgatagtaatgatcgagaccgtgttgtagaggctagggatgagctgcataggatgttaaatgaggatgaactgagggatgctgtgctccttagtctttgcaaacaaacaggatttgcccaatgctatgaatgctgctgagataactgacaagcttggacttcactctctccgccaacgtcattggtatatccagagtacatgtgccacttctggtgaagggctatacgaggggctcgattggccctccaacaacatttctaacaagggttgatgagagatgtttgatgagttttggttatctgtattttcggcatttgttcaatccgatcatctgctttgttcacttcttttatgttttagatagtcgaatcgtaatgtcttttgatattcatatttttgcaaacaattatttcagtagtgtgcctcattttggctttctttattctttctgtttctggtatgatagtggctctcgtagctgtgtgggtctgtttaatgtttttccgattaagttgaatttcgatgaactgggtacaccacgaatattagtagcaaaatacccagtaaatgtctgatgaaaaataacagaagtattcacttaaaaaaa

SEQ ID NO: 10842 - DNA, 827 bp, Helianthus annuus
gatccttatcagaagtaggatggggcttacgttcaccaaactcttcagccggcttttcgccaagaaagaaatgcgtatattgatggtgggtctcgatgctgctggtaagacaaccattttgtacaagctcaagctcgggggattgttaccaccattcctaccatcggctttaatgtggagacagttaaatacaaaaacatcagcttcactgtgtgggatgtggggggtcaggacaagatccgtcccctttggaggcactacttccagaacacacaaggtcttatctttgtggtcgatagcaatgataggaatagagttgttgaggcaagagatgagttacacaggatgttgaatgaggatgagcttagggatgcagttcttcttgtgtttgccaacaaacaagatctgcccaatgcaatgaatgctgctgaaatcaccgataagcttggccttcactctcttcgacaacgtcactggtacatccaaagcacttgtgccacctctggggaaggactttacgagggtttggactggctctccaacaacattgctaacaagacatgaggtggagatgaattgtaatttggaggtcaagaaaccggaggcaagttttgctttttgtatggtcaggtcacttttcttactggttctcgttcttccgtgactgatcgaactttgtttgttaaaaaaggcttttttgaatttttatatatatagggtatgtatgatacgatctttggtttcaactttgttggtattttaaagagataaatgttggttgtttatataagcttttttgtttatattaactaggtatgttttggtac

SEQ ID NO: 10843 - DNA, 825 bp, Flaveria ramosissima
atcgatccctcatcaaaaaagccttttctctcagggatcatcatcagaaacaggatggggctcacattcaccaagctcttcagccgtctttttgccaagaaagagatgcgtatattgatggtgggtcttgatgctgctggtaagacaaccattttgacaagctcaagctcggggacattgtgactaccatccctaccattggatttaatgtggagactgttgagtacaaaacataagcttcactgtgtgggatgtgggggtcaggacaagatccgtccactatggaggcactactttcagaacacacaaggtcttatctttgtggttgatagcaatgatagggatagagttgttgaggcaagagatgagttgcacaggatgttgaacgaggatgagctaagggatgcagttcttcttgtatttgctaacaaacaagatctgccgaatgcaatgaatgctgctgaaatcactgataagcttggccttcactctctccgacaacgccactggtacatccagagcacttgcgccacctctggggaaggactttacgagggtttggactggctctccaacaacattgctaacaaggcatgaggtgatgatcgacttgtaagaggttggaaaacctgaggcgagtttagcttttcgtttggtcaggtctctttcccgttctcatcagtgcgagcggttatgaaactttgtttgttaaacaggcttttgatttgatatatataggacatgttatggtagaaacaaaaaaaaaaaaaaaaaaataaacgtactcgtgtcgttagtaacctacctacgtcgtaccttacgtag

SEQ ID NO: 10844 - DNA, 854 bp, Carpinus betulus
attcgtcccattttgctctcggtctctctctcacatagggcagcttcccagatctgcccaactttgcctctctctcataaaccatctgcgataagagatggggctgtctttcaccaagcttttcagccggctttttgccaagaaggagatgagaattcttatggtggttctcgatgcggcgggtaagaccactattttgacaagctcaagctgggagagattgtgaccaccattcccacctttggtttcaatgtggagactgtggaatacaagaacattagcttcactgtctgggatgttggggtcaggacaagattcggcctttgtggagacattacttccaaaacactcagggccttatcttcgtggttgatagcaatgaccgtgaccgtgtggttgaggcaagggatgagcttcaccggatgttgaatgaggatgaattgagggatgctgtgctgcttgtatttgcaaacaagcaggatcttccaaatgctatgaatgctgccgagattactgataagcttggtcttcactccctccgccaacgccactggtacatccagagcacgtgtgccacttcaggggaagggctctatgagggtctagactggctttccaacaatattgctaacaaggcttaggagatcctttattattcagcaactttttgggctgcaatctctgtcaaagggatgttggcgcttgttatttggtgttcatgcgttttaccttgttactgtcccgagaatatatctgtttgtttagataattgttacactatattcatagaaatttgggcatttggccttgtagattcttaaataattcatgattcacagtttatacgtgatagt

SEQ ID NO: 10845 - DNA, 886 bp, Papaver somniferum
ctacaaagcgcagatctgatttagaggattcatagtgagacagagtcagtggggttgtctttcacaaagtcttttcagccggctgtttgccaagagagagatgcgtattctgatggttggtctcgatgctgctggtaagactaccatcttgtataagctcaagctcggagagattgtcactacaattcctaccattgggtttaatgtggagactgtggaatacaagaacattagcttcacagtttgggatgtcgggggtcaagataagattcgtccactgtggaggcactacttaccaaaacactcaaggacttatctttgtggtggatagcaatgaccgagaccgagttgttgaagcaagggatgaattgcaccggatgtgaatgaggatgagttacgagatgctgtgttgcttgttttcgctaacaaacaagatcttcctaatgcaatgaatgctgcagagataactgataagcttggccttcactctcttcgccaacgccattggtacatccagagcacatgcgcaacctctggagagggactttatgagggtttggattggttatccaacaacattgcaaacaaggcgtgaggcggcaatggaaatcagcagtagaggtttgtcgggggggttttggttttctggatggcggggtaaatttaaatccaagcttttgctgagatgggcttttggatgtggaatggcttccataggagtcatttcatgggacttttatcttttttttttgttaacaaatactgttgtaacaggagaatactcagtttgttgatatgatgctttataagcttgcttgtttttttgtatttgtggtcgaattctttactggctttttagctaatccttttagctgttacatacatt

SEQ ID NO: 10846 - DNA, 899 bp, Solanum tuberosum
cttattaccctctccaaatttggcgttaatctcaggcttcactctctcgttctttcttcattagatccctcttccataatcatctttcagcatagggatcaccaacaaggagaaatggggttgacattcaccaagcttttcagccggcttttcgccaagaaagaaatgcgaattctcatggttggacttgatgcagctggtaagaccaccatattgtacaagctcaagctgggcgagatcgttactactattcctaccattggtttcaatgtggagactgttgagtacaagaacatcagcttcactgtttgggatgtcgggggtcaggacaagattcgtccattatggagacactatttccagaacactcagggtctcattttcgtggttgatagcaatgacagagatcgtgttgtggagatgagttgcataggatgttaaatgaggatgagcttcgggacgcagtgcttcttgtttttgctaacaaacaagatcttcccaatgcaatgaatgctgccgaaataactgataagcttggactgcactctctcaggcagcgtcactggtacattcagagcacctgtgcaacatctggagagggactttatgagggtcttgattggctttccaacaacattgctaacaagtcctaaggcactggaagagttcttgcgggttgatactggatgcaggcagatttttatctagtttctttcccaagtcagtgtggttatgaacattgtcttgaaaggcattttgcatcttgttagaacttaatgaaatggctttgtaatacaagggttggatatatatgtaatgttgtttgtttaggtttgagtatatacttccataaatttgtatacaagactagttcattaatgacgtttttgttagtcatt

SEQ ID NO: 10847 - DNA, 778 bp, Panax ginseng
ttttttggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaaacacacaagggctcatctttgttgttgacagcaatgatcgagaccgtgtggttgaggctagagatgaactgcacaggatgttgaatgaggatgaactgagagatgctgtactccttgtgtttgacaaacaagcaagatcttccaaatgccatgaatgctgctgagattactgacaagcttggtttgcattctcttcgacaacgacattggtatattcagagcacatgcgccacatctggagaaggtctatacgagggactggattggtctttacaaacaattattgctaacaaggcttaggtgggctactctacccggctcagttggtactacaaagaaatacatttggtgcagtcaatctggttataagtgttgttgcaatgacttctttgtataattgtcttttggtggtttggatttcaatttcttgtcgtggtgagagaaggaaaag

SEQ ID NO: 10848 - DNA, 848 bp, Panax ginseng
tcctccgcatctgatagacagagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgtggtgtcagacaagatccgactttgtggaggcactatttccaaaacacacaagggctcatctttgttgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagagaggaaaaagatgatgttaaatttccctttgacttatctgcttaataatatacatagtattacaaata

SEQ ID NO: 10849 - DNA, 1081 bp, Panax ginseng
ttttggaacgacaactccatttagagatctctgcattccaacgttcccatcgcccacctcatcctcaatatagagatggggctgtcttttaccaagcttttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgactttgtggagcactatttccaaaactcacaagggctcatctttggtgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattgggtatattcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtgttaaatttccctttgaattatctgcttaataatatacatagtattacaaataggatttattgctcctttttgagttgtaaagcttttcatgccagtgctctggtggaatgctactatgaactatatagcttggtttatatcatttttccctcagtgcagtaaccaaaaaaaaaaaaaaaaaaaacaaaaaaaaaaaaaacaaaaaaacaaaaaacaaaaaacaaaacaaacaagagagagagacacagagagagagacacacacacacacacacacacacacacacacacacacaca

SEQ ID NO: 10850 - DNA, 950 bp, Triphysaria pusilla
gcgtgcctggctcagatatcacgcgaacatacgtatctcattccttcttgtgctggttgaagagatcttgagctcacagatctctacacctctcatcctcctcgatttgaaagatggggttgtctttcaccaagcttttcagccggctgtttgccaagagagagatgcgtatactaatggttggtctcgatgctgctggtaaaaccaccattctctacaagctcaagctcggcgaaattgtcaccactatccctactattggattcaatgtggagactgtggaatataaaaatattagcttcactgtttgggatgttgggggccaagacaagatccgtccattatggaggcattatttccaaaacacccagggcctaatctttgttgttgacagcaatgatcgagaccgtgttgttgaagcgagagatgaactgcacagaatgttgaatgaggatgaattgcgagaagctgttctcttggtgtttgccattaaatatagatctcccaaatgcgatgaatgctgctgagataactgacaaactgggccttcattctctccgccaacgccattggtacattcagagcacatgtgcaacttctggtgaggggctgtacgaggggctagactggctttcaaacaacatcgctaataagtcttgaatgctttgtgagatcgaagtgatggtttgagctttgccgttcaaccttggttccgtttatgaacaatactatcttttcaatgtattttttgtgataatttgtagatttttgttggtgtttgttgatctctctctatatattcttgcttgtgaaagtaggagtgaatattgggtcgaacttacgagtttgagggcagtgagtattaagaaaataaatgtatgttggataatcgaccaaattcgagctttggatattacgtgatttcagatgtatacaaaaaaaaaaaaaaa

SEQ ID NO: 10851 - DNA, 733 bp, Primula obconica
ctcctcccacattcttgcgcgtcggtctcaagcttacattctctctccctctctctctagagatccctccgctcgcagggatcaactaaaaggaaagagacatgggtttgacattcaccaagcttttcagtcggctttttgccaagaaggagatgcgtatccttatggtggtctcgatgccgctggtaagaccaccatcctgtacaagctcaagctcggtgagattgtagaccacaatccctaccattgggtttaacgtggaaactgtcgagtacaaaaacatcggcctttaccgtgtgggatgttggggtcaagacaagattcgtccattgtggggcattatttccagaacacccagggtctcattttcgtggtggatagcaatgacagagaccgtgttgttgaaggcgagagatgagttgcaccgcatgttgaatgaggatgagttgcgggatgcagtattacttgtctttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtcttaatttttttacttcctttttttcttgtgagacaatat

SEQ ID NO: 10852 - DNA, 913 bp, Primula obconica
aaactcccacattcttgcgcgtcggtctcaagcttacattctctctctctctctctctagagactccctccgctcgcgagggatcaaactaaaaggaaagagacagtgggtttgacattcaccaagtcttttcagtcggtctttttgccaagaaggagatgcgtatccttatggtaggtctcgatgccgctggtaagaccaccatcctgtacaagctcaagctcggtgagattgtgaccacaatccctaccattgggtttaacgtggaaactgtcgagtaacaaaaacatcagctttaccgtgtgggatggttggggtcaagacaagattcgtccattgtggaggcattatttccagaacacccagggtctctattttcgtggtggatagcaatgacagagaccgtgttgttgaggcgagagatgagttgcaccgcatgttgaatgaggatgagttgcgggatgcagtattacttgtctttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtctaattttttttactttcctttttttcttgtgagacaatatattgtcatcgacttcaattttaagtgtttatgttgattaaggattttgcaatgtctattgatctttatcagaaaggtttgttgaattcgtgcactatcagaattgtgctccagattttactgggtgcatacaattaatagccacttggcttttattcactatcatcttaaa

SEQ ID NO: 10853 - DNA, 1110 bp, Amorphophallus konjac
cccgccgtgtccgttcccggaggagcgagaggggagagagaaggagcagccggcgctggtgccggagcccacccccgtccccgcccctctcgcgtcctcgtcgcctccgccgccgtgctcgcgtctccaccttcccctctggtgagcgaagatggggctaacattcgcgaaactcttcagccggctattcgccaagaaggagatgaggatcctgatggtcgggcttgatgccgccggtaagacgactatcctctacaagctcaagctcggagagattgtcaccaccatccctaccatcggatttaatgtagagaccgtggagtacaagaacattagcttcactgtatgggatgttggcggtcaggataagatccgacctctttggaggcactactttcaaaacacccagggaccttaatttcgttgtggacagcaatgatagggatcgtgttgttgaggcaagagatgaactccacaggatgctaaaatgaggatgagttacgagaaatgctggtagtttgcttgtatttgcaaacaagcaagatctcaaatgcaatgaatgctgctgaaatcaccgataagcttggtctgcactccttacgtcaacgacactggtatatccagagcacttgtgccacttctggtgagggtttatatgagggacttgattggttatccagcaacatcgtcagcaaggcttgaaccttttatggcgtcaagagtaggagaagtgcttgaagactctggacaggattgctgctgctgcatttcttactgccatttggatttcttcgaatccgtcgcctgttgatttgctaaagacttgtctttgtagtgattgagatgcctggtctacattataggttatgtttatggagttaatttgcggaaatttgcattccatggctcatttctcattcagtactggtgggtttttttgttgttcactccgccaaattggttccttccttccttcttgaaaccatccatttttttttacccactttgtttaaacaacccagaatatgcattgattcaaaggaaaacgtaaaattttcgttacattcattgataactgtgtagtgtttcattggataattcctgttaaat

SEQ ID NO: 10854 - DNA, 1067 bp, Brassica napus
gtcattttcccagatctgttgtgttcctttcgatttcttcgaacgagtagacgtgttttcttgttgattctctagatcagagtctgtcgaaccatcgatcaatgattctccgtcattagatattgtattgggaactaagattctgattcgatctgatattattgagatccgatgcaatttgtaatcatattatacttgtttagtttaaattgatcgaatctctttttgtgtgtgtgaagaggttttgaaaaaaaaacatgggtctgtcattcgggaagctgttcagcaggctgtttgcgaagaaagagatgagaattctgatggtgggtctcgatgctgctggtaagacgaccatcctctacaagctcaaacttggtgagaacgtcaccactatcccaaccattggtttcaatgttgaaactgtgtaatacaagaacattagctttaccgtctgggatgtcggggtcaggacaagatccgtccattgtggagacactacttccagaacacgcagggacttatctttgttgtcgacagcaacgatcgtgaccgtgttgttgaagccagggacgaacttcacaggatattgaacgaggatgagttgagggatgcggttctgcttgtctttgctaaatcttcccaacgctatgaacgctgctgagattactgacaagcttggccttcactctctccgccaacgtcactggtacattcagagcacatgtcgccacctctggagaaggactctacgagggacttgactggctctccaacaacatcgcaaacaaggcgtagaagggagatagcgggattcatctttctttgcttgtttgttatatacatcagagtaaggggtctatttctctagcgctacaaaacgaaccaagtttttattatgttatacattcttcttcgtctgttcttcttcaacaatttagtactttcctttaataatctataagccttttctttttgcattttcttactgaagtgagtacattcttttctttaatcagttttttccttgtatccagtttcttcttttgagttaaacagatctttactgc

SEQ ID NO: 10855 - DNA, 765 bp, Panax ginseng
gttttttggaacgacagctccatttagagatctctgcattctaacgctcccatcgcgcacctcatcctcaatatagagatggggctgtctttaccaagcttttcagtcgcctatttgctaagagagaaatgcgcattctaatggttggtctcgatgccgctggtaaaaccacaattttgtacaagctcaaagttgggtgaaacttgtcaccactatccctacaaattggctttaaatgtggagactgttgaattacaagaacattagcttcactgtgtgggatgttggtggtcaagacaagatccgactttgtggaggcactatttccaaaacacacaagggctcatctttgtgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagagagg

SEQ ID NO: 10856 - DNA, 750 bp, Secale cereale
tcctccgtgcggttccaagctccaactcccacgcccgtctccccagagatcaggaggagcacgccccggagcgccgagacctcgaagccttcgtctccacccccggagcagagatggggctcacgttcaccaagctgttcagccgcctctttgccaagaaggagatgaggattcttatggttggtctcgatgcggctggtaagaccaccatcctctacaagctcaagctcggagagatcgtcaccaccatcccaaccatcggatttaacgtcgaaactgtcgaatacaagaacatcagcttcactgttgggatgtggggggccaagacaagatcaggccctctggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaacaagatcttcctaatgccatgaatgctgctgaaatcactgacaagcttggtctgcactccctgcgccagcggcactggtacattcagagcacttgcgcgacatctggagaaggattgtacggagggacttgactggctctccaacaacattgccacaagcttgagcgtctcgacaagtgcttcatacaagaaacaacgtgtctggatgtctcaacaactccctcgcttacctatttttactatattgtgtatatatata

SEQ ID NO: 10857 - DNA, 987 bp, Triticum aestivum
actgcacgacagccatctcttccgtgcggttccaagctccaactcccacgcccgtctcccccgagatcaggaggagcacgccgcaccggagcgccgagacctcgaagccttcgtctccacctcggagcagagatggggctcacgttcaccaagctgttcagccgcctctttgccaagaaggagatgaggattctcatggttggtctcgatgccgctggtaagaccaccatcctctacaagctcaagctcggagagatcgtcaccaccatcccaaccatcggatttaacgtcgaaactgttgaatacaagaacatcagcttcactgtttggatgtgggggccaagacaagatcaggccctgtggaggcactacttccagaatacgcagggcctcattttgttgtcgacagcaatgatagggaacgtgttgttgaggctagggatgagctccacaggatgctgaatgaggatgagctgtgtgatgctgtgttgcttgtatttgcaaacaaacaagatcttcctaatgccatgaatgctgctgaaatcaccgacaagcttggtctgcactccctgcgccagcggcactggtacattcagagcacttgtgcgacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacaggcagaagctcccttctttaagtgagctagtatcaggtcaggttgtcttttttgtatggatattatcagctgctgttcggtggttttacaaggtttaatgtgtcgacaatgtgtgtctgaaccctatctttttgagttttagtaagattggattatggttgccaatgttggtttggttcagttgaggg

SEQ ID NO: 10858 - DNA, 667 bp, Pseudotsuga menziesii
cggagatctctttgcggggagccattcttcctccctccaatctcagatctggccctttaaatccggatctctaacaggtggtcaaaatggggctcacttttaccaagcttttcagccggctcttcgcaaagaaggaaatgcgcattttgatggtgggtcttgatgctgctggtaagactaccatcttgtataagctgaagctgggagaaattgttaccaccatccctaccatcggattcaatgtggaaaccgtggaatacaagaacatcagcttcactgtgtgggatgttgggggtcaggacaagatccgtccactatggagacactacttccaaaatactcagggactcatctttgtggttgatagcaatgatagagaccgtgttgtagaagcaagggatgaactacacaggatgctgaatgaggatgaactacgtgatgctgtattacttgtgtttgcaaataagcaggatcttccaaatgctatgaatgcagcccaagtttgtcagtgatctctgacaaacttgggctgcattcccttaggcagcgccattggtatatccaaaacacttgtgcaacttctggcgagggcttgtacgagggattggattggctctccaacaacattgcaaacaaggcttgaagaaatatggtgaactgggttcct

SEQ ID NO: 10859 - DNA, 955 bp, Festuca arundinacea
tctcctttagcctctactagtctacccgcttgtgctttgggcgattccgttcgaggggaggagcggagaggagacgcggaggctggcaaggagggagatcgatggggctctcgttttcgtcgctcttcggggcgctcttcgcgaagaaggagatgcggatcttgatggtcgggctcgacgccgccggaaagaccaccatcctgtacaagctcaagctcggcgagatcgtcaccaccatccccaccatcgggttcaacgtggagactgttgagtacaagaacatcagcttcactgtttgggatgtcggtggccaggacaagataaggcctttgtggaggcactacttccagaacacgcagggccttatctttgttgttgacagcaacgacagagatcgtattggtgaggcgagagatgagctccacagaatgctgaatgaggatgagctgcgcaatgctgtgttgcttgttttgctaacaagcaagaccttcccaatgccatgaatgctgctgaaataaccgataagcttggtctccactctctgcgtcagcgacactggtatattcagagtgcttgtgctacaagtggggagggtctgtatgaagggctggactggctctccagcaacatagccagcaagtcatgaatgctttcactgggctggcagaagcaacaagcggctggacaaatgactgtaatatataggcatgttaaaatgatgtctgagttttgacatgtctttgaaaactcaatctttgagctgttatcacgctgttactcacgggtgaatgttgtgtgtggttgaatttgcacaaaacgaaaactgttatgctacaatgtgaacttttgtgccatgtgtgcccgtgtgtgatgatggccttgccatgtttctgtgtagtgtgtacagagatgtattctgcacacgattaatctcattcttgagaataatttatcc

SEQ ID NO: 10860 - DNA, 979 bp, Festuca arundinacea
ccgtctcctctagcctctactagtctactcgtttgtgcttgggcgattccgttcgaggggaggagcggagaggagacgcggaggcggggagaaagttaaggagggagatcgatggggctctcgttctcgtcgctcttcggggcgctgttcgcgaagaaggagatgcggatcttgatggtcgggctcgacgccgccggaaagaccaccatcctctacaagctcaagctcggcgagatcgtcaccaccatccccaccatcgggttcaacgtggagactgttgagtacaagaacatcagcttcactgtttgggatgtcggtggccaggacaagataaggcctttgtggaggcactacttccagaacacgcagggccttatctttgttgttgacagcaacgacagagatcgtattggtgaggcgagagatgagctccacagaatgctgaatgaggatgagctgcgcaatgctgtgttgcttgttttgctaacaagcaagaccttcccaatgccatgaatgctgctgaaataaccgataagcttggtctccactctctgcgtcagcgacactggtatattcagagtgcttgtgctacaagtggggagggtctgtatgaagggctggactggctctccagcaacatagccagcaagtcatgaatgcttccactggtctggcagaagcaacaagcggctggacaaatgactaatatataggcatgttaaaatgatgtctgagttttgacatgtctttgaaaactcaatctttgagctgttatcgcactgttactcacgggtgaatgttgtgtgggtggttgaatgtgcacaaaacgaaaactgttatgctacaatgtgaacttttatgccaggtgcgcccgtgtgtgatgaccaccttgccatgtttctgtgtagtgtgcaccgagatgtattctgcttacgattaatctcattcttgagaataatttatccgcgtgctattagag

SEQ ID NO: 10861 - DNA, 1510 bp, Secale cereale
gcgtctccgtagcctctactcgcttgtgctttgggcgattccatccgaggcgaggagagaagaggagaggaggaggcggccgaggagaagtttggtagggagatcgatggggctgtcgttcgggacgctgttcggggcgctgttcgcgaagaaggagatgcggatcctgatggtcggcctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgttgacagcaacgacagagaccgtattgctgaggcaagagatgagctccacaggatgctgaatgaggatgagctgcgcaatgctgtattgcttgttttgctaacaagcaagatcttcccaatgccatgaatgctgctagaaataacagataagcttggtctacactctcttcgtcagcgacactggtatatccagagtgcttgcgccacaagtggagagggtctgtatgaagggctggactggctctccaacaacatagccagcaaggtttctatctaacactcagggctggaatggggattttttttggtcaactttgctctggtgtttattttgtggtgttcaagtagttcaagcctttccctgtgtgtgttcagcatagttgcattatgactttgatgatgttcagaaataaatgatgcatgacactaacaagtgctattttgctgacgggattgcagtcctgaaagcttccaatggattggcagggccgcagaagcaactagcggctggacaaatgacttggaatatgtaggcatgttaaatgttgccagagtgttgacttgtctttgtaagctctatctttgagcagttatcacactgttactatgttgtactgtatcaatgattgaatgtacacacgaggaaaacctttatgctatagtgaaaatgatgccatgtacaggtcttacctgacgtccgggatggattaggaaacttaaaaaaaaaaagaaaaaaaaaaaaaaaaaaaaaaaaaaaacaaaaaaaaaaaaaaaaaaaaaaacaaaaaaaaaaaaaaaaaaaaaaaagaaaaaaaaaaaaaaaaaaaacaaaaaaaaaaaaaaaaagaaaaaaaaaaaaaaacaaaaaaaaaaacaaaaaaaaaaaaaagtaaaaaaaaaacaaaaaaaaagaaaaaaaactaaaagaaaataaacgtaataactaacatacataagacacgatagacgtacagactataacgggagacgtataggaacgcagggaatgcggataaggccagtgacagtcggaaggagatcacaggtgtaacgcgtatgaccgtaggatgcgagatagcgatgcgtatagggatgtatacatactgattgagtaagactgtagatactg

SEQ ID NO: 10862 - DNA, 712 bp, Flaveria ramosissima
gagttcagagatcgaaatccctcaaaggcacctccctgctcccaatcaatctcgaagttcacactgggttctcttcaagaaatttgcaagagtgtccagtaactttttttaatatcctaaataacaccaagatggggctgactttcaccaagctgtttagccggttatttgccaagaaagagatgcgtattctgatggtaggtcttgatgctgctggtaagaccacgatattatacaagttaaagcttggagaaattgtgacgacaattcctaccattggattcaatgttgaaactgttgaatataagaacatcagcttcactgttggatgttggtgccaagacaagatcgtccattgtggaggcactacttccaaaacacacaagggcttatctttgtggggatagcaatgacagggatcgtgttgttgaggcaagggatgaattgcataggatgttgaatgaggatgaacttagagatgctgttttgctggtgtttgctaacaaacaagatctgcctaatgccatgaatgctgctgaaatcactgataagcttggccttcattcactccgtcaacgccattggtacattcagagtacatgtgcaacatctggtgagggcctttatgaagggctggattggctctccaacaacattgctaacaaggcatgagagtacaaaaggcttttgttgtggtgtaagttcatggtag

SEQ ID NO: 10863 - DNA, 711 bp, Primula obconica
ctcccacattcttgcgcgtcggtctcaagcttacattctctctctttctctctagagatccctccgctcgcagggatcaactaaaaggaaagagacatgggtttgacattcaccaagcttttcagtcggctttttgccaagaaggagatgcgtatccttatggtaggtctcgatgccgctggtaagaccaccatcctgtacaagctcaagctcggtgagatttgtgaccacaactccctaacctatttgggtttaacgtaggaaactgtcgagtaacaaaacatcagctttaccgtgtgggatgttgggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattacttgtctttgccaacaaacaagatcttcctaatgcaatgaacgctgctgaaataactgacaaacttggtctgaactctctccgacagcgccactggtatatccagagcacttgtgcaacctccggtgagggcctgtatggaggggttggattggctctccaaacaacattgacaaataaggcttgagtagtgggggcttgatacttggatgcaggatggttctttttatctagtcttaattttttt

SEQ ID NO: 10864 - DNA, 876 bp, Primula obconica
aaactcccacattcttgcgcgtcggtctcaagcttacattctctctctttctctctagagatccctccgctcgcagggatcaactaaaaggaaagagacatgggtttgacattcaccaagcttttcagtcggctttttgccaagaaggagatgcgtatccttatggtaggtctcgatgccgctggtaagaccaccatcctgtacaagctcaagctcggtgagattgtgaccacaactccctaccagtttgggtttaacgtggaaactgtcgagtaacaaaaacatcagtctttaccgtgtgggatggttggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattacttgtttttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtctaattttttacttcttttttcttgtgagacaatatattgtcatcgacttcaattttaagtgtttatgttgattaaggattttgcaatgtctattgatctttatcagaaaggtttgttgaattcgtgcactatcagaattgtgctccagattttactgggtgcatacaattaatagccac

SEQ ID NO: 10865 - DNA, 1023 bp, Secale cereale
tcctccgtgcggttccaagctccaactcccacgcccgtctccccccgagatcaggaggagcacgccccggagcgccgagacctcgaagccttcgtctccacccccggaggagagatggggctcacgttcacaaagctgttcagccgcctcttcgccaagaaggagatgaggattctcatggttggtctcgatgccgctggtaagaccaccatcctctacaagctcaagctcggagagatcgtcaccaccatcccaaccatcgggatttaacgtcgaaactgtcgaatacaagaacatcagctcactgttgggatggggggggccaagacaagatcagggccccctagtggaggcactacttccagaatacgcaaggctcaatttgttgttgacagcaatgataggagcgtgttgttgaggctagagacgagcttcacagggatgctgaatgaggatgagctgcgtgatgctgtgttgcttgtatttgcaaacaaacaagatcttcctaatgccatgaatgctgctgaaatcaccgacaagcttggtctgcactccctgcgccagcggcactggtacattcagagcacttgtgcaacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacagacagaagctcccttctttaagtgagctagtatcaggtcaggtgttttttgtttattggatattatcagtattcccgccgtcgtggttttactaaggttactttgttcgccatgtgtgcatgaacccctactcttttgtagtgtagtaagattgaatgtggttgccaatgttggttggttcagttgagtgatgtggatggggtacgatgttgataacatacttatgtgagcgatgttt

SEQ ID NO: 10866 - DNA, 563 bp, Bupleurum chinense
tgtatctttcagtctttctccatcgttcgtgtattaggaaaaatgggtttgtctttcaccaagctgtttagtaggttgtttgcaaagaaggagatgcgtatacttatggtcggtctcgatgctgctggtaagaccaccatattatacaagcttaaaagtgggagagattgtcactaccattcctacaatcgggttcaatgtggagacggtagaatacaagaacatcagctttacagtttgggatgtcggtggtcaggacaagattcgacccttgtggagacactatttccagaatacacaaggtcttatctttgtggtcgatagcaatgatagggatcgtgtggttgaggctagggatgaattgcacaggatgttgaatgaggatgagctgagggatgctgtactccttgatttgctaacaaacaagatctgccaaatgccatgaacgctgctgagataactgataagcttggtcttcactctctcaggcagcgacactggtatatccagagcacatgtgccacatctggagaagggctatacgaggggctggactggctctc

SEQ ID NO: 10867 - DNA, 1449 bp, Cichorium intybus
cgatggcaccaaaggcagagaagaagcccgccgagaagaagccagcggaggagaagaaaactccggtcgctgagaaagcaccagcagagaagaagccaaaggccggaaagaaactgcctaaggaggctggcgctgccgctggggacaagaagaagaagagaaccaagaagagcgttgagacttacaagatctacatcttcaaggtgttgaagcaagttcatcccgacatcggtatctccagcaaagcgatgggaattatgaacagtttcatcaacgatatctttgagaaattggctcaggagagttcgaggctcgcaaggtacaacaagaagccaacaatcacatcgagggaaatccaaacagctgtaagacttgtgcttcccggtgaattggccaagcatgccgtgtctgagggcactaaggccgtgaccaaattcacgagctcttagatatttggtactatttgttagtcgtgtgtaacaatgtgttggtgatatatgatagggttagatcgtcatatctcgtgatgatttgttagaagctatgttgatgtattgttcttatttgacttttgttttgattagtaattgatgttatcgatctgatatgcgttcttaagattctgatatcaaagaaaaaagatggggcttacgttcaccaaactcttcagccggctgtttgccaagaaagagatgcgtatacttatggtgggtctcgatgcagctggtaagaccaccattttgtacaagctcaagctcggtgagattgtcacaacaatccccaccattggctttaacgtggagactgttgagtacaaaaacattagcttcactgtgtgggatgtggggggtcaagacaagatccgtccactatggaggcactacttccagaacacacagggacttatctttgtggttgatagtaatgacagggatagagttgttgaggcaagagatgagttgcataggatgttgaacgaggacgagcttcgaatgcagtgttgcttgtatttgctaacaaacaaatttccaaatgcaaagaatgccgctgaaatcctgaaagctggcctccattccctccgacagcgccctggtacattcagagcacgtgtgcaacctcgggtgaaggactttacgagggtctggattggctttctaacaacattgctaacaaggcataatgtgatacttgaatgcggatcctggatgggaggttttctcattctcgttcttgttctgagctgtgtgcggttctgggatttgttggttaaacagctttttgtgcttttgtgttggtagcaatgtttctgtctgatataatatttggttgtattgcaacttcttttttttttttttataaagtattcttgtctagattttgctttataaacctaaagctgtaacagaggttaattttgcttgttttatatagtttgctccctattctatt

SEQ ID NO: 10868 - DNA, 647 bp, Panax ginseng
tatattgtttgtcgcggaggaagatagagagagaaacaaaagagagaaaaagagaggaagatatctctgtttctttctcgtcgtatttccaattcattcgcttccttctgtaggagtagctaagatggggctgtctttcaccaagctcttcagtcggctgtttgcgaagaaagagatgcgcatactgatggtgggtctcgatgcagctggtaaaacaccattctttacaagctcaagttgggagagatagttacaacaattcctaccattggatttaatgtggagaccgtggaatataagaacattagcttcaccgtttgggatgttggtggccaggacaagatccgtcctttgtggagacattacttccaaaacactcagggtctcatctttgtggttgatagcaatgatcgagatcgtgtggttgaagccagggatgaacttcacagaatgctgaatgaggatgagttaaggatgccgtgctacttgtatttgcaaacaagcaagatcttcccaatgcaatgaatgctgctgagattactgataaacttagccttcactctctccgtcagcgccactggtatatccagagcacatgtgccacttccggtgaagggctgtacgaggggctggactggctctcaaac

SEQ ID NO: 10869 - DNA, 657 bp, Panax ginseng
aaaaagagaggaagatatctctgtttctttctcgtcgtatttccaattcattcgcttccttctgagtagctaagatggggctgtctttcaccaagctcttcagtcggctgtttgcgaagaaagagatgcgcatactgatggtgggtctcgatgcagctggtaaaacaccattctttaacaagctcaagttgggagagatagttacaacaattcctaccattggattttaatgtggagaccgtggaatataagaacattagcttcaccgtttggatgttggtgccaggacaagatccgtcctttgtggagacattacttccaaaacactcagggtctcatctttgtggttgatagcaatgatcgagatcgtgtggttgaagccagggatgaacttcacagaatgctgaatgaggatgagttaaggatgccgtgctacttgtatttgcaaacaagcaagatcttcccaatgcaatgaatgctgctgagattactgataaacttagccttcactctctccgtcagcgccactggtatatccagagcacatgtgccacttccggtgaagggctgtacgaggggctggactggctctcaaacaacattgcaaacaaggcataggctgctgaatgtgagtttggatcgtgattatagccagat

SEQ ID NO: 10870 - DNA, 778 bp, Triphysaria pusilla
tctttcaccaagcttttcagccggctgtttgccaagagagagatgcgtatactaatggttggtctcgatgctgctggtaaaaccaccattctctacaagctcaagctcggagaaatcgtcaccacaattcctactattggattcaatgtggagactgtggaatataaaaatattagcttcactgtttgggatgttgggggccaagacaagatccgtccattatggaggcattatttccagaacacccagggcctaatctttgttgttgacagcaatgatcgagaccgtgttgttgaagcaagggatgaactgcacagaatgttgaatgaggatgaattgcgagaagctgttctcttggtgtttgcaacaagcaagatctcccaaatgcgatgaatgctgctgaaataaccgacaaactggggcttcattctctccgccaacgccattggtacattcagagcacatgtgcaattctggcgaggggctgtacgaaggactagactggctttcaaacaacatcgctaacaagtcttgaatgctttgtttgtgagatcgaagtgttgatttgagatttgccgttcaaacttggttccgtttatgaacaatgctttcagtgtacttttgtgataatttgtagatttttgttggtgtttgttgatctctctctctctatatattcttgcttgtgaaagtaggagtgaatattgggccgaacttacgtatgtgagtattacgaaaataattgtatgttggataatcgaccagattcgagctttgg

SEQ ID NO: 10871 - DNA, 856 bp, Fagus grandifolia
gtctgattcaatatctcagggcagcttctctcagatctgcccaatcccttttcacatcttcaccatcttgagataaaagatggggctgtctttcaccaagcttttcagccggtctttttgccaaaaaggagatgcgtagttctaagtggtggtctcgatgcggctggtaagaccacctatttgacaaggctacaagtctgggagagattgtcacaaccattccgaccagttggtttcaatggtggagactgtggaatataagaacattagcttcactgtctgggatgttgggggccaggacaagattcgacctttgtggagacattacttccaaaacactcaggggcttatctttgtggttgatagcaatgaccgtgaccgtgtggttgaggctagggatgagctgcatcggatgttgaatgaggatgaattgagggaagccgtgctgcttgtatttgcaaacaagcaagatctaccaaatgccatgaatgctgctgaaataactgataagcttggtcttcactccctccgtcaacgccactggtatatccagagcacatgtgccacttctggggaagggctgtatgagggattagactggctttccaacaatattgctaacaaggcttaggggatcagtaaatcttcagtaaactgttttgggctgcaatctctgttgaaggtagtattttactgttgttatgtggttgtttatgtcgttttacattgatactgtcttgagaatcgtatcttgtttgtttagattcaattgttacaattatagatagtaaaatgaaatttgacctttgtaagtattctaaatattactaatgatttcactagttcatagtatgta

SEQ ID NO: 10872 - DNA, 952 bp, Cannabis sativa
cagaacatacacattcagaaatggggctgacattcacgaagctcttcagcaggctctttgccaagaaagagatgcgaattctgatggtgggtcttgatgccgctggtaagaccaccatcttgtacaagctcaagcttggagaaatcgttaccaccatccccactattggatttaatgtagagacagtagagtacaagaacattagcttcacagtttgggatgttgggggtcaggacaagatccgcccactgtggaggcactatttccagaatactcaaggtcttatttttgttgttgatagcaatgatagggatcgagttgttgaggcaagagatgagttgcaccgaatgttgaatgaggatgaactgagagatgctgttctgctcgtatttgccaacaaacaagatcttcctaatgcaatatacttgatcgttggtgactctccattctcttcgccaacgtcactggtacatccagagtacatgtgcaacctctggggaaggtctttacgaagggttggactggctctccaataacattgctagcaaggcataaggtttgagacagttctaagattttcgtgttttgccagccacctatgggaaggatggttttctttaattaagtgaatattgtaatagcagacagtttggctaaactttggattatgtaattcaagttcaggttttataaccatcacctttagctttactttttacttgtttagttgtaagcaaaagctgctattttataatggaattatgtgagtcgtgttcaggaccaggtacaagttcatcttgtttactcttttcatgcatgtttgcttttaaattgtttgaggctgtagaatttctacacataggctactatctctctccttgaattataaggttgtggactgtggtgtatgcgagctctcatagtatggatatcaataatttgacgtaagaag

SEQ ID NO: 10873 - DNA, 649 bp, Quercus alba
atcgggaccactccccatttcacgcattcctgtaaagctcatttttttttctctctctctaagcgttttttttcactagatccctctgcgaagctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcggggggccaggacaagatccgtcccttgtggaggcactactttcagaacacacagggtcttatatttgtggtggacagcaatgacagagaccgagttgttgaggcgagggatgaactgcataggatgttgaatgaggacgaactgcgagatgcagtgttgcttgtatttgctaacaaacaagatcttcccaatgcaatgaatgctgcggagattactgataagcttggcctccactccctccgtcaacgccactggtatatccagagcacttgtgccacttctggtgaagggctttatgaaggacttg

SEQ ID NO: 10874 - DNA, 861 bp, Humulus lupulus
gtgcctcatttctctctgggcagcttctcagatctgccccttttctcagcttctctcgtaatcgtctttttcgcttgagccatccgagattaagaaatggggttgtctttcaccaagctcttcagtcggctttttgccaaaaaggagatgagaattctaatggttggtctcgatgccgctggtaagaccaccatcttgtataagctcaagctgggagagattgtgacgaccattcctacaatcggattcaatgtggagactgttgaatataagaacattagctttaccgttctgggagtgtcggggtcaggacaagattcgacctctgtggagacactacttccaagaatactcaagactcatctttgtggttgacagcaatgatcgtgaccgtgttgtcgaggctagggatgagttgcatcgtatgttgaatgaggatgtgttgagggatgctgtgctgcttgtatttgccgacaaacaggatctcccaaatgccatgaatgcagctgagatcacagacaaacttggtctcactctcttcgccaacgtcactggtacatccagagcacatgtgccacatctggggaaggactctacgaaggtctggattggctctccaacaatattgctaacaaggcttaaagagacctgatctctgttgaaggatttcacgcagcaattggtgtcatcatggcatgctgcctcccttattagtttggttgttgatgggatttctttttattctttttttttactgtcattaattaatgtatctgttcagaatttgtttccacaaaatagaaattgccattttatcctgtagatgctaaataattcatggttcttagaatatataaacga

SEQ ID NO: 10875 - DNA, 941 bp, Panax ginseng
gcatcaaacggtattggagtagagactgcacgtgtccttgccttgcgaggtgtgcatgtagttatgggagtgagaaatgttagagctggtgaaaaagttaaacaagaaatactccagaaaatccccaatgctaaaattgatgttatggaaatagatctatactcacaggaatccataaggaaatttgcgaaggaatatatttcctctggtcttcccttgaacattctcattaacaatgcagggataatggcacctccgttcacgctttctaaagacaacccctgagctcattgtgcgagatccatccctagggagagagataaaacatccactctggtttcctctcgttcattcgctctcttctttaggatcaaagatggggctgtctttcaccaagctcttcagtcggctgtttgccaagaaagagatgcgcatactgatggtgggtctcgatgcagctggtaaaactccattctttacaagctcaagctcggagagatagtcacaacaattcctactattggatttaacgtggagactgtggaatataagaacattagcttcaccgtttgggatgttggtggccaagacaagatccgtcctttgtggagacattacttccaaaacactcagggcctcatctttgtggttgacagcaatgatcgagatcgtgtgattgaagccagggatgagctgcacagaatgctgaatgaggatgagttagagggatgctgtgctacttgtatttgcaaacaagcaagatcttccaatgcaatgaatgctgctgagatttactgataaacttggccttcactctcttcgtcagcgccactacggtatatccagaagcacttgtgccacttctggtgaagggtgtacgaggggctggactggctctcaaataacattgtcgaacaaggcgtagacggcttatctgagtt

SEQ ID NO: 10876 - DNA, 688 bp, Panax ginseng
aaaacctctgactccatcttgaaatcaatcctcagtgaagctttgaaaagtgttgagtgaagatggggctatctttcacgaaactgttcagcaggctctttgcgaagaaagagatgcgcattctgatggtaggtcttgatgctgctaggtaaagactaccatcttgtataaggctcaaacttggagaaattgtcacaacaatccctacaattggatttaatgttgagactgtggaatacaaaaacattagcttcactgtttgggatgttggaggccaggacaagatccgtcgattgtggaggcactacttccagaaacacacaaggtcttatctttgtggtggatagcaatgacagagatagagttgttgaggcgagggatgagttgcataggatgttgaatgaggatgaacttagggatgctgttttgcttgtctttgccaacaaacaagatatgcccaatgcaaatgaatgctgcggagaataacagacaagcttggtcttcattctctccgtcaacgtcactggtacattcagagcacatgtgccacctcaggtgagggacttatgaagggcgtggagttggtcgttctaactaacattgctaacaaggacgatgagcgtgaagtagtagttcgagttagtaccgaagtgggtagttttccatgaatccaatgtgacatacaccc

SEQ ID NO: 10877 - DNA, 933 bp, Festuca arundinacea
ccgtctcttctagcctctactagtctactcgtttgtgcttgggcgattccgttcgaggggaggagcggagaggagacgcggaggcggggagaaagttaaggagggagatcgatggggctctcgttctcgtcgctcttcggggcgctgttcgcgaagaaggagatgcggatcttgatggtcggctcgacgccgccggaaacccaccatcctctacaagctcaagctcggcgagatcgtcaccaccatccccaccatcgggttcaacgtggagactgttgagtacaagaacatcagcttcactgtttgggatgtcggtggccaggacaagataaggcctttgtggaggcactacttccagaacacgcagggccttatctttgttgttgacagcaacgacagagatcgtattggtgaggcgagagatgagctccacagaatgctgaatgaggatgagctgcgcaatgcggtgttgcttgttttgctaacaagcaagaccttccaaatgccatgaatgctgctgaataaccgataagcttggtctccactctctgcgtcagcgacactggtatattcagagtgcttgcgctacaagtggggagggtctgtatgaagggctggactggctctccagcaacatagccagcaagtcatgagtgcttccactgggctggcagaagcaacaagcggctggacaaatgactgtaatatataggcatgttaaaatgatgtctgagttttgacatgtctttgaaaactcaatctttgcgctgttatcacactgtactcacggatgaatgttgtgtgggtggttgaatgtaaacaaaacgaaaactgttatgctacaatgtaaacttttgtgccaggtgcgcccgtgtgtgataatcaccttgccatgtttctttgtagtgtgtaccgagatgtattctgcacacg

SEQ ID NO: 10878 - DNA, 642 bp, Pinus taeda
atcttcattcatttcaggcctctgcagaaacgaactctccatcagcggggtctgcgattttacagaatatctggttttctctcgagttttgcaagatggggctcacgttcaccaagctttttcaaacgtctgtttgccaaaaaggaaatgcgtattctgatggtgggtcttgatgctgctggtaagactaccattctgtacaagctgaagcttggagaaattgtcacaacaattcccactattggtttcaatgttgagactgtggagtacaagaatattagctttactgtttgggatgtcggaggtcaggacaagatccgaccactatggagacattactttcagaatacccagggtcttatatttgtggttgatagtaatgacagggaccgtgttgttgaagcaagagacgaattgcataggatgctgaatgaggatgagttgcgagatgctgttctccttgtatttgtaaacaagcgggatcttcccaatgtgatgaatgttgctgagataattgataagcttggcctgcgttctttgcgtcagtgccattggtatatccaaaatacatgtgctacttatggtcaaggattgtatgaaggtttggattggcttttctaacagcattgcaaacaaggcata

SEQ ID NO: 10879 - DNA, 803 bp, Panax ginseng
tagacagagcggtttttttggaacgacaactccactttagtagatctctgcattccaacgttcccatcgcccacctcatcctcaatatagagatggggcgtgtcttttacctaagcttttctagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaggacaagatccgacctttgtggaggcactatttccaaacacacaagggctcatctttgttgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgt

SEQ ID NO: 10880 - DNA, 695 bp, Amborella trichopoda
gggggcgctctacctgtgtgtccgtgcatcgcgagagcagtgtcaacgcagatacggggggcgtccttgttaccacccatctggcggagctttcatctcgttgctctccaaattcgggaaaaatggggctcactttcacaaagcttttcagccggttgtttgcgaagaaagaaatgcgtattctaatggttggtcttgatgcggctggtaagaccaccatattgtacaagctcaagtcgttgggcgagattgcaccatctccccacttagttgggtaatttaatggtatgtggagacagtcgagtataagaacattagcttcactgtttgggatgttggtggtcaggacaagatccggcctttgtggaggcattatttccagaatactcagggtcttatctttgttgtcgatagcaatgatagagatcgtattgtggaggccagagatgagcttcacaggatgctgaacgaggatgagctgagagatgctgttctgcttgtgttttgccaacaaacaagatcttccaaatgcaatgaacgctgctgagatcactgataagctgggtcttcactccctccgacaacgccattggtacattcagagtacttgtgctacatctggggaggggctttacgagggggttggactggctctcaaacaacaattgctaacaaggcctgaaaagttaagactg

SEQ ID NO: 10881 - DNA, 734 bp, Panax ginseng
ttttttggaacgacaactccatttagagatctctgcattccaacgttcccatcgcccacctcatcctcaatatagagatggggctgtcttttaccaagctttcagtcgcctatttgctaagagagaaatgcgcattctaatggttggtctcgatgccgctggtaaaaccacaattttgtacaagctcaagttgggtgaaattgtcaccactatccctacaattggctttaatgtggagactgttgaatacaagaacattagcttcactgtgtgggatgttggtggtcaagacaagatccgacctttgtggaggcactatttccaaaacacacaaaagggctcagtctttgttgttgacagcaatgattcgagaccgtgtgttagaggctagagatgaactgcacaggatgttgaatgaggatgaactgagagatgctgtactccttgtgtttgcaaacaagcaagatcttcaaaatgcatgaatgctgctgagattactgactaagcttggtttgcattctcttcgacaacgactatttggtattattcagagcacatgcgccacatctggagaaggtctagtacgagggactggattggctttcaaacaatattgctaacaaggcttagtgggctactctaccggctcagttggtactcaaaagaaatacattggtgcagtcaatctggttataagtgttgttgcaatgactcttgtataattgcttttggtg

SEQ ID NO: 10882 - DNA, 876 bp, Fagus grandifolia
aaatatcgttgcgaaggatagctccttttgtttacacgcagagagagaaaaggaagctacatctctcaatctctcttctctttcctcacttctcatcgcccagaatacgtagaaaaatggggctgtctttcaccaagtcttttcagtcgtctctttgctaagaaagagatgcgtatactcatggtgggtctcgatgctggcgggtaagactactattctctacaagctcaagcgtgggagagatagtccaccaccattccctacctagtttgggtttaatggtggagactgtggaatataagaacatcagcttcactgtctgggatgttgggggtcaggacaagatccgtcccttgtggagcactacttccagaacacacagggtcttatatttgtggtggacagcaatgacagagaccgaattgttgaggcaagggatgaattgcataggatgttgaatgaggacgaactgcgagatgcagtgttgcttgtatttgctaacaaacaagatcttcctaatgcaatgaatgctgcggagattactgataagcttggcctcaactctctccggcaacgtcactggtacatccagagcacctgtgcaacctcaggagaggggctttatgagggtttggattggctctcaagcaacattgcgaacaaggcatgaagctcctggggagttgttttgttgtgcactgacaattctggatgcaggggtgaatattatctagttctttttaaagacaattggattgtggttatgtcctttttattcgggaaatgtattcttttattaggtaactttgtggtctatattgtaatagtaaaattttatgtggatatatatacttgagtctttttgttgggttgtat

SEQ ID NO: 10883 - DNA, 742 bp, Lippia dulcis
aaaaggggtttatctttcacaaaggttttcaggcgactgtttgccaagaaagaaatgagaattcttatggtaggtctcgatgctgctggtaagaccaccatattatacaaacttaagctgggagaaatcgtgacagccatacctacaattggattcaatgtggagacggtggagtacaagaacattagcttcatcgtgtgggatgttgggggtcaagataagatccgaccattgtggaggcattactttcagaacactcaaggactgatttttgtagttgatagtaatgatcgtgatcgtgttgttgaggctagagatgaactgcataggatgttaaatgaggacgagctaaggaatgcagtgcttctgtttttgtccaacaaacaagatcttccgaatgccatgaatgctgctgagataaccgacaagcttggacttcactctcaacgacacgtcactggtatattcagagcacatgtgctacctctggtgaagggctatatgagggtctcgactggctctccaacaacattgctaacaaggtataaaggaaaggtgtgtgtttccaagaaatctttggcatctcaatccgggagattgttattttgtttctgtaatttttgtttaaaaaaattactaagactacctttcttcatagatagccatctatctccatttatggagattgagatttgcttgtgtaatttcagaagttataccatatctgtctcgtattgttttg

SEQ ID NO: 10884 - DNA, 502 bp, Ambrosia trifida
gccaagaaagagatgcgtattttgatggtgggtcttgatgcggctggtaagactaccattttgtacaagctcaagcttggggagatcgtcacaactatcctaccattgggtttaatgtggagactgtcgagtacaaaaacatcagctttactgtctgggatgttgggggtcaggacaagattcgtccactatggaggcactactttcagaacacacaaggtcttatctttgtggttgatagcaatgacagggatagagttgttgaggcaagagatgagttacataggatgttgaacgaggacgagcttcgcgatgcagtcttgcttgtatttgccaacaaacaagatcttccaaatgcgatgaatgctgctgaaatcactgataagcttggcctccattccctccgacagcgccactggtacatccagagcacctgtgcaacctcaggagagggactctacgagggtctggattggctttctaataacatcgctaacaaggc

SEQ ID NO: 10885 - DNA, 868 bp, Sarracenia psittacina
gactacgccctgcgagatgttccggccagggagcctttgccaatagaaaagagggttgcatcaccaagctttcagccggcttttgccaagaaagaaatgcgtatccttatggttggtttggatgctgctggtaagaccaccatttatacgagctcaagctgggagattgtgaccacaatccctactattggctttaatgttgaaaccgttgagtacaaaaatatcagtttcaccgtgtgggatgttggtggccaggacaagattcgtccattgtggaggcactatttccagaacacacagggtctcatttttgtggtggatagcaatgacagagaccgagttattgaggcaagggatgaattgcatcgcatgttgaatgaggatgaagctccgcgatgcagtactgctcgtatttgccaacaaacaggatcttcccaatgcaatgaatgctgctgaaataaccgacaagcttggtctcaactctcttcgtcagcgtcactggtacatccagagcacctgcgcaacctctggggagggactgtacgagggattggattggctctctaacaatattgctaacaaggcttgagatgttgcggaaagtttttgttgggttgtcctggatgcagtgtggtcttatctaagtctcttgtactttttcttttcttttctaccttacctctgccgggcggtttgtgtttatgaattttcattttttcttaaaaggctttttcagattttgtaatggctatgttaacattgtgatgaatgatggatacacatatttccaattctttaaaaaaaaaaaatatttatagattttgaatataatgcttatgactggaagtttgattaatatggtgttgaa

SEQ ID NO: 10886 - DNA, 571 bp, Triphysaria pusilla
cttgtgctggttgaagagatcttgagctcacagatctctacacctctcattttcaatttgaaagatggggttgtctttcaccaagcttttcagccggctgtttgccaagagagagatgcgtatactaatggttggtctcgatgctgctggtaaaaccaccattctctacaagctcaagctcggcgaaattgtcaccacaatccctactattggattcaatgtggagactgtggaatacaaaaaatattagcttcactgtttgggatgttggaggccaagacaagatccgtccattatggaggcattatttccagaacacccagggcctaatctttgttgttgacagcaatgatcgagaccgtgttgttgaagcaagagatgaactgcacagaatgttgaatgaggatgaattgcgagaagctgttctcttggtgtttgccaacaagcaagatctcccaaatgcaatgaatgctgctgaaataaccgacaaactgggccttcattctctccgccaacgccattggtacattcagagcacatgtgcaacttctggtgaggggctgtacgaggg

SEQ ID NO: 10887 - DNA, 507 bp, Ambrosia trifida
ttgccaagaaagagatgcgtatattgatggtcggtctcgatgcagctggtaagaccaccatttgtacaagcttaagctcggcgagattgtcaccactattcctaccataggttttaacgtggagactgttgagtcaaaaacattagcttcaccgtgtgggatgtcgggggtcaggacaagatccgtccgctatggaggcattacttccagaatacccaaggtcttatctttgtggttgatagcaacgacagggacagagttgttgaggcaagagatgaattgcacaggatgttgaacgaggatgagttaagagatgcagttctccttgtatttgctaacaaacaagatctcccgaatgcaatgaatgctgctgaaatcactgataagctcggtctccactctcttcgacagcgccactggtacatccagagcacttgtgcaacctctggagagggactttatgagggactggactggctttccaacaacatagcaaacaaggcatga

SEQ ID NO: 10888 - DNA, 1328 bp, Panax ginseng
tattgccttatggctttggcattatgtgtaatggttccttatgacaagatatcaaatagtgcatcattttcgattgccttccaaaccaagggatggaaatgggctggcaatgctgttggagctggtgcaagcctgggaattgtggcgtctctcctggttgccatgcttggccaagctaggtatctttgtgttattggaagggcgcggcttgtgccatcctggttagccaaggtgcacccttcaacaggcaccccattgaatgcaaccatcttcttgggggtctgccaggcatctattgcactcgtcactgacctaaacattgtaattgaaatgatctccattggcacattgtcggttttctacttagtggcaaatggacttatctatcgccgcaacaatggtggggtctgccattatgcggtggttctatgatcataatcactgccttcttccagtatatggtcccttgctttcgacaaactaccgaatggtcggttcccttaatgccatggccagcagctatatcaatctttcttaatgttttccaattcattcgcttccttctgagtagctaagatggggctgtctttcaccaagctcttcagtcggctgtttgccaagaaagaaatgcgcatactgatggtgggtctcgatgcagctggtaaaacaaccattctttacaagctcaagttgggagagatagttacaacaattcctaccattggatttaatgtggagaccgtggaatataagaacattagcttcaccgtttgggatgttggtggcaggacaagatccgtcctttgtggagacattacttccaaaacactcagggtctcatctttgtggttgatagcaatgatcgagatcgtgtggttgaagccagggatgaacttcacagaatgctgaatgaggatgaggttaagggatgccgtgctacttgtatttgcaaacaagcaagatcttcccaatgcaatgaatgctgctgagattactgataaacttagccttcactctctccgtcagcgccacgtggtatatccagagcacatgtgcctacttctggtagaaggggttgtatggaggggcgtggacgtggctctacaaaacaactattgacaaacgaaggcataggaggctgctagaatctgttggtttggatcgtgtattatacgccagaagtaaaggtagtttgtcgttattttctttgttgtttctagaaattcttagtaacatagttagttttctatttttgttttgttttgaaatctgtaccatgttgatgtttacctatttacaatctcttctcaagatattgtcattttgcc

SEQ ID NO: 10889 - DNA, 634 bp, Picea glauca
cctctgcagaaacgaacccttcatcagcggggtctgcgattttacaggatatttgattttctctcaagtttggcaagatggggctcacgttcaccaagccctttcagcggctgtttgccaagaaggaaatgcgtattctgatggtgggtcttgatgctgctggtaagactaccatcttgtataagctgaagctgggagagattgttaccaccatccctaccatcggattcaatgtcgaaactgtggagtacaagaacatcagcttcactgtgtgggatgttgggggtcaggataagatccgtccactatggagacactacttccaaaatactcaaggtctcatctttgtggttgatagcaatgacagagaatcgtgttgtagaagcaagggattgaactacataggatgctgaatgaggatgaactacgtgatgctgtattacttgtgtttgacaaataagcaggatcttccaatgctatgaatgctgcagagatcactgacaaacttgggcttcattcccttagacagtcgccattggtatatcccaaagcacttgtagtcaacttctggccgtaggggattgtacgaggggtttcggattgggctttccgaacacattgcaaacaggcttag

SEQ ID NO: 10890 - DNA, 904 bp, Cenchrus ciliaris
ttttcttcgccccgcccgaagtcgaggaggagagagggggagcaggagctgcgagatcgcgcgcacccgagatctccagtaagttgttgcaacatgcggctcacgttcaccaagctcttcagccgcctcttctccaagaaggagatgaggattctcatggttggtctcgatgcagctggtaagaccaccatcctctacaagctgaagcttggagagatcgtcaccaccattcccacaatcgggttcaatgtggagactgtcgaatacaagaacatcagcttcactgtctgggatgtcgggggtcaggacaagatcaggccattgtggaggcactacttccagaacacgcaagggcttatctttgttgttgatttttttttcacaccctcctgttgttgaggcaagagatgagcaacaagggaggggaaatgaggatgagttgagggatgctgtcttgctcatttttgctaacaagcaagatctgccaaacgcaatgaatgctgctgatattaccgataagcttggtctccattcccttcgccaacgccactggtatatccagagcacctgtgctaccacaggagaaggtttgtacgagggttttgactggctctccaacaacattgcaaacaaggcctgattggacaattctgtggcttcgtggagtacatggcggttgcattttccgcagaaacagatccatgggtcgttttgaccttgagacttgattattatttcgttggaatgcttgtcaagtattgtatttctttgctaggcttttcagagagctggtttgtccttatgtggcgtgattatactctccaaatacctgttctaatattaagacaatgtaattggccattggtactagatcgtttaccagtaatgcagttcatttcaaaat

SEQ ID NO: 10891 - DNA, 663 bp, Fagus grandifolia
tatttttctttggcttccttatgcttctcagcttatttgaaggcataacttgtatttccttctcccaactttctgttcagcaatgggtttggcaatttctcgacttgtgaagatgctcttcgcaaagaaagaaatgaggattctgatggttggtcttgatgctgcaggaaaaacaacatcctctataagctgaaacttggagaaattgttactacaatacccactattgggttcaatgtggaaactgttgaatacaaaaatgttagcttcacagtctgggacgtcggaggacaggacaagattcggccattatggagacactactttcagaacactcagggtctgatctttgtggtggatagcaatgatagagaaagagttacagaagccagagatgagctccaccggatgctaagtgaggatgagctacgtgatgcaattttgctagtatttgccaataagcaagacctcccaaatgctatgagtggttctgaaatcactgataaactaggactgcattcactccgccaacgccgctggtacatccaagctacatgtgccacttctggcccaaggactttatgaaggccttgattggctatccagcaacatctctagcaagggataacttaggcagctatcaaaggtttacgcaccttatac

SEQ ID NO: 10892 - DNA, 898 bp, Primula obconica
aaaactctctttctctctctagatccctctgcatagaaccttcttacagggttcaaccaacaggaaagagacatgggattgacgttcaccaagcttttcagtcggctgtttgaccaaaaaggagatgcgtatcctgatggtaggtcttgatgcggctggtaagaccaccattctctacaagctcaagctcggtgagtattgtcgacccacaactcccctactagtcggtaatttaatgtacgaaactgtagagtacaagaacattagtctttaccgtgtgggatggtcggaggtcaggacaagactccgtccattgtggaggcactatttccagaacactcgagggtcttatttttgtggtggatagcaatgacagagaccgtgttgttgaggcaagagatgagttgcaccgcatgttgaatgaggatgagttgcgagatgcagtactgctggtctttgctaacaaacaagatcttcccaatgctatgaacgctgctgaaataacagacaggcttggtctccactctcttcgacagcgccactggtacatccagagcacttgtgcaacatctggcgagggtctgtatgaggggttgggattggctctccaacaacatagctaataaggacttgagtacggtgattcatcctgtgggagtaacactggatatgcagctttcttatctagtctgtttcgttcccttatatttcttgtccgaaaatttgttgttatcgatttaattttgtaagtgtttttttcttgattaagaattttgcggctctctattacaatggggtttgttgaaatcatgatgcaccatcaaaattctgcagatttgactatgaatgcatgtgatatgtagtacctttgttttttgtgctatcgatatggttaaat

SEQ ID NO: 10893 - DNA, 1023 bp, Panax ginseng
gacagagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttggtactcgaatgccgctggtaaaaccacaattttgtacaagctcaagttgggtgaaattgtcaccactaatccctacaaatttggaccttttaaaagtggagacctgttgtaattcaagaacattagcttcactgtgtgggatgttggtggtcaagacaagatccgacctttgtggaggcactatttccaaaaaacacaagggctcatctttgttgttgacagcaatggatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtggtttggatttcaatttcttgtcgtggtgagagaggaaaaagatgatgttaaatttcccttgacttatctgcttaataatatacatagtattacaaatggatttattgaactaaaaaaaaaaacaaaaaaacaaaaaaacaaaaaaaacaaaaaaacaaaaaaacaaaaaaaacaaaaaaacaaaaaaacaaaaacaaaacaacaagagagagacacagagagtagagacacacaccaccgacccaccccccccccccccccccccccccccccc

SEQ ID NO: 10894 - DNA, 711 bp, Primula obconica
acattcttgcgcgtcggtctcaagcttacattctctctctctctctctctagagactccctccgctcgcgagggatcaaactaaaaggaaagagacagttgggtttgacattcaccaagtcttttcagtcggtctttttgccaagaaggagatgcgtatccttatggtaggtctcgatgccgctggtaagaccaccatcctgtacaagctcaagctcggtgagattgtgaccacaactccctaccagtttgggtttaacgtaggaaactgtcgagtaacaaaaacatcagtctttaccgtggtgggatggttgggggtcaagacaagattcgtcctattgtggaggctatttatttccagaaccacccgagggtctctattttcgtggtggatagcaatgacagagaccgtgttgttgaggcgagagatgagttgcaccgcatgttgaatgaggatgagttggcgggatgcagtattacttgtctttgccaacaaacaagatcttcctaatgcaatgaacgctgctgaaataactgacaaacttggtctgaactctctccgacagcgccactggtatatccagagcacttgtgcaacctccggtgagggcctgtatgaggggttggattggctctccaacaacattgcaaataaggacttgagtatgggggcgttgatacttggatgcaggatggtctttttatctagtct

SEQ ID NO: 10895 - DNA, 803 bp, Panax ginseng
aacgacaactccatttagagatctctgcattccaacgttcccatcgcccacctcatcctcaatatagagatggggctgtcttttaccaagctttcagtcgcctatttgctaagagagaaatgcgcattctaatggttggtctcgatgccgctggtaaaaaccacaattttgtacaagctcaagttgggtgaaattgtcaccactatccctacaatttgggctttaatgtaggtagaacctgttgaaataccaagaacatttagctttcactgtgtgggatgttggtggtacagggacaagatccgactttgtggaggcactattccaaaaacgcacaagggctacatctttgtacgttgacagcaatgatcgagaccgtgtggttgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgccattggtatattcagagcacatgcgccacatctggagaaggtctatacgagggactggattggctttcaaacaacattgctaacaaggcttaatggctactctaccggctcacttggtactcaaagaaatacattggtgcagtcaatctggttacaagtgttgttgcaattactctttgtataattgcttttggtggtttggatttcagtttcttgtcgtggtgagagaggaaaaagatgatgtattatgactgtctgttaaatttcc

SEQ ID NO: 10896 - DNA, 605 bp, Petunia hybrida
tagtggatcccccggccctggaggtatcggcacgagggaaaaaggcagctgagatctactcattttatccagcgtgtatttgattcacaaagagggggctgtctttcactaaactcttcagccgcctctttgcgaagaaggaaatagcgtatacttatggttggtctcgatgctgctggtaaaaccacaattctctacaagctcaagttgggagaaattgtcacaaccatcccaggcatgggcttcaatgtggagactgttgaatacaagaacatcagctttactgtgtgggatgtcgggggtcaggacaagattagacctctatggaggcattatttccagaacacacaaggtcttatctttgtggttgacagcaatgaccgagaccgtgtggttgaggcaagggatgagcttcacaggatgtcaaatgaggatgaattaagagaagctgtgtagcttgtatatgcaaacaaacaagatcttccaaatgccatgaatgctgctgaaatcaccgacaagcttggccttcattctctcagacagcgaccactggtacatccagagtacatgtgctacttctggagaagggctatacgagggaccta

SEQ ID NO: 10897 - DNA, 795 bp, Secale cereale
tagggacgctataatctccccagccacccgcgtccttcgccgactaacaaattccccaaatctcctccctcccggcatcgcatttcttgaccactagcagaggaatcgatcatcggttttctgccgatatcaccgatgcaaagattggatctgacgttcgaattgcgtggtcctcggaggcgctagatctgcgaccgttctgtcacgtcgcggatctcgaatttatttgggcgcgtgtagtttgtgcctctactatctatacgcctttcgtgtgatctatccgactcgtggggtatcggaagaggagtagggcgagatggggctcgcgttcgggaagctcttcagccggctcttcgccaagaaggagatgcgtatcctcatggtcggtcttgatgccgccggaaagaccaccatcctctacaagctgaagcttggagagatcgttaccactatcccaaccatcgggttcaatgttgaaactgtcgagtacaagaacattagcttcactgtttgggatgttgggggtcaggacaagatcagacctctctggaggcattacttccagaacacacagggtcttatctttgttgtggacagcaatgatagggaccgtgttgttgaagccagagatgagctccacaggatgctgaatgaaggatgagttgcgcgatgctgtgttgcttgtctttgccaacaagcaagatcttccaaatgccatgaatgctgctgaaattactgataagcttggattacattcccttcgaaccaacgtcactggtacatccagagcactga

SEQ ID NO: 10898 - DNA, 882 bp, Picea glauca
gccaagtcgcaatcatgggtctcacattctaaaagctgttcgataagctatggggaaagaaggagatgcgaatcctgatggttggcttggacgccgcaggaaagacgaccattctctacaaactcaagctgggtgagatcgtgacaacgatccccaccattggcttcaacgtcgagacggtcgagtacaagaacatccagttcaccgtgtgggatgtcggagggcaggacaagatccgcccgctttggaggcattatttccagaacacgcagggcatcatcttcgtcgtcgacagcaacgatcgtgaccgtgtgagcgaggcccgcgaggagttgcagcggatgttgaacgaggacgagctgcgggacgcttctctcttggtctttgccaacaagcaggatctgcccaatgccatgaacgctgccgaaatcaccgacaagctcggcctccacagcctgaaactccgcgcctggtacattcaatccacctgcgccacgtccggcgatggtctctactagggtctggaatggctgagcaactgcctccgcaaggcgggccacgcctaagcgtgtctgcctgctcgccctgtcccccgtcgtccagccaagccaagtccaccagccatcggaaccatcctctactcgacaaacttcctctcaaccccaccattctcggccatcggcatgtgttttgcagttgtactctcttaaagtctagtccaaacgtcacaaagtcgggcggagcctgttcctctttcggagttggctttgctgaacaaagttcgtggaatatttgttggtgcggatgctcggaacagtcttttgctactactttgcggaatctgcttaaatcagcttttagtccttaaaaaaaaaaaaaaaa

SEQ ID NO: 10899 - DNA, 609 bp, Picea glauca
ggatattcgttcatctcaggcctctgcagaaacgaactcttcatcagcggggtctgcgattttacagatatttgattttctctcaagtttggcaagatggggctcacgttcaccaagctctttcagcgtctgtttgccaagaaggaaatgcgtattctgatggtgggtcttgatgctgccggtaagaccaccattctgtacaagctgaagcttggagaaattgtcaccacaattcccactatggtttcaatgtggagactgtcgagtacaagaatattagcttcactgtttgggatgccggaggtcaggacaagatccgacactatggagacattactttcagaatacccaggtcttatatttgtcgtggatagtaatgacagggaccgtgttgtagaagcaagggatgaactacataggatgctgaatgaggatgaactacgtgatgctgtattacttgtgtttgcaaataagcaggatcttccaaatgctatgaatgctgcagagatcgctgacaaacttgggcttcattcccttagacagcgccattggtatatccaaagcacttgtgcaacttctgacgaggattgacgaggtttgattggcttc

SEQ ID NO: 10900 - DNA, 763 bp, Fagus grandifolia
aaaaaatcgcggctctcattccttccttcctccatccctccacaggtagctagagaggtagagcaagaatggggctgacatttacgaagctatttagcaagcttttgcgaagaaagaaatgcgaattctgatggtaggtctcgatgctgccggtaagaccaccatattgtacaagctcaagctcggtgaaatcgtaaccaccatccctaccatcggatttaatgtggagacagtggaaataaaaaaacatcagcttcaccgtttgggatggttgggggtcaagacaagatccgtccactgtggaggcacgtacttccaaaacactcaagggttctttatttttgtcggttgagtagccaattgatagggatcgtaattgttgaggtcaagggagaaggttgcataggatgttgaatgaggatgaactcagggaggctgttttgcttgtatttgccaaacaaacagatcttacctaatgcaatgaatgctgcagagataactgacaagcttggcctgcattctctcgccaacgccactggtacatccagagcacatgtgcaacttctggagagggtctgtatgagggtggagttggctttccgacaacattgctagcaaggcataagacgattaaagaaattttaggttccttagcgatttgggtagagtgacgccttctcagtgactgttgtaatagcagaatgtttgtctagaccttatatattttggtttgttatggtgctactttagctaaacactttta

SEQ ID NO: 10901 - DNA, 849 bp, Rosmarinus officinalis
cggccgggggagtacacgactcatcgttctgttggagatctctaaaccccgcgtgcattctcgctgctcttcttccattttaaagatggggctgtcttttactaagcttttcagccagctttttgccaagaaagagatgcgtatggtcttgatggagctggaaaaaccaccattctctacaagctcaaacttggagaaattgtcaccacgattcctaccattgggtttaatgtggaaactgtggagtataagaacattagcttcacagtttgggatgttgggggacaggacaagatccgtccattgtggaggcattatttccagaacacccagggccttatctttgttgtaacagcaatgaccgtgatcgtgttattgaagcaagggatgaattgaacaggatgctgaatgaggacgagtagagagatgctgttttgcttgtacttgccaataagcaggatcttccaaatgcaatgaatgctgcagagataactgacaagctgggccttcattccctgcaccaatgccattggtacatcaatagcacgtgtgcaagctcaggtgaaggactctatgacggattgtactggctgtcgaacaacattgctgatgggaacccaacaaccaaggttgctgatataagacgaaggagaagagcataagcgtgcggcgctggacgttagctagtaggactccattagttaggatgaagtctttttcctagtaggactctatttgttaatctgtagagtttatataaactcaagctgagtagatgaaagaggcaggaatatattatttatgagaattacagccacatcgttgattactaggttaattcaaggatta

SEQ ID NO: 10902 - DNA, 708 bp, Saccharum officinarum
cgtccggatgtacccgccccgcaatacccggtgcgacccacgcggccgctcttcccctgcgatccgagcccgcacccgcagggaggagaaggaagggatcacctgatcaccagggcgcggcctcgcgatctcggagcggagatggggctcacgttcacgaagctgttcagccggctcttcgccaagaaggagatgaggatcctcatggtcggtctcgatgcagctggtaagaccaccatcctctacaagctcaagctcggcgagatcgtcaccaccatccccaccatcggatttaatgttgaaactgtcgagtataagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaggacgagctccgtgatgctgtgcttttggtggttgcaaacaaacaagatctggctaatgccatgaacgctgctgaaatcactgataaaccttggcctggacttgctgtgccagcggcacttgttcattcagaggacgtgtgctcccttgggtatgggtggaccaagggcttgactggtttttaaacacaatgcaaaaagggctaagcatatagggggggcttcacccag

SEQ ID NO: 10903 - DNA, 683 bp, Primula obconica
ttttgccaagaaggagatgcgtatccttatggtaggtctcgatgccgctggtaagccaccatcctgtacaagctcaagctcggtgagattgtgaccacaatcctacattgggttaacgtggaaactgtcgagtacaaaaacatcagctttaccgtgtgggatggttggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattactgtttttgccaacaaacaagatcttcctaatgcaatgaacgctgctgaataactgacaaacttggtctgaactctctccgacagcgccactggtatatccagagcacttgtgcaacctccggtgagggcctgtatgaggggttggattggctctccaacaacattgcaaataaggcttgagtatgggggcttgatacttggatgcaggatggtctttttatctagtctaattttttttactttcctttttttcttgtgagacaatatattgtcatcgacttcaattttaagtgtttatgttgattaaggattttgcaatgtctattgatctttatcagaaaggtttgttgaattcgtg

SEQ ID NO: 10904 - DNA, 1860 bp, Artemisia annua
aagcaggggtatcaacgcagtactcgacgggggatcgcatccacatttgatcgacggctcccgatttcaaaaaactctcaaatctcttttccggtcgccggcgatcattcaaagacttttggcaagttgtttagtcgattgttcgctaagaaggagatgcattctgatggttggtctcgatgcggctggtaaaacaactattttgtacaagctgaagctgggagaaattgtcaccactattcctactatcggattcaatgttgaaactgttgaatacaagaacatcagcttcactgtgtgggatgttgggggtcaagacaagggcactacttccagaacacacaaggtcttatctttgtggttgacagcaatgatcgtgatcgtgtggttgaagcagctacacaggatgcttaatgaggatgaactgagagacgccgtgttgaaacaagatcttccaaatgctatgaatgctgcagagatcaccgacaagcttggtttgcaatctctccgacagcgacactggtatatccagagcacatgtgccacctctggggaaggtctatatgagggactcgattggctttccaacaacatcgctaacaaggccttcttgtgacaaacattgttagcattttatctatatgttgagaaggaataggtgatttccatcggctttcttaagactgtatacattatcacttgcagtatttgtacgtgtcttttgcaatatgcaaaatgaaaacttttaccctgagacttggttaacctagttattgcaggcagttaacttgtattctgtttccgtgaaacttgcgttcgtggtttttgcatgcatgtagtttggtacattgtgcgtttcaagtaaatgatgcattctgctgctaaaaaaaaatgagttcaaagatattgagatctgcttcacgagcagctcgatctttcatttctaagcagcagaatccccgttttttctctgaaggaagagctgttgctgctgctacagcagtttcagtcaaaggagcattgccggctctatcttctttcgggcgtgatcgttctggaaacacctccggctcatggattgctggagcatttgccctccctgctgcagcttacatgcttcaggaccaagaggcacatgcaggagcgcacattcattgctatcaagccagacggtgtgcaaagaggactgatttcagagatcattgctcgctttgaacgtaaaggcttcaaacttgtagctattaaacttgtgacccctacaaaggcctttgcccagaagcattaccatgatctttcagaaagaccttttttcaatggtctatgtgacttccttagctctggcccagttcttgccatggtttgggaaggagaaggtgtgattaagtacggacgtaaacttattggagccacagatccacaaaaatcagaacccggaaccatcaggggtgatttggctgttgttgttggaaggaatatcatccatggaagtgatggtcctgaaaccgcaaaggatgaaatcaacctatggttcaaaccagaagaggttacaagttacacaagcaaccaagaaaagtgggtctatggagacaactaattgcatccatttttgctgcatcagttcgtgtctaggccagttagtttctcggctgaaagaataaaacccatagaataaaaacgttgtatcctctgttataaaatgagtgaaaacagtatcagttttgttaagttatcggaaagacctttttagttcctgaaaacatatatatctggtcgaagttgggctgaaatctattcactttctatcttgtaatgtaatttacaagatatatagattggcttatattgttgttatagagtcat

SEQ ID NO: 10905 - DNA, 867 bp, Festuca arundinacea
acgcacagcccgcctcccaacaacccgcgatcccatcgacaaaggagacaactcgcatctcgcttcattataccccgttgatatattctttgtcggcctcaccgcccaccagccgcaaccatgggtctcgccttttccaagattttcgataagttgtgggggaagaaggagatgcgaattctgatggttggtcttgacgccgccggtaaaaccaccattctgtacaagctcaagcttggtgaaatcgtcaccaccatccccacaattggcttcaacgtcgagaccgtcgagtacaagaacattcagttcaccgtgtgggatgtcggtggtcaggacaagattcgtcctctgtggagacattacttccagaacacccagggcatcatcttcgtcgtcgacagcaacgatcgcgaccgtatcgtcgaggcccgtgaggaactccagcgcatgctcaacgaggatgagctgcgtgatgctatccttttggtctttgccaacaaacaggatcttcccaacgccatgaacgccgccgagatcaccgacaagctcggccttcacagcttgcgacaacgcggctggtacatccagtctacttgcgccacctctggtgacggtctggatgagggactcgagtggctcgccaccaccctccgaaaggccggtcacagtagatgtctcccacggaaaagcccttggccaacctctgctttctctcgcgcaccctctcatgtcacgtactctcttcccaaaccggacttcagaatagcgaggtttcggatgtaatttaaaagctaccgattcagcccaatcgaacaaattttctctttttcctgacaaaaaaaagaaaaaaggagggccgcgccggga

SEQ ID NO: 10906 - DNA, 648 bp, Pennisetum glaucum
ataccggaccaaaccgtcgaccacgccccttccctttacccccccaccagctcacaccaactcccgcccatacgaccaactttccctctctacgactgtaactcacgatgggtctttcgatctccaagctcctctccggcctctttggcaagaaggagatgcgtattttgatggtcggcctcgatgctgctggtaagactaccatcttgtacaagctcaagctaggcgaaattgttactaccattcccaccatcggttttaacgttgagaccgtggaatacaaaaacatctcattcactgtgtgggacgtcggaggacaggacaagatccgtcctctgtggaggcattatttccaaaacactcagggtatcatcttcgtcgttgactcgaatgatcgtgagcgtgtaacagaggcccgcgaggagcttcagcgcatgcttaacgaggatgagcttcgggacgcgctcctactcgtttttgccaacaagcaagatttgccgaatgcgatgcccgtgcagctgaaatcactgacaagctcggccttcacggtcttcgccagcgcacctggttcatccaagctgcatgcgctacctctggtgatggtctttatgaaggccttgagtggctcagcaccaacattaagcgccg

SEQ ID NO: 10907 - DNA, 758 bp, Thalictrum flavum
aagagatgcgtattctcatggttggtctcgatgcggctggtaagactaccatcctgtacaagctcaagcttggagaaatgtgacacaattccaaccatggtttaatgtggaacggtggaatacaagaacatcagcttcacggtgtgggatgttgggggtcaggacaagatccgtccactgtggaggcactatttccaaaacacacaaggtctcatatttgttgtggatagcaatgacagagacagagttgttgaggcaagagatgaattgcatagaatgttgaatgaggatgagttgcgtgatgctgtgctgcttgtgtttgctaacaaacaagatcttccaaatgcaatgaatgctgcagagattactgataagctcggccttcattctctccgtcagcgccactggtacattcagagcacttgtgctacctctggagaaggtctttatgagggtttggactggctatctaacaacattgctaacaaggcctgaggcagtaagcaatagctgttgaagtatcttctgcagtaaaatttgttcatgtggcctgtggtttgctcatttgtgatgcgacaccatttagaattgctttttttctatagaatattttggtgactattgtactagaggattttggtttgcttggatatattatgagctgccttcattgttggtttggaatatgattgtactgcactagctgtaaccaggatactttgtccctatcttctatatacttgatctgttttcactta

SEQ ID NO: 10908 - DNA, 949 bp, Secale cereale
tcctccgtgcggttccaagctccaactcccacgcccgtctccccagagatcaggaggagcacgccccggagcgccgagacctcgaagccttcgtctccacccccggagcagagatggggctcacgttcaccaagctgttcagccgcctctcgccaagaaggagatgaggattctcatggttggtctcgatgccgctggtaagaccaccatcctctaacaagctacaagctcagagagatcgtcaccacactacccaaccagtcggtaatttaacgtacgaaactgtacgaataacaagaacatcagtcttcacttggtttgggatggtgggggccaagacaagatcacggccctgtggaggcactacttccagaatacgcgaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcactgacaagcttggtctgcactccctgcgccagcggcactggtacattcagagcacttgcgcgacatctggagaaggattgtacgagggacttgactggctctccaacaacattgccaacaaggcttgaagcgtctcgacaagtgcttcatcaagaaacaaacgtgctggatgtctcaacaactcactgctaccattttttacatattgtgatatatatacactgtacaagagatagtatgtgtgcgtatgtgacagacagaagctctcttctttaagtgagctatatcaggtctaggtttgttttttgtatggatattatcagttacttcccgtgttcgttggttttactaaggttttactttgtcgaccatgtgtgcatacgtaacccttattctttttgtagtt

SEQ ID NO: 10909 - DNA, 2686 bp, Solanum lycopersicum
catttcaaaagctctttctctctctcccctctttgtttctctcactacggagccttctagagatcttctccgtcgaggaaaaaagtgaaggagaaatggcggcacacataggaatgatggatggggcatacttcgtcggtagatcggaaatcctggcttggatcaattccacacttcatctaaatctttccaaagtcgaagaggcgtgtactggtgcagttcattgccagttaatggatgccgctcacccagggctagtccctatgcacaaggtcaattttgatgccaagaacgagtatgagatgatccaaaactataaggttcttcaggatgtattcactaaactcaagattaccaagcacattgaggttagcaaattggtgaaaggaagacctcttgacaacctggagtttatgcaatggttgaagagatactgcgattctgttaatgggggcaatcttcacagttacaatcctcttgaaagaagggaggggtgcaagggtgccaaagaagtgaacaaaagatctgctccttcacaaaatgctaccaaaaatgcctcgactgcttcaaagcatgtctcccataacactagaagaaatgaagtacctcatgtaagcagcacaaatcaatctggtaagatctcgaggccttcttcaagtggaggatcgtcaacctattctgaaactgaacgtactgcacatgaacaacagattacggagttgaagttatcagtggatagtcttgaaaaggaaagggacttttacttttcaaaattgagggacattgaaatcctgtgccaatgtccagagattgaaaacctacctgtggttgatgcagtgaagaggattctgtatgctatggatgatgatgcatcacttgtagatactgaagccatggtatctgagcaacaccagcaagtagagacattaagttgcatatctgaagaggcagaagaaaggctgagggtagacactcaaaagagaaaaaacattgtcaatgttgacgttgaccttgctgccagcaacacattgtctccaaggcaaaggatttctgatgcttctgatgtccattgcagtggatcacttgtgacatattgatcaaccttatctcctaatgacttgttcaatctggattggggaataattcctgctaccgtctttgttactctagatacatgttgtcccagcatacttcatttctaagcaataccgtttgaggaattccatcagtatagaagtagtgaatataaaagcctatcttgttcgtatgattgtcttttgtgtacaacattgccctatgttattattgttctatagcaactattggcaactgtactggttgctttgtagtcactgcactgtagtgcaaatcttggatcattttgcctatgatgattactgtggtttaatggatgcttaagtttcagtcatctttttgtggatccattttcatttcttatttgttttattattactagcacgtttgggaattctaacatgcacgaatgtatgcggaattaaataactgctatgcgaattagcaatgtgtattaaactttgttattgatgtacaattgaaagaacaccacaaaagaatttcttggttcaaattttttcacattttgtcttcacaaatatttacttttttgttcaacaaattataatcgcatgcatttctatatgtacaaggtaattgacatgggattttgttttttgaggaagttacagcacataaaattagaaccaactgaaacgaccaatctctaggtgaccatcagttcgcacaataggcggccttaaaattaggaccaattaatcaatttttaaaataaatccagatttacaatttggaatacaagcgctatcgttattgttgaagaagaattctggaagagcttaaatatgaattcatcaactaataaggatacagaggatgtgaagggaatggaaaggagagtggaaagtgtggattaccaatcatcagttgggcaaggacaagaacaaagacctgtagaattaattcaatcaaacaccagtggtggtgtattagctaatgctgctgcctctgttgcatccaccctcgaagcaatgggtatgtcaatttccaaatttgtaaaaaaattatttgcaaagaaagagatgagaatattaatggtaggactcgatgcggctggtaaaacaactatcttgtacaagttaaaactcggggaaattgtcaatactatacctactattggattcaacgtggagacagtggagtacaagaattccagcttcacagtatgggatgtgggaggacaagataagatccggcctctatggaggcattattttcagaacacacagggtctaatatttgttgtagatagtaatgatcgagatcgaatttcagaagcgagagatgagctacatcgcatgctcaacgaggaagaattacgcggcgctacaattcttgtattcgcaaataaacaagaccttccaaatgctatgaatgttgcagatatcactgataaacttggccttcgttcactccgacaacgacgctggtacatccagagtgcttgtgcaacatctggacaggggctttatgaaggtcttgattggttatcacataatattactggcaaggcaagaacattattgccttttaatctcctcttttaatttcatttttttctcaccaaaac

SEQ ID NO: 10910 - DNA, 1951 bp, Fagopyrum esculentum
acccttaaatcactcttccatttcatctgcagccatgtcgccatccgtaacaggtcttctcgtcctcctcctcatcgcgctctcatcctcaactcaagcagccattgaaagaagcgaggaagaatccaggggactgtaccaattgtggctagccaagcaccgcaagtcctacaacgccattggagagaacgagaagagattcgagatcttcaaggacaatcttaagttcatcgacgagcacaattccgtctccggtcaaacttacaagctcggactcaacaaattcgccgacctcaccaacgaagagtacagatccaagtacttgggggcgagattcgatcccgagaaattggtgctcaaagccaagaacgcgagccctagatacgctcacgtccatggtgagaagctccctaaggccgtcgattggaggacaaacggcgctgtgaatcatgtcaaggatcaaggccaatgcggtagttgctgggcattctcaaccatagcaaccgtggaagctatcaacaagattgtgaccggcaacatgacctcactatcagagcaagagctggtagactgcgatcgaacttacgatgcaggttgcaacggtggcctcatggaccatgcctttgagttcatcctcaaaaacggcggcatcgactccgaggaagattacccttacaaggccgtggatggccagtgtgaccaatctaagaagagcaacaatgttgtaagcatcgacgggtttgaagatgttcctcccttcaatgaaagggccttgaagaaagcagtggcacaccagcctattagtgttgcaatcgaggctagtggaagagccttgcagctctaccaatccggtgtgttcactggggcgtgtgggacagagcttgatcatgctgttgtagcagttgggtacggtacagacaacggcgtcgactactggattgtgaggaactcatggggcaacggatggggagaaaacgggtatatccgtattgaacgtaacacccacatgttcacaggaaggtgcggtattgccatgcagccatcatacccggtcaagaattccaacaatccgatcaagccttactggggcaatgcagaggagggtgaagctagaagtgcttaatttatggcctctactttacatgtaatttgcttattatccatgtctagcatcagccttatactatgataaggcatggttaaatttgctgtaaatatcttttaatttcggttcattcatcaatctctgttgcacaacttgcaatttatggtcagtttgttaatcgaagtctatctttattactaattcctttcgacaaggcagcgaatacatagcagtttcctacattcttgtcagtacaacttatgatatgcccattgaaaaccccggtgagagcaggtgacaccatctaagccttggtggtgctgatattgtttgatatccaatcaagaccttcatagaggccttgcccagaagtggcacaggcactctgtatataccatcggcgctgacgaagcgagtgaagcccgagtttatctgtgatttcagcaacagccatagcattcggaagatcctgcttgttggcaaacacaagcactatagcactgcgtagctcatcctcgttgagcatcctatgaagctcatctctggcctccaagattctgtccctatcattgctatcgacaacgaagatgagcccttgggtgttctggaagtagtgcctccacagtggccggatcttgtcttggccaccaacgtcccatacagtgaagctcacgtttttgtactcaacagtctcaacgttaaaaccgatggtggggatggtggtgatgatttctccaagcttgagcttgtaaagaatggttgttttaccagctgcgtcaagcccaaccatcagaatcctcatctctttctttgcaaacaacgtcttcactagccgagatatcgcca

SEQ ID NO: 10911 - DNA, 2078 bp, Amborella trichopoda
ttgacgattcgctggggagtaggtcgaaggtgacagacaaccgggtgtacgcagtggcttcgcaaaccgcacaatatcctccgcctcgctcgcagtatcacgctccactggccttttaaatagtacgaacaccctttaaaactgcatagatcgtcagcaaaagaagtctatagcgatccccgaggatcctctgacataactaataccaaccatggggaatatgtttgcaacattattcaaaggcctctttggcaaaaaagaaatgagaattttgatggtgggtcttgatgcagcaggtaaaaccacaatactgtacaaattaaaattagggaaattgttactacaattcctactataggtttcaatgtagaaacagtcgagtataagaatataagtttcaccgtatgggatgtaggtggccaagataaaataagaccactctggcgacattattttcagaatacacaaggtttgatattcgtcgttgatagtaatgatagggaacgtattggtgaagcacgcgaagagttgatgagaatgcttgcggaagatgaactgagagatgcggtactcctcatatttgctaacaaacaagatctgccaaacgcaatgaacgcagcagagatcactgacaagttgggattacattctttacgtaatcgtaattggtatatccaagcaacgtgtgccacaagtggggacggactttacgaaggcctcgattggctttccaatcagctgaaaaatgccaaccgctaattgggaaattattttgtcaacattcagttgctatattaacattatacaaaaacagctgcacacctgtcccccctcggctctttacgatgaatgagtaacattataagaaacaaacaaaatattaattgcaaggtctctttgatcttgagtggtggatatagaaggtttattactgagaattgtctgtgtcggcaagttttttggggggagaggagtgagcaagcggggccgtgggcacacgatcgaacggccacaccggactattgccttgcgcaaatcttattattattattattatattagcattatagttacacaactttttacacagagatgccacgagaatgtggagaacttgaagtaattatattaaagtacctaactctgaaacatacgatacacattaattaatgaataatttaaatgataccttcgataaaaaaaaattcaaaaacatgaaaaacaagaataaagtacccacagtgttatcagttttgaatgcgttggacataccgattatcataatgtagctgcatattgtacattacattatataaatacgataaaatgtgatcagtagacaagagaatgttgctctgtccacactacatttacaaaagtcgctctcatctcggcccaggacggctgatacgaaaacgcagaaagtgattgcagcaaacggtgcaatgactaactctatattttctagttatatgcaaaaaaaaattttttttttccttaagttctaggcgatagaaaactttgggaaacagaagctatacggatggttatttcactagttggttgcggcaggttggatgcaccctcctccttttctcatctgcccgccccatccaacttatagttatccaactatgtatatctcactatagaggagatatcacacttatttattgcacctcggtaagataaattagaatatatatcgtcgacacattccgaaattgtgcagtgaatgtgacggaaaaaatcagagactcggaattaatttagaaagtttggagctgtcagccaagagattcaggcctcgcaactactggaatccaatacatactttggacttatcgtggcgttatatacgccagcgattacgacgctaattcgcggtcgttctttgatgtcctaacgtttttcctgtctttgaggtacattgtttttacgagataatccttcccttaatttcattgaatcgccttttcgtcatatgcgaaaattcatataattatgtatgaatgtttaaacaatttgtgaaatatattgtaattgtgactttaaaaaaaaaaaaaaaaaaaaaaaaa

SEQ ID NO: 10912 - DNA, 613 bp, Primula obconica
attacggacgaaacccacattcttgcgcgtcggtctcaagcttacattctctctctcttctctctagagatccctccgctcgcagggatacaaactaaaaggaaagagacatgggtttgacattcaccaagcttttcagtcggctttttgccaaagaaggagatgcgtatccttatggtagggtctcgatgccgctggtaagaccaccatcctgtacaagctcaagctcggtgagattgtgaccacaatccctaccattgggtttaacgtggaaactgtcgagtacaaaaacatcagctttaccgtgtggatggttgggggtcaagacaagattcgtccattgtggaggcattatttccagaacacccagggtctcattttcgtggtggatagcatgacagagaccgtgttgttgaggcgagagatgagttgcaccgcatgttgaatgaggatgagttgcgggaatgcagtattactgtttttgccaagaaacaagatctcctaatgcaatgaaacgctgctgaaataactgacaaacttggtctgaactctctccgacagcgccactggtatatccagagcacttgtgcaaccttccggtgagggcctgtat

SEQ ID NO: 10913 - DNA, 1005 bp, Conyza canadensis
cccattagaatcctattctttactcctttattcccagattaaacaccctttttaccatatagctttcacatcaatcgatccattattaaccattattaagacatctcaaatatttgcttctaagaaaccaaatttctatgtatcttgctcttgctcaaaatatgttaaagtaaacgcaacaaaaactaattctttcgggtttcttggtcttttcggagagacaatggggatgacaatatcacgattggtaaggatgttatttgcaaagaaggaaatgaggattttgatggtaggacttgatgctgcaggcaaaaccaccattctttacaagcttaaacttggagagatcgttactaccattccaacaatcggttttaacgtcgagaccgtggagtacaaggatgttagctttactgtatgggatgttggaggacaagacaagatccggccgttgtggagacactattttcaaaacacacaagggcttatattcgtggttgatagcaatgatcgagatagaatcacagaagctagagatgagcttcaccgcatactgaatgaggatgcgcttcgtgaagccacaatactcgtgtttgccaataaacaagatcttccaaacgctatgaaggtttctgaacttaccgaaaaacttggcctccattctttacgccatcgccgttggtatatacagagtacatgtgcaacatctggtgaaggactatatgaaggccttgattggctctctagcaatatatctgccaaggggtaagtatgccaaggcaaaggcaagaaagctcagaagatgaactcctcagacctgttccattaagtcacatacctacttcttttcttcataaaatgtaatgtgattaatatacttgcattatccttgtaatgttgtattttacgcatcggatggtgtactttatgggttacgaaatatagataagttcacaaaatttggtagaaaacatacatttggacgatatttttactaaccaagtg

SEQ ID NO: 10914 - DNA, 837 bp, Festuca arundinacea
cttattacaacttaccaagagattgaactatcttagttgtatctcttcaattttcattgacctttatctgaggatttaaatttataaacagaataaaaaaaacaattatcacaatgggaaatgtatttgctaatcttttcaaaaatctcttcggcaagaaggaaatgcgtattctaatggttggccttgatgctgcaggtaaaacaacaattttatacaaattaaaattaggtgaaatcgttacaaccattcctacaattggtttaatgtagaaacagttgaatataaaaatattagttttacagtttgggatgtcggtggtcaagataaaattcttccactttggagacattactttcaaaatacacaaggtttaatttttgttatcgatagtaatgatcgagaacgtgttggtgaagcccgtgatgaacttcaacgtatgcttgctgaagatgaattacgtgatgctgttctattgatatttgctaataaacaggatttaccaaatgcaatgaatgctgctgaaattaccgataaattaggtcttcattcattgcgtaatcgtaattggtatattcaagcaacatgcgcaacaagtggtgatggtttatatgaaggtcttgaatggctttccaatcaacttaagaatgccaagtgaacattattgtcaagaaattctttaaagcgtttaaacattctctctttcttttcttttcgtttctttcgtttcttgttctttgtcattattttgttcagcatatatattccaaacagatatatcagcctcgaaacacatacatttatatcagacgatggaattggttcgatatcttactt

SEQ ID NO: 10915 - DNA, 561 bp, Mesembryanthemum crystallinum
cctcctagttctagaggtgcgcacgagcttcagcttccctgagatcttgcgcccttctcccccctttctctctcctcgcacgtgaaagatggggctgtcttttaccaaactattcagtcggctatttgccaagaaggaaatgcgtatccttatggtcggtctcgatgcagctggtaaaaccacaattctttacaagctcaagctgggagagattgtcaccaccattcctaccatcggatttaatgtggagactgtagaatacaagaacataagcttcactgtgtgggatgttgggggtcaagacaagatccgtccattgtggagacattacttccaaaacacccaagggctcatctttgtggtcgacagtaacgatcgcgaccgtgttgttgaggctagggatgagctacacaggatgttgaatgaagatgaattacgggatgcagtgctgttggtgtttgctaacaagcaagaacttcccaatgcaatgaatgctgctgagatcactgacaaacttggctccattttctacgtcaacgccactggtacatacagagcaca

SEQ ID NO: 10916 - DNA, 753 bp, Sarracenia psittacina
ttaccttgcaatatatatctttaagccgaatttttcaagccacgtcaagcgcatagtattttacccatagttttacttaattattgacattaatttaaattaaccatactaaacatatattactttaagtggttgagatctttgtttttctctgatgggtaacgtatttgcgaatctgttcaaagggctctttggtaaaaaagagatgcgaatattgatggtaggattagatgctgctggaaaaacaacaatcctttataaactgaagctaggtgaaattgtaacaaccattcctactattggtttcaacgtagagactgtcgagtataagaacatcagttctacagtttgggacgttggcggtcaagataaaataaggcctttgtggagacattatttccaaaacacacagggcttgattttcgttgttgacagtaatgaccgtgaacgtattggagaggcaagggaagagttgatgagaatgttagctgaagatgaactaagagatgcagttttacttatatttgctaataaacaagatttacctaatgcaatgaatgctgctgaaataactgataaattggtttacattctttaagaaatcgcaattggtatatacaagcaacatgtgctaccagtggagatggcctgtacgaagggttagactggttatccaaccaattaaaaaattcaaaccgttaactgtaatgcaaaacttcttttgattcaatcgatataatatacgaaagtaaa

SEQ ID NO: 10917 - DNA, 512 bp, Triphysaria pusilla
tttttcatcatcttcttctcaatccctatcgctttctcgaaaaaatgggtttgtctttcaccaagctttttagccggctgtttgccaagaaagaaatgcgaattcttatggtaggtctcgatgctgctggtaagacaacaatattatacaaactcaagcttggagagattgtgacaaccattcctacaattggatttaatgtggaaacagtggaatacaagaacattagtttcactgtctgggatgtcgggggtcaagacagatccgaccattgtggaggcattactttcagaacactcaagggctgatttttgtggttgatagtaatgatcgagaccgtgttgttgaggctagggacgaactgcataggatgttaaatgaggatgaactgagggatgcagtgctcctagtatttgctaacaacaagatctcccaaatgctatgaatgctgctgagataactgataagcttggacttcactctcttcgtcaacgtcattggtatatccagag

SEQ ID NO: 10918 - DNA, 720 bp, Amaranthus tuberculatus
tcagtcggttgttgcgaagaaggaaatgcgtattcttatggtaggtctcgatgcagctggtaaaactactattctttataaactacaagctcggagagattgtcaccactattcctaccattggatttaacgttcgagaccgttgagtacaagaacattagcttcaccgtgtgggatgtcggaggtcaagacaagatccgtccattgtggagacattacttccaaacaactcaaggactcatttttgttggttgacagtaacgatcgtgaccgtgtcgttgaggccagggacggaattactataggagtgttaaacgtaaggatgagttacgggtagtgcagtcttgttggtgtttgtctaacaagcaagatcttcctaaactagcaatgaatgctgctgagatcactgacaagcttggttcgtccattcttctacgtcagcgtcactggtacatacagagcacatgtgccacctccggagaaggactttattgagggtttggactggctctcgaacaatattgctagcaaggcttaaatgaaagaaatggagtaacgttagctgttctcagatgagatgctgaaataggctgaggagtctgtcagtactgctggtgtttgccctttttatttttgtcattctatgttctcatttttggtttctaaaaggacaaaaggatatatctttctgttgtttatgttgacatgttataataccct

SEQ ID NO: 10919 - DNA, 521 bp, Arnica chamissonis
atctgcgagagtgtccagtaaaaaagttattttttactgtcctaagcaacatcaagatggggctgactttcaccaagctgtttagccggttatttgccaagaaagagatgcgtattctgatggtaggtcttgatgctgctggtaagactactgtattatacaaattaaagcttggagaaattgtgacgacaattcctacaatcggattcaatgtcgaaactgttgaatataagaatatcagcttcactgtctgggatgttggtggccaagacaagattcgcccattgtggaggcattacttccaaacacacaggggcttatctttgtggtggatagcaatgacagggaccgtgttgttgaggcaagggatgaattgcataggatgttgaatgaggatgaacttagagatgctgttttgttggtctttgctaacaaacaagatctgcctaatgccatgaatgctgctgaaatcactgataagctcggccttcattcactccgtcaacgccattggtacattc

SEQ ID NO: 10920 - DNA, 518 bp, Cleome spinosa
tcggagatcccttcgcatcaatttcgaaagggtcaccaccagctgaaggaagatgggcctttcatttgccaagcttttcagccggctttttgccaagaaggagatgcgcattcttatggtgggtcttgacgctgctggtaagacgaccattttgtacaaactcaagcttggtgagatcgtaaccaccattcccaccattgggttcaatgtggagacagttgaatacaagaacatcagcttcactgtttgggatgttggggtcaggacaagatacgtcccttgtggaggcattacttccaaaacacacaaggtttgatatttgtggtggatagcaatgacagagaccgtgttgttgaagcaagggatgaacttcacaggatgttgaacgaggatgagctacgtgatgcggtgctgttggtatttgcaaacaagcaagatctgccaaacgcaatgaacgctgcagagataactgataagctcggccttccctctctgcggcagcgacactggtacataca

SEQ ID NO: 10921 - DNA, 765 bp, Primula obconica
cgatcattgctgacggtgtttagtccattcaatccccctcgcaagacctcgaaaatactccgaggttggcctttgggggtagtatttccatccattacggccgaaactcccacattcttgcgcgtcggtctcaagcttacattctctctctctctctctctagagatccctccgctcgcagggatcaaactaaaaggaaagagacatgggtttgacattcaccaagcttttcagtcggtctttttgccaagaaggagatgcgtatccttatggtaggtctcgatgccgctggtaagaccaccatcctgtacaagctcaagctcggtgagattgtgaccacactccctaccattgggtttaacgtggaaactgtcgagtaacaaaaacatcagctttaccgtgtgggatggttgggggtcaagacaagattcgtccattgtggaggcattatttccagaacacccagggtctcattttcgtggtggatagcaatgacagagaccgtgttgttgaggcgagagatgagttgcaccgcatgttgaatgaggatgagttgcgggatgcagtattacttgtttttgccaacaaacaagatcttcctaatgcaatgaacgctgctgaaataactgacaaacttggtctgaactctctccgtagagtcactgaaatttgtatcgaaatggatggtttctcatatagaagatggagataaagtgctgaaaaagccagtcatgttcaccgaattcggttggtcgaatctgaaca

SEQ ID NO: 10922 - DNA, 530 bp, Zostera marina
tctcgctgcttcttccgcctagatctgtcttctccgtcaatagtcatcccctaggtaaggaaagatggggttgactttcaccaagctcttcagtcgcctttttgccaagaaggagatgaggattctcatggttggtctcgatgcagctggtaaaaccaccattctttacaagctcaaacttggagagatcgttaccaccattcccactatcggtttcaatgtcgaaactgttgaatacaaaaatatcagcttcactgtctgggatgttgggggtcaggacaagatcagaccactatggaggcattatttccaaaacacccagggtcttatatttgttgtggatagcaatgatagggaccgtgtggtcgaagcaagagatgtagcttcataggatgttgaatgaggatgagctgcgtgatgctgtgttgcttgtctttgctaataagcaagatcttccaaatgccatgaatgctcctgaaatcactgataagcttggtctgcattccctgcgtcagaggcactggtacatc

SEQ ID NO: 10923 - DNA, 1387 bp, Eragrostis curvula
ggaaaagggggttgatggaacgcagcgcccgcgaggcctttataggaggaggaaagatcacctgatcagctgatcaccagggcgaggcctctcgatatcgcgcaggagagaagatggggctcacgttcacgaagctgttcagccgcctcttcgccaagaaggagatgaggatcctcatggtcggtctcgacgcggccggtttcaatgttgaaactgttgagtacaagaacattagcttcaccgtgtgggatgtcgggggtcaggacaagatcaggcccctgtggaggcactacttccagaacacccagggcctcatttttgtcgtggacagtaatgacagagagcgtgttgttgaggctagagatgagctccaccggatgctgaacgaggatgagctgcgcgatgctgtgctgttggtatttgctaacaaccaagatcttcctaatgccatgaatgctgctgaaatcactgagaagcttggtctgcattccttgcgccagcgacactggtacatccagagcacatgtgctacctctggtgagggtttgtaagagggccttgactggctttccaacaacattgccaacaaggcttgaagcgtctcgggagggcttcagtgatcccagatactctggatatccgagcgcatactgcctttaccatacagctatgaaactatcattatgacagtgacgaataccgaggggtggtttacagggagcactaagctcataatggctagaagcagtcaatcaatttgctttctaggatgaaacagtaatcgatcgtggatactgactgaaaatttagaagaaatccaacgaccagtcatcgctctatatacaccttcattcctctaccaagttagctactcccgtgcctcttgggaacaaccttagtttatccattcagtctgccaccttatactcaaaacaacattaataatatacagcacatctcgcctttcgcagaaacagcctacctatcattctcttaccagacacttgccatgttgttgaacaagtcaaatccctgcacctctttgcccgagcttcaactatccttcccatacccccgcagaatgtgttctctacactcctcatcgtcatattagttctcagctgtgctctagatctatataggttaacatacagaagaccgaatctttgtaatctgtaaaccaacacaaaagtctgacatacctattaatagacactataatattaatcagagaaatctataaacactagctttcaaaactcgagtacacttcccgatacaactagtccgcatatacaactccctgcagcatctctctcagtcctgcctaccccttcccttataagacgatccatcgtcacacaccgaaaagcccacccgtatgaat

SEQ ID NO: 10924 - DNA, 489 bp, Avena sativa
agtttggtagggagatcgatggggctgtcgttcgggacgctgttcgggcgctgttcgccaagaaggagatgcggatcctgatggtcggcctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgttgacagcaacgacagagaccgtattgctgaggcaagagatgagctccacaggatgctgaatgaggatgagctgcgcaatgctgtattgcttgtttttgctaacaagcaagatcttcccaatgccatgaatgctgctgaaataacagataagcttggtctacactctctgcgtcagcgacactggtatatccagagtg

SEQ ID NO: 10925 - DNA, 533 bp, Arachis hypogaea
caaatacaacttctatatacatatatacataatgggtctttcaatctctaaactactttccggtttatttggaaagaaggagatgcgcattctgatggttggtttggatgctgctggtaaaaccaccatcttgtacaaacttaaactcggcgaaattgttacaaccattcctactattggttttaacgttgaaactgtagaatataaaaacatttcttttacggtttaggacgtaggtggtcaagataagatcagaccattatggcgccattatttccaaaatactcagggtatcatttttgtggttgattcaaatgatcgtgaacgtatttcagaagctagggaggaacttcagcgtatgttaaatgaagacgaattgcgtgatgctcttcttttggtgtttgccaacaaacaagatttgccaaatgccatgaatgctgcggaaattaccgataaactcggacttcattctcttcgacagcgtcattggtacattcaagccacgtgcgctacgagtggggatggactttatg

SEQ ID NO: 10926 - DNA, 652 bp, Phalaenopsis aphrodite
gctctgctatcctgtttctgtgtccaggcagccatgggcttggcactctctagacttgtcaagatgatgtttgcgaggcgggagatgcgaattctgatgtaggtcttgatgcagccggaaagacaactatcctttataagctcaagctcggagaggttatcaccaccatcccaaccattggttttaatgtggagactgtggactacaagaatgttagcttcacggtgtgggacgtaggtggtcaagataagattcgacctttatggagacattactttcagaatacccaagggcttatatttgttgttgacagcaatgacaaagaaaggattcttgaagctagagatgagctacatagaatgctgagtgaggatgaattacaaggtgccactctgctagtatttgccaacaaacaagatcttccaaatgcaatgagtatttctgaagtcactgataagttaggcttacatgctcttcgtcaacgccgctggtatattcagagcacttgtgctactactggggaaggactatatgaaggccttgattggctttcaaacaacatatccagcaaaccaaaataaataacttccttctactgtctgctttatatgctgtgtaaggtgaatctggcatatctacttaaaaattttat

SEQ ID NO: 10927 - DNA, 571 bp, Secale cereale
tcctccgtgcggttccaagctccaactcccacgccgtctcccccgagatcaggaggagcacgcccggagcgccgagacctcgaagccttcgtctccacccccggaggagagatggggctcacgttcaccaagctgttcagccgctcttcgccaagaggagatgaggattctcatggttggtctcgatgccgcctggtaagaccaccatcctctacaagctcaagctcggagagatcgtcaccaccatcccaaccatcggatttaacgtcgaaactgtcgaatacaagaacatcagcttcactgtttgggatgtggggggccaagacaagatcaggcccctgtggaggcactacttccagaatacgcaagggctcatttttgttgttgacagcaatgatagggagcgtgttgttgaggctagagacgagcttcacaggatgctgaatgaggatgagctgcgtgatgctgtgttgcttgtatttgcaaacaaacaagatcttcctaatgccatgaatgctgctgaaatcaccgacaagcttggtctgcactcccttcgccagcggcactggta

SEQ ID NO: 10928 - DNA, 785 bp, Panax ginseng
tttttggaacgacagctccatttagagatctctgcattctaacgctcccatcgcgcacctcatcctcaatatagagatggggctgtcttttaccaagcttttcagtcgcctatttgctaagagagaaatgcgcattctaatggttagtctacgatgccgctggtaaaacccaattttggtacaagctcaaagttgggtgaaatttgtcaccacctatccctacaaattggacctttaaagtgtggagaccttgtttgaattacaagaacattagcttcactgtgtgggatggttggtggtcaagacaagatccgacctttgtggaggcacgtatttccaaaacacacaagggctccatctttgtgttgacagcaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtatattcagagcacatgcgccacatctggagaaggtctatacggagggactggagttggtctttacaaacaactattgctaacaaggcttaagtgggctactctaccggctcacgttggtactacaaaagaaatacattggtgcagtcaatctggttataagtgttgttgcaatgactctttgtataattgcttttggtggtttggatttcagtttcttgtcgtggtgagagagg

SEQ ID NO: 10929 - DNA, 952 bp, Panax ginseng
aagcagtggtatcaacgcagagtacatggggctcctccgcatctgatagacagagcggttttttggaacgacagctccatttagagatctctgcattctaacgctcccatcgcgcacctcatcctcaatatagagatggggctgtcttttaccaagcttttcagtcgcctatttgctaagagagaaatgcgcattctaatggttggtctcgatgccgctggtaaaaccccaattttgacaagctcaagttgggtgaaattgtcaccactatccctacaattggctttaatgtggagactgttgaattacaagaacattagcttcactgtgtgggatgttggtggtcaagacaagatccgacctttgtggaggcactatttccaaaacacacaagggctcatctttgttgttgacagccaatgatcgagaccgtgtggtcgaggctagagatgaactgcacaggatgttgaatgaggatgaactgagagatgctgtactccttgtgtttgcaaacaagcaagatcttccaaatgccatgaatgctgctgagattactgacaagcttggtttgcattctcttcgacaacgacattggtaatttggatctgtgtctgtattgatacacatagaaatggaaacataatagacaattgttcctactaaattatgaccattttgaactctccaggtatattcagagcacatgcgccacatctggagaaggtctatacgagggactggattggctttcaaacaatattgctaacaaggcttagtgggctactctaccggctcagttggtactcaaagaaatacattggtgcagtcaatctggttataagtgttgttgcaatgactctttgtataattgcttttggtgtttggatttcaatttcttgtcgtggtgagagaggaaaaagatgatgttaaatttccctttgacttatctgct

SEQ ID NO: 10930 - DNA, 626 bp, Vigna unguiculata
gggttcaaacatcgatcaacaagtccaaacaacaaatcacgatgggtagtatcttcgcaaaactcttcaatccaaagaaggagatgagaatccttatggtaggacttgacgctgctggaaaaaccactatcttgtacaagctgaaacttggtgaaattgttaccactatccctaccattggtttcaatgtagaaactgtcgaatataagaagataaactttaccgtgtggggcgtcggaggccaggataaaatcagacctctttggagacactattaccaaaacactcaaggcttgattttcgtagtcgactctaatgataaagatcgagttgccgaggccaatgaagaactccagaaaatgcttcgagaagatgaactccgtgacgccactctcttggtttttgcaaacaaacaggatcttccgaacgccatgagcgttagcgaaatcactgacaaacttggtcttcactctttgggttcccgaaaatggtacatccaagctacttgtgctaccaccggagatggtttgtatgaaggattggattggctttctaccgcactcaatgccaaataatgttgtacaattcaaaggtaaatagcgacaataaagtatttgtgaaacttt

SEQ ID NO: 10931 - DNA, 479 bp, Avena sativa
agggagatcgatgggctgtcgttcgggacgctgttcgggcgctgttcgccaagaaggagatgcggatcctgatggtcggcctcgacgccgccgggaagaccaccatcctgtacaagctcaagctcggcgagatcgtcaccaccatccccaccatcgggttcaaacgtggagacagtagagtataagaacatcagcttcactgtttgggatgttggtggccaggacaagataaggcctttgtggaggcactacttccagaacactcagggccttatctttgttgtcgacagcaacgacagagaccgtattgctgaggcaagagatgagctccacaggatgctgaatgaggatgagttgcgcaatgctgtattgcttgttttgctaacaagcaagatcttccaatgccatgaatgctgctgaaataacagataagcttggtctacactctctgcgtcagcgacactggtatattcagagtg

SEQ ID NO: 10932 - DNA, 1079 bp, Panax ginseng
tttttggaacgacagctccatttagagatctctgcattctaacgctcccatcgcgcacctcatcctcaatatagagatggggctgtcttttaccaagcttttcagtcgcctatttgctaacgagagaaatgcgcattctaatggttggtctacgaatagccgctggtaaaaccacaattttgtacaagctcaagttgggtgaaattgtcaccacttatcccgtacaattggcttttaatgtggagactgttgaatacaagaacattagcttcactgtgtgggatgttggtggtcaggcaagatccgacctttgtggaggcactatttccaaaacacacaagggctcatctttgttgttgacagcaatgatcgagaccgtgtggttgaggcttagagattgaacttgtctactaggtattgtttgtaattgtaggtattgtaacttgagagatgctgtactccttgtgtttgcaaacaagcaagatcttccaaatgccatgaatgctgctgagattactgacaagcttggttttgcatttctctttcgtactaacgccatttggttatatttcagagcacatgcgccacatctggagaaggtctatacgagggactggattggctttcaaacaacattgctaacaaggcttaatgggctactctaccggctcacttggtactcaaagaaatacattggtgcagtcaatctggttacaagtgttgttgcaattactctttgtataattgcttttggtggtttggatttcagtttcttgtcgtggtgagagaggaaaagatgatgtattatgactgtctgttaaatttccctttgaattatctgcttaataatatacatagtattacaaataggatttattgctcctttttgagttgtaaagcttttcatgccagtgctctggtggaatgctactatgaactaattatagcttggtttatataacaaaaaaagaaaaagaaaaaaaaaaaaaaaaaagaaaaaagaaaaaaagaaagagtagagaagagagacagagagaggaggagagagagggggggggggggggggggggggggggggg

SEQ ID NO: 10933 - DNA, 727 bp, Saccharum officinarum
atttcttttcccctgcgatccgagcccgcacccgcagggaggagaagggatcacctgatcaccagggcgcggcctcgcgatctcagagcggagatggggctcacgttcactaagctgctaagccgtctctttgacaagaaggagatgaggatcctcatggtcggtctcgaggcagctggtaagaccaccatcctctacaagctcaagctaggcgagatcgtaaccaccatccccaccataagatttaatgatgaaactgtctagcacaagaacattactgtcactgtttgggatggcggtggtcaagacaagatccggaccctgtggaggcactacttccataacacccatggcctcatttttgttgtagacagcaacgacagatagcgtgttgttgacgccagatatgagctccaccggatgctgaacgaggacgagctccgtgatgctgcgctgttggtgctagcaacaaacaaaatctgcctcatgccatgaacgctgcgtgaatcactgatcagcttggcctgcactcgctgcgccagcggcactggtacatccagagcacgtgagctacctctagtgaggcgctagacgaagggcttgactggctttcgaacaagaatgccaacatggcttaagcatctatgcagggcttcaaccaaaggaatcactctggatatactcgtgtgcgaaactgcctgtaccattacaagtatgtactatatag

SEQ ID NO: 10934 - DNA, 2551 bp, Hordeum vulgare
gttcgaaattagttgacactcaaatggatataaggttggactcaaaaatatatgtgtccttcaaatttgcaagcggaaagtgtttataagagggagaaaaaattaaaccaaacaggcggtacggactcccttgacagatcctcgcgctcaacatattgggcgagtgcaaacaaatttgcgtgactgcagatatcgcttgtgaatgaatttaaagaaagaccaaatcctggattcttttcagaggaaagaccgaaaggaatcagcaaatgaaataaacagagatttatgtctttttcatttacccacgaagacaaaaatgacgataggagtcaaataccgtggaatcactcgtgcgtagggcatacggcctccacacgcctggcggcgacctctttaaatcctgtccgttcacgcacgttcgggagggcatcctcgaaagccctcacctcaccctcccaatcccgccgcgttccagggatggccgccgccgccaccgccaccgccgtcccgcccgccacggcctcctccaacctcctcttcacgccccccgctccttcccccgtccatggacagctcaggtgccatgccggccccagcccctcgctcctcgcgctgcgccaccgcgccgcccgcgctgtgccggccagggccctgttcgacaaggtcacgcccttcaacttcggcgacggagaccgccctatcgaggaggacgacggcgacgaccacccccgcgaggagtgcggcgtgttcggcgtcgtgggcgacccggaggcgtcgtcgctctgctatctcggcctgcagaagctgcagcaccgcggtgaggagggcgccggcatctgcgccgccggggacgacggcaagctcaagtccgtgacgggcctgggtctcgtcagcgacgtcttcagggacccggcgcacctcaagagcctccccgggcaggccgccatcggccacgtccgctactccacctccggcggcaacgcccagctgtgcaacgtgcagccgttcctcgccggctaccggttcgggcagctcgcggtggcgcacaacggcaacctggtgaactacatgccgctgcgcaacaagctggaggcgcagggctccatcttcaacaactcgtcggacacggaggtcatcctccacctcatcgccacgtcgctctcgcgcccgctgctcgcccgaatctgcgacgcctgcgagcgcctccagggcgcctactcgctgctcttcctcacggccgacaagctcttcgccgtccgcgacccgttcggcttccgcccgctggtcatgggccgccgccccaacggcgccgtcgtgttcgcgtcggagacctgcgcgctcgacctcatcgacgccgtgtacgagcgagaggtggagcccggggaggtgatcgtcgtggaccgccgggacatgtccgtgtcctccgcctgcctcgtcccgcaccgcccgcgcaagtcgtgcgtgttcgagcacatctactttgcgctgcccaactccatcgtgttcgggcacgccgtccacgagcggcgcaccgcctacggccgcgcgctcgccgaggagtcccccgccccaaccgccgacgtggtcatccccgtgccggactctggcttctacgcggcgctcggcttcgcgcaggcctccgggctcgagttccagcagggcctcatccggtcgcattacaccggccgcagcttcatccagccgacgcaggccatccgcgacctcgccgtcaagctcaagctcgcgcccgtgcgcggcgtcatcacgggcaagagcgtggtggtcgtggacgactcgatcgtgcgaggcaccacgtcgagcaagatcgtgcgcctgctccgcgacgccggagcgcgcgaggtgcacatgcgcatctccagccccccggtcgtcggccgatgccactacggcatcgacacgcccgacgagaatgagctgatatccaacaggctggacattgagggcgtgcgcaagatgatcggctgcgactcgctcggcttcctgacgctggacaagctccacagcatctacggcgacgaggcggacgagctctgcgacgcctgcttctcgcggaaatacccggtggatccgccggagaaggtgccggccatggcatccgccgatgaagactgaccagaatgtgcaactagggaagtgcctctatactccgcatgctcttctataggattttgggcgtggcgaatcgtgtcgtggcaattgcattcatcatctgaaattttgcaggtcttaagtttgtatccctgagcggctagcattccatggcctctcaaattgaggtttcgaaacctttttcttgagttaatcaatttatataagaaaggttgacagctcaggcatctaaggttgtttcgttgccttcctgaattgctaatgaattccatttttcaacctcctgctgaatcggaaacatttttaatagttaccttcctcggtcgcgtaatataagagcggaatacatccacaaagccaagcaaaaaatagataaatcatgtggagtacgtaatagtcaacactaaatacgtagaagttg

SEQ ID NO: 10935 - DNA, 1272 bp, Citrullus lanatus
aaacgccctcccaacaaccgctttccaccaccgccaaatacgcccaaccaccacgctttctcatttttcttctctctcctcccgcatttctttctgtaagctacttcgaaaatggcgccggaactcgtccatactgccggagctccggtgaagccgcccggcggacgtcggctgccccggcgagcgtacgtgacgttcttggccggcgacggcgactacgtgaagggtgtcgtcggactggccaagggcctccggaaggtgaaatcggcgtacccgctggtcgttgccgtgttgccggacgtccctgaggatcaccggcggattctggagtgtcagggatgtattgttaaggagatcgaaccggtttacccgccagaaaaccagacccggttcgccatggcttattatgttatcaattattctaagctccgtatctgggagttcgtggaatacaataaaatggtgtatttagatggagacattcaagtatacgacaacatagacgaattattcgaattacccaacggccatttctacgccgttatggactgcttctgtgaaaagacatggagccacactcctcagtatcagataggctactgccaacaatgccccgataaggttcggtggcccgacgacctcggtcaaccctgtcccccgctctacttcaatgctggcatgtttgttttcgagccaaatattgcgacatatcatgatctattgaatactctcaaagtcacccctcccaccccctttgctgagcaggactttttgaatatgtactttagagatgtttacaagcctattcccttggatttcaacttggtattagccatgctttggcgtcatccggagaatgtcgatctaaatcacgtcaaggttgttcattattgtgctgcgggatcaaagccatggaggtacacagggaaggaggagaacatgcagagagaggacataaaaatgctagtcaacaaatggtgggatatctacaacgatccctctttggactacaagccgcctccgccgcgcacggcggatggagatgtcatcgacatgcagcccttcatctctgctctctccgaagccggacccgttcactttgtcacggcgccctccgctgcttgacgacggggtagatgaatctgaagctgagaaactctccggtggtttgacaaaacagactcaaagaaagaagaagtatataataattgtgttatgatatatgataataataattagttgtttcatttattattattattattattattt

SEQ ID NO: 10936 - DNA, 1037 bp, Panax ginseng
cagtggtatcaacgcagagtacatgggggcgccaaaggggaactgagaaagaacaaaactcttctaaagggcagctgagtcattcagtattctatcttgttagatcttcccaagaatctagccaacctgcccaacaacaacaacagtcgccaccatttcttcccttttcaattttgaaaaagaagaagaaaatagatagagatggctgggtacagagctgaagatgaatatgattacttgttcaagttggttttgattggtgattctggtgttgggaaatccaatcttctttccaggtttactaggaacgagtttaatctcgagtccaagtctactattggggtcgagtttgctaccaaaagtctcaccgtcgacggcaaggtcatcaaggctcaaatctgggatactgctggtcaagaaagatatcgtgccattactagtgcttactaccgcggagctgttggtgctttacttgtgtatgacgtcactcgtcacgttacgtttgagaatattgagaggtggttgaaagagttaagagatcacacagaccaaaacatcgtagtaatgctcattggcaacaaatcagatcttcgacaccttgtggctgtttcaaccgaggatgcaaaagctctagcagagagagagtctctgtacttcatggagacttctgcactagaagcaaccaatgtcgagaatgctttccaggaagttcttactcagatatatcgtgttgtcagcaagaagacggttgaaactggggacgaaggagccgtttcttccctcccatccaaaggagagacgataaatgtcaaagacgactcatctgttctcaagagatttggttgctgctcaagctaggccttttgagttggaaacttgccacattattgttgtttctttgtacattatctttttcatttacgatgaatattatccatgagaatatagaaaggaatatttttgtggaagcattgtttaaataggttcagattgtggcttttttgtatgggttgatcgaacaataaaaatatatatat

SEQ ID NO: 10937 - DNA, 1032 bp, Fagopyrum esculentum
ttcaacccaaaaatcgaacacttggacccatcttgttgctctagaaaaagccgcccaatttcaatactcaatacacattctccatttctccatctcccagatctccctgcttcttcaaagatcatatagaggttacgtttagcagtagttgtaattcggaggcacaaaatgtcaggctatagagcagaggatgactatgattaccttttcaaggtggttcttatcggagattcaggggtcggaaagtccaatttgttgtccaggttcaccaggaacgagtttagcctcgagtccaagtccactatcggcgttgagttcgctactaggagcttgaatgttgatggaaaggtcatcaaagctcagatttgggatactgctggtcaagagaggtatcgagcaatcacaagtgcatattaccgaggtgcggttggcgcattgctagtgtatgacgtcacacgacattcaactttcgagagtgttgagaggtggttgagggagcttagagaccacacagacccaaacattgtagtgatgctgataggcaacaagtctgatcttcgccacctcgtggcagttcccacagaagacggtcgctcatttgctgagagagaatctctctacttcatggagacctctgccctcgaagccaccaatgtggacagcgccttctcagaggttctgactcagatctaccatattgtgagcaagaaggcaatggagaccggagacgatgctaatggctccactgttcctactggtgagaaaattgatgttggaaaggaagtctctgctatgaaatcagtgggatgctgttcaacttgatctgatctataacattatttttataggatttggtcattgtattgcacaccatgatatgtaaaatttcggtttgattgccatggaaccttatatgttttgttttaggaaatagagaatgatgattttctttgacgaatattttttagttatggaggtgttactagctatttcttagctctatgcatccttttaaatttattcatgaaaaaa

SEQ ID NO: 10938 - DNA, 889 bp, Olea europaea
aaatttgaaaagagagatgtcagggtacagagcagaagatgactatgattacctcttcaaggtggttcttataggggattctggtgttggcaagtccaacttgctttcaagattcactagggatgagttcagtcttgagtccaaatccaccattggtgttgagtttgcaaccagaagcttgaacgtcgatggaaaggtcatcaaggctcagatttgggacactgctggccaagaaaggtaccgtgcaattaccagcgcctactaccgcggtgcagttggtgctttgcttgtttacgatgtgacgatgcacccgacatttgaaaatgttgaaagttggttaagagagttgagggatcacacggatcccaatatagttgtcatgctcattgggaacaagtctgatctccgacatctagtggcagtctcgaccgaggatggaaagtcttttgctgagaaggagtcactctacttcatggaaacttctgcactcgaagctactaatgtggaaaatgcttttttgaggttcttactcagatataccgtattgtgagcaagaaggcaatggagacaggagagaatggagctgtatcgaatgtcccttcaaagggtgagaaaatcgatgtgaacaaagatgtatctgctacgaagagaggtggttgctgttcgacgtaaaccctgtgctttttgctttacattgcatgcagttgtttggaagaagttttatttatttgtattgctttcatttagatggaatattttttgccgccttaaatgttatggaatcagatgggtgaatagaggagtattatagttatgttgtgttgtgtgctcatatagtatattttgttatgtttaaatacttatttataataaataaattgtggtttta

SEQ ID NO: 10939 - DNA, 1247 bp, Orobanche aegyptiaca
tcacttgacagcagtcatgccgattcctaactaaaccactccagtcaaaagaaaacacgcagaaaattaagagatcaaaaagaaaaagaaacgtaagaatttcacatttaacagtcagtaaaaacaacagaaaaaaacagataattattggaatcacacctcatttctgaaagacggttggatcttcatatcctgtcaaatccgtacagactaatggcgggttacagagcagaagacgattatgattaccttttcaaggtggtattgataggagactctggagttggcaaatccaacttgctttccagattcaccaggaatgagtttagccttgagtccaaatcaactatcggcgttgagtttgcaaccagaagcttgaccgttgatggaaaagtcatcaaggctcagatttgggacactgctggccaagagaggtaccgtgccattaccagtgcgtattatcgtggggccgttggtgctttgctcgtctatgatgttaccaggcacgccacgttcgaaagcgtcgagaggtggttaaaggagttgagagatcatacggatcccaacatagtcgtcatgcttatcggcaataaatccgatctccgacatctcgtggctgtctcgactgaggatggaacctcgttttgcgagagggaatcactttacttcatggaaacttccgcactcgatgctactaatgttgataatgctttcacagaggttctcacgcagatatatcgaattgtgagcaagaagacgatggagacaagtgataacagggacgcgccaagtgtcccggcaaagggtgagaaaatcgatattagtaaggatgtttcggatatgaagaaaggcggttgctgctcgtcctagtttttttgaaagaggacttgttctgtcacactttgctatgagactgtggtgtaaagatttatggggttgatggttcttgcagatattagttagcgcaaagacgacttaattatcgttaaacgtgcttgaatttgtattgcttttggtgtttaattggaattgcaattgatatcttcaggtatggagaggatgaacttggtcaccatatttatcttcattgcttagtttccaactttgatgattattctgtgcattcgttgtttctattattaccctcaaccaccagatctgtacaagattgtgattttcagtttgggttctttttggattatgtggtcgttttgatgtgtcttatattcattattgtacaatctttt

SEQ ID NO: 10940 - DNA, 903 bp, Triphysaria pusilla
gatcctattactgtcgtttgaaattcaacctcaaatctgtacatattcatggcgggttacagagcagaagacgattatgactacctattcaagttggttttgatcggcgactcgggagtcggcaaatctaacttgctctccagatttaccaggaatgagtttagcctcgagtcgaaatcgaccattggcgttgagtttgctacccgaagcttgaccgttgatggaaaagtaatcaaggctcagatttgggacactgctggccaagagaggtaccgagccattaccagtgcatactatcgtggggctgttggggctttgctcgtgtacgacgtgaccagacactccacattcgagagtgtcgagaggtggctaaaggagttgagggatcacaccgatcccaacatcgttgtcatgctcatcggcaataaatccgatcttcggcatcttgtggctgtctcgaccgaggacgggacctcattttcggaaaccgagtcgctgtactttatggaaacctctgcgctagatgccaccaatgttgatagtgctttcaccgaggttcttacgcagatatatcgggttgtgagcaagaagacgattgaggcgggggataatggggacgggccaagtgtcccgtcgaagggtgagaatattgatgttagtaaggatgtatcggctatgaagaaaggtgggtgttgttcgtcgtaaaatgaaagggttaatcagctcggaccatttcactcgaagatcgataggattaacttttattattattgaattatcgttgtatttggaaaatggaataattttctccatatttctttcataactcttttctttttgaagtgtaatatacactatattcttcaggaatcaagaatgtttaccgtaccaaaaaaaaaaaaa

SEQ ID NO: 10941 - DNA, 950 bp, Malus domestica
caccgaaagctgcacatctctgcaactctctctctctctctctctccccctctctcttaattcgaacaccaaaagttagagaactgcagaaatggctggatacagagccgacgatgactatgactacctcttcaagttggtcttgattggggactccggcgtggggaagtcgaatctgctctctaggttcaccaagaacgagttcaacctcgagtccaaatccaccattggcgttgagtttgccaccaggaccttgaccgttgacggaaaagtcatcaaggctcagatttgggatactgctggccaagaaaggtaccgcgccatcactagtgcttactatcgcggggctgtgggtgcactccttgtgtacgatgtcactcgccatgcgacatttgagaatgtcgacagatggctgaaggaattgaggaaccacaccgattccaacattgttgtgatgctcgttgggaacaaatcagatctccgccaccttgtagctgtctcaactgaagacgggaagtcctatgctgagaaggagtcactctacttcatggaaacatctgcactggaatcaaagaatgtagaaaactcctttgctgaagttctgactcaaatataccatactgtgagcaagaaggcggttgaagggggagaaaatggaacttcatctgtcccagcacaaggagagaaaataaacatgaaagatgatgtgtccgcgttgaagagagttgggtgctgctcaagctaggcctggtaaacaaaacttgattgaatgaatatggcttctatgaactgtgtaatattttgcagagggacacaaactagagaataccggaacacgaaatttttactctgagtaagctagcttatgttatcctcaattggtaaacaatttcagtggatgctgattagcacattttaatccgcacttcagcaccatctatgcctttaaa

SEQ ID NO: 10942 - DNA, 1542 bp, Cicer arietinum
attcttccggcctataatttattaagcaaaaaatggctattagagtatttttccaatactttttacaaaaagaaaagaaagaaaggatcggttgcaagcaagtcaagtaagactgaggatttctttggtttcactccacatttgtgtggcacttttcttttcattcatcactcgctcctccactcacacttgcataagaaaaaagaaacaagaaacgaattagcaaagggttattattgtgttaactaataatggggggatacagagcggatgacgactacgactaccttttcaaagtagttctaatcggtgattccggcgtagggaagtcaaaccttctttcaaggttcaccaagaacgagttcaacctcgaatctaagtccaccattggcgtcgagttcgccacacgcacccttaacgtcgacaccaaagtcgttaaatctcagatctgggacaccgccggtcaggaaaggtatcgagcgatcaccagtgcttattatcgtggggctgtaggtgcacttcttgtatacgatgtcacacgccatgcaacatttgagaatgttgatagatggctgaaagaattaaggaatcacacagattcaaacattgttgtgatgcttgttgggaacaagtcagatcttcgacacctagtagctgtatcaactgaagacggaaaggcttatgctgagaaagaatcactgtacttcatggaaacctcggctttggaagcaacaaatgtagagaatgcattcgccgaagttttgactcaaatctaccattttgttagcaaaaagacagttgacagcgcagaaaatggaactgcaactgtgccaaccaaaggagagaaaatagatcttaagaatgatgtgtctgcattgaagagagttggttgctgctcaagctaaagctttgctagctaaaataattcaattggtttatgctatgaggtctgttgtacctgtaatattctttgagagatacaaagtagaaaagaaaagaaatttaaattttcactacaattaattagactttctttctaacattgaagaaaccatgtttcatgttcaatacgatctggggaagcaagttgctggcttcatggcctagtcttaattattgtattatttagttactgagatgttttcactatcaaagattcaagcttaaaataggcataggattttgttatttgaaaagattacgcggtggatgtgattcctttctgctcgacaaacttttcagtatcaatttggcaatgtataatatttggcaacccttttgtatcttctgctctgcgaccgtctgaaagtataatatttttaaggtagtaagaggttgcatctttggatgcgccatctcattttttgtgtcatctttatcttcttttgcatgtttggtcgatgtcttgcttcttcagtcaattttgacgactaatttctgtaagtaacaattttttctttgtttgcttcttccatctttatttttcattgtgcttcttactgctaattcctaaagaatgaagatgatttactgtggtgcatg

SEQ ID NO: 10943 - DNA, 1012 bp, Cichorium intybus
tgctagcacccagattttgtcgattcaaattttaaaaagttgaagagttgagacccttttacgaacggtgtttccccattttgaagcccagagaaacgggtcaaatacacacaaaaccaaaaaccgtgtgagagagaaacctcccacttcgttgcttattattttacgaaaggaaaagggaaaagaataaagcagagggatctatacaaatctgaaattagttttgtggagattgtgaatatgtctggatacagagctgatgatgactacgattaccttttcaaggttgttttgattggcgactcaggtgttggaaagtccaacttactctcacgattcactaggaatgagtttagcctcgagtccaaatccaccatcggtgttgagttcgctacaagaagcttaactgttgatagcaaagtcatcaaagctcagatttgggacactgctggtcaagaaaggtatcgtgcaattacgagcgcgtactaccgaggagcggtaggagcacttctagtatacgacgtgacaagatatccgacatttgaaaacgtggaacgttggttaaaagagttgcgggaccacaccgatccaaatatcgtggtcatgcttatcgggaacaaatccgatcttagacacttggtggccgtgcaaaccgacgatgggaaatcatttgcggaaaaagaatcgctttacttcatggaaacatccgctttagatgctacaaatgtggagaacgcgtttgcggaagtgcttactcagatatatcggattgttagtaagaaagctatggatacgggtgatgagaccgcatctacggttccatcgaaaggcgagaaaatcgatgtgggaaaagaggtttccgcgatgaagtcggtcgggtgttgttcgtcttaggtttatgagatttgttgtggttttggattttaagattaaatgagtaagtactcttgtttatggtttagttgtagatgttgcaattttatttgttttgtttaatcgtggtttatttatt

SEQ ID NO: 10944 - DNA, 1084 bp, Cichorium intybus
tcccgtatcattctggaactccccccgatccctttgacatcgcagaattgctagcacccaagattttgtcgattcaaaattttaaaaagttgaagagttgagacccttttacgaacggtgtttccccattttgaagcccagagaaacgggtcaaatacacacttctgattacaccgtgtgagagagaaatctcccacttcgttgcttattattttacgaacgggaaaagggaaaggagaagggaaaagaataaagcagagggatctatacaaatctgaaattagttttgtggagagtgtgaatatgtctggatacagagctgatgatgactacgattaccttttcaaggttgttttgattggcgactcaggtgttggaaaatccaacttactctcacgattcactaggaatgagtttagcctcgagtccaaatccaccatcggtgttgagttcgctacaagaagcttaactgttgatagcaaagtcatcaaagctcagatttgggacactgctggtcaagaaaggtatcgtgcaattacgagcgcgtactaccgaggagcggtaggcgcacttctagtatacgacgtgacaagatatccgacatttgaaaacgtggaacgttggttaaaagagttgcgggaccacaccgatccaaatatcgtggtcatgcttatcgggaacaaatccgatcttagacacttggtggccgtgcaaaccgacgatgggaaatcatttgcggaaaaagaatcgctttacttcatggaaacatccgctttagatgctacaaatgtggagaacgcgtttgcggaagtgcttactcagatatatcggattgttagtaagaaagctatggatacgggtgatgagaccgcatctacggttccatcgaaaggcgagaaaatcgatgtgggaaaagaggtttccgcgatgaagtcggttgggtgttgttcgtcttaggtttataagatttattgtggttttggattttaagactaaatgactactcttgtttatggtctagttgtagatgttgcagtctcatttcttttgcctaatcatggtttatttattagggtttgttttt

SEQ ID NO: 10945 - DNA, 1065 bp, Cichorium intybus
tcccgtatcattctggaactccccccgatccctttgacatcgcagaattgctagcacccaagattttgtcgattcaaatttttaaaaagttgaagagcttgagacctttttaccaacggtgtttccccattttgaagcccagagaaacgggtcaaatacacacaaaaccaaaacccgtgtgagagagagagaaacctcccacttcgttgcttattatttcacgaaagggaaaagaataaagcagagggatctatacaaatctgaaattagttttgtggagagtgtgaatatgtctggatacagagctgatgacgactacgattaccttttcaaggttgttttgatcggcgattcaggtgttggaaaatccaatttactctcacgattcaccaggaacgagtttagcctcgagtccaaatccaccatcggtgttgagttcgctacaagaagcttaactgttgatagcaaagtcatcaaagctcagatttgggacactgctggtcaagaaaggtatcgcgcaatcacgagcgcgtactaccgaggagcggtaggcgcactgctagtctacgacgtgacaagatatccgacatttgaaaacgtggaacgttggttaaaagagttgcgggaccacacggatccaaacatcgtggtcatgcttatcgggaacaaatccgatctcagacacttggtggccgtgcaaaccgaagacggcaaatcatttgccgaaaaagaatcgctttacttcatggaaacgtctgctttagatgctacaaatgtggagaacgcgtttgcggaagtgcttacgcagatatatcggattgttagtaagaaagcgatggatgcgggagatgagaccgcgtccacggttccatcgaaaggcgagaaaatcgatgtgggaaaagaggtttccgcgatgaagtcggtcgggtgttgttcgtcttaggtttatgagatttgttgtggttttggattttaagactaaatgagtaagtactcttgtttatggtttagttgtagatgttgcaattttatttgttttgtttaatcgtggtttatttatttatt

SEQ ID NO: 10946 - DNA, 1205 bp, Cichorium intybus
tcccgtatcattctggaactccccccgatccctttgacatcgcagaattgctagcacccaagattttgtcgattcaaaattttaaaaagttgaagagttgagacccttttacgaacggtgtttccccattttgaagcccagagaaacgggtcaaatacacacaaaaccaaaaaccgtgtgagagagaaatctcccacttcgttgcttattattttacgaacgggaaaagggaaaggagaagggaaaagaataaagcagagggatctatacaaatctgaaattagttttgtggagattgtgaatatgtctggatacagagctgatgatgactacgattaccttttcaaggttgttttgatcggcgattcaggtgttggaaaatccaacttactctcacgattcaccaggaacgagtttagcctcgagtcgaaatccaccatcggcgttgagttcgctacaagaagcttaactgttgatagcaaagtcatcaaagctcagatttgggacactgctggtcaagaaaggtatcgtgcaattacgagcgcgtactaccgaggagcggtaggcgcacttctagtctacgacgtgacacgatatccgccgtttgaaaacgtggaacgttggttaaaagagttgcgggaccacaccgatccaaatatcgtggtcatgcttatcgggaacaaatccgatcttagacacttggtggccgtgcaaaccgacgatgggaaatcatttgcggaaaaagaatcgctttacttcatggaaacatccgctttagatgctacaaatgtggagaacgcgtttgcggaagtgcttactcagatatatcggattgttagtaagaaagctatggatgcgggtgatgagaccgcgtctacggttccatcgaaaggcgagaaaattgatgtgggtaaagaggtttccgcgatgaagtcggttgggtgttgttcgtcttaggtttataagatttattgtggttttggattttaagactaaatgactactcttgtttatggtctagttgtagatgttgcagtctcatttcttttgcctaatcatggtttatttattagggtttgttttttattttattttgagtaagtgcttttggaacaaagtactatatgaatgaattgtgtttcataaagtctggaaaaacatctgtttcaaatttcataattaagtgctcacccatactaatgatc

SEQ ID NO: 10947 - DNA, 774 bp, Elaeis guineensis
cgccttgcgaaaccggggaggaggagaaccctatcgagtccagctctgtctttccttcttgttctcgttaattaagatccaagaagaagagagaagtaggagaagaggggaaaaagaagagagagatggcggggtatagggcggaggacgactacgactatctgttcaaggtggtgctgatcggggactcgggggtggggaagtcgaatctgctgtcgaggttcaccaggaacgagttcaacctcgagtccaagtccaccatcggcgtcgagttcgccacccgcagcctcaacgtcgacggcaaggtcatcaaggcccagatttgggacacgccggccaagaagtatcgtgccatcactagtgcatactaccgaggagctgtaggtgcattgcttgtctatgatgttactcggcatgcaacattcgagaatgctgagcgctggttgcgggagttgagagaccatacggatccaaatatagttgttatgcttgttggaaacaagtctgatcttcgtcatcttgtagctgtttcaacggaagatgggaaagcttttgcagagagggagtcactctatttcatggagacatccgcattagaagcaacaaatgtggaaaatgcctttgctgaggtcttaactcagatttatcggattgtaagcaaaaaagcagttgaggcaggtgatgattctgcttctgcagtccccagtaaaggggagaaattaatgtgaaggtatgatgtttctgctctaagagagttggctgctgctcttctta

SEQ ID NO: 10948 - DNA, 1471 bp, Trigonella foenum-graecum
ttctaataacacccaattcatcacattcattttcatatatactaaggttcattcttaccttaatttgttaagttccaatggctcttcaggctgcttctttgcttcctgcttctttctccattcctaaagagggaaagattggtgcatctcttaaggactcaactctttttggtgtttcattgtctgattctttgaaaggtgacttcagctcttctgcattgaggtgcaagagggaattgcgacaaaagtcggggctgtgagggcagagacagcggctacagccactccatcagtcgtcaagtcatcatccgatggcaagaaaacattgaggaaaggaagtgttgtgatcactggtgcttcatctggattaggccttgccactgctaaagctttggctgagacaggaaaatggcatgtaattatggcttgtagggatttcctcaaagctgcaagagctgcaaaatctgctggaatggcgaaggaaaactacacaatcatgcacctagacctttcctctcttgacagtgttcgccaattcgtcgataactttaggcgatctgaaatgccgttggatgtgcttgttaacaatgccgctgtttatttgccaactgccaaggaacctagattcaccgctgaaggctttgagcttagtgttgggacaaaccatctaggtcatttcctcctttcacgccttttgctcgaggacctgggaaaatctgattacccttcaaagcgcttgatcattgtcggctcaatcacaggtaacacaaacacattggccggaaatgtaccaccgaaagctaaccttggtgacttgaggggacttgccggtggcttgaatgggcttaacagttcatccatgattgatggtggagatttcgacggtgccaaggcatacaaggacagcaaagtctgtaacatgctcacaatgcaagagttccacagaagataccatgaggaaactggaatcacatttgcttccctttaccctggttgcattgccacaacaggcttgtttagggagcacattcccttgttcagaactctattccctccattccaaaagtacataaccaaaggctacgtctcagaagatgaagcaggaaagagacttgctcaggttgtgagtgatccaagcttaacaaaatccggtgtttactggagctggaacaaagcttccgcttcatttgaaaaccagttatcccaagaggcgagtgatgtagagaaggctcgcaaggtgtgggaggttagtgagaagcttgttggtctggcctaaagtgagcctccgacatctatgctgagttagaggcagaggcattgccatggaaggaaaatgatgtcctagaagaatgacaatgatatcatgttgagtgcattaattgttgctttgttagataggaacctttttttgtctttatgtaggagtcgatgaatcaataaaatcattcaactatttggcgaagtgcttata

SEQ ID NO: 10949 - DNA, 1452 bp, Sarracenia psittacina
actcagctccgcctccggccacctcctcttcgacaacccacttccatttcaagttccccatggctttccagaccgctgctctgcttccttcttctctctccattatcaaagagggcaaggccagtgcatcttttaaggactctactctttttggaatatctctctgtgatcatatcaaacctaattccagctgctcttcactgagaatcaagagggaatccaaccaaagcaagtttgccactggggcaacaagaattcaagcagtggttacaactccagcagttaaccgggctgcgccggaagggaagaaaacgctgagaaagggcagtgttgttatcaccggagcctcctccggcttgggcctggccaccgccaaggctctggcagaaacgggcaaatggcacgtgattatggcttgcagggacttcctgaaagccgaaagagccgccaagtcggccggcattaccaaggagaactacaccgtcatgcatctcgaccttgcctcgcttgacagtgtccgccagtttgtcgataacttccggaggtcgggccgcccgctggatgttctggtctgcaatgcagctgtctacctcccgacagccaaggagcctactttcaccgccgatgggttcgaacttagcgttgggactaatcatcttggaccttccttttgtcgaggttgatgctcgatgacttgaagcaatctgattacccatcaaaaagactcatcatcgtaggctcaattacaggtaacacaaataccctggctggaaatgtgcctccaaaggccaacctaggggacttgagaggctttgccggagggttgaatggactaaacagctcaaccatgatcgatggcggggaatttgacggtgccaaggcttacaaagatagcaaggtctgcaacatgctcaccatgcaagagttccaccgccgataccacgaggaaaccgggattacatttgcttccttgtacccgggttgcatcgccaccacagggttgttccgggaacacatccccttgttcaggctccttttccctcccttccagaagtatatcaccaagggtttcgtgtccgaggaagattccggaaagcgactcgcccaggttgtgagtgatcccagcttgacgaagtctggcgtctactggagctggaacaaggattcggcgtccttcgagaaccaattgtctcaagaagcaagtgattcagaaaaagcccgtaaagtttgggagcttagtgagaaacttgttggcctggcataaaaaagagagcgctttgaaatgagattcttgacatcagactaatcttcttggagagagaggacttacctgagttttgggatcctgttgcgagtgcagaattaggatgctgtgccgttgtaagcagatgatcttgtgtaaaatgaacgatgatcttgagtcgcagtgaacaataaaatcattctcctttt

SEQ ID NO: 10950 - DNA, 1378 bp, Chenopodium quinoa
ctttaacattacatttcactcaaaacatttaaaacatcaagtttttagtttttaggttcatataatataccaaaaaatggctctccaagcttctttgcttccttctgccttgtccatccctaaagagggaaaatctactgcatcattcaaggactctagcttatttggggtatctctgtcagactatgtcaaagctgacttcagttcatctgctttgagatgcaagagagaatgcaatgcaacaagggcagcagggccaatcagagcacaaacctcggcagtggcgacaccaggagtaactagatcatcaccagagcaaaagaaaactctaagaaagggtagtgttattgtcaccggtgcatcctccggtctaggacttgcaactgcgaaagcattagccgagacaggaaaatggcatgtaatcatggcgtgtagggacttccttaaggccgaaagggcggctaaagctgctggaatgtcaaaggagaattatagtataatgcatcttgatctttcttctcttgacagtgttaggcattttgtgaacaattttaggcaatcaggaagtccccttgatgtgttggtttgtaatgccgctatttaccaacctactgctcgggatccttcctttactgctgaaggctttgagctcagtgttgggactaatcatcttggccatttcttgctctcgaggttgttgcttgaggacttgaacaagtcggattatccttctaggcggctcattatcgtcggatctattacaggtaacacgaacacattggccgggaatgtgccaccaaaggccaacctaggagacatgagggggctcgccggtggattgaatggcctaaacagctctgccatgatagatggtggagattttgatggggccaaggcatacaaagacagtaaagtctgcaacatgcttaccatgcaggagtttcaccgtcgctaccatgaagacaccggaatcacctttgcttcactataccctggctgcattgccactactggcttgtttagggaacatatccccttgtttagggctcttttccctccattccaaaagtacgtcaccaagggatatgtctctgaagatgaagcagggaaagacttgctcaggttgtcagtgacccgagtttgacaaaatccggtgtatactggagctggaacaaggcttcggcttcatttgagaaccagatgtctcaagaagccagtgatcctcagaaggccaagaaagtctgggagatcagtgaaaagctagttggtttggcatagaaacttaagcagatgtcacaatgcctagctcctctgctaactttgtgtgattgggagagacggtagcatcgaaaaattacagggtttcagatagatgtgg

SEQ ID NO: 10951 - DNA, 1329 bp, Flaveria ramosissima
aacaatctttattagatattcacaccaacccacttcagtttcaacctccaatggctctccaagctacctcatctttcaccattcacaaagaggtgtctttgaaggattgtagtctgtttggagcaccattatcaactaatctcaaagttgatttcacaagcaggagggaattcaaccaaaggggtgcattgaaaaccaaagctgttgccacctcatctccggctgcaacccgtgcatcaaccgatggaaagaaaacattgagaaagggtactgtgatcatcactggagcttcatcaggattgggtctagcaactgcaaaatctcttgcagaaacagggaaatggcacgtgattatggcgtgcagggactttttgaaagccgaaagggcggcaaagtcatcggggatgtcgaaagagaattacacagtgatgcatttggacctttcgtctttggatagtgtgaggcagtttgttgggaattttaggcaatctggaagaccagttgatgtgctggtgtgcaatgctgcggtttatttaccgaccgcgaaagaaccaacgtatacggctgatgggttcgagcttagtgtcggcacgaatcatcttgggcatttcttgcttgcaaggttgttgcttgatgacatgaagcagtcggattatccgtcgaaaagactcataattgttggctcaatcacaggtaacacaaacactttggctggcaatgtaccaccaaaggctaaccttggtgacatgaggggtctagccggcgggttaaacgggctcaacagctcagccatgattgacggtggagatttcgacggtgcaaaagcatataaagacagtaaagtctgcaacatgcttatgatgcaagaatttcaccgtcgttttcatgaagaaaccggcattacatttgcttcattgtaccctggttgcattgcaacaactggtttatttagggaacatattcctcttttcagactcctttttcctccattccaaaagtacataactaaagggtatgtttctgaggatgaatctggcaagagacttgctcaggttgtgagcgatccgagtttgaccaaatcgggagtttactggagctggaacaacaattcggcttcgtttgagaaccagttgtcggaagaagctagtgatgtctccaaggctcgaaaagtatgggagatcagcgagaaattagtcgggttagcttaaacaacaaatctttcttctttgagtatggttgatttgggttaaaatgtgagtgtaggacatgtttgcaggcagttttctgttgtatatttaggctaatttccaataagaatcaataataatt

SEQ ID NO: 10952 - DNA, 1425 bp, Flaveria ramosissima
tctttattagatattcacaccaacccacttcagtttcaacctccaatggctctccaagctacctcatctttcaccattcacaaagaggtgtctttgaaggattgtagtctgtttggagcaccattatcaactaatctcaaagtagatttcacaagcaggagggaattcaaccaaaggggtgcattgaaaaccaaagctgtagccaccacatctccaggtgcaacccgtgcatcaaccgatggaaagaaaacattgagaaagggtactgtgatcatcactggagcatcatctggattgggtctagcaactgcaaaatctcttgcagaaacagggaaatggcacgtgattatggcgtgcagggactttttgaaagccgaaagggcggcaaagtcatcggggatgtcgaaagagaattactcagtgatgcatttggacctttcgtctttggatagtgtgaggcagtttgttgggaactttaggcaatctggaagaccagttgatgtgctggtgtgcaatgcagcggtttatttaccgactgcgaaagaaccgacgtatacggctgatggtttcgagcttagtgtcggcacgaatcatcttgggcatttcttgcttgcaaggttgttgcttgatgacatgaagcagtcggattatccgtcgaaaagactcataattgttggctcaatcacaggtaacacaaacactttggctggcaatgtaccaccaaaggctaaccttggtgacatgaggggtctagccggcgggttaaacgggctaaacagctcagccatgattgacggtggagatttcgacggtgcaaaagcatataaagacagtaaagtttgcaacatgcttatgatgcaagaatttcaccgtcgttttcatgaagaaaccggcattacgtttgcttcattgtaccctggttgcattgcaacaactggtttatttagggaacatattcctcttttcagactcctttttcctccattccaaaagtacatcactaaagggtatgtttctgaggatgaatctggcaagagacttgctcaggttgtgagcgatccgagtttgaccaaatcgggagtttactggagctggaacaacaattcggcttcctttgagaatcagttgtcggaagaagctagtgacgtctccaaggctcgaaaagtatgggagatcagcgagaaattagtcgggttagcttaaacaacaaatctttcttctttgagtgtggttgatttgggttaaaatgtgagtgtaggacatgtttgcaggcagttttctgttgtatatttaggccaatttcaataagaatcaataataattattataagctctgtttatgctaagaaaaaaaaaaaaaaaaaaataaactctcggtcgtagacacgtctactacgagacagacgacgacgacacagggagtag

SEQ ID NO: 10953 - DNA, 1352 bp, Flaveria ramosissima
catcaacaagattcaaatccaacaatctttattagatattcacaccaacccacttcagtttcaacctccaatggctctccaagctacctcatctttcaccattcacaaagaggtgtctttgaaggattgtagtctgtttggagcaccattatcaactaatctcaaagttgatttcacaagcaggagggaattcaaccaaaggggtgcattgaaaaccaaagctgttgccacctcatctccggctgcaacccgtgcatcaaccgatggaaagaaaacattgagaaagggtactgtgatcattactggagcttcatcaggattgggtctagcaactgcaaaatctcttgcagaaacagggaaatggcacgtgattatggcgtgcagggactttttgaaagccgaaagggcggcaaagtcatcggggatgtcgaaagagaattacacagtgatgcatttggacctttcgtctttagatagtgtgaggcagtttgttgggaattttaggcaatctggaagaccagttgatgtgctggtgtgcaatgcagcggtttatttaccgactgcgaaagaaccaacgtatacggctgatgggttcgagcttagtgtcggcacgaatcatcttgggcatttcttgcttgcaaggttgttgcttgatgacatgaagcagtcggattatccgtcgaaaagactcataattgttggctcaatcacaggtaacacaaacactttggctggcaatgtaccaccaaaggctaaccttggtgacatgaggggtctagccggcgggttaaacgggctaaacagctcagccatgattgacggtggagatttcgacggtgcaaaagcatataaagacagtaaagtatgcaacatgcttatgatgcaagaatttcaccgtcgttttcatgaagaaaccggcattacatttgcttcattgtaccctggttgcattgcaacaactggtttatttagggaacatattcctcttttcagactcctttttcctccattccaaaagtacataactaaagggtatgtttctgaggatgaatctggcaagagacttgctcaggttgtgagcgatccgagtttgaccaaatcgggagtttactggagctggaacaacaattcggcttcgtttgagaaccagttgtcggaagaagctagtgacgtctccaaagctcgaaaagtatgggagataagcgagaaattagtcgggttagcttaaacaacaaatctttcttctttgagtgtggttggtttgggttaaaatgtgagtgtaggacatgtttgcaggcagttttctgttgtatatttaggccactttcaataagaatcaataataattatca

SEQ ID NO: 10954 - DNA, 1327 bp, Flaveria ramosissima
caacaatctttattagatattcacaccaacccacttcagtttcaacctccaatggctctccaagctacttcatctttcaccattcacaaagaggtgtctttgaaggattgtagtctgtttggagcaccattatcaactaatctcaaagttgatttcacaagcaggagggaattcaaccaaaggggtgcattgaaaaccaaagctgttgccacctcatctccggctgcaacccgtgcatcaaccgatggaaagaaaacattgagaaagggtactgtgatcatcactggagcttcatcaggattgggtctagcaactgcaaaatctcttgcagaaacagggaaatggcacgtgattatggcgtgcagggactttttgaaagccgaaagggcggcaaagtcatcggggatgtcgaaagagaattacacagtgatgcatttggacctttcgtctttggatagtgtgaggcagtttgttgggaattttaggcaatctggaagaccagttgatgtgctggtgtgcaatgctgcggtttatttaccgaccgcgaaagaaccaacgtatacggctgatgggttcgagcttagtgtcggcacgaatcatcttgggcatttcttgcttgcaaggttgttgcttgatgacatgaagcagtcggattatccgtcgaaaagactcataattgttggctcaatcacaggtaacacaaacactttggctggcaatgtaccaccaaaggctaaccttggtgacatgaggggtctagccggcgggttaaacgggctaaacagctcagccatgattgacggtggagatttcgacggtgccaaagcatataaagacagtaaagtctgcaacatgcttatgatgcaagaatttcaccgtcgttttcatgaagaaaccggcattacctttgcttcattgtaccctggttgcattgcaacaactggtttatttagggaacatattcctctgttcagactcctttttcctccattccaaaagtacataactaaagggtatgtttctgaggatgaatctggcaagagacttgctcaggttgtgagcgatccgagtttgaccaaatcgggagtatactggagctggaacaacaattcggcttcgtttgagaaccagctgtcggaagaagctagtgacgtgtccaaggctcgaaaagtatgggagataagcgagaaactagtcgggttagcttaaacaacaaatctttcttctttgagcatggttgatttgggttaaaatgtgagtgtaggacatgtttgcaggcagttttctgttgtatatttaggccactttcaataagaatcaataataa

SEQ ID NO: 10955 - DNA, 1335 bp, Flaveria ramosissima
attcaacaatctttatctgatatttgcatcaaccgacttcagtttcagcctccaatggctctccaagctacctcatctttcaccatccacaaagaggtgtctttgaaggattgtagtctgtttggagcaccattatcaactaatctcaaagttgatttcacaagcaggagggaattcaaccaaaggggtgcattgaaaaccaaagctgtagccaccacatctccggctgcaacccatgcatcaaccgatggaaagaaaacattgagaaagggtactgtgatcatcactggagcatcatctggattgggtctagcaactgcaaaatctcttgcagaaacagggaaatggcacgtgattatggcgtgcagggactttttgaaagccgaaagggcggcaaagtcatcggggatgtcgaaagagaattacacagtgatgcatctggacctttcgtctttggatagtgtgaggcagtttgttgggaactttaggcaatctggaagaccagttgatgtgctggtgtgcaatgcagcggtttatttaccgactgcgaaagaaccaacgtatacggctgatgggtttgagcttagtgtcggcacgaatcatcttgggcatttcttgcttgcaaggttgttgcttgatgacatgaagcagtcggattatccgtcgaaaagactcattattgttggctcaatcacaggtaacacaaacactttggctggcaatgtaccaccaaaggctaaccttggtgacatgaggggtctagccggcgggttaaacgggctcaacagctcagccatgattgacggtggagatttcgacggtgctaaagcatataaagacagtaaagtttgcaacatgcttatgatgcaagaatttcaccgtcgttttcatgaagaaaccggcatcacgtttgcttcattgtaccctggttgcattgcaacaactggtttatttagggaacatattcctcttttcagactcctttttcctccattccaaaagtacattactaaagggtatgtttctgaggatgaatctggcaagagacttgctcaggttgtgagcgatccgagtttgaccaaatcgggagtttactggagctggaacaacaattcggcttcgtttgagaaccagttgtcggaagaagctagtgacgtctccaaggctcgaaaagtatgggagattagcgagaaattagtcgggttagcttaaaacaacaaatctttcttctttgagtgtggttgatttgggttaaaatgtgagtgtaggacatgtttgcaggcagttttctgttgtatatttaggccaattccaataagaatcaataataattat

SEQ ID NO: 10956 - DNA, 1477 bp, Arnica chamissonis
gactgccaccgtggcagacctttcggaataaaccccattactaaaaaccttatcgttcccaaatcccgaccaagacatcaagctttggctcatttcatggctcttcaagcttctcttcttccttctgcaatctccgttcacaaagatgggaagctgaattcgtctctcaaggagagttctttcaatggagctttcgtctcaaacaatttcaaatctgatttcagccctcttttgatcggaacaaaggagcttaaaaggaagtcattatggggacctgttcgcgcacaaacagtgactgcagctccatctgttaacgaagctgcaccagatggtaagaaaacactgaggaaaggtaatgtgataatcacaggagcctcgtcgggtctgggtctagccacagcaaaggcattggccgacactggaaaatggcacataatcatggcatgtagaaacttcctgaaagccgaaaaggctgctaaatctgttggcattactaaagaaaactacactgttatgcaccttgacctttcttctcttgaaagtgttcgccaattcgtggacacgtttaggctgtctggtcgaccccttgatgcacttgtgtgcaatgcagcgatctatttgcctacggctaaagagcccacttacaccgcagaaggatttgaacttagtgttgggactaaccatcttggccactttctcctctcaaggttgttgctagatgacctgaagaaaacggattacccgcaaaaacgactcgtcattgttggctccataacaggaaacacaaacacgttggctggaaacgtgccaccaaaggctaacttgggggacctgcgggggttagccgggggtttgaacgggctaaacagttctgcgatgattgacggaggcgagttcgatggtgctaaggcctacaaagacagcaaagtatgcaatatgctgacaatgcaagagttccatagacggtaccatgaagaatccggaattagcttttcgtccctgtaccccggttgtattgcgactacaggtcttttcagggaacacatcccgttgtttcgactactattcccgccattccaaaagtacatcacgaaaggttacgtgtcggaagaggaagccgggaaacgactagctcaggtcgtaagcgattcgagcctaacgaaatcgggtgtgtactggagctggaacaagaactctgcttcatttgagaaccagctttctcaagaagccagtgatgcggagaaagctcggaagctgtgggaggtcagtgaaaagctcgttggtttggcttagtcaaagtcaagaataatttagtcaaagtcaaattcaagaatagtcaaacagtgtgatatggatgtgtttgttgtgttgtatggtacaatataacaatgcattcttgaattttcgatatctgttaagcttgtgtgatgatgaatttccgaaagtaagagtgtaaaactgaatatgagatcaaaat

SEQ ID NO: 10957 - DNA, 1484 bp, Gossypium raimondii
aatctcaacaaacaacattagtacacccatcagattagcttagcagtagcgggttcatggctctccaagcagcttcattgctcccacccaccatctccattcacaaagaggccaaatccaatgcttgtcttaaagagacaactctgtttggtgttccattttcaacccatttcagctttcctcttcatttaactcaggaactcaggaaaaagggagtagctgccggaattgttcgagcacaaacagctgctacaactccggcagtcgatcgggctgctccacaagggaagaagaccttgagaaagggtactgtgataataaccggtgcgtcgtccggtttaggcctagcgacagccaaggctcttgccgagacaggggaatggcatgtaatcatggcgtgtagaaattttctcaaggctgagaaagctgctaaatcggttggcattacgaaggagaattattccgtgatgcatttggaccttgcgtcgcttgaaagtgtgcggcaatttgcggataccttccgtcgctcgggcaggccgcttgatgctttggtttgcaatgctgctgtgtacttgccaactgctaaggaaccgacttatactgccgaagggttcgaactcagcgtcggaacaaaccatctcggtcatttcctcctagcaaggctactcctagatgacctcaagcagtcagattatccttataagcgtctcattattgtcggttcaattacaggaaacacaaacacattggccgggaatgtgccaccgaaagctaacctcggggaccttagaggtcttgcaggaggcttgaatggaatacagagttcagccatgatagatggaggagattttgatggtgccaaggcatataaagacagcaaagtttgtaatatgctcaccatgcaagaattccacaggcggtacaacgaggaaaccggaatcacctttgcctccctttaccccggttgcattgcaacaacaggtctgtttagggaacacattccattgttccgtcttctcttcccaccgtttcaaaagtacattacgaaaggctatgtttcggaagaagaagctgggggcagacttgcacaggttgtgagtgatccaagtcttacaaaatcaggtgtttactggagttggaacaagaactcagaatcattcgaaaaccagctttcaaaagaggcaagcgacgcggagaaggcacggaagttgtgggaggttagcgagaagttggttggtttggcttaaataggcaccgaaatgagaatatatagacaaactataaatataatttacctatgtttccaattttgtaaatgctacaggttttgttcttaattacaaaacacagaaagttatcctattatttgtcatttctatcagctaaaacatatgggaattgaagcttttgtcaattattactgcagtttcaaccaaagcatgagtaatctatgaggcaataaaccagtgtattgtacatgatag

SEQ ID NO: 10958 - DNA, 1487 bp, Artemisia annua
tactccgacggggataccagaagaatttaagtttggcacaagaaatcacaacacttgcaagtgtatatatatcagcatcacattatcaagcttcatatccaacactctttattagatatttacagtatcccacttcatatcctaagctctaagctccaatggcccttcaagctacctcttctttctccatccacaaagaggcatgtttaaaggagtctagcatatttggagcaccactatcaactcatgttaaagttgacttcacatcatcttcaaaaagcaagaaggaattcagccaaaggggcgcacttagaacccaagcagtagccaccccaactcccactgcaaaccgtgcatcaacagatgcaaagaaaactttaagaaagggtacagtcatcataactggtgcttcatcgggtttaggtctagccacagcaaaatctctagcagaatcagggaaatggcacgtgattatggcatgcagagactttttaaaggcggaaagagctgcaaaatcatcaggaatgacgaaagagaattattcagtgatgcatttagacctttcatcacttgatagtgttaggcagtttgttgcaaactttaaacaatcgggtcaatcacttgatgtgttggtttgcaatgctgcggtttatttaccaactgctaaagagcctacttacacagctgatgggtttgagcttagtgttgggactaatcatcttggtcacttcttgcttgcaagattattgcttgatgacttaaagcagtcggattatccatcaaaaagactcatcatcgttggctcaatcacaggtaacacaaacactttggctgggaatgtacctccaaaggctaacctaggagacatgagaggtctagcgggtggattaaacgggctcaacagctctaccatgatcgacggtggagattttgacggtgcaaaagcatataaagacagcaaggtctgcaacatgctcatgatgcaagaattccaccgtcgttaccacgaagaaactggtatcacatttgcttccttgtaccccggttgtattgcaacaacaggattatttagggagcatattcccctttttagactcctatttcctccattccaaaagtacatcaccaagggttacgtgtccgaagaagaatccggcaagagacttgctcaggttgtgagtgatccaagtttgacaaaatccggagtttactggagttggaacaacaagtcggcttcttttgagaacgagttgtcagaagaagctagtgatgtctccaaggctcgtaaagtatgggagatcagtgagaaactagtcgggttggcttaaacaagaaagatccctgggttggcttaaacaagaaagatcccttcttcggttaattaatttgagtgataatgtgagtttaggacatggctgaaggcagttttctattgtatatttaggtttgtttgaatcagaagcaataataaaaccactccttattta

SEQ ID NO: 10959 - DNA, 1747 bp, Phaseolus vulgaris
gaacattcctaaacaacagacccaattcacatttttctctctctcaagttccaatggctctccaggctgcttctttggtttctgcttctttctctgttgccaaagagggaactgccacgtctctcaggaacaccacaatgtttggtctttcaatggcagacgctctcaaagccgacttcagctctccctcattttcatgcaaaagggaattccagcagaaaaattgtcctttaagggtccaatcagtggcaacaactccaggagtcacaaaggcttccccagaaggcaagaaaacattgaggaaaggaagtgttattatcactggagcttcctctggattgggcttggccactgctaaggctttggctgagacaggaaagtggcatgtgataatggcttgcagggatttcctgaaagctgaaagggctgcaaaagctgctggcatggctaaggaaaactacactgttatacatttggaccttgcctcccttgatagtgtcagacaatttgtgtacaacttcaggcaatcaggcaggccactggatgtgcttgtttgcaatgctgcagtttacttgccaactgctagtgaacctacatacactgccgatggcttcgaactcagtgttggaacaaaccatttgggccatttcctgctttctcgcctattgcttgaggacttgaacaaatctgattacccttctaagaggttgatcattgttggctcaattacaggaaacacaaacaccttggcaggaaatgtgccaccaaaggctaaccttggtgacatgaggggactagctggaggcttgaatggactaaacacttcagccatgatagatggaggatcctttgatggcgcaaaggcgtacaaggacagcaaagtctgcaatatgcttaccatgcaagaattccacagaagattccatgaagaaactggaatcacatttgcttccctctacccgggttgcattgcaacaacaggcttgttcagagaacacattcccttattcagacttctcttccctccattccaaaagtacataaccaagggctttgtctcagaagatgaatcaggaaagaggcttgcacaggttgtgagtgatccaagcctaacaaaatcaggtgtttactggagctggaacaaggcctctgcttcatttgaaaaccaattgtcacaagaggctagtgatgcagataaagctcgcaaggtttgggagatcagtgagaaacttgttggtttggcttaaagtggcatcttcacagcttccatgatcgaggggcatttgtcacagagttcaataacatctcacaagactttagacccttttctggtgctttttttttattggtgcttcttctagcggctaactcctcttgtcttgatgactactctcgatcaatcctttcaaagtgcacatgaatgcattttgcttaattcagcatttggaccttctaccccttcatcttttctttatacattttttattacattaatacttaatacacacttaccagaagaactccaaagtgaattggctaaatcatttggtaacaaagtgggaggggctgtgggtccacttaaaaagaaaaacggcacggattgtttattttaatccgctaacctatttaggtccgtctcgcataatttacagctcatgtgggacgggttggacacataacccgtataactttagcctaaatgtattaataatttgacaattatttttaaaacgcattaaatgttgtc

SEQ ID NO: 10960 - DNA, 1441 bp, Flaveria ramosissima
gtgtagtatcgaccacaataggttgtacattctgcttaaatactagtacttttgcttatccccatggctcttcaagcttctcttctttcttctgcaatctccgtccacaaagaggggaaattgaattcttctttcaaagagagttcaatcagtggagctttcgtttcaaaaagtgtcaaatctgattttagccctcttttgatcggaacgaaggagcttaaaaggaagtcattattgggaccgattcgcgcacagacagcaactgtagcgccatctgtaaacgaagctgcacctgatggcaagaagacactgaggaaggggaatgtgatcattacaggagcttcatcgggtctgggtctagccactgcaaaggcgttggccgacacaggaaaatggcacataatcatggcttgtagaaacttcctgaaagccgaaaaggctgcaaaatcagttggcattactaaagagaactacactgttatgcaccttgatctttcttctctcgaaagtgttcgccagtttgtggacacgtttaggcggtctggtcgacctcttgatgcccttgtgtgcaatgcagcggtctatttgcctacggctaaagaacccacttacactgcagaaggatttgaacttagtgttgggactaaccatcttggccactttctcctctcaaggctgctgctagatgaccttaagaagtcggattacccgcaaaaacgactcatcattgttggctctataacaggaaacacgaacacgttggctggaaacgtgccaccaaaggctaacttgggggacctgagagggttagccggggggttgaacgggctaaacagttcagccatgatcgacggaggagacttcgacggtgctaaagcctacaaagacagcaaagtatgcaacatgctcacaatgcaagagttccacaggcggtaccatgaagaatcaggaattaccttctcatccctgtaccccggttgcattgctacaacgggtctttttagggaacacattccattgtttcgacttctgttcccgccattccagaagtacatcacgaaaggttacgtgtcagaagaggaagcgggaaaacgactagctcaggtggtaagtgactcgagcctcgcgaagtcgggtgtgtactggagctggaacaacaagtctgcttcatttgaaaaccagctttctcaagaagccagtgatgcggagaaagctcggaagctgtgggaggtcagtgaaaagcttgttggtttggcttagtcaaagtcaaaagtctaagtcaagagaaagttttagtcaaagtcaaaatcaagaatagtcaaactgagtgatatggatgtgtttgttgtgttgtacggtacaatataacaatgcattcttgaattttcaatccgttaagtttgttagttgtggcatgatcaatttccgaaggtaatatatg

SEQ ID NO: 10961 - DNA, 1507 bp, Gossypium hirsutum
cgggttcatggctctccaagcagcttcatcgctcccacccaccatctccattcacaaagaggccaaatctaatgcttgtcttaaagagacaactctgtttggtgttccattttcaacccatttcagctttcctcttcatttaactcaggaactcaggaaaaagggagtagctgccggaattgttcgagcacaaacagctgctacaactccggcagtcgatcgggctgctccacaagggaagaagaccttgagaaagggtaatgtgataataaccggtgcgtcgtccggtttaggcttagcgacggccaaggctcttgccgagacaggggaatggcatgtaatcatggcgtgtagaaattttctcaaggctgagaaagctgctaaatcggttggcattacgaaggagaattattccgtgatgcatttggaccttgcgtcgcttgaaagtgtgcggcaatttgcggataccttccgtcgctcgggcaggccgcttgatgctttggtttgcaatgctgctgtgtacttgccaactgctaaggaaccgacttatactgccgaagggttcgaactcagcgtcggaacaaaccatctcggtcatttcctcctagcaaggctactcctagatgacctcaagcagtcagattatccttataagcgtctcattattgttggttcaattacaggaaacacaaacacattggccgggaatgtgccaccgaaagctaacctcggggaccttagaggtcttgcaggaggcttgaatggaatacagagttcagccatgatagatggaggagattttgatggtgccaaggcatataaagacagcaaagtttgtaatatgctcaccatgcaagaattccacaggcggtacaacgaggaaaccggaatcacctttgcctccctttaccccggttgcattgcaacaacaggtctgtttagggaacacattccattgttccgtcttctcttcccaccgtttcaaaagtacattacgaaaggctatgtttcggaagaagaagctgggggcagacttgcacaggttgtgagtgatccaagtcttacaaaatcaggtgtttactggagttggaacaagaactcagaatcatttgaaaaccagctttcaaaagaggcaagcgacgcggagaaggcacggaagttgtgggaggttagcgagaagttggttggtttggcttaaataggcaccgaaatgagaatatatagacaaactataaatataatttacctatgtttccaattttgtaaatgctacaggttttgttcttaattacaaaacacagaaagttatcctattatttgtcatttctatcagctaaaacatatgggaattgaagcttttgtcaattattactgcaagcacgagtaatctatgaggcaataaaccagtgtattataaaacatcaaaataaacacttttcacctatgggtaatttttccaaatataaactctaggttaaattattgctagaataagctaaattaagct

SEQ ID NO: 10962 - DNA, 1344 bp, Centaurea maculosa
accacagcgacaacttgtacattccgcttaaaaatcagtacgtttctagcatcaggaatccatggctcttcgagcagcttctcttcttccatctgcaatttccgttcacaaggaggggaagctgaattcttctcaaaatggagcttttctctccaaaaatgtcaaatctgatttcagtcctcttctaattggaacaaaggagcttagaaggaagtcatcgttggcgcccattcgtgctcaaaccgcaaccgtggctccatccatcaacgaagccacacaagacggcaagaaaacgctcaggaagggcaacgtgataatcacaggagcctcatctggtctcggtctagccacagcaaaggccttggccgataccaacgaatggcacgtgatcatggcttgtaggaacttcctgaaagcagagaaggccgctaaatccgtcggcattgctaaggaaaactacaccgttatgcaccttgacctttcttcgctcgaaagcgttcgccaatttgtggacacctttaagcgttccggtcgaccccttgatgcacttgtgtgcaatgcggccatctacttgcctacggctaaagaacccacttacactgccgaaggattcgaacttagtgtcgggactaatcatcttggccactttctcctctcgagattgttgctagatgacctcaagaaatcagattacccgcaaaagcgactcatcatcgttggctccataacagggaacacgaatactttggctggaaacgtgccaccaaaggcgaacttgggggatctgagaggcttagccgggggcttaaacgggctaaatagttctgctatgatcgatgggggagaattcgatggtgcaaaggcctataaagatagcaaagtgtgcaatatgctaacaatgcaagagtttcacagacgataccatgaagaaactggagttaccttttcgtccttgtaccctggttgcattgctacaaccggtttattcagggaacatatcccgttgtttcgacttctattccctccgttccaaaagtacatcacgaaaggctacgtttcagaagaggaagccggaaaacgtttagcccaggtagtaagtgattcaagcctaacgaaatcaggtgtgtactggagctggaacaagaactctgcttccttcgaaaaccagctctcgcaagaagccagcgatgcagagaaagcccggaagctgtgggaggtcagcgagaaactggtcggtttggcttagaatcaacagcattatgaaactcatgcatagtcaataatagtttttatatcatggtatgaatgtgtttgttgtgttgtacaatacaatataatgatgca

SEQ ID NO: 10963 - DNA, 1383 bp, Echinacea purpurea
agtagcagaaaatcgttgaagaaacagagttcttcggttcatatcttcttacagtatcgacccacaacaggttgtacattgcgcataaaaagcagtacattttgagcacgaagaacaaaattcttccttatccatggctcttcaagcttctcttcttccttctgcaatctccgttcacaaagaggggaatggagctttggtttcaacaaaggttaaatctgatttcagcccacttttgatcggaacaaaggagctcaaaaggaagccattgatgggaccaattcgtgcacaaacagcaaccgtatccccatctgttaaggacgccgcatcagatggaaagaaaacccttaggaagggcaatgtgatcataactggagcctcatcgggtctgggtctagccacagcgaaggctttggctgacaccggaaagtggcacattgtcatggcttgtagaaacttcctgaaagctgaaaaggctgctaaatcggttggcattagtaaagagaactacactgttatgcaccttgatctttcgtctcttgaaagtgttcgccagtttgtggacacatttaggcggtctgggcgacctctagacgcgcttgtgaacaatgccgcggtttatttgcctacggctaaagagcccacttacactgcggaaggatttgagcttagtgttgggactaaccatcttggtcattttcttttatcaaggttgttgattgaggaccttaagaagtcggattacccgcaaaaacgactcatcattgttggctccataacaggaaacacgaatacgttggctggaaatgtgccaccaaaggctaacttgggggacctgagagggctagccgggggtttgaatgggctaaacagttctgccatgatcgacggaggagagttcgacggtgctaaggcctacaaagacagcaaagtatgcaatatgctgacaatgcaagagttccatagacggtaccatgatgaaactggaattaccttttcgtccctgtaccccggttgcattgctacaacgggtcttttcagggagcacattccgttgtttcgacttctattcccgcctttccagaagtacatcaccaaaggttacgtgtcagaagaggaagctggaaaacgactagctcaggttgtaagtgattcgagcctaacgaaatcgggtgtgtactggagctggaacaaaaactcggcttcattcgaaaaccagctttcccaagaagccagtgatgcggagaaagctcggaagctgtgggaggtcagtgaaaagcttgttggtttggcttagtgaaagtcaagaataagattagtcaaagtcaaagttaaagtcaaagatggtcaaattgcgtagtatggatgtgtttgttgtgttgt

SEQ ID NO: 10964 - DNA, 1438 bp, Chrysanthemum coronarium
ctcattatttccctctaaaagacactttcaactccagtcaacaatggctctccaagccacctgtttctccgttgttcacaatgttgctggaaaggccaatgcatctttgaaagactcgaccctcttcggagttccacttttggataaccgtagcaatgatatcacttcattggtgtcgaaaaacaagatggaattcacccgtacaaaagtcttcaaagcccaagctgtagccaccacaagtactccagcagtgacccgtgctgcaccaaagggtaaggaaacattaagaaaaggatgtgttgtaatcaccggagcgtcctccggtttaggtttagcaaccgcaaaagcattagccgagactggaaagtggcacgtgatcatggcatgtagggactttctaaaagcggaaagagcagcaaaatcatctggaatatcaaaagaaaattacacagtgatgcatttagatcttgcatcattagatagtgttcgccaatttgttgctaactttaagcaatctggacgcccactagacgtcttggtatgcaacgctgctgtatatcaaccaacagctaaagaaccaaccttcacagcagacgggatcgagcttagcgttggtactaatcatcttggtcactttttactatccagattattacttgacaacatgaaacagtctgattacccttcaaaaaggctcataatagtcggatcaatcaccggaaacaccaacactttggctggaaatgtgcctccaaaggctaatctgggtgatatgaggggtttagccggtggtttgaacgggctaaatagctcaactatgattgacggaggtgactttgatggtgcgaaagcgtataaagatagtaagatttgtaatatgctaacaatgcaagagtttcataggaggtatcatgaagaaactggtattacattcgcttccttataccccggttgcattgctaccacagggttgtttagggaacacattccacttttccgaatgttatttccaccattccaaaagtttattaccaaagggtatgtctctgaagaagaatccggcaaaagacttgctcaggttgtgagtgatccaagcttgacaaaatcgggtgtctactggagttggaacaaggattcagcttcatttgagaaccagttgtcggaagaagcaagtgacgtgagcaaggctcgtaaggtgtgggagataagcgagaagcttgttgggttggcttgaattatgttccaatgatgaatgaaggaaggaatgcctagttggaaccaagtgtaggaatttggtgcaatttacaacttatgtgatgtatattagttttagtctgaataaggaaatcactcaccttctttcgtttagaagagtttggaaaattatgtctcggattatgaaatgtttggaatcaatgtactacttactttcttatta

SEQ ID NO: 10965 - DNA, 1418 bp, Chrysanthemum coronarium
aaataaattccttccaaacaccctattcaaactccagttagcaatggctctccaagctacacctttctctgtccaaaatcttgcaactaatttgaaggactcgaccctcttcggtgttccacttttggataaccgtaaacttgatatcacttcatctgtgttgaaaagcaagatggaattcacccgaacaaaagttttcaaagcccaagctgtagccaccacaagtgctccagcagtgaccagtgcggcaccagagagtaagaaaacattacgaaaaggtagtgtcattataacgggagcttcctctggtttaggtctagccacagcaaaagctttagcagaaaccggaaaatggcacgtgatcatggcatgtagagactttctaaaagcagaaagagcagcaaaatcagcagggatatcaaaagaaaactacacagtgatgcatttagaccttgcctcattagatagtgttcgccaattcgttgctaatttcaagcaatcgggtcgtccactagacgtattagtatgcaatgcagcggtctatcaaccaacagctaaagaaccaaccttcacagcagatggaatcgagctaagtgttggtactaatcatcttggtcacttcttactttcaagattgttgcttgatgacatgaaacagtccgattacccttcaaaaagactcataattgttggctcgattactgggaacaccaacactttggcaggaaatgtgcctccaaaggctaatctgggtgacatgaggggtttggctggtggtttgaacggactaaatagctcaaccatgattgacggaggtgactttgatggtgcgaaagcatataaagatagtaagatttgtaatatgcttacaatgcaagaatttcacagaaggtaccatgaagaaactggtatcacatttgcttcattataccccggttgtattgctaccacggggttgtttagagaacatattccactattccgaatgttgtttcctccatttcagaaatttattacaaaagggtttgtttccgaagatgaatctggcaaaagacttgctcaggttgtgagtgatccaagcttgacgaagtcgggtgtgtactggagctggaacaaggattctgcttcgtttgagaaccagttgtcggaagaagcaagtgatttgagcaaggctcgtaaggtgtgggagataagcgagaagcttgttgggttggcttaaattcacaatatatggatgaaagaaggatggaagctaggtttggttgcaagtgatcacgcgagtgtagaatttggtgcaatttgtttaacaattatgtgatgtaaatttagtttagttacaataaggaaatcactaagctacttttgtgtgaaaaaatatgaaaaatcacgtcatagatgatgaaaatgttcaaatatat

SEQ ID NO: 10966 - DNA, 1261 bp, Chrysanthemum coronarium
aaataaattccttccaaacaccctattcaaactccagttagcaatggctctccaagctacacctttctctgtccaaaatcttgcaactaatttgaaggactcgaccctcttcggtgttccacttttggataaccgtaaacttgatatcacttcatctgtgttgaaaagcaagatggaattcacccgaacaaaagttttcaaagcccaagctgtagccaccacaagtgctccagcagtgaccagtgcggcaccagagagtaagaaaacattacgaaaaggtagtgtcattataacgggagcttcctctggtttaggtctagccacagcaaaagctttagcagaaaccggaaaatggcacgtgatcatggcatgtagagactttctaaaagcagaaagagcagcaaaatcagcagggatatcaaaagaaaactacacagtgatgcatttagaccttgcctcattagatagtgttcgtcaattcgttgctaatttcaagcaatcgggtcgcccactagatgtattagtatgcaatgcagcagtctatcaaccaacagctaaagaaccaaccttcacagcagatggaatcgagctaagtgttggtactaatcatcttggccacttcttactttcaagattgttgcttgatgacatgaaacagtctgattacccttcaaaaagactcataatcgttggctcgattactggaaacaccaacactttagcaggaaatgtgcctccaaaggctaatttgggtgatatgaggggtttagccggtggtttgaacgggttaaatagctcaactatgattgacgggggtgcttttgatggtgcgaaagcgtataaagatagtaagatttgtaatatgcttacaatgcaagaatttcacagaaggtaccatgaagaaactggaatcacgtttgcttcgttataccccggctgtattgctaccacggggttgtttagagaacatattccacttttccgaatgttgtttcctccatttcagaaatttattacaaaagggtttgtttccgaagatgaatctggcaaaagacttgctcaggttgtgagtgatccaagcttgacgaagtcgggtgtgtactggagctggaacaaggattctgcttcgtttgagaaccagttgtcggaagaagcaagtgatttgagcaaggctcgtaaggtgtgggagataagtgagaagcttgtcggtttagcttaaattcgcatatattgatgaaggatggaaggtttggttgcaact

SEQ ID NO: 10967 - DNA, 1505 bp, Flaveria ramosissima
ccaacacatttgtgtagtatcgaccacaataggttgtacattctgcttaaatactagtacttttgcttatccccatggctcttcaagcttctcttcttccttctgcaatctccgtccacaaagaggggaaattgaattcttctttcaaagagagttcaatcagtggagctttcgtttcaaaaagtgtcaaatctgattttagccctcttttgatcggaacgaaggagcttaaaaggaagtcattattgggaccgattcgcgcacagacagcaactgtagcgccatctgtaaacgaagctgcacccgatggaaagaagacactgaggaaggggaatgtgatcattacaggagcctcatctggtctaggtctagccactgcgaaggcgttggccgacacaggaaaatggcacataatcatggcttgtagaaactttctgaaagccgaaaaggctgctaaatcagtaggcattactaaagagaactacactgttatgcaccttgatctttcttctctcgaaagtgttcgccagtttgtggacacgtttaggcggtctggtcgaccccttgatgcccttgtgtgcaatgcagcggtctatttgcctacggctaaagagcccacttacactgcagaaggatttgagcttagtgttgggactaaccatcttggccactttctcctctcaaggctgctgctagatgaccttaagaagtcggattacccgcaaaaacgactcatcattgttggctctataacaggaaacacgaacacgttggctggaaacgtgccaccaaaggctaacttgggggacctgagagggttagccggggggttgaacgggctaaacagttcagccatgatcgacggaggagatttcgatggtgctaaagcctacaaagacagcaaagtatgcaatatgctcacaatgcaagagttccacaggcggtaccatgaagaatctggaataaccttctcatccctctaccccggttgtatcgcaacaacgggtctttttagggaacatgttccgttgtttcgaattctgttcccaccattccagaagtacatcacgaaaggttacgtgtcagaagaggaagcgggaaaacgactagctcaggtagtaagcgactcgagcctcgcgaagtcaggtgtgtactggagctggaacaacaagtctgcttcatttgaaaaccagctttctcaagaagccagtgatgctgagaaagctaggaagctgtgggaggtcagtgaaaagcttgttggtttggcttagtcaaagtcaaaagtcaaagtcaagtgtaagtttagtgaaagccaaaatcaagaatagtcaaactgagtggtatggatgtgtttgttgtgttgtacagtacaatatacaatgcatcttgacatttcaatcggttatgttagttgttgtggcatgatcaatttccaaggtaatatatgagatcaaacaagatgcacaaatacgtaattgaaacatagaaatagtgatgttattact

SEQ ID NO: 10968 - DNA, 1386 bp, Flaveria ramosissima
atcgaccacaataggttgtacattctgcttaaatactagtacttttgcttatccccatggctcttcaagcttctcttcttccttctgcaatctccgtccacaaagaggggaaattgaattcttctttcaaagagagttcaatcagtggagcttacgtttcaaaaagtgtcaaatctgattttagccctcttttgatcggaacgaaggagcttaaaaggaagtcattattgggaccgattcgagcacagacagcaactgtagcgccatctgtaaacgaagctgcacccgatggaaagaagacactgaggaaggggaatgtgatcattacaggagcctcatctggtctaggtctagccactgcgaaggcattggccgacacaggaaaatggcacataatcatggcttgtagaaactttctgaaagccgaaaaggctgctaaatcagtaggcattactaaagagaactacactgttatgcaccttgatctttcttctctcgaaagtgttcgccagtttgtggacacgtttaggcggtctggtcgaccccttgatgcccttgtgtgcaatgcagcggtctatttgcctacggctaaagagcccacttacactgcagaaggatttgagcttagtgttgggactaaccatcttggccactttctcctctcaaggctgctgctagatgaccttaagaagtcagattacccgcaaaaacgactcatcattgttggctctataacaggaaacacgaacacgttggctggaaacgtgccaccaaaggctaacttgggggacctgagagggttagccggggggttgaacgggctaaacagttcagccatgatcgacggaggagacttcgatggtgctaaagcctacaaagacagcaaagtatgcaatatgctcacaatgcaggagttccacaggcggtaccatgaagaatcaggaataaccttctcatccctctaccccggttgtatcgcaacaacgggtctttttagggaacatgttccgttgtttcgaattctgttcccgccattccagaagtacatcacgaaaggttacgtgtcagaagaggaagcgggaaaacgactagctcaggtagtaagcgactcgagcctcgcgaagtcaggtgtgtactggagctggaacaacaagtctgcttcatttgaaaaccagctttctcaagaagccagtgatgctgagaaagctaggaagctatgggaggtcagtgaaaagcttgttggtttggcttagtcaaagtcaaaagtcaaagtcaagagtaagtttagtgaaagtcaaaatcaagaatagtcaaactgagtgttatggatgtgtttgttgtgttgtacagtacaatataacaatgcattcttgaattttcaatctg

SEQ ID NO: 10969 - DNA, 1342 bp, Triphysaria pusilla
attagtgccataaatatctattaatatctctctaccaacaattagattatacccaagaaatcttgaaatggcattacaagctgctgctctgcttccctctgcatttcccattaacaaagagggaaaatccagtgcagctttaaaagattctgccctttttggagtatcactttcagactatgtcaaagctgactttacctcttctgcattgataaccaagagacaattcagacctcaagcagtggccacctctccaaattccactccagccacctcacaagccaagaaaactctccgaaaaggcactgtcatcatcaccggagcctcgtcgggcctaggcctggccactgccaaagctctgtccgatagcggcaaatggcacatcatcatggcctgccgagactttctcaaggccgaaaaagcggccaagtctgtagggatggccaaggataactacaccgtcatgcatttggacctttcgtcactcgagagcgtccggcagttcgtcgataacttcaaacgggccgggcgggccctcgacgttctggtttgcaatgcggctgtctatcagccaaccgctaaggagccctcgtttacggctgatgggttcgagcttagcgttgggactaatcatttgggtcactttcttctttcgagattgctgcttgatgacatgaaggagtccgatttcccttcgaagaggcttattatcgtcgggtcaattacggggaacacaaacacgttggccggaaacataccaccaaaggccaacctcggggacttgcgcgggctccaggccgggctgaacgggccaagcagttctcccatgatcgacggtggggattttgacggggccaaggcgtacaaggacagcaaggtctgcaacatgctgacgatgcaggaatttcacagacgttatcacgaggaaacgggcatcacattcgcgtccctttatccgggctgcattgccacaaccgggcttttcagggagcacatccccttgttcaggctcctattcccgccattccagaagttcatcactaagggatatgtatcagaggaagaagctggaaaaagacttgctcaggttgtgagtgatccaagcttgacaaagtcaggtgtttactggagctggaataagaactcagcttcatttgtgaaccagttgtctgaagaagcaagtgatgctgataaagccaagaaagtgtgggaagttagtgagaaactttgtggtttaaaggattgattcattaaagctttgtcacagttttggattgaggaactatttagactctagtttcattataaatcaagatttagtttaagattcttggttaggatc

SEQ ID NO: 10970 - DNA, 1333 bp, Flaveria ramosissima
tccaacaatctttattagatattcacaccaacccacttcagtttcaacctccaatggctctccaagctacctcatctttcaccattcacaaagaggtgtctttgaaggattgtagtctgtttggagcaccattagcaactaatctcaaagttgatttcacaagcaggagggaattcaaccaaaggggtgcattgaaaaccaaagctgttgccacctcatctccggctgcaacccgtgcatcaaccgatggaaagaaaacattgagaaagggtactgtgatcatcactggagcttcatcaggattgggtctagcaactgcaaaatctcttgcagaaacagggaaatggcacgtgattatggcgtgcagggactttttgaaagccgaaagggcggcaaagtcatcggggatgtcgaaagagaattatacagtgatgcatttggacctttcgtctttggatagtgtgaggcagtttgttgggaattttaggcaatctggaagaccagttgatgtgctggtgtgcaatgcagcggtttatttaccgaccgcgaatgaaccaacgtatacggctgatgggttcgagcttagtgtcggcacgaatcatcttgggcatttcttgcttgcaaggttgttgcttgatgacatgaagcagtcggattatccgtcgaaaagactcataattgttggctcgatcacaggtaacacaaacactttggctggcaatgtaccaccaaaggctaaccttggtgacatgaggggtctagccggcgggttaaacgggctaaacagctcagccatgattgacggtggagatttcgacggtgcaaaagcatataaagacagtaaagtctgcaacatgcttatgatgcaagaatttcatcgtcgttttcatgaagaaaccggcattacgtttgcttcattgtaccctggttgcattgcaacaactggtttatttagggaacatattcctcttttcagactcctttttcctccattccaaaagtacataactaaagggtatgtttctgaggatgaatctggcaagagacttgctcaggttgtgagcgatccgagtttgaccaaatcgggagtttactggagctggaacaacaattcggcttcgtttgagaaccagttgtcggaagaagctagtgacgtctccaaggctcgaaaagtatgggatatcagcgagaaattagtcgggttagcttaaacaacaattctttcttctttgagtgtggttgatttgggttaaaatgtgagtgtaggacatgtttgcaggcagttttctgtggtatatttaggccaatttcaataagaatcaataataattat

SEQ ID NO: 10971 - DNA, 1459 bp, Flaveria ramosissima
atctttattagatttttacaccaacccacttcagtttcaacctccaatggcgctccaagctacctcatctttctccattcacaaagaggtgtctttgaaggattgtagtctgtttggagctccattatcaactcatctcaaagttgatttcacaagcaggaaggaattcaaccaaaggggtgcattgaaaaccaaagctgtagccaccacatctccggctgcaacccgtgcatcaaccgatgggaagaaaacattgagaaagggtactgtgatcatcaccggggcttcatcaggattgggtctagcaacagcaaaatctcttgcagaaacagggaaatggcacgtgattatggcgtgcagggactttttgaaagccgaaagggcggctaagtcatcggggatatcgaaagagaattacacagtgatgcatttggacctttcgtcgttggatagtgtgaggcagtttgttgggaactttaggcaatcgggtcgaccgcttgatgtgttggtgtgcaatgcagcggtttatttgccgaccgcgaaagaaccaacgtatacggctgatgggtttgagcttagtgtcgggacgaatcatcttgggcatttcttgcttgcaaggttgctgcttgatgacatgaagcagtcggattatccctcgaaaagactcataattgttggctcaatcacagggaacacaaacactttggctggcaatgtaccaccaaaggctaaccttggtgacatgaggggtctagccggcgggttaaacgggctcaacagctcagccatgattgacggtggagactttgacggtgccaaagcatataaagacagtaaagtctgcaacatgcttatgatgcaagaatttcaccgtcgtttccatgaagaaacgggcattgcatttgcttcattgtaccctggttgcattgcaacaactggtttatttagggaacatattcctttgttcagactccttttccctccattccaaaagtacatcactaaggggtatgtttctgaggatgaatctggcaagagacttgctcaggttgtaagcgatccgagtttgacgaaatcaggagtttactggagctggaacaacaattcagcttcatttgagaaccaattgtcggaagaagctagtgacgtctccaaggctcagaaaatatgggagataagcgagaaattagtcgggttggcttaaacaactaatctttcttctttaagtttggttaatttgggttaaatgtcagtgtgagtgtaggacatgtttgcaggcagttttctgatgtatatttaggtccattttaataagaatcaataataataataataataaaagctccatttatgttaaggaaaaaaaaaaaaaaaaaataaaagtactatgtgtatacctacctagtctacttagtagactacccgaacgacgacaacagggaaggtagtagcccccccc

SEQ ID NO: 10972 - DNA, 1331 bp, Centaurea maculosa
ttgtacattccgcttaaaatcagtacgtttctagcagcaggaatccatggctcttcgagcagcttctcttcttccatctgcaatttccgttcacaaggaggggaagctgaattcttctcaaaatggagcttttctctccaaaaatgtcaaatctgatttcagtcctcttctaattggaacaaaggagcttagaaggaagtcatcgttggcgcccattcgtgctcaaacagcaaccgtggctccatccatcaacgaagccacacaagacggcaagaaaacgctcaggaagggcaacgtgataatcacaggagcctcatccggtctcggtctagccacagcaaaggctttggccgataccagcgaatggcacgtgatcatggcttgtaggaacttcctgaaagccgaaaaggccgctaaatccgtcggcattgctaaggaaaactacaccgttatgcaccttgacctttcttcgctcgaaagcgttcgccaatttgtggacacctttaagcgttccggtcgaccccttgacgcacttgtgtgcaatgcggccatctacttgcctacggctaaagaacccacttacactgccgaaggattcgaacttagtgtcgggactaaccatcttggccactttctcctctcgagattgttgctagatgacctcaagaaatcagattacccgcaaaagcgactcatcatcgttggctccataacagggaacacgaatactttggctggaaatgtgccaccaaaggcgaacttgggggatcttagagggttagccgggggcttaaacgggctaaacagttcagctatgatcgatgggggagaattcgatggtgcaaaggcctataaagatagcaaagtgtgcaatatgctaacaatgcaagagtttcacagacgataccatgaagaaagtggagttaccttttcgtctttgtaccctggttgtattgctacaaccggtttattcagggaacacatcccgttgtttcgacttctattccctccgttccaaaagtacatcacgaagggctacgtttcagaagaggaagccggaaaacgactagcccaggtagtaagcgattcaagcctaacgaaatcgggtgtgtactggagctggaacaagaactctgcttccttcgaaaaccagctctcccaagaagccagcgatgcagagaaagctcggaagctgtgggaggtcagcgagaaactggtcggtttggcttagaatcaacacattatgaaaaccatagtcaataatagttttcatttcatgctatgaatgtgtttgttgtgttgtacagtacaatataatgatgcatttttga

SEQ ID NO: 10973 - DNA, 1337 bp, Flaveria ramosissima
caatctttattagatattcacaccaacccacttcagtttcaacctccaatggctctccaagctacctcatctttcaccattcacaaagaggtgtctttgaaggattgtagtctgtttggagcaccattatcaactaatctcaaagtagatttcacaagcaggagggaattcaaccaaaggggtgcattgaaaaccaaagctgtagccaccacatctccaggtgcaacccgtgcatcaaccgatggaaagaaacattgagaaagggtactgtgatcatcactggagcatcatctggattgggtctagcaactgcaaaatctcttgcagaaacagggaaatggcacgtgattatggcgtgcagggactttttgaaagccgaaagggcggcaaagtcatcggggatgtcgaaagagaattactcagtgatgcatttggacctttcgtctttggatagtgtgaggcagtttgttgggaactttaggcaatctggaagaccagttgatgtgctggtgtgcaatgcagcggtttatttaccgactgcgaaagaaccgacgtatacggctgatggtttcgagcttagtgtcggcacgaatcatcttgggcatttcttgcttgcaaggttgttgcttgatgacataaagcagtcggattatccgtcgaaaagactcataattgttggctcaatcacaggtaacacaaacactttggctggcaatgtaccaccaaaggctaaccttggtgacatgaggggtctagccggcgggttaaacgggctaaacagctcagccatgattgacggtggagatttcgacggtgcaaaagcatataaagacagtaaagtttgcaacatgcttatgatgcaagaatttcaccgtcgttttcatgaagaaaccggcattacgtttgcttcattgtaccctggttgcattgcaacaactggtttatttagggaacatattcctcttttcagactcctttttcctccattccaaaagtacataactaaagggtatgtttctgaggatgaatctggcaagagacttgctcaggttgtgagcgatccgagtttgaaccaaagtcggtagtttactggagctggaacaacaattcggcttcgttgagaaccagttgtcggaagaagctagtgacgtctccaaggctcgaaaagtatgggagataagcgagaaattagtcgggttagcttaaacaacaaatctttcttctttgagtgtggttggtttgggttaaaatgtgagtgtaggacatgtttgcaggcagttttctgttgtatatttaggccacttcaataagaatcaataataattatcataagctct

SEQ ID NO: 10974 - DNA, 1375 bp, Fraxinus spp
ggatattagatttgtatcaaagaaacatcaaatactaacaaattgaaaatccatggctctacaggctgctgccattctcccctctgcatttgccattcacaaagaggaaaaaaatagtgcatctttgaaggactctagcctctttggagtttcaatctcagaccgtatcaaggctgacaagagagaattcgggttgaggaagttctcagtcggggctatcagagctgaggcagtggctacctctccagttttcacccctgcaacagttccagggaagaaaacactaagaaagggcactgtggtgatcaccggagcctcctccggtttaggcctggcaacggcaaaagctctggctgaaaccggaaaatggcacgtaattctggcctgcagggacttcctcaaggctgagagggcagcaaagtccgttggaatgtctaaggaaagttacaccattatgcatttagaccttgcttccctcgacagtgtgaggcagtttgtcgaaaatttcaagcaatctggccggccccttgacgtcttggtttgcaatgctgctgtctatcagccaactgcaagggagccttcattcacagctgatgggtttgagctcagtgttgggactaaccatctaggccatttccttctttcaagattgttgcttgatgacatgaagcagtctgattatccatcgaagagactcataattgtcggctcaattacagggaatacaaatacactggctggaaatgtacctccaaaggcgaaccttgggatttgagggcctccaaggggggttgaatggattaaacacctcgtccatgattgacggtggagatttcgatggagcaaaggcatacaaggatagcaaggtgtgcaatatgctcacgatgcaagagtttcaccgtcgttacaacgaggaaactggcatcgcatttgcttccctttaccctggttgcattgcaacaacaggcctgtttagggagcacatccccttgtttaggctccttttccctccatttcaaaagttcatcaccaaggggttcgtctcagaggaagaagccggaaagagacttgcacaggttgtaagtgatccaagtttaacaaagtcaggagtctactggagttggaacaaggattcggcttcattcgagaaccagttgtctcaagaagccagtaatgccgataaagctcgtaaagtatgggaaatcagtgagaaactagttggtttggcttgaagggtaatcctcagtcactttgttcactaatatttggggccaaagacgaagattttggattgaacgcttgtagttgtaaggaaaaataaacgaaaattcaacttgtaacattaaagttagaatcaaaatcacttacaattacc

SEQ ID NO: 10975 - DNA, 5520 bp, Zea mays
ccgaaaaccaaaagaagtttatctacacacataaaagcgttttggagaacatgcagaatgtcattttgcgccggattgcacgtgctggtaattcatgtgtgttcgttgcgtagcaattccgatccggccttgatcttctctctccctcctgcctgttccctctaggctctagcaaaagggagaggcgaaccagctcagagccggcgaccgccaccccacaccgcatctcccgactcccgctgctgtagtgctgtgcactagccaagccagcttgcatattccttctcccccacgctttcccgtgcttccattccaccaccagggccgcggaacgccccgccccgcccggcccccgcgcctcccctttccacctgttcgtcgcgtgcgcattcgttcgcgcagccagccagccagccaccaccggcccccaccatcgatcgatatcctcctcctgtctctcttgctgctagctctcgcagttccgtccgatcgactatactgatccagctcctgctatgcgcggcggctagctcctcgacgacgagctgatcaatccgacaatccgagtccgccggcgcggatcgtcgatcgatcggccaccagaccatggggactccggtgaacatcatcgtcggctcgcacgtgtggctggaggaccccggcgaggcgtgggtcgacggcgtcgtcaccgagatcaaaggcggcgacgccaccatcgccaccaccaacggcaaaacggtcgtggcgagccttggcagcgtataccccaaggacacggaggcgccgccggcaggagtggacgacatgaccaagctagcctacctccacgagccgggcgtcctgcacaacctctcctgccggtacggcctcaacgagatatacacgtacaccgggaacatcttgatcgcggtgaaccccttccagaggctgccgcatctgtacgacgtgcacatgatggagcagtacaagggcgccagcttcggggagctcagccctcatctcttcgccatcgcggacgcctgctacaggcgagccaagcgatcctggtgagcggcgagagtggcgctggcaagacggagaccaccaagatgctcatgaggtacctcgcattcatgggaggacggtccggcaccgagggacgcaccgttgagcagcaggttctagagtctaacccggtacttgaagcatttggtaacgccaagacagtgaagaacaacaactcaagtcgattcggcaagttcgtggagatccagttcgacaagcatggcaagatatccggggctgccgttcgcacgtatctcctcgagcgatcgcgagtgtgtcaggtctccgatcctgagaggaactaccactgcttctacatgctctgctccgcgccccccgaggacgtgaagaggttcaaggtgggagacccaaggtcgttccattacctgaaccagacgaactgctatgaggtggccaacgtggacgacgcgagagagtacatagaaactagaaacgctatggatatcgttggcatcgatcaagaggaacaggacgcgatcttcagagtagtagcggcgatcctccacctaggaaacatcaacttttccaaagggcaggagatcgactcgtccaagctgagagacgataaatcggtccatcaccttaaaacagttgcggaactgctaatgtgtgacgagaaggccctcgaagactccctctgccagcgtgttattgttacgcctgatgggaacatcacgaagccccttgatccaggctctgcggcgttaagccgtgatgccttggcaaagacagtgtattcacgactgtttgactggatcgtagacaagatcaataactcgattggccaggatccagatgcgaccaatataataggcgtgcttgatatctatggatttgagagcttcaagatcaacagtttcgagcaattatgcatcaatttgacaaacgagaagctgcagcagcacttcaatcagcatgtgtttaagatggagcaagaagaatacacaagggaggaaatagactggagctatgttgaatttgtagacaatcaggatgtgctggacctgattgaaaagaaacctggaggaataattgcactcctggatgaggcatgcatgtttccaaagtctacacatgagacatttgctcaaaagatgtaccaaacgtataaggtccataagcgcttcagcaagcccaagctagctcggacagcctttacgatcaaccattatgcaggggatgtgacgtatcaagcggatcagttccttgataagaacaaagactatgtggtagccgaacaccaggccctactaaattcttcaaggtgcccttttgttgcaaacctcttccctccattacctgaggaaacctctaaacagtccaaattctcttcaattggtactcgctttaagcaacaactgcaatccctcatggaaacactgaatactacagaacctcactacatcagatgtgtcaagcctaatgctgtactcaaacccggcattttcgagaactacaacgtcttgaatcagttgagatgtgggggtgtcctggaagcaattcggatcagctgtgctggttatccaacgaagaggacatttgatgagttcattgatcggtttggaatgcttgcaccggagcttgtcgacagcgatgagaaggccgcctgtgcagcgatatgtgatagaatgggtttgaaaggatatcagatagggaaaactaaggtattcctaagagctggtcagatggcagagctggatgctcgaagagcagaaattttggctaatgctgcgcgactaatccaaaggcgtattaagacacatcttatgcgaaaggaattcatcaaattaagaaaagcctcagttcaatctcagaagttctggagagcacgactagctaaaaagatttttgagtatatgaggagagacgctgcttcaattaggatacaaaagcacgtgcgtgcgcattctgccagaaaagcgtacctgcaagtatatgaatcagctacagcaatacaaacaggattacgagcaatggcagctcgcaacgaacacagattccgaagagagaccagggcatccataattatccagactcggtggcgccaacacagagcttatactgcttacaaacagcaacagaaagcttctttgattctccaatgcttgtggagggcacgcattgcaagaaaggaacttcggaaactgagaatggaagcaagagagaccggcgcactgaaagaagcaaaagacaagctagaaaagagagtagaagaactcacatggcggttagacgtcgagaagcgtttgagggctgaccttgaagaagcaaagagccatgaaattgaaaagttgcaatctgcactacaaaaaatgcaagaaaatctcgaggaagcccatgcagcaatagtaaatgagaaagaggctgcaaagttagcgattgaacaggcaccaccaaagatagtagaagtgccggttattgacaatgcgaaacttgaggagttgacaactcaaaataaagaacttgaggatgaactaagtacgtttaaacagaaggctgaggatcttgaaaataagcttattgagttccaaaaacagtctgatgaactgtcacaagagacacaagaacaagcatccaaagttactgaacttcaagagctggtcgaaaggcttgaagcaagtttatccaatatggaatctgaaaaccaagttctacgacaacatactcatgtcctatgagaaagtctcataaactaaaaataataatacatttagcttggaaagcaagatcgccaccttggagtcagagatagagttgctccacagcaattctgcactagctattcaggccgtggttactcctgaaatgaatcagacaacagtaatcgaggaatttgacaagggacaccagcttgaagaagttaaaacggtcaatgtatttgctattatttttacctggcaaacatttatacagtttaagataagcttccacaggaaaaccacgacgccctgattaaaagtatggtagaagacaggagatttgacgacaaaaaatccgctgcagcatgcattgtctacaaatcactcctacactggcattcatttgaagcggagaagactaacatatttgatcgaatcatccaaataattaggtcatcagttgagggagcagaaagttctggagagctagcctattggttgtcgacaacatcaactctcctctacttgttacaaaacactctcaaagctagcagttcattaagtaaaggaacaaatcgcagccggaccacaacaggcagtctgttcagtagaatggtgcagagtgcccggacatcatcaggcttaggcatagctagtggatacagtggaatggtgggaaggcctgacactgatgcatcgatggtagaggcaaaatatccagcacttcggttcaagcaacacttgacagcatatgtcgagaagatatacgggataatcagagataacctgaagaaggaaataagtccgttcttgacaatgtgcatacaggctccaagagctaaccgtgtgaggccatcacggggatcactaaaaagcatacactctaatgcactagctaggcaagcatcaagtctgcattggcaaaacattgtcaagtgcctggatcatacactggaaacgatgaaaaaaaactatgtagctccggtgataatcaggaaaacatttaaccaagtatttgcatacttgaatgtgcaactcttcaacagcttgctgcttcgtcgggaatgctgctcttttagcaatggggagttcttaaaggctggtttacaagacctggagcagtggtgctctaggacaactgaagagtatgtagggacgtcctgggatgaactgcaacacattaggcaggcagtcgggttcctggttttgcatcagaaatcacacaaaatcctggaggaaattacgaatgagatttgccctgttttgagcataactcaaatataccgcatagcaacgatgttctgggacgacaagtacggtgcacaaggcgtatctcaagaggtcattggaaggatgagaacgatgacaacggacgactcagtaactactccaaacagttcgttcttgctggacgacgactcaagcataccgatatcgttggatgacatagctcggctgatgcttcacatcgatccgtccgatgtggaaccgcccccgctactgaggcagaattctcagtttcactttcttctgcagcagcacacggactgatatcttctacagataaagagcagaatgaatggtacagttacttgtggagttacagggaactgaagattttttttaggagtgcacagattgagttgtgattttttttcccttccttttttttatggttttgggtgggaaatggctacaaagaaagggaaatatagggtatatcgtgatatcattcatttgattggtttgattgtttggaacagagagatttgtaattatttgaatatgtatataaattatagaagcatctgatcac

SEQ ID NO: 10976 - DNA, 1279 bp, Hordeum vulgare
tttaaatgttcaattgctgtgtgcatcagcttttatttaacctgttctgtgaattagcagcatacttttcatatggcttatcttttaacaattttagttactgatgctactgtctctagtcttctaagctaattagagctgtacttgcttgtagcaaaacatgggacatgttttagtgtctccttgacagatatagaaccttaacctcaactggcatgcacttaccatccaaactaattgctttttcctccatatttcagtaagttgcagagcgatgccctgagggaggctatcacaaacattaccaatgactgccgtgagaagaaccgcaagttcgttgaaaccattgagctgcagattggtctgaagaactatgacccgcaaaaggacaaacgtttcagtggctctgttaagcttcctcacatccctcgcccaaagatgagggtttgcatgcttggtgatgcccagcatgttgaagaggcagggaaaatgggccttgactgtatggatgtggaatcgctgaagaagatgaacaaaaacaagaagctagtcaagaagcttgcaaagaagtatcatgctttccttgcatctgaggctatcattaagcagattccccgacttcttggacctggtcttaacaaggcaggaaagtttccaactttggtgtctcaccaggagtcccttgagtccaaggttaatgagaccaaggccactgtcaagttccagttgaaaaaggtgctttgcatgggtgttgccgttggccacctgggtatggaggagaagcagatcttccagaacgtgcagatgagcgtgaacttccttgtctctctgttgaagaagaattggcaaaacgtgcggtgcctgtacctgaagagcacaatgggaaaggtgtaccggttgttctagactctagtcttctaggatttccaggagattgacaacttgggaacttttgttgctttctcaattatcaaattttcgtgcgcgtcgagtgacaattattgtcttgtactgagatggtttgttctattgtctggaacttcatgacattttatccgttgtccctgtgccttcctactgttctgctagctgtcaatcatcagcttaacgctagattcagcattggtccattgatatttacgactgtcagaatcttattttaccgtgtgtgttgggttggtggaatcttggtgtaaccgagctgccctgcgggtatccttggagtatcccggccatttctttggagtctgcactgacgagttttgtcttccgatctcgc

SEQ ID NO: 10977 - DNA, 1117 bp, Vaccinium corymbosum
actacaggtaaacccaacccagcccagaacacacgtatgagaaaagccccctctcacgtgtttagggttcgcgccgtcggaagttatttatctcccaacgaactgcgtagtgcgtggtctctcttagctcactcgtcggccattacaaaccctaatctagccatctagggttttctcctcagttagtaagttgaagcaagggaaatttttcagctatgagtaagcttcagagtgaagtcttgagggaagcaatcactcagattggcaatgatgtcaaggagaaaaaacgcaacttcactgaaaccattgagctccagattgggctgaaaaattatgatcctcagaaggataagcgtttcagtggttccgttaagttgcctcacattcctcgtcccaaaatgaaggtttgcatgcttggtgatgctcagcacgtggaagaggctgaaaagataggcttggagtatatggatgtggaagggctgaaaaaagcttaacaaaaacaagaaactggttaagaaacttgctaagaaataccatgccttcttagcttcagaagctgtcatcaagcagattccccgtctattaggacccggtctcaacaaagcagggaagtttcccacccttgtctctcaccaagagtccctcgagtctaaagtcaacgagactaaagccacagtgaagtttcaactgaagaaggttctctgcatgggggtagctgttggcaactgcagtatggaggataagcagatctttcaaaatgttcaaatgagcgtgaactttctagtttcgttgttgaagaagaactggcaaaatgttaggtgcttgtatctcaagagtaccatggggaagccaatccgcatcttctaaggaggcaattatttgagctgttctactgaggaattttgtttgatcaaattcaagaagttattcctgtatcgatctccagtttgtattcttcttttcttttttgttctccagtttggattcttcttgaataccatcaaaactttgtaatgctttgtttttctagtatattttttgatggcgaaaaatcttaaatcatctatttgtgacagttaaacatcttcacctttgatagttgaatggttgaactgca

SEQ ID NO: 10978 - DNA, 1008 bp, Panax ginseng
aggcagtcgcaaccctaatctagggtttcattccagtatcgaagtcactgaagtaggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcacgtggaagaggcagagaaaattggtttggaatacatggatgtggaaggcctgaaaagcttaacaagaacaagaaattagttaagaaactcgcaaagaaataccatgctttcttagcttctgaagccgtcattaagcagattccccgtcttttgggcccagggctcaacaaagcaggcaagtttcctacacttgttactcaccaggagtcccttgagtctaaagttaatgagaccaaggccacagtaaaatttcaactgaagaaggtactctgcatgggagttgctgtggggaacttgagtatggaggagaaacaaatttttcaaaatgtgcagatgagcgtgaatttcctagtttcattgttgaagaagaactggcaaaatgtcagatgcttgtacctgaagagcacaatggggaagacagtccgcgtcttttagggagtttcctgcttatggttaggcagtgtatgagagtatttttctgaatatttccttgtaatggacaaattttattttccagctgtttatcttgatgctattaagaatattatgaattcaaatatggattattgtgactttttgtttggagagagaatcaatggttatgcacttctgcttgttaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaa

SEQ ID NO: 10979 - DNA, 1125 bp, Olea europaea
atcttcaccattcgacgccccaacgccactgtcactcgttgccgtcttccaaaccctaaatagaagtgaaacgggaagagaaaaagatctccggccatgagtaagcttcagagtgaggcccttcgagaagctatctcagtaattactactgataccaaggagaagaatcgtaactttgttgagacaattgagctccagattgggctcaaaaactatgatccacagaaggataaacgttttagtgggtcagtgaagttgccccacattcctcgccccaagatgaagatttgcatgcttggggatgctcagcatgttgaggaggcagagaaaattggtctggaatccatggacgtagaggctttaaaaaattgaacaaaaacaagaaactggttaagaagcttgctaaaagatatcatgctttcctagcctccgaagctgttataaagcagattccccgtctcttaggacctggtcttaacaaggcaggcaagttcccgactcttgtttctcaccaggaatctcttgaatcaaaggtcaacgaaaccaaggccacagtgaaattccaattgaagaaggtgctttgcatgggagttgctgtaggaaactgcgctatggaggagaagcagatttttcagaatgtgcaaatgagtgtcaactttctagtttcacttttgaagaaaaactggcagaatgtgaggtgcttgtacctaaaaagtacaatggggaagcctcagcgcatcttttaaggagattatgttttgttttctgttcaaccgattttagagatagttttggagctaaagcaatggagtttcccctgtaatagcaagtttttatttatctttggtcttgatggtgcgttcagacatcatatttattgttttattttgttatttttctactgcgatgggattgatttttgcttgctgtaccgacgtttctataatgaatagccagtttatcattgctgggttgaagcttactattattaatcaactgttgctgtttgaaacaattttttccttcaaaaccatgcttagaaatttgtacttgcaatttctattgagtcctgatcattcgtcatttttgcgtcataattcgaaattcagtcgttgattgaatgcg

SEQ ID NO: 10980 - DNA, 811 bp, Spinacia oleracea
ggttcacaaactttgctccttttgaactttaatcatgagtaagcttcaaagtgaagctgtgagagaagctatatctgggattgcaaatgattgaaaggaaaagaatcgcaagtttaccgagactattgaactccagattgggctgaagaattatgacccacaaaaggacaagcgtttcagtggctctgttaaattgccacacatccctcgtcccaagatgaaagtttgcatgcttggagatgcacaacacgtcgaagaggctgagagaataggtttgcaatggatggacgtagaagcgttgaagaaactcaacaagaacaagaagctggttaaaaagcttgcaaagaagtaccatgctttccttgcatctgaagcagtcattaagcagattccgcgtttgctcggtcctggtcttaacaaggctggcaagttccctactcttgtcacccaccaagaacccttggagaacaaagtgaacgagattaaggcaactgtgaagttccagcttaagaaagttctctgcatgggagttgctgttggtaaccttagtatggaagagaagcagatattccaaaatgtgcaaatgagcgtcaactttctcgtctcattgctgaagaagaattggcaaaatgtccggtgcttatacctgaagagtaccatgggcaagccataccgcatcttctaaatcagtctatgtcactgtttttgatttaccggcctaggagagtttgcttatcgcctgttccttcattaaaaccttcgccttattgcctattactcagttacgttccaaaactgtatcagcttagtt

SEQ ID NO: 10981 - DNA, 2944 bp, Brassica oleracea
attcattattacgctctgctttataaaagtaaaaaaaatcattttttttttcttttttctcactttttcatttcctcccatttccacttttttttttctcatttaccccaaaagtaaccaattacacttatacagtcataatttcagaaaaaaaaagagaggaatcgagaggacggtgaattttctcatatatggatctccctactataaatatatgagatgttcagtttcaactaaaaccaattttaaacgctagaagcatatttccccaaggtatatataacagtaatgatgcttttagtgatcgttgccatccttgtctgccttgtaagctacgtttaccgatcattgaagcctccaccaccgcgaatctgcggggttcctcacggtcccccggttacttctccgagaatcaggctcagtgatggaagatatcttgcttatagagaatctggcgttgatagagccagtgctaactacaagatcatcgtcgttcatggatttaatagctccaaagacatggaatttcccatctctaaggatcttattgaagaacaagggatatactttctgtttttcgatagagcaggatatggagaaagtgatccacacccttcacgtacagtcaaaagcgaagcatacgatattcaagaactggccgataaactcaagatcggaccaaagttctacgttctcgggatatcactcggtgcttattcggtttatagctgccttaaatacattccccaccgactagctggagcagtcttagtggttccatttgtgagctattggtggactaaagtgcctcaggacatattgagtgaagcgttcaagctaatgccagaaaaagaccagtggacatatagagttgctcgttattttccttggctattgtattggtggttgacccaaaagttgtttccttctttgagtataatctccgagagaagtgcgttatgcagcgacagagatttggtcatcctaaaaaagaagttggagaatccgagtcctcgcttggaaaaagcaaggcaacaaggagaccatgaatgtcttcaccgggacatgatggctggatttgcgacatgggagttcgacccaactgaactggcaaatccgttcggggagggtgtaggatcagtccacatgtggcaaggggccgaagacaggattgttccgcgagaagttaaccaatatatatcaaagaagcttccatggataaagtatcacgaactctcaggctatggacatcttctacacgccgaggagcagaaatgtgaagacattataaaggcgcttcttgtcgagagatgatatctacacaaagatgtcttaacgttattcactaacgttgaaggtttcatttaaaatatggattactatggggggattttatcggatgagtaagaaatatagaccaaaacaaaatattgttgaaatagaaatttactaaatccatctagtaagttaaaataactcagttaaaatataaattatataaatgaggttcctatggatctcttttatgtttggataaaggatatttgacaagaattggtcacaagtaagttgtatatttgtagattgtgtctgcattgaggcaaataattctttcatgtattcatagctccctttggaagaacatttacctgggaaaagcttagctaattgtaaactgacgtttgaagctttgcatagttcagagtttgagacaaaaaaaaaaagaaacggataagagttagatagaacttttgttttgtattttgggcttggaagtatataatagccagcaaacacccaattgttggatattttaaatatgggcctatatcatattgggcttttaattagttgaaacagaatgggcttagggtttcgttccccttctgtcttgctcatatatcatataaagttgcacaaaccttctttcgctgtttccgatcttccacaggtggaacagtatctgagaaactccccaaaatgagtaagctccagagcgaagccgtgagagaggcgatatcctcaatgatcacccactgcaaggagacaaagccacgcaagttcactgagaccatcgaactccagattggtcttaagaactatgacccacaaaaggacaagcggtttagcggatccgttaagttgcctcacattccaaggcccaagatgaagatctgcatgctcggtgacgcccagcacgttgaagaggctgagaagattggattggactctatggatgttgaagctcttaagaagttgaacaagaacaagaaacttgttaagaagctagccaagaagtttcatgctttccttgcttctgagtctgtcattaagcagattcctcgtcttcttggtcctggtctcaacaaggcaggaaagttccctacacttgttagccacctagagtctttggaggccaaggtgaatgagactaaggcaacagtcaagttccagctcaagaaggttctctgcatgggtgtcgctgttgggaatctcggcatggaggagaagcagatctttcagaatgttcagatgagcgttaacttccttgtttcactcttgaagaaaaactggcaaaacgtgaggtgtttgtacttgaagagtacaatgggtccaccaaaccgtgttttctaagatgtttttatctcaaagtttctctcaaggtgtcatcagactcggaggacagttgatgagccttcttcttggattacttcctgaatctttactttgtaggatcaagcttttgtttcaagacaattttgtttctgttattattagtgggattttctctattttgagttttcaagatttgcgatttcgtgacaaacacattgtttagactttaaagcttagtcttggactcttggatgaatttgaccaatcaaatggtccgtcttttctttacttaacattccttgaatcaaccaaactagattcttagtca

SEQ ID NO: 10982 - DNA, 833 bp, Panax ginseng
aagcagtggtatcaacgcagagtacatggggaggcagtcgcaactcgcaaccctaatctagggtttcattccagtatcgaagtcactgaagtcggaagaaagtttcaagcatgagtaaacttcagagtgaagccctgagagaagctatctctcagattactaatgagtccaaagagaaaaagcgtaattttacggagaccattgaactccagattggtctgaagaactatgatccccagaaggataagcgtttcagtggttctgtaaagttgcctcacatccctcgtcctaagatgaaggtttgcatgcttggtgatgctcagcacgtggaagaggcagagaaaattggtttggaatacatggatgtggaaggcctgaagaagcttaacagacaagaaattagttagaaactcgcaaagaaataccatgctttcttagcttctgaagccgtcattaagcagattccccgtcttttgggcccagggctcaacaaagcaggcaagtttcctacacttgttactcaccaggagtcccttgagtctaaagttaatgagaccaaggccacagtaaaatttcaactgaagaaggtgctctgcatgggagttgctgttgggaatctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttgtcttctttttggttgaagctttttagcaaagtcagtgtatgagataatattttcccaaaaattcccta

SEQ ID NO: 10983 - DNA, 1319 bp, Zea mays
tattgtttctttgggagccgggtccaactgttagttcattctcataatgaaaatggatgtgagatagattcaggttcttgtctcgacacatgagatggattcacgtagcttgcttattattattgattattctactgttttgccttctgcaattcttcctgttggcaagagtactttgaattctagagtattgttcccatccagatagattatccctgcctaataaattctgcccattgattattgcagtaagttgcagtctgaggttctcaaggatgccatctcccagatagttcaggatgccaagaagaataggaagttcactgagactgttgagcttcagattagtctgaagaattatgatccacaaaaggacaagcgtttcagtggctctatgaagttgcctcacatccctcatccaaagatgaaggtgtgcatgcttggtgatgcccagcacgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccagatgagcgtcaacttccttgtttcccttctgaagaagaactggcagaatgtgagatgcctctacatcaagagcaccatggggaaaccatgcagggtgttctaagtctgcttttttgtgaagtctgctcttcatgatatttggtttttgaaccgaggttgtcttgaactaaaactcttgttagatcatatttggttggcaggatatttgagtccgggcaggtgttttccccttgtctttgtaatctctctatataatgttttttgagaggctcagtataatacgtgtattatacgttataccaattatacgttatacccaatcgtttttgttactgtggaaccatgagtttacgccattgctgctgcgccctcggggtagcgcccctctatttatgggatagagccttgtaggaagttttggtcactaatctggttgctattactagactaaagaatgtagacatgcatcgggtttaaaaatccaagacactttggctaataaatgttagggtcgatctgttgtggacgcg

SEQ ID NO: 10984 - DNA, 928 bp, Allium cepa
tccagacacgaactatttgtgtatattggagttgggcaagctaacgaaaaaagagtaagttgcagagtgatgtttgcgagaagcaatcacccagatcaaaactggtgcaacagagaagaaaaggaattttactgaaacatagagctgcaaattgggcttaagaattacgaccctcaaaaggacaagcgtttcagtggttcagtgaagttgccacacattcctcgacccaaaatgaaggtttgcatgcttggtgatgctcaacattgtgaggaggcggagaaaatggaccttccattcatggatgttgagagtttgaagaagttcaataagaacaaaaagttagtgaagaagatggcaaagaaataccatgttttccttgcatccgaagccgtcattaagcagattccacgtcttcttggaccaggtctcaacaaggcaggcaagtttcccactctagtcagtcaccaggaatccttggaagccaaagtgaacgagaccaaagcaatggttaagtttcagttgaagaaggtactttgcatgggtgttgctgttggtaactgtggtatggacgaaaaacagatctttcaaaatgtgcaactcagcgtcaactttcttgtttctctgctgaagaagaattggcagaatgttaggtgcttgtatctgaagagcaccatgggaaggccagttagaattttttaagctttgcaatgcaacattggatttacaagatctttatttggccttattgcttattttttgaactttgttgcgtccttttgcaaatggtattatgaatgcgagttggttttgaagcagaattgatgttagaactatttttgtttctggttttgatgtaaaaataccatccgtatgctgttattttatgttgaatttactgttgcttgttttgcatgtaatggatctttga

SEQ ID NO: 10985 - DNA, 1016 bp, Rosmarinus officinalis
agtcattccagccaccgtctcactaccccgggcgtagcgtttttcttcagtgattcgggaagctaatcgaccgtgaacgatgagtaagcttcagagtgaggcgctgagggaggccatcactgttattgtttcagatgcgaaggagaagaagcgcaacttcacagagactgttgagctccagataggactcaagaactatgacccccaaaaggacaagcgtttcagcggctctgtgaggttgccacatattcccagacccaaaatgaaaatctgcatgcttggagatgcccagcatgttgaggaggcagagaagattggccttgagtccatggatgtggcagctctgaaaaagttgagtaaaaacaagaaattggtaaagaagctagcgaagaggtgccatgctttcttggcctctgaagcagttgttaagcagattccgcgtctcttgggtcctggtcttaactaggcaggtaagttccctactcttgtgactcgccaggagtcgcttgaagccaaggtgaacgagacaaaggccaccattaagttccaattgaagaaggtcctctgcatgggtgttgctgtgggtaaccttgacatggaggagaagcagatcttccaaaatgtgcaaatgagtgtcaacttcctcgtttcccttttgaaaaagaattggcaaaatgtgaggtgcttgttcttgaagagcaccatgggaaagccacaacgcatcttctgaaaagtttataaacttattaaagtcgtagaatgacaaaagttgtgagggagcataaactattctaaatttcccagaaatgggaattttttggttctctttttcttgacgttgacctcggatttattatggatactcttttttatttcattatctccagattattgcccataatatgtacttttggtttattagtttcatcgtttgcataattagcagttacatctatctatttctgtacactattttgctacagatctttttcaacaagtattttaaattaaaaatt

SEQ ID NO: 10986 - DNA, 1140 bp, Avena sativa
ctcccttcgaccgccgccgcaccatcgacgaaatccgtcgtcgactgaccggcggcaaccatgagtaagctttcaagtgaggcggtcaaggatgccatcacccagattgttgggggaggccagagaaaagaagcgcaagttcactgagactgttgagcttcagattggtctcaagaactatgacccgcaaaaggacaagcgtttcagtggctctgttaagctgccccatatcccccgcccgaagatgagggtgtgcatgcttggtgatgctcagcatgttgaccaggctgagaaattgggacttgactccatggatgtggagagtctcaaaaagatgaacaagaataagaagcttgtcaagaagctagccaagaagtaccatgctttcttagcatctgaagccatcatcaagcagatcccccgtctccttggtcctggtctcaacaaggcaggcaagttccccacactggtgagtcactccgagtctcttgaagccaaggtcaatgagactaaagctacagtcaagttccagctgaagaaggttctgtgcagtggggttgctgtgggtaacttgtcgatggatgagaagcagatccaacagaacctccaaatgagtcgttaacttccttgtcgtcccttctagaagaagaactggcagaatgtgaggtgcctagtacgtagaagagcgaccaagtggggaacgcgtggtccgggtgttctaagttgtcttgctcagtgaagttgataagatactctgtactgccaacctgagttcgtctttgtttagaatctgttcatgatgctaatttggtcatcaagcgaatagtcagcaaagcattcgggtctactggtatcttttggaacttgtgaagaatggaactcgtattctgtatgagtttacgaatgcgtacggttgtgccttctacgtgtcgtttggtttagttagacggttcgccgaagtactaagtttagtgtagtcctagtttacccttaaacacgtaccgttcgttaagaaaaagttcggtttagaacctaaggttaaaccttacggttaacgttactaaggtcggtaacgtttaccaacggttaaaccaggtaaccgtaaaacttggttaggttacgttaccggtaagttaaaac

SEQ ID NO: 10987 - DNA, 1479 bp, Zea mays
agaaaatagaaacgagcatgggccgactggagacgttccacgcacaacgcactgacgcacgcaggaactgaagcgggtacccgctaaccgggtacccgtatcctacccgtacttctcgggtatttgtcgggtagtggtcatcctgtatcctacccgtatccgactgatccgtatccgactgatgtatatctgggtagtatccgtatccgacccatatacaaaattactcgtatccggtacccgaaaaaccaggtattttaagtacccgtatccggtacccgccgggtaatctcgtcccgttttcacccctagattaagctggagtccgaggttctcaaggatgtcgtctcccagatagttcaggatgccaagaagaataggaagttcactgagactgttgagcttcagattagtctgaagaattatgatcaacaaaaggacaagagtttcagtggctctgttaagttgcctcgcatccctcgtccaaagatgaaggtgtgcatgcttggtgatgcccagcacgttgaggaggctaagaagatgggacttgactacatggatgttgaggccctaaagaaaatgaacaagaacaagaagcttgttaagaagcttgccaagaagtaccatgcttttttggcatcagagaccatcatcaagcaaattccccgtctccttggtcctggtctcaacaaggcaggcaagttccccactctggtcactcaccaggaatccctggaatccaaggtgaatgagacgaaggctacaatcaagtttcaactgaagaaagtcctttgcatgggtgtcgcggtcggtaacctgtctatggaggagaagcagatccaacagaacatccagatgagcgtcaacttcctcgtgtctcttctgaagaaaaactggcagaatgtaagatgcctctacatcaagagcaccatggggaaaccatgcagggtgttctaagtctgcttttttgtgaagtctgctcttcatgatatttggtttttgaaccgaggttgtcttgaactaaaactcttgttagatcatatttggttggcatgatatatttgagtccaggcagatgttctcccctttgtctttgtaatctctctatataatgttttttgagaggctcagtataatatgtgtattatacgttatacccaattgtttctgttaatgtggaaccatgagtttccgccattgctgctgcgccctcggggtagcgcccctctatttatgggatagagccttgtaggaagttttggtcactaatttggctgctattactagactaaagtatgtagacgtgcatcgggtttaaaaatccaagacattttggctgataaatgttagggccgatctgttgtggatgcggttctgttattagcctcgtgtttgcttgaaattgtctattttgcttaatagccatccatgctgtctattttaggaattctggattctgaagaacaagggagccctttg

SEQ ID NO: 10988 - DNA, 1076 bp, Theobroma cacao
cttccccctcattatcaggataaaaatataatttctaattataccctaaacattactattatacacaaaacaatttggaatttgattaacatgtatcgtaaaacgcggctagggtttctcacatctctggtaaatattatagttttattcgtggaaataacagagattccgggatgagtaagcttcagagtgatgcccttagagaagctatttccaccattgtggctcagtccaaggaaaaaaaccgtaagttcactgagaccattgaactccagattgggctgaaaaactatgatccccaaaaggacaagcgtttcagtggatctgtgaagctgccacacattcctcgccctaagatgaagatctgcatgcttggagatgctcaacatgttgaagaggcagagaagataggcttggattatatggatgttgaagcactgaagaagcttaacaagaacaagaagttggtccgagaagtatatatcaggcctttctgtcatctgaagctatcatcaagcagatccctcgtctcttgggtcctggtctcaacaaagcagggaaattcccaacccttgttactcaccaggaatccctagagtccaaggtgtgaagttccaactgaagaaggttctttgcatgtgggagttgctgttgggaatgtagctatggaggagaagcagatcttccaaaatgtgcaaatgagtgtcaatttccttgtttcattgttgaagaaaaactggcaaaatgtgaggtgcctctacctgaagagtaccatgggcccttcaaacaggatcttttgagatgatatttactttctattagtgttatgtacggagtgaaagtagttgttgggattaatagtcagtttaggttcaaatttcgtgttatcttttgctgctggaatccctagagatattatgaatttgagaccttggaaggtttgttttgcatatcaactgagtttttgcattaatgttaaaaattccaatctttcaacaaaaaatgtatcgtagaacactctttaaatttattgtattaaatatctttttttaattcgataaaaaatcgtaaaaatt

SEQ ID NO: 10989 - DNA, 1178 bp, Zea mays
gaattctagagtattgttcccatccagatagattatctctgcctaataaattctgcccattgattattgcagtaagctggagtccgaggttctcaaggatgtcgtctcccagatagttcaggatgccaagaagaataggaagttcactgagactgttgagcttcagattagtctgaagaattatgatcaacaaaaggacaagagtttcagtggctctgttaagttgcctcgcatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagaccatcatcaagcaaattccacgtctccttggtcctggtctcaacaaggcaggcaagttccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccaaatgagcgtcaacttcctcgtgtctcttctgacgaaaaactggcagaatgtaatatgcctctacatcaagagcaccatgggaaaccattcagggtgttctaagtctgcttttttgtgaagtctgctcttcatgatatttggtttttgaaccgaggttgtcttgaactaaaactcttgttagatcatatttggttggcatgatatatttgagtccgggcaggtgttttccccttgtctttgtaatctctctatataatgtttttgagaggctaagtataatatgtgtattatacgttatacccaattgtttctgttaatgtggaaccatgagtttccgccattgctgctgcgccctcggggtagcgcccctctatttatgggatagagccttgtaggaagttttggtcactaatttggctgctattactaaactaaagaatgtagatgtgcatcgggtttaaaaaatccaagacattttggccgataaatgttagggccgatctgttgtggatgcggttctgttattagccttgtgtttgcttgaaattgtctattttgtttaatag

SEQ ID NO: 10990 - DNA, 796 bp, Rosmarinus officinalis
atatgacattacccgcctcttctctgtgcgtcttctgcagtcttcggtcttccatagaggcagtggagctgttcacctgtggaaagcaagactaatctaatctttcgcgaaacagagaaactttgtcgagaccattgaactccagattgggctgaagaactgtgatccccaaaaggacaagcgttttagtggttcagtcaaactgcctcatattcctcgccccaagatgaaggtttgcatgcttggtgatgctcagcacgtggaagaggctgagaagattggtcttgagtacatggatgttgaagggttgaagaaactcaacaaaaacaagaagttagtgaaaaagcttgccaagaagtatcacgctttcctggcatctgaagcagttatcaagcagatcccccgtcttcttggccctggtcttaataaggcaggcaaatttcctacgctggtcactcatcaggaatccttggagtcaaaagtaaatgaaacaaaggccacagtcaagtttcagcttaagaaagtcctttgtatgggtgttgctgtgggcaatttggacatggaggagaagcaaattttccagaatgttcaaatgagcgtcaattttcttgtatcgctattaaagaaaaactggcagaatgtcaggtgcttgtatctgaagagtaccatggggaggccacaacgcattttctaagcaattgtttttatttactttaatcattctagtgcgggttaaagagttcgcagatgagtacactctttttggtgaatgtctggaatatttttggattctgca

SEQ ID NO: 10991 - DNA, 1136 bp, Glycine max
ctaactagggttttcgcttgagctctgcgagatcttgagtcgccgatttgaaaagatgagtaagcttcagagtgatgctttgcgtgaagccatctcaggaatcatggccgattccaaggagaagaatcgcaaatttgtggagaccatcgaactccaaatcggtttgaagaactacgatccacagaaggacaagcgtttcagtggctccgtcaagttgccccacatccctcgccccaagatgaaaatttgcatgcttggtgatgctcagcatgttgaagaggcagagaagataggactggactggatggatgtagaagccttgaaaaagctaaacaaaaataagaagttggtgaagaagctagctaaaaaataccatgcttttttagcatctgaagcagtcattaagcagattcctcgtcttttgggtcctggtctcaacaaagcaggaaagttccctacacttgttactcaccaggaaactcttgagtcaaaggttaatgagtctaaggccatggttaaatttcaacttaagaaagtgctctgcatgggagtagctgtgggcaatgttagtatggaggaaaagcaaatcttccaaaatgttcaactgagtgttaacttccttgtctctttgttgaaaaagaactggcaaaatgtgagtagtagtccacactcaatatttcttaaactcattgcctctggtgccttcttttttattgtgcttttcttgaaattatatgttcttgttgctgttttatgcttatcacgtatgatttatgaatggttattggtgttatataaaaatctcagctactataataatagtcttcaatatcaggcgggcatggattgaatccatgattatcgcataggttttatcttctgattatatggttatgtagatgatgaaaagattctttattgtctcttctttctacaatatgcctgtccaatatgctcttaatgtgatttcacatcagtgaatgtgaagtttggccaatgctgttttagtttgcgtctttgttgaatttgttgcctattgactctggctggcagtgtttgctttgcaattttttcattctatttttatagtctcaatccattaataccaatttttcttttttctttttgtttctttc

SEQ ID NO: 10992 - DNA, 868 bp, Brassica juncea
aggtggaagagctcaagaagtaataatcctgagaaggagatacaagtcaagtgtgaggaagaagatgcaatgtctctgagaccatcgaactccagattggtcttaagaactatgacccacaaaaggacaagcggtttagcggatccgttaagttgcctcacattccaaggcccaagatgaagatttgcatgctcggtgacgcccagcacgttgaagaggctgagaagattgggttagagtctatggatgtggaagctcttaagaagttgaacaagaacaagaagctggtgaagaagctcgccaagaagttccatgctttccttgcttctgaatcagtcatcaaacagattccacgtcttcttggtcctggtctcaacaaggcaggaaagttcccaactcttgttagccaccaagagtctttggaatccaaagtgaatgagacaaaggcaacagtgaagttccagctgaagaaggttctttgtatgggtgttgctgttggtaacctgtccatggaagagaagcagctgttccagaatgttcagatgagcatcaacttccttgtctcactcttgaagaagaattggcaaaacgtgaggtgtttgtacttgaagagcaccatgggaccaccacaaaggatcttctgagttctctactccaacatttgctctttggttctcaaacatttgctctttggttatcaaacatttgcttcgtggttttgtttgtttcagacatcttgagttatggttttgtttgatattagcagaacggaggtgttagtttgctttttgttagacaatataatatgcaatgttcgtttctctacattatcgactctccaattcaatttatctatcagttctcgaca

SEQ ID NO: 10993 - DNA, 857 bp, Zea mays
gtacataggcaagattattgtaaaagctcgttgtaaaaaagctaaagcaaacatgcctacgccgaaccctcatgtatttttattgacacttggcaattagtttcgttattatgcttcactgcagatacggatgaccatgtctttttagcgattccacataaccattaaattcaacaatatgacgaattgcagaatcagaacgagaaacagaacatgggggaacattagtacacaacgagctctgactgctgaagatcttctcgatgaagacgaacatacaataagacacaaggacgatactagagcaggacacatcccatccacagatctagacacgaacatgctacagcacacagcgcaaatgaagaccctactttctaagccttcttgggggacttggcgcccttcttgggggacttgggctccttgctgccgccgctggccgccttctccgccgccttcttgggcaggagcacggagtggatgttggggaggacgccgccgtgcgcgatggtgacgccggccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttcttgaggtagcgcccgatccggccgacggggaactgcagcccggccttgacggaccgcgtcaccgacttcttcctggggccgcctgccttgcgcccggccgcccccttcttccccttgctaccgggttccggtggcgtccatgactg

SEQ ID NO: 10994 - DNA, 1154 bp, Oryza sativa
ctccagctaatgcagttgtttgtaaagagtctaatcagcagagagatcagttcatccccccaacgatccgaccgtccatctcccctcccacggatcgacgggcccaccaccctccccttcccccaaccgtttaaatacgccaccccaccggcctcgtctccatcgcgcactcgcattcgacgacccaagaaaaggaaaaaaaaagaaaaacaatcctccacgccttcgagcgcagcaggaaccagcttagctagactagccatggacgccgccggagccggagcgggtgggaagctgaagaagggagccgccgggaggaaggccggtgggccgaggaagaaggcggtgtcgcgctccgtcaaggccgggctccagttccccgtcggccgtatcggccgctacctcaagaagggccgctacgcgcagcgcatcggcaccggcgcccccgtctacctcgccgccgtcctcgagtacctcgccgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggcggccggcaagtcccccaagaaggcctagacgtcggcgcctcgctttgcttgtttagctggagtagattggacgggatgtgtgtctgttagtagtctgctgatgctgttgatctaatctatagtggtgtcgttgaaccttgtgtctgttcaagaagataaatctaagatatgttaaatttttcttcagagatgtttccattcttgctccttatgctttggctgtggagatctgaattttctcaattgtcagatccgatcttataagatcgttcgaatttggttgcttgggttgggcgggtaacttaaaatcacccaaatttgttggtggtgtgttgggcttagtgccgcctcaaaaatttggtgtttggaatgaaaatcaccgaatgcctaagtatgggtatctcagcatctgtgattttgctggatgttgaagtgattggt

SEQ ID NO: 10995 - DNA, 508 bp, Centaurea maculosa
cgctagcacaaagtagaagaaaggagctgccggaaggaaggccggaggtccgaggaagaagtcggtcacacgttcggtcaaagccggtctacagtttccggtcggtaggattgggcgttacctgaagaaaggacgatacgctcagagagttggaaccggagctccggtgtacctcgccgccgttctcgagtaccttgccgcagaagtcttggaattggctggaaatgcagctagggacaacaagaagaacagaatcatcccaaggcatgtgttgttagccatcaggaatgatgaggagcttggaaagttgttggctggtgtaacaattgctcatggaggtgttcttccaaatatcaacccaattctgttgcccaagaagactgctaccaaggagcctaaatctccatccaaagctgcaaaatcaccaaagaaagctgctgcctagatgaatgactctgattagattattcttcttttgtatctgtaattgtatgctcctctttcttat

SEQ ID NO: 10996 - DNA, 692 bp, Hordeum vulgare
cgaagggcaagaagggcgcggtgtcccgctcagtcaaggccggcctccatcttcccgtcgtcgtcgccgtggtaggacgggaggagggagtccgcctccttctggccgtcgtcgccgtggtaggacggcatggacgcctccggcaccgtcgcgaagggcaagaagggcgccgcccgggcgcaaggccggcgggcccaggaagaagtcggtgtcccgctcggtcaaggccggcctccagttccccgtcggccgcatcgggcggtacctcaagaagggccgctacgcgcagcgcgtcggcacgggcgcccccgtctacctcgcggccgtcctcgagtacctggccgccgagctgctggagctcgccgggaacgccgccaaggacaacaagaagagccgcatcatcccccgccacctgctgctcgccgtcaggaacgacgaggagctcggcaagctgctggccggcgtcaccatcgcgcacggcggcgtggtccccaacatcaacacggtgctgctccccaagaggaccgtggagaaggagggcaaggcgcccaagtcgcccaagaaggccgccaagtcgcccaagaaggccgccaccccgaagaaggcctgatggagatgcgttctgtgtcgtttaggctgtgtgctgcgtagtgttcttcttcgaatctgaataggggtgtgaagtcgttcgg

SEQ ID NO: 10997 - DNA, 555 bp, Chenopodium quinoa
aaattaggagagagaaagtaagagagagaaaatggatacaggaggaaaagcgaagaagggagcaggaggaaggaaaggaggtgggccgaagaagaagccagttacaaggtcagttagagctgggttacaatttccagttggtagaattggaaggtatttgaagaaaggaaggtatgctcaacgtgttggtactggtgctcctgtttacttggctgctgttcttgagtaccttgctgctgaggtgttggaattggctggaaatgctgcaagagacaacaagaagaacagaatcatcccaaggcatgttctactcgctgtgaggaacgacgatgagctcggaaagcttcttgccggagtcaccattgcacacggaggagttcttccaaacataaacccagtattgttgccaaagaagactgcagagaagtctccaaaggagccgaaatctaccccaaggctaccaaatcccccaagaaggcttagatttttagtggtttggctttcccatctctagtttgtgttttctggtaatctctgtatgtaatgtcagtagat

SEQ ID NO: 10998 - DNA, 582 bp, Chenopodium quinoa
ggatcacactcgaaaatcttacacatttcatttcaatcttcttgttcatcttcataaattaggagagagaaagtaagagagagaaaatggatacaggaggaaaagcgaagaagggagccggaggaaggaaaggaggtgggccgaagaagaagccagttacaaggtcagttagagctgggttacaatttccagttggtagaattggaaggtatttgaagaaaggaaggtatgctcaacgtgttggtactggtgcccctgtttacttggctgctgttcttgagtaccttgctgctgaggtgttggaattggccggaaatgctgcaagagacaacaagaagaacagaatcatcccaaggcatgttctacttgctgtgaggaacgatgatgagctcggaaagcttctcgccggagtcaccattgcacatggaggagttccttccgaacactaaaccctttattgttgccaaagaagactgctgagaagtctccaaaggagccgaaatctcccaaggctaccaagtcccccaagaaggcttagaatttttagtgggtttgggctttcccatctctagtttgtgtttt

SEQ ID NO: 10999 - DNA, 584 bp, Chrysanthemum coronarium
tctaaaaaatggatgcaacaaaatcaaagaagggagctgctggacgcaagggaggcggtccaaggaagaagtctgtcacccggtctgtgaaagccggtctccagtttccggtcgggagaattggaaggtatttgaagaagggaaggtatgctaagagggttggtactggtgccccggtttatcttgctgctgttcttgagtaccttgctgctgaagttttggaattggctggaaacgccgcaagggacaacaagaagaccagaatcatcccaaggcatgttctattggccatcaggaacgatgacgagcttggaaagttgctatttggagtgaccattgcccatggtggagtgcttcccaacattaacccagtcttgttgccaaagaagacagcaagcaaggaacctaaatcgcctgcgaagaaggcagcaaagtctcctaagaaagctgctgccactgttgctgctgagtagatgggtagtgtgtggaatgtggttgttgctgggtttgtaattgtagttaatgaatgattatgtggtcagttgtttgtttaggttgttatggttatgtgttgttggctgttg

SEQ ID NO: 11000 - DNA, 691 bp, Chrysanthemum coronarium
aatggatgcaacaaaatcaaagaagggagctgctggacgcaagggaggcggtccaaggaagaagtctgtcacccggtctgtgaaagccggtctccagtttccggtcgggagaattggaagatatttgaagaagggaaggtatgctaagagggttggtactggtgctccggtttatcttgctgctgttcttgagtaccttgctgctgaagttttggaattggctggaaacgccgcaagggacaacaagaagaccagaatcatcccaaggcatgttctattggccatcaggaacgatgacgagcttggtaagttgctatctggagtgaccattgcacatggtggagtgcttcccaacattaacccagtcttgttgcctaagaagacagcaagcaaggaacctaaatcgcctgcgaagaaggcagcaaagtctcctaagaaagctgctgccactgttgctgctgaatagatgggtagtttgtggaatgtggttgttgctgggtttgtaattgtagttaatgaatgattatgtgatcagttgtttgtttaggttgttatggtatgtgttgttgactgttggttattaatgaagaaacttcttgtttcagtatcttgctttgttataatgcatgagccatgcttatttgactgttaatcatttcaagttattttgctttgaatctgaacaatatag

SEQ ID NO: 11001 - DNA, 578 bp, Ambrosia trifida
catcataacttacaatggaagccgtagcaaagccaaaaaggtgcagctggcaggaaagccggcggtccaaagaagaaaccggtttcccggtccgtcaaagccggtcttcagttcccggtcggtaggctcggtcgctatttgaaaaaaggccggtatgctaagcgtgtgggtaccggtgccccggtctaccttgctgctgttcttgagtaccttgctgctgaggttttggaattggcgggaaatgcagcaagggacaataagaagaataggatcattccgaggcatgtgcttttggcggtgaggaatgatgaagagcttggaaagcttctggcgggtgtgacgattgctcatggtggtgttctgccgaatattaatccagttcttttgccgaagaagtcagccactaaggaggctgcaaaatctccagcgaaggcgaccaagtcaccaaagaaagcatagagctagtggttgaatagtagtttctggttttttggattttgtgtaattaggaacacaatttgatgcttgtttcaggggaatttagtagtattttaggttgatgtattgagcaagtgaac

SEQ ID NO: 11002 - DNA, 756 bp, Cocos nucifera
ggagtcgctcgatccgcacgaaccgaatcgtttggggcttccacaatccgctaccgtgttggtgcgcggaaccagaaacagatcggaggatacgcgatggagagcggaggaactaagatcaagaaaggggctggcggtcggaagggcggtggcccaaagaagaagcctgtctcccggtccgtcaaggccggtctccagttcccagtcggtcgcatcggccgctacctcaagaagggccgttacgcccagcgcgtcggaaccggcgcccccgtctacctcgccgccgttctcgaataccttgccgctgaggttttggaattggcggggaacgcggcacgtgacaacaagaagaacaggatcatacctaggcacgtgctgctggccataaggaacgacgaggaactggggaagctgctggccggggtgaccattgcccatggaggagttcttccgaacattaacccggtgctccttcccaagaaggcggataaggctgggaaagaaccaaagtcgccagccaagtcgccgtctaaggccggcaagtctccaaagaaatcttagaagctttgttctcaatgtaatttgggggcctctttttctaaactctagaaacgagggattgcaaaatgggcgcccccccccccccccccccccgtttgctctcatggtgctctctttcatctacttactatttctattaattaatggaattctagtatatttattaattgtgttaatttatgggagcctagtatg

SEQ ID NO: 11003 - DNA, 785 bp, Phalaenopsis aphrodite
catctgcattcttctttccagaaattcaatctaacgcaataccatggacgccggcgggaaggccaagaagggtgctggtggccgcaaaggcggcggcccgaagaagaagcccgtttcccgatccgtcaaagctggcctccagttccccgtcggccgcatcggccgattccttaaaaagggccgttactctcagcgggtcggcaccggtgctcccgtttacctcgccgcagtgctcgagtatctcgccgccgaggttttggagttggctggaaacgcagcaagggataataagaagaatcgtattatccctaggcatgttcttcttgccgtgaggaacgatgaagaacttggaaaacttcttgctggcgtgacgatcgctcatggaggtgtgctgcccaacatcaaccccgtgttgcttccaaagaaatcagcagcggcgaaagagccgaaggagccgaagtcgccttctaagaagattaagcatgggaagaaggattagaatggaaatttgctgctttttttggtctgtatttaaattctgtggcgttagggttgtttccaggaagaaggtgggattgtaagatgttttttccttaaaaaatatatatttttagtaatggaaaagaatgttcgttgcgtttcatggactagtttgtatgattcgcatttaagatgtgtcttttttatgtttttcatgcatttctctgttgttgagtcagtattgccctgaaatatcattgttggcagtgatggcgatctgcggaaaataatttaaataaagtgcc

SEQ ID NO: 11004 - DNA, 615 bp, Helianthus annuus
accatttattattattcaccgatatacaatcaatcaaacaatccgatcaaatggaggccaccgggaaaagctaaaaagggtgccgcaggtcgcaaagcaggcggcccaaggaagaaggccgtcacccggtctatcagagccggtctgcagttcccggtcggtagaattggccgttatttgaagaacggtcgttatgccaaacgtgtcggaaccggtgctccggtttatctcgctgctgtgcttgaataccttgctgctgaagtgttggaattggcgggaaatgcagcaagggacaacaagaagaacagaataaatccaaggcatgttctgttggcaattaggaatgatgacgagcttggaaagcttttggctggtgtgacgattgctcatggtggtgttctaccaaacattaacccagttttgttaccaaagaagaccgctgcgaaagagccaaaatcgcctgttaaagctaccaaatctcccaagaaggctgctgcttagatgttagatctgttgttgttcttatgtgatgtgattgtagttaaactgagaatgaatctagctttatgttaattgttatattgtttgttaaagtatggaagaaacctctggttt

SEQ ID NO: 11005 - DNA, 529 bp, Arachis hypogaea
aaacacacaactctcgttctcattttctcacaatctctctctctttctccgcaaagaatctgcaatggacgctgcatcgaaagtgaagaagggtgccggtggcaggaaaggaggcggcccaaagaagaagccagtttcccgctccgtcaaagccggtctccagttccccgttggaagaatcggacgttacttgaagaaaggaaggtactcccaacgtgttggaaccggtgcccctgtctaccttgctgccgtattggagtatctagcagctgaggtgttggaattggctggaaatgctgcgagggacaacaagaagaacaggattattccaaggcatgttcttttggcagtgaggaacgatgaagaattggggaaattgcttgctggtgttaccattgcacacggtggtgttcttcccaacattaaccctgttttgttgcctaagaagaccgctgagaaagctcccaaggaaaaaaagtcaccctcaaggccactaagtctccgaagaaagcttgatttgggtgtttag

SEQ ID NO: 11006 - DNA, 712 bp, Cenchrus ciliaris
accccctcggagatggacggcgctgccgcgaaggtgaagaaggcggcggccggccgcaagctcggcggcccgaagaagaagccggtgtcgcgctccgtcaaggccgggctccagttccccgtcggccgcatcgggcgctacctcaagaagggccggtacgcgcagcgcgtgggcaccggcgcccccgtctacctcgccgccgtcctcgagtacctcgccgccgaggtcctcgagctcgccggcaacgcggcgcgcgacaacaagaagaaccgcatcatcccgcgccacgtcctcctcgccatccgcaacgacgaggagctcggcaagctgctgtcgggcgtcaccatcgcccacggcggcgtcctccccaacatcaacccggtgctcctccccaagaaggctgctgagagggccgagaaggccgagaaggcgtccaagtcgcccaagaaggccgccaccaagtcccccaagaagtaggctgctcgtgccggagcgccccgatctcatccgatctgcgactagtgtgtccttgtgtccgttgcttttgtgtgtatgtagtggtgcatccctatccatctatttatcgttttcaccgatctctggatcgaaagtttaggtctagttctagctgtagtggttggtgcagccgtgcagggatttctatgttacccatatttaatgagaagaggaatgaatttgcaatcctttatga

SEQ ID NO: 11007 - DNA, 626 bp, Ambrosia trifida
caccaaaacacacaacaaacataatactaataatatctctaaacagttttagcattacaaatggagtcaactggaaaggctaagaagggtgctggaggaaggaaaggtggcccaagaaagaaggctgtcactcgttcagtcaaagccggtctacaattcccgttggtagaattggtcggtatttgaaaaaaggtcgttacgctaagcgtgttggaaccggtgctcctgtttacctagctgcggtccttgagtatctcgcagcagaagtgttggagttggctggaaatgcggctagggacaacaagaagaatagaataataccaaggcatgtgttgttagccataaggaatgatgaggagcttggaaagctattggctggtgtaacgattgctcatggtggtgtgcttccgaatattaatccggttcttttgcccaagaagactgctgctaaagagcctaaatcgccatcgaaagcggctaaatctcccaagaaagcgaagtagattggttggatatgtgtgagaagagtttggtttagttgtttggttctgttatgttatgttttagagtagtttatattgttagatgtagctgacttcaagctgttaaatgaaaccacttgtttc

SEQ ID NO: 11008 - DNA, 642 bp, Trigonella foenum-graecum
cacacagatttcgtagcaaaaaatctaggttccaaattccaatctcggaaatggacgcgagcacgaaggcgaagaaaggagctggtggaagggtggaggtccaaggaagaagtcggtgaccagatccatcagagctggtcttcaattccccgtcggaagaattggtcgttacttgaagaaaggtaggtacgctcaacgtgttggtaccggtgctcctgtttacctcgccgctgttcttgaatatcttgctgctgaagttcttgagcttgctggaaatgctgcccgtgataacaagaagaataggatcattccaaggcatttgttgttggctgtgaggaatgatgtagagcttggaaaattgcttgctggtgttaccattgctcatggtggtgttcttcctaacattaaccctatccttttgcctaagaagaatgaaaaagctgcttcagggaaggagcctaagtctcctaaagctggaaagtctccaaagaaggcttagatctgttttcaatctttagatgattgtgtgcatatctaagcgtagatttcttttatgacatagaaagttttaatgtaattcaagtgataatgcacttatcctttatgaatttaatccatcaatgaaatcttttagcattcaaa

SEQ ID NO: 11009 - DNA, 730 bp, Taraxacum officinale
acttaatcggaaaatcattgaggcattctcttttcgtcaggttcaaaatttctaatttagtctttcaatagtgaaatggaggccggaacaaaggtgaaaaagggtgcagctggaaggaaggccggtggccctaagaagaagccggtttcccgctccgtcaaggccggtcttcagttccccgtcggaaggttaggtcgatacctcaagaaaggccagtatgcaaagcgtgtcggtaccggtgctccggttacctcgccgccgtccttgagtaccttgctgctgaggttttggagttggctggaaatgctgcaagagacaacaagaaaaccagaatcattcccagacatgttcttttggctgtgagaaacgacgaagagttaggaaagcttttatccggtgtgacgattgctcatggtggtgttcttccaaacatcaacccaattcttctgccaaagaaggctcttgagaaggcaacaaaggaacctaaatctccatcaaaagcaaccaaatctccaaagaaagcttaatggctgaataaatgcctatctaggttccttgttcatcttccatttgtttagggtcaacatgtgattgcattttaggaaaagttagtggttattgtagtcttattgtattgagaatctgttgctggatctgattacgtgtaggacaacatctcggttgtttgaaatggaaattggtattttgtataattacaatgtttctcttc

SEQ ID NO: 11010 - DNA, 706 bp, Olea europaea
gtgcgaatcaatttcctgtcttaccaacgtatatacaaacataattactttgtctccagggttagaatcgatacttcatggaatctggaaaaatcaagaagggtgcgggagggagaaagggcggaggcccaaagaagaagccagtgacccggtccgtcagagctggtttgcaattcccggtgggaagaattggccggtacttgaagaagggccggtatgctcaacgggttggcaccggagctccggtttacatggctgccgtccttgagtacctcgcagctgaggtgttagagttggctggaaatgcagcccgggacaacaagaagaacaggataatccctcgtcatgtattgttggccgtgaggaacgatgaggagcttggaaagttattgcaaggggtcaccattgctcatggaggagtgcttccaaacattaatccagtgctgttgccaaagaaaactggtgcagaaaaggaaccaaaatctccttccaaggctaccaaatctcccaagaaagctgctgcttagctcaattgatatgtattttacccttacctgactctccatcttgtatgaaattgtgggcttagaatgtgttattttgatggttactaggtaaattagtagggtgagaaaggaaggttgtaagtgatggttgtgatgttttgggatctttttaatgaagtcaatgaaagaaacttcttgtt

SEQ ID NO: 11011 - DNA, 508 bp, Cirsium arvense
acgcggggggaccaatcacttgtcacgaacaaagcgctcttgagggaaatggaaactccggaaaagctaagaagggtgccggtggccggaaaggaggcggtccaaggaagaaggccgtcactcgttccatcagagctggtcttcagttccccgtcggtaggattggccgttacctgaagaacggacgttatgctaaacgtgtcggaactggtgctccggtttacctcgccgccgttcttgaataccttgctgctgaagttttggaattggcaggaaatgcagcaagggataacaagaagaacagaataatccctagacatgttctattggcgattaggaacgatgacgagcttggaaaactgttggctggagttacaattgcacatggaggtgttcttcccaacataaacccagttcttttaccaaagaagacagctgcaaaagagcctaaatctccatctaaagctaccaaatctccaaagaaagctgattaggttactttaataaa

SEQ ID NO: 11012 - DNA, 543 bp, Flaveria ramosissima
ttcattcacacacaaacaaacaaccacaaacctccaatggaagccaccggaaaagcgaaaaagggcgccggcggccgcaaagccggcggtccacgtaagaaagccgtcacacgctccgtcaaagccggtctccagttccccgtaggtagaatcggtcgttaccttaaacacggtcgttacgccaaacgtgtcggcaccggagctccggtctacctcgccgccgtgctcgaataccttgcagcagaagttttggaattggcgggaaatgctgcgagagataataagaagaataggattattcctaggcatgtgttgttggcgataaggaatgatgatgagcttgggaagctgttgtctggagtgacgattgctcatggtggtgttttgcctaatatcaaccctgtgttgttgccgaagaagactgctgcaaagagcctaaatcgccttcgaaagctacgaaatcgccgaagaaggcttagattacgttgatatgattgttgttttgtgttatcgatgtaggtagattgaaagtcgagtttagtt

SEQ ID NO: 11013 - DNA, 524 bp, Cirsium arvense
tagaagaaaggagctgccggaaggaaggccggaggtccgaggaagaagtcggttactcgttcggtcaaagccggacttcagtttccggtcggtagaatcggccgttacctgaagaaggacgctacgctcagcgtgtcggaaccggagctccggtgtacctcgccgccgttctcgagtaccttgccgctgaagttttggaattggctggaaatgcagcaagagacaacaagaagaacagaatcatcccaaggcatgtgttgttagccatcaggaatgatgaggagcttggaaagttgttggctggagtgacaattgctcatggtggtgttcttccaaacatcaaccctattttgttgcccaagaagactgcaaccaaggaacctaaatctccatccaaagctgcaaagtctccaaagaaagctgctgcctagatagatgtctctgattagattattctccttttgtatctgtaattgtatgcttctcctttcttatagccttgcagggttgttgtttgggttatt

SEQ ID NO: 11014 - DNA, 792 bp, Trigonella foenum-graecum
atcaattatcaccactcaaaatcttccacttcacacaacacacagatttcgtagcaaaaaatactagggttccaaattccaatctcggaaatggacgcgagcacgaaggcgaagaaaggagctggtggaaggaagggtgggaggtccaaggaagaagtcggtgaccagatccatcagagcaggtcttcaattcccgtcggaagaatcggtcgttacttgaagaaaggtagatacgctcagcgtgttggtactggtgctcccgtttacctcgctgctgttcttgaatatcttgctgctgaggtgcttgagttggctggaaatgcagcacgtgataacaagaagaataggattattccaaggcatttgttgttggctgtgaggaacgatgaagagcttggaaaattgcttgctggtgttacaattgctcatggtggtgttcttcctaacatcaaccctgttcttttgcctaagaagaatgagaaggctgcaactgcaactgctagcaagtctccagctaaggctaccaaatctccaaagaaagcttagatttagtttctagggtttcttgatttcgatttcgtgttttgtttatatctaagtttagtcataacagacatgtttaatgtgtttgtagcaatgtattttgaatatcagcgtttctcatgtagggatctgattcatcaatgaaaacatcttgtttcattgcctaaacacttcatattatgtgatattttgttatgtggagatctctataatctattttctgattaattattgctatgattatgattt

SEQ ID NO: 11015 - DNA, 687 bp, Conyza canadensis
cttacatattttcacattatacattttagaaaaataaaaatcattttaaaagaatggataccaccggaaaagcgaaaaagggtgccgcaggtcgcaaaggtggcggtccaaggaagaaggcagttacccggtcaatccgtgccggtctacagtttcccgtcggtagaattgggcggtacttgaaaaacggtcggtatgctaaacgtgtcggcaccggagctccggtttacctcgccgccgttctcgagtaccttgccgctgaagtattggagttggcaggaaatgcagcaagggataacaagaagaacaggataataccaaggcatgtattgttggcaatcaggaatgatgatgagcttggaaaactcttgtctggagtaaccatcgcacacggcggtgttcttccgaatatcaaccctgttttgttaccaaagaagaccggtgctgctgccgcgaaagagccaaacgtctccagctaaaacagctaagtctcctaagaaggcagctgctgagtagggtgtgcggtttagttgatgctggatggatgtttatgtttgtttgtaatttgtagttaatttggtttagtttattgaagatctaatgtggttgatttagatgagaatgatgatattatgattatatgttttatcttttgtgttttatcaatggaagaaaccacttgtttct

SEQ ID NO: 11016 - DNA, 681 bp, Conyza canadensis
cttacatattttcacattatacattttagaaaaataaaaatcattttaaaagaatggataccaccggaaaagcgaaaaagggtgccgcaggtcgcaaaggtggcggtccaaggaagaaggcagttacccggtcaatccgtgccggtctacagtttcccgtcggtagaattgggcggtacttgaaaaacggtcgttatgctaaacgtgtcggtaccggagctccggtttacctcgccgccgtcctcgagtaccttgccgctgaagtattggagttggcaggaaatgcagcaagggataacaagaagaacaggataataccaaggcatgtattgttggcaatcaggaatgacgatgagcttggaaaactcttatctggagtaactattgcacatggtggtgttcttccaaatatcaaccctgttttgttaccgaagaagactggtgctgccgccgcgaaagagccaaagtctccggctaaaaccgccaagtctcctaagaagacagctgctgctgctgagtaggattgtggtttagttgatggatggatggatgtttatgtttgtagttaatttggtttagtttattgaagatctaatgtggttgatttagatgagaatgatgatattatgattatatgttttatcttttgtgttttatcaatggaagaaaccacttgtttct

SEQ ID NO: 11017 - DNA, 818 bp, Secale cereale
tctctccatcccaatccccacctaccgtccgctctcgcacgccatggacgccacaggcaccggcgccaaggggaagaagggcgctgccgggcgcaaggccggcggccccaggaagaagtcggtgacgcggtccgtgaaggccgggctccagttccccgtcggccgcatcgggcggtacctcaagaagggccgctacgcccagcgcgtcggcaccggcgcccccgtctacctcgccgccgtcctcgagtacctcgccgccgagctgcttgagctcgccgggaacgccgccaaggacaacaagaagagtcgcatcatcccccgccacctgctgctcgccgtcaggaacgacgaggagctcggcaagctgctggccggcgtcaccatcgcgcacggcggcgtgatccccaagatcaacccggtgctgctccccaagaggacggccgagaaggagggcaaggcgcccaagtcccccaagaaggccgccaaatccccgaagaaggtcgccacaccgaagaaggcttaagagagatgcgttatgtctagttgatgatgtaccctgtttagttgtttaggctgtgttgtgttcgtctggatagtggcgtgaaggtgttctgtctagttgatgtaccttgtgttgttcatgttcatggaagaaattcagaaatctctctgaactcccaatatgctgctgtaactaaaaacttaaaaaaaaaaaaaaaaaaaaaagaaaaaaaaaaaaaaaaaaataaaaaaaaaaaaaaaagaaaaaaaaaaacgaaaagaagaacacgaacgaacgaacaagacgaaggtagaag

SEQ ID NO: 11018 - DNA, 715 bp, Silene vulgaris
ataattcattcatctacttttctctctctctctttttaccttcatttcccggtcacatcatggactccaccggtgggaaaggcaagaaaggcgcagccggtcgaaagggtactggtcctaagaagaagccggtttcaagatcggttaaggccggtttgcagtttccggttggtcgtattggtaggtatctaaagaaaggaaggtatgctcagcgtgttggtagtggtgctccggtttatctctctgctgttcttgagtatctcgctgctgaggtgttggagttggctggaaatgctgcacgggacaacaagaagaacaggattataccgcgacacgttctgttggctgtgaggaacgatgaggagctcggaaagttgctagctggagtgacaattgcgcatggaggtgtgttgccgaatattaacccggtgttgttgccaaagaaggctgctgagaagtcaccaagggaacctaagtcgccttccaaggttaccaaatctcctaagaaagcagcagcttgaatcctaagctaatctaattaagacttgagagctagatgaaatatgaaatgttgtttgcttgagtaatgtcatttgtacttaagttatcgttctttgtttagatttgtgaatttgtgtttcgtagtgatcggatgttgtagttgtagcagagaattgaaatgaaaacttgttatcatcaacctcgttcgagtaaa

SEQ ID NO: 11019 - DNA, 713 bp, Valeriana officinalis
atcaatctcaatttctcaaactaatctaatctgctttctgatatcatacaatctgtgttgaaatggaagccggaggtaagccaaagaagggagctgcaggaaggaaaggtggtccgaggaagaaatctgtgaccagatccgtcaaagccggtctccagttccccgtcggaagaattggccggtacttgaagaaaggaaggtatgccaagagagtcggtaccggagctccggtctaccttgctgctgtgcttgagtatctcgctgctgaggttctggaattggctggaaacgctgcacgtgataacaagaagagtagaatcattccgaggcatgttctgttagccataaggaacgatgaagaattgggaaaattgctttcaggtgttacaattgctcacggtggtgttcttcccaacatcaacccagtcttgttgcctaaaagatctgagaaagcagaaggaaaagaggggaaaatctccagcaaaggctgccaagtctccaagaaaacctgttgctgcctagatttgatctatgtttcagtatttagggttatctattttcgttattctgtttgtgttttgtatttagttgttcctgatttagatttacttttgggattaagtatgttagagctgtttgtgtttagggtttattgtgttttatcagcattctgtgaattgctactttaatcatcatatcaatgaatgaaacca

SEQ ID NO: 11020 - DNA, 722 bp, Chrysanthemum coronarium
aaaatggaaacaggtggaaagaaaaagggagcagcaggaaggaaagcaggagggataaggaagaagtcagtgacgagatctgtgaaagctggccttcagtttcctgttgggaggattggaaggtatttgaagaagggtaggtacgccaaacgtgttgggactggtgctcctgtttatcttgctgctgttcttgagtatcttgctgctgaggttttggagctagctggaaatgctgctagggacaacaagaagagtaggatcataccaagacatgttttgttggcgataaggaatgatgaggagcttggaaagcttttgtctggtgtgacgattgctcacggtggtgttcttccaaacattaacccagttttgttgcccaagaagaatctcgcaaaggaaccagctaccaagtctccatctaaagctaccaagtccccaaagaagaaagctgctgagaaagctgatgcttagttgaagaagaaatgtgacacttgttgtatgtactcaacttatttggcaatgtaggttgacttgaattttatcctgttttagggtgtaggagaattgtatgtttgctttgtttaagttaggacctaggtatgaagaagaatctctctttttcgttatcagaattgttattttccgaatgtaagaatgtgtaagaatcaatcttaatgggtactacatttgcttgcgaaaaatggtggcttgagttgtttatg

SEQ ID NO: 11021 - DNA, 454 bp, Ambrosia trifida
cattacaaatggagtcaactggaaaggctaagaagggtgttggaggaaggaaaggtggtccaaggaagaaggctgtcactcgttctgtcaaagccggtcttcaattcccggttggtagaatcggtcggtatttgaaaaaaggtcgttacgctaagcgtgttggaaccggtgctcccgtttaccttgccgcggtccttgaatatctcgcagcagaagtgttggagttggctgggaatgcggctagggacaacaagaagaacagaataataccaaggcatgtgttgttagccataaggaatgatgaggagcttggaaagcttttggctggagtaacgattgctcatggtggtgttcttccgaatattaatccggttctttgcctaagaagactgctgcatcgaaagagcctaaatcgccatcgaaggcggccaaatctcccaagaaagcaaagtag

SEQ ID NO: 11022 - DNA, 845 bp, Aristolochia fimbriata
ttcctacgatttctgcaaaagtaagagagagagagtgtgagagaggaggagaaatggagggagcagggaagacgaagaagggagctgcggggaggaagggtggtgggcccaagaagaagccagtgtcaagatcggtgaaggccggacttcagttcccggtcggaaggattggccggtacttgaagaaaggaaggtacgctgcgcgagtgggaactggagctcctgtgtatctttctgctgttcttgagtaccttgctgctgaggtactcgagttggccggaaatgctgccagagataataagaagaaccgaatcatacccagacatgttcttcttgcaattaggaacgacgaggaacttggaaagcttctcgcgggcgtaacaattgcacacggaggtgttctacccaacatcaaccctattctcctgcccaagaaaaccgagaaggcagctgcgagcaaggagcccaaatctcccacgaagtctccctctaaggccaccaagtctcccaggaaagccgtggggggcgccccatgattcgctttggccacgctgcattttggccagcggatccgggctcccctgtatgtaactgttgtggtctctctatgtaggaaaggaagaaatgatgtaattggtgtctcagcagaaaaaaaaaattgtatctttctaggttgttcattgttaatgacaattgcccttttttgtcttccattttctccgttctcgattacttttccgctatacgcaccaaagttggagattggtaacgagttcgattttcagctcgtatgatccagcgtgtaataagaatcaaggatggttgtagagacctgttcgtttttt

SEQ ID NO: 11023 - DNA, 988 bp, Cichorium intybus
tcgatacacctagctaacaactctcccatttctcactgtttattcgtcgctacaaggaaaatggaaggcgcaggaaaaacaaagaagggtgctggaggaagaaagggaggcggtccaaggaagaaggcggttgcccgctccgtcaaggccggacttcagtttccagttggtaggattggtcgttacttgaagaaaggacgttatgctaagcgtgttggaagcggtgctccggtttacctagccgctgtccttgaataccttgctgctgaagtgctagagctggccggaaatgctgctcgggacaacaagaagaccagaataattccaaggcatctactgttggccattaggaacgatgaagagcttggaaaattgctgggtggagttacgattgcacatggtggtgttcttcctaatataaaccctgttctattgccaaagaagacagctgccaaggaaccttctactccatctaaagctgccaaatctcctaagaaagctaagaaggctgaatagattacttggttagaattgtagcttttgtattaagatcgtatgataagttggaaagttgatgttgatcaaaatttaacgaatgaaaccacttgtttcttataactgttgcaacataatcctcttagtatatgcattatatttctaatcattttgattacaagaaagaagaaaagagatttgattttgagagtggtttgagagatacaagcttgatttataagtgtgtcttctcacacgtgtgcatgtgtgtttttttggcgggaaatgtttgggtaccttttccaaatccaatgttgttattatatatagtcccttattaacttacataaccgggactttttggttttccatctttccgtttttttaggagtgatgttcacgcgtgttatggtaacacgtgtgcctgtaattttttaagtttagagggtagtaaataacgtccctttcttatggcctgaatttgggctaacaa

SEQ ID NO: 11024 - DNA, 429 bp, Flaveria ramosissima
aaatggaagccaccggaaaaaccaaaaagggcgccggaggacgaaaagccggcggcccaagaaagaaggccgtcactcgctccgtcagagccggtctgcagttcccggtcggaagaatcggccggttcttgaaaaaggccgatacgcccaacgcgtcggaaccggagctccggtctacctcgccgccgtcctcgaatacctcgccgccgaagtgttggagttggcgggaaatgctgctagagataacaagaagaacaggataatccctaggcatgtgttgttggcaattaggaacgatgaggagcttgggaagttgttggctgggagtgacgattgctcatggtggtgttcttccgaatattaatcctgtgttgttgccgaagaagactgcggtggctaaagacctaagtctccgtcgaaagctactaa

SEQ ID NO: 11025 - DNA, 709 bp, Linum usitatissimum
acaatcagcaaagctttttgctctctaacatcgaaagcttctcccaatccaagtcagctttctccttcgtttcaaaaactttcctccgcttgagatggaatccgcagccaccaaagtgaagaaaggagccggcggcaggaagggcggtggccctaagaagaagccagtctccagatcggtgaaggccggacttcagttccccgtcggtaggatcggaaggtacctgaagaagggaaggtacgctcagcgcgtcggcaccggagctccggtctacttggctgcagtcctcgagtatttggcagctgaggttcttgagcttgctggaaatgctgcccgtgacaacaagaagaacaggatcatcccaaggcatgttcttctggcaatcaggaatgacgaggagctcggaaagctgcttgccggagtgaccattgctcatggaggagtcctgccgaacatcaacccagtgctgctgccgaagaagactgacagagctactaaggagcccaaggaatccaccaagtctccagccaaggccggaaagtcccccaagaaagcttagttggtttagtgttgtttctgttgttaactttaagatgtatctatttcgtccgagttaatgataagctttaatgtctgttattttctccatcagtctcttgtaatagtggtaaaatcttagtgaatggaatagggatggaacttctttgtt

SEQ ID NO: 11026 - DNA, 694 bp, Linum usitatissimum
aaagctttctgctccctcatataaaaagcttcttccaatccaattcagctttctccttcgtttgaaaagctttcctccacttgagatggattccgcagccacaaaaatgaagaaaggagccggcggaaggaagggcggcggtcctaagaagaagccagtctccagatcggtgaaagccggacttcagttccccgtcggtaggatcggaaggtacctgaagaagggaaggtacgctcagcgtgtcggcaccggagctccggtctacttggcggcagtcctcgagtatttggcagctgaggttcttgagcttgctgggaatgctgctcgagacaacaagaagaacaggatcatcccccgtcatgttcttctagcaatcaggaatgacgaggagctcggaaagctgcttgccggagtcaccattgctcacggtggagttctcccgaacatcaacccagtactgctaccgaagaagactgatcgagctactaaggagcccaaggaatccaccaagtctccagccaaggccggaaagtctcccaagaaagcttagaatggtttagagtcgggtctgttgttaactttaagatgtatctagttcgtccaagttaatgataaacttaatgtctgttatttttctccatcagtctcttgttatagaggtaaaatcttagtgaatgaaatagaattggaactg

SEQ ID NO: 11027 - DNA, 737 bp, Allium cepa
aacccatcttatcccaaatccaaaaaagaatccctaattttaatctgaaatctcgtattcgaagcaatggaggctggcggcaaaacgaagaaaggagccggaggaaggaagggaccaagtgggcccaggaagaagtcggtcactaggtcagttaaagccggtctacaattccccgttggtcgtatcggccgatacttgaagaagggacgatacgcacagcgtgttggcaccggagctccagtctacctcgccgccgttcttgaatacttggcagcggaggtattagagcttgctggaaacgcagcaaaggacaacaagaagaacagaattattcctaggcatgtgcttcttgccataagaaacgacgaggagttgggaaaattgctaggtggcgtgactattgctcatggtggtgtactgccgaatatcaaccctgtgcttttgccaaagaagactgctgccaaagaatctgatgctcccaaatcgcctaagaaggtagctgcaaaatcaccaaagaaggctgctgcaaagacacccaaaaaggctgctgcttaagctattttgttggtagatgtcaaaatacgtggttacgtaatgtagcatctccttaattttttattgaacttctggtgttcaaattctcatgaagttttaatggcaattgaggtttttatcatctacatctcagtaaccgtattttattctctttgcgtttgcaatatttagacaatatgtca

SEQ ID NO: 11028 - DNA, 958 bp, Secale cereale
atccctcctctcgtcccgacgagcaccagcggccagacatggacgtctcaggcaccggagcgggagcaaaggcgaagaagggcgcggccgggcgcaaggccggcggccccaggaagaagtcggtgacgcggtccgtcaaggccgggctccagttccccgtcggccgcatcgggcggtacctcaagaatggccggtacgcgaagcgcgtcggcacaggcgcccccgtctacctcgccgccgtcctggagtacctggccgccgagctgctggagctcgccgggaacgccgccaaggacaacaagaagtcccgcatcgtgcccaggcacctgctgctggccgtgaggaacgaccaggagctcggcaggctgctggccggcgtcaccatcgcgcacggcggcgtgctgcccaacatcaacccggtgctgctccccaagaggacggcggagaaggagcccaaggagggcaagtcgcccaagaagaccgccaagtcccccaagaaggccgacaagaaggcttagagagagacgagcatccattagcttgtagtgctcactaatggtttcgatgtagatctgtgctgccaagaaaaaaagcaattcagaaatttcacttcgattgggttagccgctgtagtgctctgttgtaacagtgattgctgtgtcggtgtagatctgttctgcgaaggggaaaatgtcagaaatctctctgattcgagcaaattgtttgttcttcttctgttcttggtgttgcaatgttaacataggcgcggtaggaaaaactcagatctgttcgaatttgtcaacatttctcgcttgtggcactgaatacgccaagcgatgcccaccagtgattgctgttttgctactggtgtcggagtagatctgtgccgccaagagaaaaatgtaagaaatctctggttcgagtaaattgtttgatctgcttggtattgcaaataggt

SEQ ID NO: 11029 - DNA, 875 bp, Secale cereale
tcagtattcttcctaattcgttaaacctaaattccttccttcttcgccccgagtcccagagcatcacctgcaagcaatggacgtctcaggcactggagctggcgccaaggggaagaagggcgcggcagggcgcaaggccggcggccccaggaagaagtcggtgacgcggtccgtcaaggccgggcttcagttccccgtcggccgcatcgggcgctacctcaagaagggccgctatgcccagcgcgtgggcaccggcgcccccgtctacctcgccgccgtcctcgagtacctcgccgccgagctgctagagctcgccggaaacgccgccaaggacaacaagaagagccgcatcatcccgcgccacctgctgctcgccgtcaggaacgacgaggagctcggaaagctgctggccggcgtcaccatcgcgcacggcggtgtgatccccaagatcaacccggtgctcctccccaagaggaccgcggagaaggagggcaaggagcccaagtctcccaagaagactaccaagtcccccaagaagaccaccaaggcttagatcgatgcgttccaagtcgtagttgtccggtggtgttccctgtagcggtgtcgtttcgtcttgttatgtgcatgtataatggaagaacgtcaggtatagtctctctgactttggcttaaaaaacgaaaaaaaaaaaaaaaaaaaaaaataaaaaaaaaaaaaaaacgaaaaaaaaaaaaaaagtaaaaaaaaaactaaagtaacgacgtacgtacgaacgacgacgtaacggacggtaaaggtacgaggtactagtacgagtacacgacgtccgtaggaacttcgtagtacgtccgtaacacgtccgttaagtcggtaaccg

SEQ ID NO: 11030 - DNA, 740 bp, Secale cereale
aaatccctcctctcgtctcgacgagcaccagcggccaggcatggacgtctcaggaaccggagcgggagcaaaggcgaagaagggcgctgccgggcgcaaggccggcggccccaggaagaagtcggtgacgcggtccgtcaaggccgggctccagttccccgtcggccgcatcgggcggtacctcaagaatggccggtacgcgaagcgcgtcggcacgggcgcccccgtctacctcgccgccgtcctcgagtacctggccgcggagctgctggagctcgccgggaacgccgccaaggacaacaagaagtcccgcatcgtgcccaggcacctgctgctggccgtgaggaacgaccaggagctcgggaggctgctggccggcgttaccatcgcgcacggcggcgtgctgcccaacatcaacccggtgctgctccccaagaggacggcggagaaggagcccaaggagggcaagtcgcccaagaaggccaccaagtccccaaagaaggccgacaagaaggcttagagagagacgctcaaacgcgcatcgattagcttgtactagtgcttagtagatctttgctgccaagaaaagacaattcagaaatctctctgatttatccaaattgtttgctcagtcgcctgtacatcgattagcttagttgtcgtgctctgtagtaacagtgattgctgtgtcgatgtagatctgtgctgcgaagaggaaaatttcagaaatctctctgatt

SEQ ID NO: 11031 - DNA, 712 bp, Secale cereale
aaatcaccaaccaaatcccctctctcccgcggcccgacgagcagcagccaccagacatggacgtctcaggtaccggagccggagcgaaggccaagaagggcgcggcagggcgcaaggctggcggtcccaggaagaagtcggtgacgcggtccgtcaaggccgggctccagttccccgtcggccgcatcgggcgctacctcaagaatggccggtacgcgaagcgcgtcggcacgggcgcccccgtctacctcgccgccgtcctggagtacctggccgccgagctgctggagctcgccgggaacgccgccaaggacaataagaagtcccgcatcgtgcccaggcacctgctgctggccgtgcggaacgaccaggagctcggcaggctgctagccggcgtgaccatcgcgcacggcggcgtgctgcccaacatcaacccggtgctgctccccaagagggcagcggagaaggagcccaaggagggcaagtcgcccaagaagaccgccaagtccccaaagaaggccgacaagaaggcttagagacgcgtgctttgtagaactaatggtttcgatgtagatctgtgctgccaagaaaaaacaattcagaaatctctctttgatagataagcagctgtagtgctttgtagtaacagtgattgctgtccatgtagatctgtgctgcgaagaggaaagtgtcataaatctctctgatttga

SEQ ID NO: 11032 - DNA, 718 bp, Secale cereale
ctccgcgacatcccaaatcaccaaccaaatcccctctctcccgcggcccgacgagcagcagccaccagacatggacgtctcaggcaccggagccggagcgaaggccaagaagggcgcggcagggcgcaaggccggcggtcccaggaagaagtcggtgacgcggtccgtcaaggccgggctccagttccccgtcggccgcatcgggcgctacctcaagaatggccggtacgcgaagcgcgtcggcacgggcgcccccgtctacctcgccgccgtcctggagtacctggccgccgagctgctggagctcgccgggaacgccgccaaggacaataagaagtcccgcatcgtgcccaggcacctgctgctggccgtgaggaacgaccaggagctcgggaggctgctggccggcgtgaccatcgcgcacggcggcgtgctacccaacatcaacccggtgctgctgcccaagaggacggcggagaagggagcccaaggagggcaagtcgcccaagaagaccgccaagtccccaaagaaggatgacaagaaggcttagagacgcgtgctttgtagaactaatggtttcgatgtagatctgtgctgccaagaaaaacaattcagaaatctctctttgatagataagcagctgtagtgctttgtagtaacagtgattgctgtccatgtagatctgtgctgtgaagaggaaagtgtcataaatctctc

SEQ ID NO: 11033 - DNA, 736 bp, Secale cereale
gactgaacaccctccgcgatatccaaatcaccaaccaaatcccctcctctcccgcggcccgacgagcagcagccaccaaaaacatggacgtctcaggcaccggagccggagcgaaggccaagaagggagcggccgggcgcaaggccggcgggcccaggaagaagtcggtgacgcggtccgtcaaggccgggctccagttccccgtcggccgcatcgggcggtacctcaagaatggccggtacgcgaagcgcgtcggcacgggcgcccccgtatacctcgccgccgtcctcgagtacctggccgcggagctgctggagctcgccgggaacgccgccaaggacaacaagaagtcccgcatcgtgcccaggcacctgctgctggccgtgcggaacgaccaggagctcgggaggctgctggccggcgtcaccatcgcgcacggcggcgtgctgcccaacatcaacccggtgctgctgcccaagaggacggcggagaaggagcccaaggagggcaagtcgcccaagaagaccgccaagtccccaaagaaggccgacaagaaggcttagagacgcgtgctttgtagaactaaaggtttcgatgtagatctgtgctgccaagaaaaaacaattcagaaatctctctttgatagataagcagctgtagtgctttgtagtaacagtgattgctgtccatgtagatctgtgctgcgaagaggaaagtgtcataaatctctctgatt

SEQ ID NO: 11034 - DNA, 647 bp, Conyza canadensis
cacaaacgaattctctgttatcaattttacacaacctttctcctaaaaatattcaacaaatggaaacacaaacaaaaccaaagaaaggttttggaggccgaaaagccggtgccggtccacgaaagaaggccgtaacccgttcaatcaaagccggtctacaattcccagtcggcagaattggccggtttttgaaaaaaggccggtatgctcagcgtgtcggtagcggtgcccctgtttatctcgctgctgttcttgagtatctcgcagcagaagtgttggaattggctggaaatgcggcgagggataacaagaagaacaggataatacctcgacatgtattgttggcaatcaggaatgatgaagagttaggaaagttgttggctggagtgacaattgcacacggtggtgtcttgccgaacattaacccggttttgttgcctaagaagactgctgccgccgcgaaagaaccaaagtcgccggctaaggctgccaagtcacctaagaaggctgctgctgcttagatgtatttgttgattgtttagtatttcttggttttgtttggttagagatggtagaaaaaattatgcatggttagatggatgtaatcagttgttattaatgaatgaattaatagaactttttgtttc

SEQ ID NO: 11035 - DNA, 764 bp, Rosmarinus officinalis
gttcaacttcaatacttgcagagggctaaaatcttcattccatttccatggaggctgccacaaaaccgaagaagggcgcctcaggaagaaggggcggcggtcccaagaagaaaccggtctcccgctccgtcagagccggcctgcagtttcccgtcggcagaatcggccgttacttgaagaaaggccgctatgcgcaacgtgtcggcactggcgcgccggtgtacatggctgccgttctcgagtatttagctgctgaggtgctcgagttggctggaaacgccgctcgggacaacaagaagaacaggatcatcccgaggcacgttctgttggctgtgagaaacgatgaagagctcgggaagttgttgcagggtgtgacgattgctcacggcggtgtgcttccgaacatcaatcctgtgctcttgccgaagaagactggcggagacaaggccactaaggagccgaagtcgccggtcaaggctgcaaaatcgccgaagaaagctgctgcttagttttaggtagattgggttcagcaaattttatcaattgtttgtgatttttggcttagaatgggttccttagcggaatttagagggcagagaatgaagattttgtaattatttagtgctgttgatttagagcccaattttaatatgtatctagttaattcagccacattttggggatcgcgtttggtttctttgttatttcttgaaatctggtggtttttgttcgttctgctgtttaatttgatgtttattctgtgg

SEQ ID NO: 11036 - DNA, 709 bp, Olea europaea
taccagttttacacacgtatatatacacacaatttcttttctccagggctagtattgtcagttaatggaatccgggaaaatcaagaagggtgccggagggaggaagggcggaggcccaaagaagaaaccggtaactcgatccgtcagagccggtttgcaattcccggtcggaagaatcggccggtacttgaagaagggccggtatgctcagcgggtcggtaccggagctccggtttacttggctgctgtccttgaatatctcgctgctgaggtgttggagttggctggcaatgcagccagggacaacaagaagaacaggataatcccaaggcacgtattactggcagtgaggaacgatgaggagcttgggaaattgttgcaaggagtcaccattgctcacggtggcgtgcttccgaacattaatccagtgctgctgccaaagaaaactggtggagacaaggcaactaaggaaccaaaatccccttcaaaggctaccaaatctcctaagaaagctgctgcttagcacaattaacatgcatcttactcttatctgactcttcctcttgtatgaaaattgtgggcttagaatctgttcttttgacggttattagctgtattgttagggtgaaaaggaagattgtaagttgatggttgtgttgttttgggatcttctttaattatattaatgaagaaacttctggtttccaat

SEQ ID NO: 11037 - DNA, 665 bp, Allium cepa
tttagtttacggggggtcattaccgcataccctttccccacaaatcaaatcaatccctaattttatttcaaaaccgaatttgacgccatggaagccggtggcaaagcaaagaagggcgccggaggcagaaagggaccaagtgtacccagaaagaaggccgtcagcagatctgtcaaggccgggcttcagtttcccgtcggtcgtatcggccgatacttgaagaagggtcgctattcccagcgcgttggcaccggggcccctgtttaccttgccgccgtcatggaatacctcgccgctgaggttctggagctagctggtaacgcagcaaaagataacaagaagaatcggattattccaaggcatgttcttcttgcaataagaaatgatgaggagctgggaaaattgctagctggagtgaccatagcacatggtggtgtattgcccaacatcaatccagttcttttgccaaagaagactgttgctaaggattccgaagcaccaaaatcaccaaagaaggcggcaaaatcccctaaaaaggctccagaaaaatgatttcttggttggtttggaatcacatgtttatatgacgtagtgaggatatgttttctcttttgttgtcggggtttgttttgacttttcttacaaatgaagccttttttaagttt

SEQ ID NO: 11038 - DNA, 3196 bp, Ambrosia trifida
aaacttgtataaaaaaatgcacacagagtgttcctacaaatctgttgatctcctccaatgccaatcgtctgacaagcataaacactgccggacggatcatccggatttttccatgcaccatctttctctctttctgttgttatcttatcaattacgattaatccaaagctttcacatactcaaacaccctttcaattcacacacacaacaacatgattaacacaacaaatctgttattcaatcctctgtttcaacctccatcactctgtacctccatgtcccttacaattccttcactcaacaacacgttctcaccgtcgtcttatcgttaccgttatcgttacgtcaacggctcggtcaacgctcgcagtgtgtttttatatagcagaaagagtgttcgtaatcgtgttaatccgattcgagtttattccgcatctaaggcagaagaaaagcaagtcagaaagtattcacctcttcttgagagccccttcccattagaacacaatgtatcaactacagaatttaagacaattcctgacatttggagatccgcagcagaaaggtttggtgatcgggttgcattggttgacccgcatcatgatccgcctacaaatatgacgtacaagcaggtggagcaggacattataaatttctctgaaggtttaagagtgattggaatcaagccatgtgaaaagctagcactttttgcagacaattcctgtcggtggcttattgctgatcaaggtattatggccacaggagcaataaatgttgtgcggggatctaggtcatccgtggaagagctgttacacatttacaaccattctgaaagtgtcgcactagctgtggacaatcctgaattatatctccagatggcggatgcctttaattctaaggcatccgttaaatttgttatcctactttgggtgaaaaatcatccatatctagccatgtgaaggagggaattcctgcttatacatacaaggagatcatagatatgggtcgtggaagtcgtgcgagttttgctgattcacatgatgcccaggaacagtatgtttatgagcccatcaagtctgatgatgttgctgctcttatatacacaagtgggaccacaggcaacccaaaaggagtaatgcttacacataataatcttttacaccaggtacataatttgtgggacatcgtccctgctgggccaggggatagatttttaagcatgcttccaccttggcatgcatatgaacgtgcttgtgagtattttatactttctttgggaattgagcaagtatacacaacggttaaacacttgaaggatgatttgcgggaatatcaaccacaatatatgatatccgtccctctagtatttcaaactctgtacagtgggatccagaagcagatatccaccagctcagctatccgtaagctgattgcagtatccttgataaggatcagtatggcatacatggagttcaaaaacatttatgagggtaaatatttgtcaagaaatccgaagcaaccttcttacattgctgcaatcttggactggctatatgcacgggttattgctgcaattttgttacctttgcatttactggcaaagaaacttgtgtacagtaaaattcacgcgtctattgggctttcaaaggctgggataagcggaggtggtagcttgcctatgcatgttgacaaattctttgaggcaattggcactaaagtccaagttggttatggcttaacagagtcatctcctgttgtagcggctcgacgaccacattgcaatgtacttggctcagttgggcaccctattcgacacacagaaataaaagttgtaaacgaggaaacaggtgaagaccttcctcccggttcaaagggaattgtcaaagccaggggtccgcagatcatgcagggttattacaagaatcccaatgcaacaaaccaagccttagatgaagatggttggttaaacactggagatattggctggatttcccctgttcattcagtaggacgaagtcgtattctggtggcattattgttcttgaaggacgtgccaaggatacgattgtcctttcaacaggtgaaaacgttgaaccagaacagctagaagaagctgccatgagaagtagtttgatcctacaaatagttgtcattggccaggataagcgtcgtcttggagctatcattgttccaaacaaagaagaaattttgttggcattcaaaaagtcatccacgtcagattcagatgctgttgaacttagcaaagagaaagtaacaggcttgttatcagaagagcttcgaaaatggacctcagattgctcttttcaaatcggacctattctcatcattgaagagccttttacgatcgatagcgggttgatgaccgcgaccatgaagatcaggaggaaccaagttgtggaactatataaagagcagatagatgatctatacaagtaatgtttgtttaattgtattgaaaataaatgaaatttgttattgttttgctcttttattttcttacatgtgtaaaagaagataaatatttcttctatgttatattttaataagtaaataataatagtttacgtatcattttcaaaaagaagatattcttcttcattcaaggattctaccataaacaagccagtttacaatcctcctaaaacacatcctaaatcccatacccaacccaactacatttccatacaaacataaacacaatctaagccttctttggtgatttcgtcgctttggatggcgacttcggttccttagcagctttgtcaagagccttctttggcaacagcaccggattgatgttcggaagaacaccaccatgagcaatagtcacaccagacatcagctttccaagctcatcatcatttcgaaccgccaacaatacatgccttggtatgattctgctcttcttgttatctcttgcagcatttccagccaattccaaaacctcagcagcaaggtactcaaggacagcagcaaggtaaaccggagcaccggtaccgactcgtttagcgtaccggcctactttaaggtaccggccgattctaccgaccgggaactggagaccggctttaacggaccgggtgactgatttcttttttggaccgccggctttccttcctgcggctccttttttcgactttgcaccggtttccattgcaatgtgtgatgtttttagagt

SEQ ID NO: 11039 - DNA, 678 bp, Helianthus annuus
cccaattgccatggaagccgctggaaagtcgaaaaaaggagccgcaggaagaaaggccggcggtccgaaaaagaaaccggtcacccggtccatcaaagccggtctccagttccccgtcggtagaatcggccggtacctgaaagtaggccggtacgctaagcgtgtcggtaccggtgctccagtttacctcgctgctgttctcgagtaccttgctgctgaggttttggagttggctggaaatgctgcaagagataacaagaagaaccgaatcataccaaggcatgtattgttggctgttcgaaatgacgatgagcttggaaagcttttatccggcgtgacaattgctcatggaggtgttcttccgaatatcaacccggttctcttgccgaagaaggctcatgataaggctgctaaggaacctaagtcgccatcaaaatcgacaaaatcacctaagaaggctacttagatgatgttgtttgtgattacatttgtatgatggtgtagttggatatgagatttaggttgtgctttagaaggatgattgtaaactggtttgtttatggtacaattctagtatgaagaaaaagaatctctctttttatgaaatgaaaattgttaagtatctatccttttgggccacattatttgctcaaatgtttaaatatgattttttaattt

SEQ ID NO: 11040 - DNA, 711 bp, Chrysanthemum coronarium
tcaaacatcccaacggttttccttattcttctaaatcaaacattttctaaatcagcgcgttaaatggagacaggggggaagattaagaaaggtacagctggaagaaaggctggtggtcctaagaagaagcccgtttcgcggtctgtgaaagctggtcttcagtttcctgttggtaggattgggaggtatttgaaaaaaggtcgttatgctcaacgtgttggcactggtgctccggtttatctagctgcagtgcttgagtaccttgctgctgaggttttggagttggctggaaatgcagcgagggataacaagaagaacaggattattcctaggcatgttttgttggctgtgaggaatgatgaagaactaggaaagcttttgaacggtgtgacgattgctcatggtggtgttcttccgaatattaatccagttcttttgccaaagaagtcggctgtgacaaaggagcccaaaaaatcaccgtcaaaggcagctaaggagccaaagaaagggaatactaggatgttggttttataggtgtgatgttgtttgtttgaaagataataaaattaaccgaggaagcttagggtagatgaccgtactagtaggaacaaattatggttggaattatcgtagtattagaaacttttaactttaatgaagtgaatgaagcacaacatcttgttagtatgaaatgaaattactgttaatgaa

SEQ ID NO: 11041 - DNA, 1088 bp, Lactuca sativa
aaaataatctcaaaaagtaacccaaattcaaaattcatcggagcattttaattggtggatccacttcacacggatcggtgatgaataaacgaagaccgttagattaaataccaatccagcggccaaaaacaagcccagttcacggtcctgatcctccccaaataatcctcgctatataaacaactcatcggtggcgaatgttatcatcaatcacttgttttcatacccataaatcacttgtcttctaagccaaaaagagaaatggaaaccaccggaaaagctaagaagggtgccggaggaaggaagggcggtggcccaaggaagaagtctgttactcgatccgtcaaagctggtctccagtttcccgttggtagaattgggcgttaccttaaggtcggacgctatgctaaacgtgttggaaccggtgctccggtctacctcgccgctgttcttgaataccttgccgctgaagtgttggagttggcaggaaacgccgcgagggacaacaagaagaccagaatcatcccaagacatgttcttttggccatcaggaacgatgatgaacttggaaaacttttgggtggagtgactattgctcatggtggtgttcttccaaacatccacgctgttctattgcccaagaagtctgctacaacagagcctaaatcaccatcgaaggctgcaaagtcaccaaagaaagcagctaaaactccaaagaaagctgaataggctatggtagtttggttgttgttcatctgtgtgtgtatttgtcgttaaattacatatggagtttagtattctaaccattccgtttgtttagactatcgatcgtatgttaccacctctctgtttatcaatggaagaaaccacttgtttctattctcaactttgtttgtttatttctgttattctactatttcttacattaatgtgtaacttcaataacttaaatgagctgaatcaaataaacagatgtccagactcttctgcccagtttcgcgaatcattaaatgcactttttagatatttgttacgttttcctttatttgacgtcatttatgatgtttattttgttgttacagttggag

SEQ ID NO: 11042 - DNA, 901 bp, Fraxinus spp
gaatcaattaccagtatttccaacttttatttagacattattacttcgtctccagggttggaatcgttgtttcatggaatcaggaaaaatcaagaagggtgccggagggagaaagggcggaggcccaaagaagaagccggtgacccggtccgtcagagccggtttgcaattcccggttggaagaattggtcggtacttgaagaagggccggtatgctcaacgtgtcggtaccggagctccggtttacatggctgccgtccttgaatacctcgcagctgaggtgttagagttggctggaaatgctgcccgggacaacaagaagaaccgtataatcccacggcatgtattgttagccgtgaggaacgatgaggagcttgggaagttgttgcaaggagtcaccattgctcatggaggggtgcttccgaacattaatccagtgcttttgccaaagaaaactggtggagaaaaggaaccaaaatctccttccaaggccacaaaatctcccaagaaagctgctgcttagcttgattgacatgtattttacccttatctgactctccatcttgtatgaaattgtgggcttattagaatgtgttattttgatggttattagtaattggtagggtgagaaaggaaggttgtaagtgatggttgtgttgttttgggatctttttaattaaatcaatgaaagaaacttcttgtttctgatttgctctagttttttcatgttggtttgatattttggcgattaagatggttgaaacttgtgttgggagttcaaatgcaacagttatttggttgtgctacttttcttgaacctcctcccttgtgttgagtcaagagatagatggatagatagatgttttgttccattgattgtaaattgtattcctcgggtgct

SEQ ID NO: 11043 - DNA, 432 bp, Cenchrus ciliaris
gtcgggtcgcaaggccggcggacccaggaagaagtcggtgacccggtccgtgaaggccgggctccagttccccgtcggccgcatcgggcgctacctcaagaagggccggtacgcgcagcgcgtgggcacgggcgcccccgtctacctcgccgccgtcctcgagtacctcgccgccgaggtcctggagctcgccggcaacgcggcgcgcgacaacaagaagacgcgcatcatcccgcgccacgtcctgctcgccatccgcaacgacgaggagctcggcaagctgctggccggcgtcaccatcgcccacggcggcgtcctccccaacatcaacccggtgctcctccccaagaaggtcgccgagagggctgagaaggctgagaaggcaaccaagtcgcccaagaaggccgctaccaagtcccccaagaagtaggc

SEQ ID NO: 11044 - DNA, 486 bp, Centaurea maculosa
atggaaagtaccggaaaagcgaagaagggcgccggtggccggaaaggtggtggtccgaggaagaaggcggtgactcgctccatcagagctggcctccagtttcctgtcggtaggattggccggtatcttaagaacggccgttatgctaagcgtgtaggtaccggagctccggtgtacctcgccgccgtgctcgaataccttgccgctgaagttttggaattggcagggaatgctgcaagggataacaagaagaacaggataatccctaggcatgttctgttggcaattaggaatgatgatgagcttggaaagcttttggctggagttactattgcacatggaggtgttcttcccaacataaacccaattctgctaccaaagaagacagctgcaaaggagcctaaatcaccatcaaaatcaacaaaatctccaaagaaagctgattaggttgcttttataaattaatgatgttgttatggctgtctg

SEQ ID NO: 11045 - DNA, 686 bp, Cucurbita pepo
atccactgggcaaatttcattttcctgtaattccttcaagttcctctggtttccggcgatcaggttaggtttcgatggacgcaagcggcaagttgaagaagggagctggcggcagaaagggcggtggcccgaagaagaagcctgtttctcgctctgttaaggccggcctccagttccccgtcggtagaattggtagatatttgaagaatggccggtatgctcgacgtgtcggtactggagctccggtctacatggccgccgttcttgagtatctcgccgctgaggtgctggagttggctggaaatgcagcccgggacaacaaaaagaacaggataattccaaggcatgtattgttggccataaggaacgatgaggaacttgggaaattgcttgctggtgtaacgattgctcatggaggtgttcttccaaacataaaccctgttctgttgccaaagaaaagcgagaaagcagctagtaaagaaccgaaatcaccatcaaagacccccaagggagcaaaatccccaagaaggcctaggtttttcttctaatctgaaaacttgactgttctttgcccatttgtatgtactttgttggccttttaggatcatcttctgtgttgtttatcaatgtaagcttaaaactgaagaattgggagagactctatcactcccaccatcgtaatgaat

SEQ ID NO: 11046 - DNA, 987 bp, Pinus pinaster
acagaatagcaggaattttagtaaacgcaggtgaagttgtgaaggcgtgttattgcccgtaatttatcatcagagatggaggcgggatccaaagcaaagaagggtgcaggcggcaggaagggaggcggccccaagaagaagtcagtttccaaatctttgaaagcgggtcttcagtttccagtgggaagaattggaaggtatctcaagaagggcagatatgctcagcgacttggtataggggctcccgtttatttggcagctgttctggaatacttggcagctgaggtcttggaacttgcagggaatgctgccagggacaacaagaagaacagaataattcctaggcatctgctcttggctgtgaggaatgatgaggaattgggtaaactcatggctggtgtgaccattgctagtggtggtgtgctgcctaacatccaccaggtgctgttgcccaagaagagtgagaaggccaaggagcccaagtctcctgcaaaggcttaggatatgggctttttcttgttggtgccatttgtgtgggtgctgctcaactgaagcagggccatgtttatatttattctctcttccaatggtgttttgtaacaccacctgttttaattgggaatctcagaaactctttgggatggtgaggagttgcaggtagggatctgtgaatatggtgttgataaagcttttgccttttattatgatttttgcttgtttcctgacttagggtgggctcaatctgtgtcttgggttttggtatctttctttgtggttcttagttaatgaaagaagcaatcttgggcaaagagatattctctgggatctgtaatggtcctgctggtttttgcttgaattctttgtccatttcctccaatgaaagtgactgaataaagttgtcagtgtagtgcggcctgttgattccttccaatgaaaatgactttcaatggacctatcactacagcatatttgtcattcaattattac

SEQ ID NO: 11047 - DNA, 942 bp, Pinus taeda
agaacagcaggaattttagtaatcgcaggtgaagttgtgaaggcgtgttattgcccttagtttatcatcagagatggaggcgggatccaaagcaaagaagggcgcaggaggcaggaagggaggcggccccaagaaaaagtcagtttccaaatctttgaaagcgggtcttcagtttccagtgggaagaattggaaggtatctcaagaagggcagatatgctcagagacttggtataggggctcccgtttatttggcagctgttctggagtacttggcagctgaggtcttggaacttgcagggaatgctgccagggacaacaagaagaacagaataatacccaggcatctgctcttggctgtgaggaatgatgaggaattgggtaaactcatggctggtgtgaccattgctagtggtggtgtgctgcctaacatccaccaggtgctgttgcccaagaagagtgagaaagccaaggagcccaagtctcctgcaaaggcttaggctatgggtttttgcttgttgctgccatttgtgtgggtgttgctcagctgaagcagagctatgtttatatttattctctcttccaatggtgttttgtaacaccacctgttttaattgggaatcttagacaactctttgggatggtgaggagttgcaggtatggatctgtgaatatgtgttgataaagcatttgccttttattatgatttttgcttgtttcctgagttagggtgggctcaatctgtcttggaatttggtatcttctttgtagttcttagttaatgaaagaagcaatcttgggcaaagagatattctctgggatctataatggtcctgctggtttttgcctaaattctttgcccatttcctccaatgaaaatgactgaataaagttaccagtgtagtgcggcctgttgattccttccaatgaaaatgacttttaa

SEQ ID NO: 11048 - DNA, 690 bp, Allium cepa
ccccaaatcagtaaaagaaaccctaattttaattcaaatcccatatccgaagcaatggagaccggaggcaaatcaaagaaaggagccgcaggtaggaagggaccaagcgggccgaggaagaaggccgttaccaggtcagttaaagccggtcttcagttccccgttggccgtatcggccgatacctgaagaagggacggtacgctcagcgtgttggcaccggagcccccgtctacctcgccgccgtcctcgaatacttggcagccgaggtattggagcttgctggaaatgcagctaaggacaataagaagaacagaatcattcccagacatgtgcttcttgctataaggaacgacgaggagttgggaaaactgctaggtggtgtgactatcgctcacggtggtgtgttgccgaatatcaaccctgtgcttttgcccaagaagactgctgccaaagaatctgatgctccaaaatctcccaagaaggttgctgcaaaatcaccaaagaaggccgctgcaaagacacccaaaaaggctgcttgagttagtgtttgatagatgttgaattgtgtttatgtaacgtgccatttcttcgtctttctatttgacttttggagttaaatttcacgaaatgttttaatggtaatagatgtttatgaaacgaaatgttttattgctaatctcgaattttct

SEQ ID NO: 11049 - DNA, 741 bp, Secale cereale
accaaatccccctcctctcccgcgtcccgacgagcagcagccgccagacatggacgcctcagccaccggagccggagcgaagggcaagaagggcgcggccgggcgcaaggccggcggccccaggaagaagtcggtgacgcggtccgtcaaggccgggctccagttccccgtcggccgcatcgggcgctacctcaagaagggccggtacgcgaagcgcgtcggcacgggcgcccccgtctacctcgccgccgtcctcgagtacctcgccgccgagctgctggagctggccgggaacgccgccaaggacaacaagaagtctcgcatcgtgcccaggcacctgctgctcgccgtccggaacgaccaggagctcgggaggctgctggccggcgtcaccatcgcgcacggcggcgtgctgcccaacatcaaccccgtgctgctccccaagaggacggcggagaaggagcccaaggagggcaagtcgcccaagaaggccaccaagtccccaaagaaggccgacaagaaggcttagagagagacgctcaaacgcgcatcgattagcttgcagtgctttgtagatctttgctgccaagaaaaggcaattcagaaatctctctgagttatccaaattgtttgctcagtcgcctgtacatcgattagcttagtcgtcgtagtgctctgtactagtaacagtgattgctgtgtcgatgtagatctgcgctgcaaagaggaaaatgtcagaaa

SEQ ID NO: 11050 - DNA, 743 bp, Secale cereale
caccagccgccagacatggacgcctcagccaccggagccggagcgaagggcaagaagggcgcggcagggcgcaaggccggcggccccaggaagaaatcggtgacgcgatccgtcaaggccgggctccagttccccgttggccgcatcggccgctacctcaagaagggccggtacgcgaagcgcgtcggcacgggcgcccccgtctaccttgccgccgtcctcgagtacctcgccgccgagttgctggagctcgccgggaacgccgccaaggacaacaagaagtcccgcatcgtgcccaggcacctgctgctggccgtgaggaacgaccaggagctcgggaggctgctggccggcgtgaccatcgcgcacggcggcgtgctgcccaacatcaacccggtgctgctccccaagaggacggcggagaaggagcccaaggagggcaagtcgcccaagaagaccgccaagtccccaaagaaggccgacaaaaaggcttagagagagacgcgcgtcgattagcttaagctttgctgtaacagtgatcgctgttttactaatggtgtcgatgtagatctgtgctgccaagaaaaagcaattcagatttttctctgatttatccaaattgtttgcccggtcttctgttcttgatatcgcaatgtgacataagtgctgtgggaaagaacccaaaaaaaaaaaaaaactaacgaagactacgcgaacggacgacacagggagtaggggggggg

SEQ ID NO: 11051 - DNA, 674 bp, Secale cereale
accagccgccagacatggacgcctcagccaccggagccggagcgaagggcaagaagggcgcggcggggcgcaaggccggcggccccaggaagaagtcggtgacgcggtccgtcaaggccgggctccagttccccgtcggccgcatcgggcgctacctcaagaagggtcgctacgcgaagcgcgtcggcacgggcgcccccgtctacctggccgccgtcctggagtacctggccgccgagctgctggagctcgccgggaacgccgccaaggacaacaagaagtcccgcatcgtgcccaggcacctgctgctcgccgtccggaacgaccaggagctcgggaggctgctggccggcgtgaccatcgcgcacggcggcgtgctgcccaacatcaacccggtgctgctgcccaagaggacggcggagaaggagcccaaggagggcaagtcgcccaagaagaccgccaagtccccaaagaaggccgacaagaaggcttagagagaggcgagcgtcgattagcttaagctttgctgtaacagtgatcgctgttttactaatggtgtagatgtagatctgtgctgccaagagaaagcaattcagaaatttctctaatttatccaaattgtttgccctgtcgtcgtgtgttcttgatatcgcaatgtgacataagtgacgttg

SEQ ID NO: 11052 - DNA, 705 bp, Secale cereale
tcagcccaaatcaccaaccaaatcccctctctcccgcggcccgacgagcagcagccaccagacatggacgtctcaggcaccggagccggagcgaaggccaagaagggcgcggcagggcgcaaggccggcggtcccaggaagaagtcggtgacgcggtccgtcaaggccgggctccagttccccgtcggccgcatcgggcgctacctcaagaatggccggtacgcgaagcgcgtcggcacgggcgcccccgtctacctcgccgccgtcctggagtacctggccgccgagctgctggagctcgccgggaacgccgccaaggacaacaagaagtcccgcatcgtgcccaggcacctgctgctggccgtgcggaacgaccaggagctcgggaggctgctagccggcgtgaccatcgcgcacggcggcgtgctgcccaacatcaacccggtgctgctccccaagaggacggcggagaaggagcccaaggagggcaagtcgcccaagaagaccgccaagtcccccaagaagaccgacaagaaggcttagagacgcgtgctttgtagaactaatggtttcgatgtagatctgtgctgccaagaaaaaacaatccagaaatctctctttgatagataagcagctgtagtgctttgtagtaacagtgattgctgtccatgtagatctgtgctgcgaagaggaaagtgtcataaa

SEQ ID NO: 11053 - DNA, 751 bp, Triticum aestivum
aaatcaccaaccaaatcccctcccctcctctcccgcgtcccgacgagcaccagccaccagacatggacgcctcagccaccggagccggagcgaaggcgaagaagggcgcggccgggcgcaaggccggcggccccaggaagaagtcggtgacgaggtccgtcaaggccgggctccagttccccgtcggccgcatcgggcgctacctcaagaatggccggtacgcgaagcgcgtcggcacgggcgcccccgtctacctcgccgccgtcctcgagtacctcgccgccgagctgctggagctcgccgggaacgccgccaaggacaacaagaagtcccgcatcgtgcccaggcacctgctgctcgccgtgaggaacgaccaggagctcgggaggctgctggccggcgtgaccatcgcgcacggcggcgtgctgcccaacatcaacccggtgctgctgcccaagaggacggcggagaaggagcccaaggagggcaagtcgcccaagaagaccgccaagtcccccaagaaggccgacaagaaggcttagagagaggcgcgcgtcgattagcttaagctttgctgtaacagtgatcgctgttttactaatggtgtcgatgtagatctgtagttctgtactgccagggaaaaacaaattcagaaatctctctgatttattatccaaattgtctgccctgtcgtttgttcttgatatggcaatgtgacataagtgctctgggaagactcagatctgtttga

SEQ ID NO: 11054 - DNA, 585 bp, Arnica chamissonis
ttgcaatggagaccggaggaaagttgaaaggggtgccggcggcaggaagggtggcggtcctaagaagaagccggtttctcggtccgttaaggccggtcttcagttccccgtcggtaggctcggtcgttacctcaagaaaggccggtatgcaaaacgtgtcggcactggtgctcctgtctaccttgccgctgttctcgagtaccttgcagctgaggttttggagttggctggaaatgctgcaagagacaacaagaagaacagaatcattccaagacatgtgcttttggctgtgaggaacgatgaagaactcgggaagcttctagctggtgtgacgattgctcatggtggtgttcttccgaacatcaatccagttcttcttccaaagaaggcacatgacaaagcaacgaaggagccttcaaaatctccatcaaaagcaacaaaatcaccaaagaaagcgttttagtgttggttgctgaagaacgttttattgctctacccttttatgtaattaggaacacaatttgactattaatttaggactagtttagtctgatgcattgaatcttgttactgactctgtttgtt

SEQ ID NO: 11055 - DNA, 976 bp, Chrysanthemum coronarium
cgcacatcacacttcttcctatctgtacattactcgaacaattcgtgctctttcaattagtgtattctagattgcgcaaattataagtaacactccaaacacataaaattcaaaacatcatactaatagcaccaacattttccaacatccacaaacactaaaactcataccaaaagaaacccaaattttcaaattcaaatttcaaaatttgaaaaatggaaacaggaggaaagaaaaagggagcagcaggaaggaaagctggaggatcagggataaggaagaagtcagtgacgagatctgtgaaagctggccttcagtttcctgttgggaggattggaaggtatttgaagaagggtaggtacgccaaacgtgttgggactggtgctcctgtttatcttgctgctgttcttgagtatcttgctgctgaggttttggagctagctggaaatgctgctagggacaacaagaagagtaggatcataccaagacatgttttgttggcgataaggaatgatgaggagcttggaaagcttttgtctggtgtgactattgctcacggtggtgttcttcctaacattaacccagttttgttgcccaagaagaatctcgcaaaggaaccagctaccaagtctccatctaaagctaccaagtccccaaagaagaaagctgcagagaaaaaagctgctgagaaagctgatgcttagttgttgaagaaatgcgactcttgttgtatgctttcaacttatttggcgatttaggttgacttgaattttagtatgttttagggtgtaggagtatggtactttgtttaagctaggacctaggtatgaagaagaatctctctttttcgttatcagaattgttattttccgaatgtaagaatgtgtaagaatcaatcttaatgggtactacatttgcttgcgaaaaatggtggcttgagttgtttatgttgattaaaactttgatgatgtaaggt

SEQ ID NO: 11056 - DNA, 692 bp, Fraxinus spp
gggtctgaatcaattaccagttttacccacgcatatatacacgcaattttttttctccagggctagtattgtcatttaatggaatccgggaaaatcaagaagggtgccggagggaggaagggcggaggcccaaagaagaagcccgtgactaggtccgtcagagccgggttgcagttcccggttggaagaattggccgatacttgaagaatggccggtatgctcagcgggtcggtaccggagctccggtttacttggctgccgtccttgagtatctcgctgctgaggtgttggagttggctggcaatgcagcaagggacaacaagaagaacaggataatcccaaggcatgtattgttagccgtgaggaatgacgaggagcttggaaagttgttgcaaggagtcaccattgctcacggtggagtgcttccgaacattaatccggtgctgttgccaaagaaaactggtggagacaaggcaactaaggaaccaaaatctccttctaaggctaccaaatctcctaagaaagctgccgcttagcacaattgacatgtattttacccttatctgactcttcctcttgtatgaaaattgtgggcttagaatgttttcttttgatgcttgttaggtgtattggtagggtgaaaaaggaagattgtaagttgatggttgtgttgtttttgggctcttaatta

SEQ ID NO: 11057 - DNA, 705 bp, Olea europaea
agttttacccacgtatatatacacaaaatttcttttctccagggctagtattgtcagttaatggaatccgggaaaatcaagaagggtgccggagggaggaagggcggaggcccaaagaagaagccggtaactcggtccgtcagagccggtttgcaattcccagtcggaagaattggccggtacttgaagaagggccggtatgctcagcgggtcggtaccggagctccggtttacttggctgccgtccttgaatatctcgctgctgaggtgttggagttggctggcaatgcagccagggacaacaagaagaacaggattatcccaaggcacgtattacgtggcagtgaggaacgatgaggagcttgggaaattgttgcaaggagtcaccattgctcacggtggcgtgcttccgaacattaatccagtgctgctgccaaagaaaactggtggagacaaggcaactaaggaaccaaaatccccttcaaaggctaccaaatctcctaagaaagctgctgcttagcacaattaacatgtatcttactcttatctgactcttccttttgtatgaaaattgtgggcttagaatgtgttcttttgatggttattaggtgtattggtagggtaaaaaggaagattgtatgctgatggttgtgttgttttgggatcttctttaattatgttaatgaaagaaacttctggtttcca

SEQ ID NO: 11058 - DNA, 594 bp, Allium cepa
aacaatttcgtatcttcccccaaatctggaaaagaaaccctaatttcaagttaacatccggaattcgaatcaatggaaactggtggaaaaatgaagaaaggagccggaggtagaaaaggaccaagcggccccaggaagaagtcagtcacaaggtcagttaaagccgggcttcaattccccgtcggccgtatcgggcgatacttgaagaaaggacgatacgctcaacgtgtcggtaccggagctcctgtctacctcgccgccgtccttgagtacctagcagccgaggtattggaacttgctggaaatgcagcaaaagacaacaagaagaacagaatcattccaagacatgttcttcttgcaataagaaacgatgaggagttgggaaaattgctgggtggagtgaccattgctcatggtggtgtattgcctaatatcaaccctgtgcttttgccaaagaagactgcttccaaggaatccgacgctcccaaatcaccaaagaaggctgcaaaatcacctaagaagactgctgcaaaatcacctaaaaagactgcttaagtggtgttgttggtagatgttaaattatgtgtttatgtg

SEQ ID NO: 11059 - DNA, 736 bp, Allium cepa
tctaatcaaatccctaattttatcctaatcaacttgaagcgatggaagccggtgggaaagcaaagaaaggcgccggaggtagaaaaggaccaagcggacccagaaagaagggcgtcagccgatctctcaaggctggacttcaatttcccgtcggtcgtatcggccgatacttgaagaagggtcgctatgctcagcgtgttggcaccggagccccagtttatctcgccgccgtcatggaatacctcgcagcagaggttttggagctagctggtaacgcagcaaaggacaacaagaagaatcgcattatcccgagacatgttcttcttgcaataagaaatgacgaggaattgggaaaattgctagctggagtgaccatagcacatggcggtgttttgcccaacattaaccctgtgcttttgccaaagaagactgctgctaaggagtctgaaaccccaaagtcatccaagaaggcagcgaagtcccccaaaaaggttgctgcaaaatgagttttggttggctttggaattacatgtttatatgatgtggtaagaatatgttttctctttgtttactggtttgttttgatttagttaatggaacatgtcttttaagtttaatggagttattcattcgagcactttcttctgtcatttttggtttgttgaacttaacactttaggtcgagtcatttcttgctttatctgaataaacgtgaccttggaaatctgcgtcagtc

SEQ ID NO: 11060 - DNA, 495 bp, Allium cepa
gccctagttttaatttaagatcccaatttcgaagtgatggataccggcagcaaagcgaagaagggagctggaggcagaaaggggccaagtggacccaggaagaagtccgtcacgagatcagttaaagctggtcttcaattccccgtcggtcgtatcggccgatacttgaaaaagggacgatacgctcagcgtgtcggtaccggagctccagtttatcttgccgccgttcttgaatatctagcagcagaggtattagagctggctggaaatgcagcaaaagacaacaagaagaaccgaatcattccaagacacgttcttcttgcaataagaaacgatgaggagttgggaaaattgcttggtggagtgactatagctcatggtggagtattgccgaacatcaacccagtgcttttgcctaagaaaactgctgccaaggaatccgaaactcctaaatcacccaaaaaactgctgcaaaatcccctaagaaggttgctg

SEQ ID NO: 11061 - DNA, 2424 bp, Sorghum bicolor
cgaaaacacaaacgcacacaagcacacggcgcaggggaaaaaacacggagaaatcgaacgcgaaagagggtgacgagggaggagaggagagagaaagagaggcggggaaggagatagcacgggggctttatcggagatggatgccggagcaaaggtgccgaagaaggccgcggcagggcgtcgcggcggcggcggcccgaagaagaagccggtctctcgctccgtgaaggccggcctccagttccccgtcggccgtatcggccgctacctcaagcagggtcgctacgcccagcgtatcggcaccggcgcccccgtctacctcgccgccgtcctcgagtacctcgccgccgaggtcctcgagttggcggggaacgcagcgcgggacaacaagaaaaaccggatcatcccgcggcacgtactgctggcgatccgcaacgacgaggagctcgggaagctgctggccggcgtcaccatcgcgcatggcggggttctgcccaacatcaaccctgtgttgctcccaaagaagaccgctgccgccgccgccaaggagggcaaagagaagaagtcacccaagaaggccgccaccaagtcgcccaagaaggcggctgccgcataggctcccgccaatgccggtgcccttgtctcttgctctcttcctctgtccgctctgaactgaaacgctcctagctgtcgttgtcggtcaaggtcgttgttgcttgatgcatttgttgtggttgttcgtgtgtaattgcgcgcctttcgcccaatccgcatgtactgtgtaggttgacactggtttaggtttcgatctgtgaaacgctggtttagattcaaggagtgtgtgagctgtgaagggcaggggatggggtgggatctgtgaatcattagatgctgtttgtaataatattgcgaagatgtgtaaaatccgttctgtgcttccattccgtgcttgattgtctggatgtgatatatcttttccattagttggtgacctttgttatgtttatatggttgcatctactatgattaactggttgtagtaactgtagggtgttggcttgttttatgctattgttgcttcccatcagctcgtgttaaagtttaaactaaaaacgggttatgatctgtaccccgaattggttgaccatggtgagggttattgacatatcaattcaagtgatgcttacataacactatgtgctgttaaagtcaattaaataggagtgtatgaaatgttctcctattaaacaaaaaaagggtaaacggttggtcttccatcaattagccagttatcaggcaaattgtttgaatagacactactgactaccctggaacatttaaagatcctttcagaaggcttagagtttgtttaggcttagagtttgatatcacggagctgccctcacgtcggacgtttgatttgcttgcgagacacgcgtcgcctatcgggactgggggcgcacggacgacgccatgaacccagcgcccactgaattttcttccaacaatggggtgtatgttttgttgacatttctgttagttgaccacttgtcctacagtccatttgggatgattacaaaccattatgtggtgttgatgtcaattgagtatgggcttggctgtttgctgtcgacatttctcttagatgatcaatgatattactgttggcctgttgttcaataaagcctgtgtccttggctagtcctcagctgtagataattgaaatatgatatccagtgaaattcttgcaaaaccaaaactttgaaatatggtggctggatatcattcgtctatagatcttcctgttttgaagtgtgattgctttgatagattgtggaaacacatttaagaattgttgctcagagtgtgtgtgcaattcattgcataggcataatataagagtgattggatttattttatttttgtgtaacgtgtggtttctttgttttccagcaatttccggcaaatagagtcctgtagaatattggcatgtttttatgtgcaggattacagaatgttaggattttcatctcagtacttcatttctctataggttgcaattttttggtactttgacacttacatatgtgggcctgttggttcgttgccaaaccttgtggcactttaggcgcgagacagtttcttaggcgtgtgtttgttccacaccattattgtggctggccaaactttattaggccagtctcaatgcatgtttcatgggagtgtcatgcacattaaatagggtgccacataagcaaaattgctgacttggcagggtcattaaatgaaggtggcagggtcattaaatgaaggagtttcagcagatgagagaggagtttcatccacatgaaactcatatggctcggttacctagtcttggtaactgtgccatgaaactatgtattgagactggccttagagtca

SEQ ID NO: 11062 - DNA, 819 bp, Rosmarinus officinalis
tttcaactctacctgccaaaatctctcaacatcaaatcaattcccatttgtaccaaaattaagaaatggaaaccgttggaaaagtgaagaagggagctggcggacggaagggcggcggccccaagaagaagccggtttcccggtccgtcaaggctggcttgcagttcccggtcggtagaatcggccggtatttgaagaagggccgttattcgcagagggtaggaaccggtgcgccagtttacttggctgccgtgctcgagtatcttgcagctgaggtgttggagttggcaggcaatgctgctagagataacaagaaaaacaggattattccgcggcacgtgctactcgctgtgagaaatgacgaggagcttggcaagcttcttgccggagtcaccattgcacacggtggagttttaccaaacatcaacccagttcttctacctaagaagttggagaaggcagcggagaagtcgcctaaatcaccatcgaaggggaccaaatctcccaagaaggcttgatgctggatttgtggttgaatggtattgtttttgttctttgtatgtaatttgcattgctcttggtaatgtaggaaggaggctgttcataactggattaaaaatctctgtactatctcgttggattgctccttgttagaattgatgggaaatatcaggatgattggctttcaacatatttattttcttgcaaggggaaaggttaaggttcaatatattgaaattacaaaggggggaaaatatagttgtagtggttgagggacgccttactgaatcaaaatgtaactaacataccgacatatgt

SEQ ID NO: 11063 - DNA, 846 bp, Rosmarinus officinalis
acttccccccggccggggggctcactatttcaactctacctgccaaaatctctctacatcaaatcaattcccatttgtaccaaaattaagaaatggaaaccgttggaaaagtgaagaagggagctggcggacggaagggcggcggccccaagaagaagccggtttcccggtccgtcaaggctggcttgcagttcccggtcggtagaatcggccggtatttgaagaagggccgttattcgcagagggtaggaaccggtgcgccagtttacttggctgccgtgctcgagtatcttgcagctgaggtgttggagttggcaggcaatgctgctagagataacaagaaaaacaggattattccgcggcatgtgcttctcgctgtgaggaatgatgaggagcttggaaagcttcttgccggagtcaccattgcacacggtggagttctaccaaacatcaacccagttcttctacctaagaagtccgagaaggcagcggagaagtcacctaaatcaccatcgaaggggaccaaatctcccaagaaggcttgatgctggtgttgtgtttgaatggcattgttttggttctttgtatgtaatttgcattgttcttggttatgtaggaaggaggctgttcataactggattaaaaatctctgtactatctcgttggattgctccttgttagaattgatgggaaatatcaggatgattggctttcaacatatttattttcttgcaaggggaaaggttaaggttcaatatattgaaattacaaaggggggaaaatatagttgtagtggttgagggacgccttactgaatcaaaatgtaactaacataccgacatatgt

SEQ ID NO: 11064 - DNA, 715 bp, Sesamum indicum
tgcaattctgctttcagtctcacatcacatcttcttttgtagttcttcattcataatttctttgttactagagagaaatggaaagtggcggcaaattgaagaagggagctgggggaaggaagggcggcggtccgaagaagaagcccgtttcccggtccgtcaaagccggcctccagttcccggtgggcaggatcggacggtatctgaagaagggacgatattcggagcgggtgggtacaggtgcgccggtttacatggctgccgtgctcgagtaccttgctgcagaggttttggaattggctggaaatgcggcgagagacaacaagaagaacagaatcattccgaggcacgttttgctcgcagtgaggaacgatgaagagctcggaaagcttctagctggagtgacaatcgcacacggaggcgttctaccgaacatcaacccagttcttctgccgaagaagtctgagaaggcggcggagaagccagctaagtccccaaccaaggccaccaagtcgccgaagaagggttaactgatccatgttcttgtgaagtgtagaattgaatgacattgttgggtttcttgaagttcaatgaatgtaatttgaacgagtgctgagtagggaaggatgtttataactggagtaattgtacttcatcctctacagttgctttttagatcctccactatataaatttaatgggaagattatctctc

SEQ ID NO: 11065 - DNA, 765 bp, Cucurbita pepo
gcggggaaccaaacccgcctatttgcttaaccatcgactgtaactctccggcgcgcagcggcttcgttttcttcacagtaggaccttcaggcagcattcaatggaggccagcggcaaggcaaagaagggtgcaggaggaaggagaggcggcgagaagaagaaatcggtttctcgttccgttaaggccggcttgcagttccccgtcggtcgtatcgctcgttatctgaagaaaggaagatactctcagcgtgtcggcaccggcgctccggtctacttagcagcagtcatggagtatctagccgccgaggttcttgagttagccggaaatgccgctagagacaacaagaagaacagaatcattccaaggcacgttctagttagcgtattaggaacgacgaagaactcggaaaattgctcgccggcgtaaccattgccagtggcggtgttctgccaaacatcaacccggtgctgttgccgaagaagacggacaaggctttgaaagagccgaaatctccatcgaaggccggtaagtcgccgagcaaggcggcttaatcataatgaatctgtaatttatgacggtgttttggattttgtttgtaatggtagaagacgaagattagggattagggctttggaatgcattactgtaatcgatcatggctattttaccgattttccggcgaggaatcaaaccagaggctctactcgtagttaatcgttaatcacaaacttattaatgaatgatattaatgaaatggaattaaa

SEQ ID NO: 11066 - DNA, 625 bp, Flaveria ramosissima
ccgcacatatactcgccggaaaacccaaccatttcatccattttctccacaagtcgccggccgtcgccatggaaaccggtggaaagttgaaaaaaggagctgccggaaggaaggccggcggtccgaagaagaagccggtcacaaggtccgttaaggccggacttcagtttccggtcggtagaatcggccggtaccttaaggtcggtcggtacgccaaacgagtaggtaccggtgctccggtgtatctcgctgcggtcctcgaataccttgccgctgaggtattggaattggctggaaatgctgcaagagacaacaagaagaacagaatcatacctaggcatgtgttgttggctgtgaggaatgacgatgagcttggaaagcttctttcaggtgtgacaattgctcatggtggtgttcttccaaacattaatccagttcttttgccaaagaaatctcatgataaagctacaaaggaaccaaaatctccatctaaatcaactaaatccccaaagaaagcttagttgatttatccacacttacaatggtgatgtaggatgaatcagcagatttagaaggattgtaatttgctatgtttatggtaggatctaggtgtgaagaagaggaa

SEQ ID NO: 11067 - DNA, 764 bp, Guizotia abyssinica
acgctctctctcctcctctgttcaatcaaatagtcgccggaaaaaccaacatttcatccgttttcttcacaagtagccgtctgtcgtcatggaaaccggtggaaaattgaagaaaggagctgccggaaggaaagcaggcggtccgaagaagaagccagttaccaggtccgttaaggctggtctccagttccccgtcggtaggatcggcagatacctcaaggtcggtcgctacgccaagcgagtaggtaccggtgctccggtttatctagccgccgttctcgaataccttgctgctgaggttttggaattggctggaaatgctgctagagataacaagaagaacagaattaacccaaggcatgtgttgttggctgtgagaaatgatgatgagcttggaaagcttctatctggtgtgactattgctcatggtggtgttcttccgaacatcaatccagttcttttgcccaagaaggcacatgataaggctgcaaaggaacctaagtctccatccaaaacaactaaatccccaaagaaagcttagttgttgaagagattacactcttgtgtatgtatccacattcctatggtgatgtaggataatttgaatttgtggtgtttttagggaagatttattaggattgtaatatgctatgctaattttaggaactgggtatgatgaagaagaatctctcttttctaataaaaattgccattttctgaattgtgcaacttttgaactcaattaatggtggtacacaaataaa

SEQ ID NO: 11068 - DNA, 663 bp, Lippia dulcis
gtcaattcccatttgcaacaaaattaagaaatggaaaccggtgggaaagtgaagaagggagcaggcggaaggaagggcggtggcccgaagaagaaaccagttacccggtccgttaaggctggcttgcaattcccagtcggtagaattggccgctacttgaagaagggccgttattcccagcgggtgggaaccggcgcgccggtttacttggctgccgtgcttgagtatcttgcagctgaggtgttggagttggcaggcaatgctgctagagacaacaagaaaaacaggattattccccggcatgtgctgctagctgtgaggaacgatgaggagcttggcaagcttctagccggagtcaccattgcacatggtggagttctaccaaacatcaatccagttcttctacctaagaagtctgagaaggcagcggagaagtcacctaaatctccatcaaaggggaccaaatctcccaagaaggcttgattgatccaagaatggccttgttttcgtactttgtatgtagtctggattgttgttgcttatgtaggaaggaagctaccatctcgttagtttgttccttgttagaattgaatggaaatatcattacttcacgatctttggcgttgaacacattaattggaaaatgttctaaataaaaaagaa

SEQ ID NO: 11069 - DNA, 665 bp, Helianthus annuus
ccaattgccatggaagccgctggaaagtcgaaaaaaggagcagcaggaagaaaggccggcggaccgaaaaagaaaccggtcacccggtcaatcaaagccggtctccagttccccgtcggtagaatcagccggtacctaaaagtaggccggtacgcaaagcgcgtcggtaccggtgctccggtttacctcgctgccgttctcgagtaccttgctgctgaggttttggagttggctgggaatgcagcaagagataacaagaagaaccgaatcataccaaggcatgtattgttggctgttcgaaatgacgatgagcttggaaagcttttatccggcgtgacaattgctcatggaggtgttcttccgaatatcaacccggttctcttgccgaagaaggctcatgataaggctgctaaggaacctaagtcgccatccaaatcgactaaatcaccgaagaaggcttagatgatgttgtttgtgattacatttgtatgatggtgtagttggatatgagatttaggttgtgctttagaaggatgattgtaaactggtttgtttatggtagaattctagtatgaagaaaaagaatctctcttttttatgaaatgaaaattgtgaaggatctatcctttgtgggttaaattgtttgctcaaatgtttaaatatga

SEQ ID NO: 11070 - DNA, 760 bp, Triphysaria pusilla
tgaaactagtagatggacaccaccattttcaactttgcttatcatctgacatacaaatttccccctaaccaatcatctttgtagccgaaccaaaaatggaagctactccaaaggcaaagaagggagctgctggaagaaaggccggtggcccaaagaagaagtccgtttcccgatccgtgaaagccggtctccagttccccgtcggcaggatcggccgatttctcaaaaagggtcgctactctgagcgtgtcggttccggtgcaccggtttacatggccgcggttctagaataccttgctgctgaggtattggagttggctggaaatgcagcaagagacaacaagaaaagcaggattatcccaaggcacttgttgctggccgtgaggaacgatgaggagcttggtaaacttctggctggagtgacaattgctcatggtggtgttataccaaacataaacccggttctgttgcccaagaaatctgacaaggtggctgagaaggcacccaaatcaccatcgaaggctactaagtctccgagaaaggcatagactgaaatttttctttctgaatgtcggattgggataaaataacctttattggtttgtagggattgtgttatcttagggctatgtaggtgatgatgtttataactgcagtaattgtacttttaaccctttctattgctacttttgttgttaaatctcatgatttaaatttaatggaaagattgcttttacaaatttactaaaaaaaaaaaaaa

SEQ ID NO: 11071 - DNA, 651 bp, Utricularia gibba
cccacacacaacgaaatggaatccaccacgaaacacaagaagggagccgccggacgtagaggggggggccccaagaagaagcctgtttcccggtcggttaaagctgggctccagttcccagtcggcagaattgggcgttacctcaaaaagggccgttactcgcagagagtgggcaccggtgcgcccgtgtacatggcagcggttctcgagtacctcgcagctgaggttctcgagctagccggaaacgctgctagggataacaagaagaacaggataatccccaggcatgttctactagcagtccgcaacgatgaggagctgggcaagctgctggccggagtcacaattgcgcatggtggcgtccttcccaatatcaacccggtactgctgccaaagaagtccgatacggcggagaaggcaccggcgaaatcgtcgacaaaagccaccaagtctcctaagaaagcaggggcttgaacatggggtcggcgtgccggaagttctttctatgttcatgtttgtttgtggatgaaagctgttgtatggcgctgatgtttccgttctagaaaactaattgttatttgaatgtaatggaaaacaaggggcattgttttccattccaacggaagcagaaatcagcacaccagcccagag

SEQ ID NO: 11072 - DNA, 695 bp, Valeriana officinalis
aaactaatctaatctgctttctgatatcatacaatctgtgttgaaatggaaaccggaggcaagccaaagaagggagctgcaggaaggaaaggtggtccgaggaagaaatctgtgaccagatccgtcaaagccggtctccagttccccgtcggaagaattggccggtacttgaagaaaggaaggtatgccaagagagtcggtaccggagctcctgtctaccttgctgctgtgctagagtatctcgctgctgaggttctggaattggctggaaacgctgcacgtgataacaagaagagtagaatcattccgaggcatgttctgttagccataaggaacgatgaagaattgggaaaattactttctggtgttacaattgctcacggtggtgttcttcccaacatcaacccagtcttgttgcctaaaagatctgataaagcagaagcgaaagaggggaaatctccagcaaaggctgccaagtctccaagaaaacctgttgcggcctagatttgatctatgtttcattatttagggttatctattttgttattctgtttgtgttatgtatttagttgttactgatttagagttgcttttgggattaagtatgttagtgtttagggtttattgtgttttatcagcattctgtgaattgctactttaatcatcattagattttgagcctgtcgattgtggcc

SEQ ID NO: 11073 - DNA, 697 bp, Valeriana officinalis
caaactaatctaatctgttttctgatatcattcaatctctgtggaaatggaagccggaggcaagccaaagaagggagctgcaggaaggaaaggtggtccgaggaagaaatctgtgaccagatccgtcaaagctggtctccagttccctgtcggaagaattggccggtacttgaagaaaggaaggtatgccaagagagtcggtaccggagctccggtctaccttgctgctgtgcttgagtatctcgctgctgaggttctggaattggctggaaacgctgcacgtgataacaagaagagtagaatcattccgaggcatgttctgttagccataaggaacgatgaagaattggggaaattactttctggtgttacaattgctcacgtggtgtcttcccaacatcaacccagtcttgttgcctaaaagatctgagaaagcagaaggaaaaaaaggggaaatctccagcaaaggctgccaagtctccaagaaaacctgttgctgcctagatttgatccatgtttcagtatttagggttatctattttcgttattctgtttgtgttttgtatttagttgttcctgatttagatttacttttgggattaagtatgttagagctgtttgtgtttagggtttattgtgttttatcagcattctgtgaattgctactttattcatcatatcaatgaatgaaaccact

SEQ ID NO: 11074 - DNA, 691 bp, Valeriana officinalis
taatctgctttctgatatcatacaatctgtgttgaaatggaaaccggaggcaagccaaagaagggagctgcaggaaggaaaggtggtccgaggaagaaatctgtgaccagatccgtcaaagccggtctccagttccccgtcggaagaattggccggtacttgaagaaaggaaggtatgctaagagagtcggtaccggagctccggtctaccttgctgctgtgcttgagtatctcgctgctgaggttctggaattggctggaaacgctgcacgtgataacaagaagagtagaatcattccgaggcatgttctgttagcaataaggaacgatgaagaattgggaaaattactttctggtgttacaattgctcacggtggtgttcttcccaacatcaacccagtcttgttgcctaaaagatctgagaaagcagaagcaaaagaggggaaatctccagcaaaggctgccaagtctccaagaaaacctgttgctgcctagatttgatccatgtttcagtatttagggttatctattttcgttattctgtttgtgttttgtatttagttgttcctgatttagatttacttttgggattaagtatgttagagctgtttgtgtttagggtttattgtgttttatcagcattctgtgaaatgctactttaatcatcatatcaatgaatgaaaccacttgt

SEQ ID NO: 11075 - DNA, 775 bp, Valeriana officinalis
aatcatcaatctcaatctctcaaactaatctaatctgctgtctgatatcataatatctgtgttgaaatggaaaccggaggcaagccaaagaagggagctgcaggaaggaaaggtggtccgaggaagaaatctgtgaccagatccgtcaaagccggtctccagttccccgtcggaagaattggccggtacttgaagaaaggaaggtatgctaagagagtcggtaccggagctccggtctaccttgctgctgtgcttgagtatctcgctgctgaggttctggaattggctggaaacgctgcacgtgataacaagaagagtagaatcattccgaggcatgttctgttagccataaggaacgatgaagaattgggaaaattactttctggtgttacaattgctcacggtggtgttcttcccaacattaacccagtcttgttgcctaaaagatctgataaagcagaagcaaaagaggggaaatctccagcaaaggctgccaagtctccaagaaaacctgttgctgcctagatttgatctatgtttcagtatttagtgttatctatttcggtattatgtttgtgttatgtatttagttgttactgatttagagttgcttttgggattaagtatgttagtgtttagggtttattgtgttttatcagcattctgtgtattgctactttaatcatcatttgattttggagcctatcgattgcggccgaggtgtaatttgttttttccatatgattagttaataagaagctgaaatgtgttgcaa

SEQ ID NO: 11076 - DNA, 800 bp, Carpinus betulus
aagagcgacccgacttatcccattccatcatcttcccccaattttctcgtttttgccctaagacaaatcattcattcatcaatttcggttatttttccggtccagctgcgagggcagtgtctagcggtgtgtgattgttagtgtttcgatggagaagaagggtgccggaggaagaagaggtgtggggggccgaagaagaagccagtttcgcggtccgtaaaggccggtttgcagtttcccgtagggaggataggccggttcctgaagaaagggaggtacgcgcaacgtgttggctctggtgctccggtttacttggccgccgtgctcgagtacctagctgctgaagtgctggaattggctggaaatgcagctcgtgacaacaagaagaacaggataattccaaggcatgttctgttggcagtgaggaacgatgaagagcttgggaagttgcttgcaggtgttaccattgctcatggtggtgtccttccaaacatcaaccctattctattgcccaagaagacagcggagaaggctgccaaagagcccaagtctccagccagggccaccaagtctccgaagaaggcttagctttctctagccaatcaagttgcttctttttcatttgtatgtaatttgggtgtaggttgtatgtgcagtggaaaattgatgaatttgaaaaatcttgtgacttctttgttaggattttctctgaaattaatggatgaaatcacttgtttcattacttagatttaatgatcaatagctgcatatcatttatgcttgtttgatttttagaaact

SEQ ID NO: 11077 - DNA, 887 bp, Lactuca sativa
acggattacaggttaaccacaatccaacggctgatactaacccattttacaattccaaacccctcacacaccacatataaacaatgccgacgctactcctcaagcaccatcatctacaatcaactcactcagtcatttctgaaaagcaatacacataaacacatggagggaaccggaaaagtgaagaagggtgccgctggaaggaagggtggtccgaggaagaagtcggtcactcgttcagtcaaagccggtcttcagttccccgtcggtagaatcggtcgttttctgaagaatggacgttatgctaagcgtgttggtaccggtgctccggtgtaccttgctgccgttctcgaataccttgctgcggaagtattagagttagcagggaatgcggccagggacaacaagaagcacagaataatcccaagacatttacttttggcagttaggaacgatgaggaacttggaaaattgttggccggagtaacaattgctcatggtggtgttctaccgaatatcaacccgattcttttgcccaagaagactgctgctgccgcagagccaaaatctccttctaaggctgccaagtcacctaagaaagctgcaaaagcctagtttaatgttacatttaatcctatgggttttaatctgttaatcgtttgtggttgattgttcgttaaagagcttagattagtttttgttaatcagatgtatccaattcgaatgaatgaaacagcttgtttcttaattttatggacttttggagtaacttatgtttgtcgtttttggtatcgtttcaattgatattcacatggtctgtataatcgtgcggggggccttgggttggtcttttccatttgcatgggctaaatatatgtaagcgatta

SEQ ID NO: 11078 - DNA, 649 bp, Olea europaea
ccaaattaattttaaatattcttaattgttgaattttaacctaatttcatggagtccgctgcaacaaaagtgaagaagggtgctggaggaaggaagggcggcggcccaaagaagaagcctgtgtcccgttccgtcaaagccggcctacagtttccggtcggtagaattggacgttacttgaaaaagggtcgctacgcccagagggtgggtactggagccccggtttacatggccgcagttcttgaatatcttgctgctgaggttttggagttggcgggaaatgcagcacgggacaacaagaagaacagaattatcccgaggcatgtgttattggctgtgaggaatgatgaagagcttgggaaattgctgcaaggagtgaccattgctcatggtggagtgcttccgaacattaacccagtattgttgccaaagaagactggtgcagataaggaaccaaaatcaccctcaaaggctaccaagtcccccaagaaggctgctgcttagttcaatatgaattcacttgataaaatattttaccatgtagctagcttagccttagaatgagtttctagaaaaaatgggttgtagagaaaagataaggttgtaatttgtagccctatttctttgaatccatgaattaaaattgaaa

SEQ ID NO: 11079 - DNA, 964 bp, Lactuca sativa
tcatcgaatccgctcatttcacactgtttattcatcgctaaaagaaaaatggaaggcgcagcaaagtcaaagaagggtgccggaggaagaaaggccggtggcccaaggaagaaggcggttacccgctccgtcaaggccggacttcagtttcccgtcggtagaattgggcgttttctgaagaaaggacgttatgcgcagcgtgttggaagcggtgctccggtttacctcgccgctgttcttgaataccttgctgctgaagtgctagagttagctggaaatgcttctagggacaacaagaagaccagaattattccaaggcatcttctgttggccattagaaatgatgaagagcttgggaaattattgggtggagttacgatcgctcatggtggtgttcttccaaatatcaacccaattctattgccaaagaagaccgctgctaaggagccttcaactccatctaaagctgctaaatctccaaaaaaagccaagaaggctgagtaaattatgacgctagaatttgtagttcttttttggtttaagatcatgttacaagtttgtatgatgatgttgatcaatatttaatgaatgaaacgacttgtttcttataattgtcgcgtcatggatcttcttattatttgactgtctttcaattacgtttagttgagatttaatgtagttttggtcgatggtgttgtgttccagccttcgctacagtagccacctttgccgacaaaatgagaccttgggtggcgaagtcttccaaccctatgatgaacacagttaatgaaaacaactacaatggtggctgccaagactataaatagaggcttcattcttcagttgtaagcatcccaaacacagagaaatagatagtataacacttagagtgagagtgttagtgagagggttggttttttgtaatagttgagtgtgagagttgctcctcctattgtaattctat

SEQ ID NO: 11080 - DNA, 888 bp, Allium cepa
ggggatcgtaatcgtatttcccccaaatcaaatccggaaaccctagctttaatttagaagttcaaactcaaagcaatggaggcaggcggaaaaatgaagaaaggagctggaggtagaaagggaccgagcggacccaggaagaagtccgtcacaagatcggtcaaagctggtcttcagttccccgtaggccgtatcggcagatacttgaagaagggccgatacgctcaacgtgtcggtaccggagcgcctgtttaccttgccgccgttctggaatatctagcagcggaggttctagagctggctggaaatgcagcgaaagacaacaagaagaatcgaatcattccaagacatgttcttcttgcaataagaaacgatgaggagttgggaaaattgcttggtggagtgaccattgcgcatggtggagtgttgccaaatataaaccctgtccttttgcctaagaagactgctgctaaggaatccgagactccaaaatcaccgaagaagactgctgccaaaactcccaaaaaggctgtttaactgattttgatagtagatgccaatatctgtgtttatataatgaagtttggcggttgaagttttcgtgaaattataatgtcaactgagattgtgtccaagttctgacgtgatatggatttagacttgttttctctcttgcttttacgatccgtagagttgcgtgaatttggtttaaagtgataatcagtaaaactaaactgactttaagaattagtattatttcaaaaatatttatttcgaatgtggttgagatatacaaattttggttttatgttaatttttcacgtccacaaaattagattgtggaaacattaactgatgaagtaatgagatttatgatgcatcggttgg

SEQ ID NO: 11081 - DNA, 758 bp, Secale cereale
gactaccaaatcccctcctctcccgcgtcccgacgagcagcagccgccagacatggacgcctcagccaccggagccggagcgaagggcaagaagggcgcggcggggcgcaaggccggcggccccaggaagaagtcggtgacgcggtccgtcaaggccgggctccagttccccgtcggccgcatcgggcggtacctcaagaatggccggtacgcgaagcgcgtcggcacgggcgcccccgtctacctcgccgccgtcctcgagtacctggccgcggagctgctggagctggccgggaacgccgccaaggacaacaagaagtcccgcatcgtgcccaggcacctgctgctggccgtgaggaacgaccaggagctcgggaggctgctggccggcgtgaccatcgcgcacggcggcgtgctgcccaacatcaacccggtgctgctccccaagaggacggcggagaaggagcccaaggagggcaagtcgcccaagaaggccaccaagtccccaaagaaggccgacaagaaggcttagagagagacgctcaaacgcgcatcgattagcttgtactagtgcttagtagatctttgctgccaagaaaagacaattcagaaatctctctgatttatccaaattgtttgctcagtcgcctgtacatcgattagcttagtcgtcgtgctctgtagtaacagtgattgctgtgtcgatgtagatctgtgctgcgaagaggaaaatttcagaaatctctctgattaaagca

SEQ ID NO: 11082 - DNA, 606 bp, Fagus grandifolia
tctcccattcataatctctgccctaaaatctcaatatttcatacctttctttcaagcccagtaggtgtttgtgtttttgtctgttagaaaatggagaagaaaggagctgcaggaagaaaaggtggaggcccaaagaagaagccagtttcccggtccgtgaaagccggtttgcaatttccagtcggaagaataggccggttcctcaagaaagggaggtacgcacaacgtgtcggaagcggtgcccctgtttacatggctgccgtgcttgaataccttgcagctgaagtgttggagttggctggaaatgcagcacgtgacaacaagaaaaacaggattattccaaggcatgtgttgcttgctgtgaggaacgatgaggagcttggaaaattgcttgctggtgttactattgctcatggtggtgttcttcccaatatcaatccagtgcttttgcctaagaagactgcttccaaggagcccaaggttccttccaaggctaccaaatcacccaagaaggcttagtttagtctatagcctaatttagatgcttgttttttcaatttgtatgtaacttgggtttaggatcttgtttgtatttttttttttttt

SEQ ID NO: 11083 - DNA, 458 bp, Centaurea maculosa
gccatttctgcaaatagccttcagaaattatcagagagagatggacaccaccggaaaagtgaagaaaggagctgccggaaggaaggccggaggtccgaggaagaagtcggtcactcgttcggtcaaagccggtcttcagtttccggtcggtagaatcggccgttacctgaagaaagggcgttacgctcagagagttggaaccggtgctccggtgtacctcgccgccgttctcgagtaccttgccgcagaagtgttggaattggctggaaatgcagcaagagacaacaaaaaagaacagaatcatcccaaggcatgtgttgttagccatcaggaacgatgaggagctcggaaaattgttggctggagtaacaattgctcatggaggcgttcttccaaacatcaaccctattttgttgcccaagaagactgctaccaaggagcctaaatctccatccaaa

SEQ ID NO: 11084 - DNA, 713 bp, Chrysanthemum coronarium
cggggatggaaacaggaggaaagaaaaagggagcagcaggaaggaaagtaggaggaggatcagggataaggaagaagtcagtgacgagatctgtgaaagctggccttcagtttcctgttgggaggattggaaggtatttgaagaagggtaggtatgccaaacgtgtcgggactggtgctcctgtttatcttgctgctgttcttgagtatcttgctgctgaggttttggagctagctggaaatgctgctagggacaacaagaagacaaggatcataccgagacatgttttgttggcgataaggaatgatgaggagcttggaaagcttttgtctggtgtgacgattgctcacggtggtgttcttccaaacattaacccggttttgttgcccaagaagaatctcgcaaaggaacctgctaccaagtctccatcgaaagctaccaagtcaccaaagaagaaagctgctgagaaagctgatgcttagtcgttgaagaaatgtgacacttgttgtatgtactcaacttatttggctatgtaggttgactttaattttatcctgttttagggtgtaggagaattatatgcttgctttgtttaagttaggacctaggtatgaaaaagaatctctctttttcgttatcagaattgttattttccgaatgtaagaaatgtgtaagcatcaatcttaatgggtactacatttgcttgcgaaaaa

SEQ ID NO: 11085 - DNA, 554 bp, Allium cepa
ttctccccaaatcaattcaggaaaccctaggttcaattcagaagtccaaactcgaagcaatggaggcaggcggaaaaatgaagaagggagctgcaggtagaaagggaccaagcggacccaggaagaagtccgtcaccagatcgatcaaagccggtcttcaattccccgtcggccgtattggccgatacttgaagaagggccggtacgctcagcgtgttggcaccggagctcccgtttaccttgcggccgttcttgaatatttagcagcagaggtcctagagcttgctggaaatgcagcgaaagataacaagaagaaccgaatcattccaaggcacgttcttcttgcaataaggaacgatgaagagttgggaaaactgttaggtggagtgacaattgcgcatggtggagtgttgccgaacatcaaccctgtccttttgcctaagaagactgccgctaaggaatctgagaccccaaaatcaccaaagaagactgctggcaaaacgcccaaaaaggctgcttaattgattttgaggtctcagattccttagcggcag

SEQ ID NO: 11086 - DNA, 735 bp, Allium cepa
tagttacggggtacggcctagttgcgggggatcataatcgtatttgccccaaattaaacccggaaaccctagctttaatttagaagttcaaactcaaagcaatggaggcaggcggaaaagtgaagaaaggagctggaggtagaaagggaccgagcggacccaggaagaagtccgtcacaagatcgatcaaagctggtcttcagttccccgtaggccgtattggccgatacttgaagaagggtcgatacgctcaacgtgtcggtaccggagcgcctgtttaccttgccgccgttctggaatatctagcagcggaggttctagagctggctggaaatgcagcgaaagacaacaagaagaatcgaatcattccaagacatgttcttcttgcaataagaaacgacgaggagttgggaaaattgcttggtggagtgaccattgcgcatggtggagtgttgccaaatataaaccctgtccttttgcctaagaagactgctgctaaggaatccgagactccaaaatcacctaagaagactgctgccaaaactcccaaaaaggctgtttaactgatttttatggtagatgccaattgctgtgtttatataatgaagtttgtctgattttcttttggaagttcggtggtttgtagttttcttgacattacaatgtcaattgatattgtattaagcttcttttgcttaatcactaaatcctattcctggtttaatgcttgttggt

SEQ ID NO: 11087 - DNA, 586 bp, Allium cepa
caatttcgtatcttcccccaaatctggaaaagaaaccctaatttcaagttaacatccggaattcgaatcaatggaaactggtggaaaaatgaagaaaggagccggaggtagaaaaggaccaagcggccccaggaagaagtcagtcacaaggtcaattaaagccgggcttcaattccccgtcggccgtatcgggcgatacttgaagaaaggacgatacgctcaacgtgtcggtaccggagctcctgtctacctcgccgccgtccttgaatacctagcagccgaggtattggaacttgctggaaatgcagcaaaagacaacaagaagaacagaatcatcccaagacacgttcttcttgcaataagaaacgatgaggagttgggaaaattgctgggtggagtgaccattgctcatggtggtgtattgcctaatatcaaccctgtgcttttgccgaagaagactgcttccaaggaatccgacgctcctaaatcaccaaagaaggctgctgcaaaatcacctaaaaagactgcttaagtggtgttgttggtagatgttaaattatgttgttttatgcgatttggtttaagg

SEQ ID NO: 11088 - DNA, 546 bp, Allium cepa
cctagctttaatttagaagtccaaactcaaagcaatggaggcaggcggaaaaatgaagaaaggagctggaggtagaaagggaccgagcggacccaggaagaagtccgtcacaagatcggtcaaagctggtcttcagttccccgtaggacgtatcggcagatacttgaagaagggccgatacgctcaacgtgtcggtaccggagcgcctgtttaccttgccgccgttctggaatatctagcagcggaggttctagagctggctggaaatgcagcgaaagacaacaagaagaatcgaatcattccaagacatgttcttcttgcaataagaaacgatgaggagttgggaaaattgcttggtggagtgaccattgcgcacggtggagtgttgccaaatataaaccctgtccttttgcctaagaagactgctgctaaggaatccgagactccaaaatcacctaagaagactgctgccaaaactcccaaaaaggctgtttaactgattttttatggtagatgtcaattgctgtgtttatataatgaagtttg

SEQ ID NO: 11089 - DNA, 1529 bp, Zea mays
tgtccttccatcgatgagtgcacgacgcctctgcctgtcccaggcacaacaagacactcgtagtagaacggacgtgcctttgcctgtagccccacattggacaaaagatatctcccacattaattaatgttaatgatggcatgatcggacagaggagaacgtactgtactcctcggccgccactcataatagtacaagcttattgcccttaactaatgtatatcttacacaaacacaagcaaagcaaaccgagctattaacggacgagaaacacccaacgccgtggaggtgtggaggcgcctagtattatactagtagcgggtgtggtatctggcctgggcctgggcctggatcttgggtcccctcaccgtgttagtacccaggcccgaccttattgacgagcgcgagcgcgttgctggtgacctgcgcgacctcgacgaccttgccccggatggcggcgcgcgtgccggcgtcgacggcgcgggacgagaggccgtcgaggcaggtgtcctcgtcggtgagcgcggcgctgcaccaggtctgcacgttgctgaggtgccacctgaacgccggcgtccccgcgcggcccatcccggcgccgcccatctcctgcgccgcgtcgcggaggtggcccacgctgtccgccagattgtccaggcagtctcgcacgggacctgccgacgccgaccccgaccccgaccccgaccccttcttcgcgcctttgccgttgctggcgccgcacaggcggcccacgtacgccgacgcggcgcgcgcgcggtccgcgctcaccgacagcgcggcgcgcgccagctcccgcgggctccgcggcggcggcgacccgccgtacgacgccaggctctgctcgcacaccgacgggtactgcgtcgtgcggcacgacttgcggacgaagtcgctggctgccggcgacgcggcggacacgagccccgctgcggcggcggcgagcagcagcaggaggggggcagcggcagcggcagcaacactgcgcgggcgagccatgattgattgtcttggtgagctgagctgagctggtgcggtgtgcggggtgtgtgtgctgtgctgtgcagcagggcaggcaggtcacggagtcacagtggagagggtggtggctgcttcgcttgaatgattgaatgcctattgtaatcacccacctagctgtgtctgcttatatagggagatttggaatatgtgctgttttcggagatgatttttttagaaagcaaaaaaaaatccggaggcaggcagtagtgtatgctatatttctctcattttgcattattgcttttgggcttcgaacatcaaccatgcatttggtgatctgatctgattttatgtgaatggaaacatttctagaatggtcctcgtcttgggtcagaattaaatacgacgccaaccaccaagctataacttcgtcacgtaagagaaattagttaaatgtaggagcgactcgtatatttgtcaaatgataccacctaggttcacaaactttaaaaatatatttctagatcttg

SEQ ID NO: 11090 - DNA, 1159 bp, Fraxinus spp
acacaatttagtcatacaatctctgtaaattcagtctgttttagtgcttaaaagggaaatggcgaagcatattgaggttggagaccctgaatttacagcaaaagactatcaagacccacctccagcaccgttgattgatcctgaagaactgactaaatggtcattttacagggctatcattgctgaattcgtagctactttactgttcttatacattactgttttgactgtgattgggtacaagagccagagcgccaccgatgaatgcggcggcgttggcattttgggggattgcttgggcctttggtggcatgatttttgtacttgtttactgcactgctggtatttccggagggcacattaacccggcagtgactttcgggttgtttttagcccgaaaggtttcattggttcgggcaattatgtacatggtggctcagtgtttaggggccatttgtgggtgtggattggtgaagttattccagaaggcttactatgttagatacggtggtggcgccaatggacttgcagttggatatagcacaggcaccggattggcggccgagatcatcggcacttttgtccttgtttacactgttttctcggccacggaccctaaaagaagtgccagagactcccatgttccggtattggcaccactgcctattggatttgctgtgttcatggttcatttggctacaattccgatcaccggcaccggtatcaaccctgcccgaagtttgggagctgcagtgatgtacggcaaggataaggcctgggacgatcaatggatcttctgggcaggacctttcattggggcagccattgctgcattctaccatcagtacattcttagagcaggtgcagttaaagctctaggatcattcaggagtagtgcttctgcttattaaaatcacttgtgggagaatccaattggggaaatcaacccatggagtaaatgttgtgtggtcttggaaattggcacttcttttttaagtgtgcctaaagttctctttttccttctgtttgtcaaggtctttttaacttataagcatcaaattaagaatttactttcaagtctgcagcttcaaattcaaatggtattactatttatgcaatgtactgttcaaggcaccaatccaatggatatattagtttt

SEQ ID NO: 11091 - DNA, 2358 bp, Capsicum annuum
ctcttcactaaaacttcaccacacattcaaatatcaaacacttttcaacattattctaaacttctagtttatttagccattaaagaaagagcaaaaaatgggcaaggacattgaagttggcactgaatatgcaccaaaggactaccaagacccacctccagcaccattaattgaccctgaggagctaggaaaatggtcattttatagagccattattgctgaatttatagcaactttgttattcctctatattacggtcctcactgtaattggatacaagagtcagagtgacattgaccataacggtgtacaatgtggtggcgttggcattcttggaattgcttgggctttttggggtatgatattcgtacttgtttattgcactgctcgtatttctggtggacacattaacccagctgtcacgtttggtcttttcttggccagaaaagtgtcgttggttcgggccattatgtacattgtggctcagtgtttaggagccatttgtggttgtggcttttcaaaaggataatacgttgaatgatggatatagcacgggtactggtttgggtcctgagattataggcactttcgttcttgtttacaccgtatttacggctactgatcttaagagaaacgccagagactctcatgttcctgtattggcaccactcccaattggattcgcggtgtttatggttcacttagcaacaattcccgttactggaactggtattaaccctgctaggagttttggggctgctgttatttaaggcaaagacagagcctgggatgatcaatggatattttgggttggaccctttattggtgctgcaatagctgcattttaccatcagtttatattgagggctggagcagttaaagcacttggttcattcagaagcaatgcctaatcatcaagaatcaatagttgagagacctacgaaaaatggagtcaaattaaagaacggtaaaaagttccctcttaaaatgggatatgatacattccattcgagaaattgtatacaagtatttgggagaatcctctttaaattgtttttgcttatgttattacttattagatagagtgtggtctttggcagtttaggcacttgttttaactgtgccaaaattagtcactgcagcttgttttcttgtttgcctatgcttgttttgagtaccaaaataatggaatgagcaatgttatggtcctttttaaggcctgctgcatttatcttttgttggaaattgcacttaaactttaacttgaacatatttcatttcgtaaaatgaggtaaaattgatttctttagtaagtatgaattacttcatgtattgatattcgaatgacaaatcaatacatgtcatgtcgtggatctatgaacccgtaatgagagagctcattagatcatcgatcttccaagtctataaatatacggctaattccctttattgttcttcaatcttgacatcactaaaattgttatatgatgatagaacagaatgaggaatacttgacctatcaaacgtcagttggaacactacctctgcactgatgatcagaacaacttagcatcatataagccttgaaaatatcctctgacagaaatgcaaagtaagtttgcatacaatagacctttgtagtcggacacttcatccccgatcctctgtgcatagtgggagttttagtgcaacagattgcccttcttgcaccagaaaagttcaaatcattcttgaaggctatgtaaacaacattagtgcatagggatgtcttgactcggaactttgaagacatggttcttattgaggacgagagtattattatgaatcacattcaactcaatgtggataccaaggtcacacaaatagtaattgcctgacaagagctattgagccgagaacaagcaatagcacgtgggttaatttgggatcgaggttgagtagtgcacatgagaacggttgcatcaaaagggtgtagtggtacgtaattcagggattatgcatatcgacaagaaattgtttgttcctctggacttctttctagagtcaaaacttctcatccttatttttatctctatcattagttactcgctatttcaatagcttccattataattaaatagtttaagtgttgagaattcgagtttattacataaagttaaaatgatcttctgaacccttatactatgtcggttttgtaagttggacacttttacttatatgtttgtcatctggaccctttaaccattaaaaaataacattttaaacactttttcggtgagtgtgttacactcgctccacgtcagctgccacatctgtcacgtcattttccacatcatttttatatataaaaaatattaa

SEQ ID NO: 11092 - DNA, 1139 bp, Fraxinus spp
aatctctgtaaattcagtgtgttttagtgcttaaaagggaaaaatggcgaagagtattgaggttggagaccctgaatttacagcaaaggactatcaagacccacctccagcaccgttgattgatcctgaagaactgactaaatggtcattttacagggctatcattgctgaattcatagctactttactgttcttatacattaccgttttgactgtgattgggtacaagagccagagcgccaccgatgaatgcggcggcgttggcattttggggattgcttgggccttttgtggcatgatttttgtacttgtttactgcactgctggtatttccggagggcacattaacccggcagtgactttcgggtgtttttagcccgaaaggtttcattggtcggccattatgtcatggtggctcagtgtttaggggccatttgtgggtgtggattggtgaaggcattccagagggcttactatgttagatacggtggtggtgccaatggacttgaagttggatatagcacaggaaccggattggcggccgagatcatcggcacttttgtccttgttacactgttttctcggccacggaccctaaaagaagtgccagagactcccatgttccggtattggcaccactgcctattggatttgttgtgttcatggttcatttggctacaattccgatcaccggcaccggcatcaaccctgcccgaagttttggagctgcagtgatctatggcaaggataaggcctgggacgatcaatggatcttctgggcgggacctttcattggggcagccattgctgcattctaccatcagtacattcttagagcaggtgcagttaaagctctaggatcattcaggagtagtgcttctgcttattaaaatcacttgtgggagaatccaactggggaaatcaacccatggagtaaatgttgtgtggtcttggaaattggcacttctttttttaagtgtgcctaaagttgtctcttttttcttatcttctgtttgtcaaggtctttttaacttataagcatcaaattaataattgctttcaagtctgcagcttcaaatggtattactatttatgcaatgtactgttcaaggcaccaatccaatggatatattagtttt

SEQ ID NO: 11093 - DNA, 1096 bp, Flaveria ramosissima
aaagaaaccaatggccaaagacattgaggttgcggaatacggtgcgaaagactaccaagacccaccaccagccgagctctttgacgcagaggagctaaccaaatggtcattctacagagccgttattgcggagtttatagccacctcttgttcctctacatcaccgtcttgaccgtcatcggctacaagtcccaaaccgaccccgaccacagcgctgatcaatgcggtggcgtcggcattctcggcatcgcttgggccttcggggcatgatattcgtgctcgtgtattgcactgctggtatctccggtggacacattaaccctgcggttacgtttgggctgtttttggctaggaaggtgacactccccagggcggttatgtacatggtggctcagtgcttgggtgcggtctgtgggtgtggtctggttaaggctttccagaagtcttactacaatgcttatggtggtggtgctaatgagcttgcagatggctacagtaaaggcactggtttgggtgcggagatcattggtacgtttgtgcttgtgtacaccgtcttctccgccactgatcccaagagaaatgcacgcgattctcatgtccccgtgttggcacctctccctatcggattcgcggtattcatggttcacttggccaccatcccgatcaccggcaccggaatcaaccccgctcgtagttttggtgctgcggtcatgtacggaaaagaaaaggcttgggatgatcaatggttattctgggtgggaccgatgatcggagctgcgatcgcggccttctaccaccagtacgtgttgagagcaggggcagtcaaagctcttggatcattcaggagcaatgcctaagaagaagcatagcatgaatgtatgatgaagtgtttttcatgtggctttgaagaaattgtacaaatttggcttaaatgtatttggtatttaagggtgcttagttttttaatgtgcccaatatggtcctgcttccgagtgcttaagcttctttttttctaatgtccattttgttcctcttgttttgtttgtatttggtcaaagttcaaagggtgtaatatttgctacccaaataataatat

SEQ ID NO: 11094 - DNA, 1158 bp, Ambrosia trifida
actaaaagactatacttactcttaactaatattatacgacaatgggcaaagatgttgaggttggcgagcatgagtatggagcaagagattaccaagaccctccaccagctgacctcttcgacgcggaggaacttaccaaattggtctttttattagagccattattgctgaattcgtcgctaccctcctttcctttacatcactgtgttgactgtcatcgggtacaagtcccaaaccgaccctagccatagtgctgaccaatgcggtggtgttggcattcttggcattgcttgggcctttggtggcatgatctttgtcctcgtctattgcactgctggcatctcgggtggacacattaaccccgcggtgacatttgggctatttttggctagaaaggtgacactccctagggcgttcatgtacatcgtggctcagtgcttgggtgccgtatgtgggtgtggtctagttaaagctttccaaaagacttactaccatacttatggtggtggtgccaacgagctcgcagatggctatagtaaaggcaccggcttgggtgctgaaatcattggcacatttgtccttgtttacaccgtcttctctgccactgaccccaagagaaatgcacgagattctcatgtcccagtattggcacctctccctatcggatttgccgtattcatggttcacttggccaccatcccaatcactggcactggaatcaacccggctcgtagttttggtgcggccgtcatgtacggaaaagacaaagcttgggatgatcaatggttattctgggtgggaccgatgatcggagccgccatcgctgccttctaccaccagtttgtattgagagcaggcgcagtcaaagctcttggatcctctaggagcatataagtgcttttggaagaaattgtacaaatttgtgtgttgtttaatgtgtgtgaatggttgtcttggggctacgttggtttttaacgtgttcctataatatttttaacgtttaatccttttgtatttttctgttttcacttcccttttgtttgtggtcaaatttactaaattagtaaattgattgaatgtagtgtactttatcgactaatgaaaattccaattctttaataacttaaccaacctaaaattaacctttttacaacttaa

SEQ ID NO: 11095 - DNA, 995 bp, Flaveria ramosissima
aggactcacacaaacacatacacacaccaagcttttatagaacaaaatgggcaaagacattgaagttgccagtggccatgagtacggcggaagagactaccaagacccgccccggcggacctcttcgacgctgaggagctgaccaaatggtcgttttaccgagccatcatcgcggagttcgtcgccaccctcttgtttctttacattaccgtcttgaccgttatcggctacaagtcccaaaccgaccccgcccacagccccgaccaatgtggcggtgtcggcattcttggcatcgcgtgggccttcggtggcatgatcttcgtcctcgtctattgcaccgccggcatctcaggtggacacattaaccctgcggtgacattcgggttgtttttggctaggaaagtgacgctcccgagggcgttcatgtacatcgtggctcaatgcttgggcgcggtatgtggttgcggtctggttaaagcgttccaaaagacttactacaacacttatggtggtggcgccaatgagctcgcggagggctacagtaaaggcaccggcttgggtgctgaaatcatcggcacatttgttcttgtctacactgtcttctccgccactgatcccaagagaaatgcacgagattcccacgtccccgtattggcacctctccctatcggatttgcggtattcatggttcacttggccaccatcccgatcaccgggaccgggatcaacccggctcgtagctttggtgccgcggtcatgtatggaaaagacaaagcctgggatgatcaatggttgttctgggtgggaccgatgatcggggccgccatcgccgccttctaccaccagtatgtactgagggcaggtgcagtcaaagctcttggatcccaacggagcaatgcttaagctatgagtgaaataatctgtacaaatttgttaatggagtttactttgaagtcctttggttatctttgaatgtcactttagtcccttttgtt

SEQ ID NO: 11096 - DNA, 1136 bp, Flaveria ramosissima
cttcaacacaacatacactcacaacaagacttcggttaaaggaaaccaaactaggccaaagaacattgaggtgcggaatacggtgcgaagactaccaagaccaccaccagccgagctctttgacgcagaggagctaaccaaatggtcattctacagagccgttattgcggagtttatagcaaccctcttgttcctctacatcaccgtcttgaccgtcatcggctacaagtcccaaaccgaccccgaccacagcgctgatcaatgcggtggcgtaggcattctcggcatcgcttgggccttcggtggcatgatattcgtgctcgtgtattgcaccgctggtatctcgggtggacacattaaccctgcggttacttttgggctgtttttggctaggaaggtgaccctccccagggcggttatgtacatggtggctcagtgcttgggtgcggtctgtgggtgtggtctggttaaggctttccagaagtcttactacaatgcttatggtggtggtgccaacgagctcgcagatggctacagtaaaggcactggattgggtggcggagatcattggcacatttgtgcttgtgtacaccgtcttctccgccactgaccccaagagaaatgcacgtgattctcatgtccccgtgttggcacctctgcctatcggattcgcggtattcatggttcacttggccaccatcccaatcacgggcaccggaattaaccctgctcgtagttttggtgccgcggtcatgtacggaaaaggaaaaggcctgggatgatcaatggttattctgggtgggaccgatgatcggagctgcgattgcggccttctaccaccagtacgtgttgagagcaggggcggtcaaagctcttggatccttcaggagcaatgcctaaggagcatagcatgaatgttgcagtatttttcatgtggcttcgaagaaattgtacaaatttggcttaaatgtatttggtatttaagggcgcttagtttttaatgtgcccaatatcgtcctgcttccgagtgcttaagcttctttttaatttccattttgttcctcttgttttcttgtattggtcaaacttcaaagggtgtaatatttgctacccaaataataatatcagaggctttt

SEQ ID NO: 11097 - DNA, 1101 bp, Rosmarinus officinalis
caagaagatgttcgcgtttacatattcaaaaggattcttgtgcctaatatctctctctctacacatctccaattctctccctccgcagatgacgaaggagatggcggagcacggctcctacggggcgaaggactaccacgatcctccaccggctccactgatcgatgcagaggagctgacgaaatggtcgttctacagagctttgattgctgagtttatcgcaactctgctgttcctctacatcacagtgctcacggtgatcgggtacaagagccagtcggcggcggacgagtgcggcggcgtcggaattctcggcattgcatgggccttcggcggcatgattttcatcctcgtctactgcaccgctggaatctccggtggtcacattaacccggctgtgacattcgggctactcttggcccgaaaagtgtcgttgattcgggccgtgatgtacatggtatctcaatgtttgggggccatttgcggagtcgggctggtgaaggccttccaaagctcatactacaaaaagtacggcggcggcgccaacgagctcagcctcggctacagcaccggagtcgggctcggcgcggagatcatcggcaccttcgtcctcgtctacaccgtcttctccgccaccgatcccaagaggaacgcaagagattctcacgttccggtgttggcgcctctcccgattgggtttgcagtgttcatggttcatctggcgacgatcccgatcaccggcaccggcatcaaccctgctcggagtcttggagctgcagtcatatacaatcaggacaaggcttgggatgatcattggatattctgggtggggcccttcattggtgcagccattgcagctttctaccatcagttcatattgagggcaggagcagctaaagcccttggctcgttcaggagcagtacttcccaccatgtttaattattttaatttctatgatgaattgtcaggaaaagagaaaattgctgtcttctttttcattttaatgacttcacgcttttcgagcaggaaatggaacaagagaaatatttatcattttcatgttaattattaataatatcccttttctttttatattaaag

SEQ ID NO: 11098 - DNA, 1176 bp, Tripterygium wilfordii
cccaccactcaattcactactcagcagcagagaagccatggccaaggacattgaagcttcaggattccaataccaaggactaatcaagacccaccaccagcacctctaattgacgctgaggagctcacccaatggtcattatacagagccgtaatcgccgagttcatagccacactcttattcttgtacataactgttttaacagtgattggctacaagagccaaatagataacgccgacccgtgcggcggcgttggaatcctcggcatcgcatgggcgttcggtggcatgatcttcgtccttgtctactgtcaccgccggaatctcaggaggccatattaacccggcggtgacgtttgggcttttcttggcgaggaaggtgtcactgatccgggcaagtattgtacatggcggcccagtgtttgggagccatatgcggatgtgggcttgtgaaggctttcgagaaggcctactacaccagatacggtggtggagctaacgagctcgctgatgggtacagcaccggcactggattgggtgcagagatcattggcacttttgttcttgtttacactgtcttctccgctactgaccccaagaggaacgcaagagactcacatattcctgtattggcaccacttccaattgggtttgctgtattcatggtgcatttggccacaattcccatcactggcactggtattaaccctgcaaggagttttggagctgcagtgatatacaacaatgacaaagcttgggatgaccaatggttgttctgggttggacccttcattggtgctgcaatcgctgcaatctatcaccagttcatcttgagagctggtgcaattaaggcccttggttccttcaggagctcctcctccaacatgtgaatttgagaatatgcttcaccagctcttccattgaccatttgaaatcaaataatcaatggtgttatggtggaaggacttgagttgtattttgtatcaaggctttgtatattaatgttagtggttggatgtcaatggtatcacctttgtgtgataggcactcgttttatttgtgcctaatgttgttatttgctatgtttgcttcttaattaaagatctcatcccaattgatatgtgagagtagattcaatgtttggaggtttactgtggaggaataaattttagaaaa

SEQ ID NO: 11099 - DNA, 1272 bp, Panax ginseng
gttaaagttggagtagcacatgtgggtgtggatctgagtggtgtcttgaaccccgacattagtgatcctgaaggagtgaacagcccagtcagatccaaacactccactatttctctctaaaccttcttctaaatcactagaaaaatttgtgtgcaaaaacagtactgtatattttttttatatagtgttgttgtgtagttatgggaaaggacggagaagtaacggagcagagtgagttctcagccaaggactaccattgatccgccaccggcagcctttatcggcaccgatgagctaaccaaatggtcactttacagggctgtccattgctgagttcatagccaccctcctcttcctttatatcactgtcttgacggtcatcggctacaagagccagtcagccaccgatgagtgtggcggcgttggcctcctcggcatcgcctgggcctttggtggcatgatcttcgtccttgtttactgcaccgccggtatctctggaggacacattaaccctgcggtgacgttcgggttgttcttggcaaggaaagtgtcgctaataagggcggtgtttttacatggtagcacagtgtttgggtgcaatctgtggagtagggttggtgaaggccttccaaaagtcattatataacaggcatggtggtggagccaacgagctggctgatggttacaacaaaggcactggattgggagctgagatcattggcacttttgttcttgtctatacagttttctcagccactgatcctaagaggaatgctagagactcccatgtccctgttttggctccacttcccatcgggttcgcggtgttcatggttcacctagccacaatcccaattactggaaccggtatcaaccctgctaggagctttggagctgcagtcatctacggcaaacagaaggcctgggatgaccaatggatcttctgggttggacctttcattggtgctgccattgctgcattctaccaccagtatattctgagagcagcagcaattaaggctcttggatccttcaggagcaatgcttaattaattatgtttcaacaattacaatggaggacgtacatgcttaatactactgcagcaagcttaattgctctgtcgtcgtctatgaattaattaaggaggatatctatatgttaaaatatggagatcagacaggcaattaaggacggacataaatggagttaattgtagatataataataatcaagatttgttgtaatttctatctgtgttgtatttactttct

SEQ ID NO: 11100 - DNA, 1331 bp, Fagus grandifolia
atactctctggccctccataaatacccctttccactcactcctccatccacatattactactcctttcctttccttctaaaacgtttcctttaattttcacactctcaaactcgtaattaagagcttcaaagcttaagtgagtatgactaaggacgttgaggttgcggagcagggtgagtattctgctaaagactaccatgatccacctccggcgcctttgatcgacgctgaggagctaacccagtggtccttttacagagctcttatagccgagttcattgccactcttcttttcctttacatcacagtactcactgtgattggctacaagagccagagtgacacagccaatcggccccgacgccgcatgtggtggcgtcggcatccttggcattgcttgggcctttggcggcatgatcttcgtccttgtttactgcaccgctggtatctctggaggacatattaacccggctgtgactttcgggttgttcctggcgaggaaggtgtcgctcgttcgagccgtgttgtacatggtcgcacagtgcttgggtgcaatcagtggtgttgggttggtgaaggcgttccaaaagtctcactacaacaggtacggtggtggagccaacgagctagcacttgggtacaacaagggcgttggattgggggctgagatcatcggtacctttgttcttgtctacactgtcttctcagctactgatcctaagaggaacgcaagagactcccatgttcctgtattggcacccctccctattggattcgctgtattcatggttcacttggccacaatcccaatcactggcacgggtatcaacccagctagaagttttggagccgcagtgatctacaaccaagacaaggcctgggatgaccaatggattttctgggttggaccttttattggagctgccattgctgccttctaccatcaattcattcttagagcagcagctattaaggctctaggatccttcagaagcaatgcttaagcttttcatcaattatttcccaaagatggagatgatgtttaccaaaaagaataacaatattgaggagtgctagtctgtctgaggtccttagcaatccctcatggtttgatggaattgtaaagagggccatggaattgtaaataaacgtgcctatgggacaagtagggtgccttttgttgtatccctttctttttctttttttttcatgtatttatgtggtgattgttgtccttgtttatccttaatcatcatcttttgcttttacttttccatgtggtgtcaatcgtgttgtttccacataaaaagctagtaaaatggattgtagt

SEQ ID NO: 11101 - DNA, 869 bp, Ambrosia trifida
gcaaaagactaccaagaccctccaccagctgccctctttgacgccaaggagctaaccaaatggtccttttaccgagccatcattgctgagttcattgccacactcttgttcctttacatcactgtcttgaccgtcattggctacaagtcccaaaccgaccctgaccacagccctgaccaatgcggtggtgtcggtattctcggtatcgcttgggccttcggtggcatgatatttatccttgtttattgcactgctggtatctcaggaggacacattaaccctgcggtcacatttgggttgtttttggctaggaaggtgactctccctagggccttcatgtacatggtggctcaatgcttgggtgcaatctgtggttgtggtttggttaaagcattccaaaagacttactacaacaagtatggtggtggtgccaatgagcttgcagatgggtacagtaagggtaccgggttgggtgcggaaatcattggcacatttgtacttgtgtacaccgtcttctctgccactgaccccaagagaaacgcacgcgattctcatatccccgtgttggcacctctccctatcggattcgctgtattcatggttcacttagccactatcccaatcactggtaccggtatcaaccctgctcgtagttttggtgcagccgtcatgtacggaaagaaaggcatgggatgatcaatggatattctgggttggaccgatgatcggagcagccatagcggcattctaccaccagtttgtgttgagggcatgggcaattaaagctcttggatccttcaggagcaatgcttgagtatgaagcttggtgcatttgagaagaaaatgaattgtacaaaattgctttgttt

SEQ ID NO: 11102 - DNA, 1167 bp, Taraxacum officinale
tggcatcggcggggatcatccagttatccaagcactcactcacactctcactcacacagaaaaagcacacatagctttgagaaatgggcaaagatgttgaggttggtggcggtcatgaatataccgcaaaagattaccaagaccctccgcctgctgccttctttgacgccgaggaactcaccaaatggtctttctacagagccatcattgcggaattcgtcgccaccctcttgttcctttacatcaccgtgttgactgtcatcggctacaaggcccagaccgatcccctccacagcgacgaccagtgcggcggcgtaggaattttaggtatcgcgtgggcctttggtggcatgatcttcgtcctcgtttactgcaccgccggcatctccggaggacacattaaccctgcagttacgtttggactgtttttggctaggaaagtgacattcccacgggcagtcttgtacatcatagctcaatgcttgggtgctatttgtggttgcggtctggtcaaggctttccagaagacatactaccagacttatggcggtggtgctaacgagctcgcagatggatacaataagggcacaggcttgggtgccgaaatcatcggaacatttgttcttgtatacaccgtcttctccgccactgacccaaagagaaatgcacgcgattcccatgtccctgtgttggcacctcttcctatcggatttgctgtgttcatggttcacttggccacaatcccaatcaccggcaccggaatcaaccctgctcgtagttttggtgctgccgtcatgtatggaaaagacaaagcgtgggatgatcaagtgtgtgcagtggatattctgggtgggaccgatgatcggagccgccatcgctgccttctaccacatgttcgtactcagagcagcggctgttaaagctcttggatccttcaggagcaatgcctaattaggcaagagcatgaagtttgcaatatcatccatgtttccaagaaattgtataaatttgtcttttttatttggtatttaaggccgatggtttttcaaggtggtcactatggtctcttgacaatggttttatgtacatttagtcccttttgtttttgttgtaattgtccaaggggtttatttgctacccaaatgttaagataccaaggaaggggtt

SEQ ID NO: 11103 - DNA, 1146 bp, Chelidonium majus
caacagctagctgtttcagaggtgaagaaaaatggggaaagacgttgaaaggaactcatgagcaaggtgggtactcagctaaagactaccatgacccaccaccagctccattcttcgatcttgcagaactcacttcctggtccttttacagggctttaatcgctgagttcgttgctactctcttgtttctctacatttgtgtcttgactgtcatcggttacaagagtcagattgccggcggtgacgaatgtggtggtgtgggtatccttggtatcgcttgggctttcggtggcatgatctttgtcctcgtttactgcaccgccggtatctccggaggacatattaacccagcagtgacctttggactgttcttggcaaggaaggtctcactacttagggcattgggttacatggtggctcagtgtttgggtgcaatctgtggtgttggtctggtgaaggccttccagaaggcttactacgtccgatacggtggtggggccaacgagcttgccgatgggtacagcaagggcaccggattggctgctgagatcatcggaacctttgttcttgtctacaccgtcttctccgccactgatcctaagaggagcgcaagagactcccatgttccggttttggcaccactcccaattggatttgctgtgttcatggttcaccttgcaaccatccccattactggaactggtatcaacccagctaggagttttggagctgctgtgatttacaacaaggagaaggcttgggatgaccagtggatcttctgggttggaccattcattggtgctgccattgctgctttctaccatcagtttatccttagagctggagcaatcaaggctcttggttcattcaggagcagccaacacaattaagttaccatcatcagattcttatggtcaatgtttgtggagaggagatgaagtttgaaaagaaaaataatggaggagagagagaaagaaagatgaatcatggatttgaggatgaggaaagtaatgggaaagtgtagataaatcacttggaaaagggggaggaaattaaatggagggtttcaaatgtgattttctctctcttgttcttgtggtttcaatccttatgtctttggtaatttaaatgtatctaagtgttctg

SEQ ID NO: 11104 - DNA, 1239 bp, Humulus lupulus
gaaacttaccacaaatcaaaacgacttgactctctcactagccttagtagcaaccagctctctttgcttctttcttcgtaggcttttttttttgtgttgagtgttagcagcaatggtgaaggacgttgaagcaggaggacaacatgggtactcggccaaggactaccaggatccaccaccggcaccgttgttcgacgctgaagagcttggtcagtggtccttttacagggctatcattgctgagtttgtggccacgcttttgttcttgtacatcaccattttgacagtcatcggctacaagagccaggttgatccagcgcacagctccgatgcctgtggtggcgtcggaattttgggtattgcttgggccttcggtggcatgatcttcgtcctagtttactgcaccgccggaatctctggaggacacatcaacccagctgtgacgttcggactgttcttggcaaggaaggtgtctttggttcgaaccatcttgtacatagcggctcagtgtttgggagccatctgcggatgtgggctggttaaggctttccagagtgcttactacgacttatacggcggaggagccaactcccttgcccatggatacagcaccggtaccggactagccgctgagataatcggtacctttgttcttgtctacactgtcttctctgctactgaccctaaaagaagcgcaagagattcccatgttcccgtcttggcaccacttccaattgggttcgctgtgttcatggttcaccttgccaccactccccatcactggtactggtatcaacccagctagaagttttggggctgcagtgatttacggcgaggcatggaatggccactggatcttctgggtcggaccattcattggagctgccattgctgctttctaccaccaatttgtattgagagcagccgctgttaaagctcttggatcattcagaagcgctaacaccatgtgatctgggatcaatgtatgagtttttctctcatctgggcaccaatatatgtcgaaaacaaaaagaattacacgttctaaattgtcataatgaggcttttgaacttggtatttatgtatatgattttaatttcaagtatctgtttgtagttttctgtcttggggtctagttttagatgtgccccttttcttcttttccgctttctctcttcttcttcttacgagtgtttgtgtccttgtgagtttcatcaatgaaaaatcaaagttgataa

SEQ ID NO: 11105 - DNA, 945 bp, Platanus occidentalis
tcacagcttttgtagacttctgctctttctctctctctctctcattttgatatggggaaggacgttggtgagcacggctcgttctcggcgaaggactaccacgacccaccaccggcgccgttgatcgacggcgaggaattgaccaagtggtccttctacagggctctcattgctgagttcattgcaacgcttttgtttctctacattactgtgttgacggtgatcgggtacaagagccagactgatccggccaagaacggtgatgaatgtggtggggttgggattctcggcatcgcttgggctttttggtgggatgatcttcattccttgtttactgcaccgccggtatctctggagggcacatcaacccggcggtgacgttcggcttattcctggcgcgtaaggtatctctgatccgagcggtgatgtacatggtggctcagtgcctgggggctatctgcggtgtggggctggtgaaggccttccagaattcgtattacgtccagtacggtggcggggccaacgagcttgcccaaggctacagcaatggcgtggggctggcggccgagataattgggaccttcgtcctcgtctacaccgtcttctccgccactgatccaaagaggaacgccagagattcgcatgtcccggttttggcaccacttcccattgggtttgcggttttcatggttcacctagccacgatcccaatcacgggcaccggtatcaacccagctaggagtcttggagctgctgtcatctacaacaaagaaaaggcctggaatgatcagtggatcttctgggttggccctttcattggtgctgccatagcagctttctaccaccagttcgttctgagagcaggtgccgttaaagctcttgggtccttcaggagcaacccccacgtctaattttctgtcaatctctttgcattgtccaatgttt

SEQ ID NO: 11106 - DNA, 1116 bp, Cleome gynandra
tctctctctctctctctctctctcagaaacagaggacagctctgtgttttctctctctttgaagaacggattaagcgaaagaggacttgcaagagcaatggcgaaggatgtggcggagcaagggtcgttctccggtaaggactaccaagacccaccaccggcgccgctattcgacgcggcggagctggggaaatggtcgttctacagagcactcatagctgaattcatcgcgacgcttctcttcctctacatcaccgtgttgacggtcattggctacaagagccagaccgacacaaccctcaactcaggcgccgatcagtgcggcggcgttggcattctcggcatcgcttgggccttcggcggcatgatcttcatcctcgtctactgcaccgccggtatctctggaggtcacatcaacccggcagtgacggtttgggctgttcttggcgaggaaagtatcgttggtccgagcagtgttgtacattgtggctcagtgccttggagccatttgtggcgtgggtttggtcaaagccttccaaagctcttattacattcgctatggtggcggtgctaactctttagccgacgggtacaacgtgggaaccgggatcggggcggagatcatcggtactttcgtcctcgtctataccgtcttctccgccacggacccaaagaggaatgcccgtgactcccacgtcccggtattggctccactaccaattgggtttgctgtgttcatggttcacttggccacaattccgatcaccggcaccggcattaaccctgctcggagttttggagctgctgtcatctacaaccaagagaaagcttgggatgatcattggatcttttgggtcggtccgttcaccggggcagccattgcagctttctaccatcagtttgtgttgagggctgcagcagctaaggctcttggttcgttcaggagccaatctcatgtttgattttcatttccgcccaattatgatgtaaaagggcaagaattgtgttggagaagtgaaagaagaataaatggaatgtggcttaggtggtggggatgagtattcattggatttgaaagaaaggtttgagtgagacttgtaccaattggtaacatat

SEQ ID NO: 11107 - DNA, 850 bp, Camellia sinensis
gtggcggagcaggggtcttactccgccaaggactaccaggatccgccaccggcaccgctaatcgacgcggaggagctgaccaagtggtcgttttacagggctctgattgcggagttcattgccacgcttttgttcctttacattacgattttgacggtgattggttacaagagccaggttgacccggtcaagaatgctgaccagtgtggcggcgttgggattctcggcatagcttgggcttttggtggcatgatctttgtgcttgtttactgcactgctggaatttctggaggacacataaacccagcagtgacatttgggctgttcttggctcgaaaagtgtcgctgattcgagcagtgatgtacatagtggctcagtgcttgggtgccatatgcggagttgcgcttgtgaaggccttccagagctcctactacgaagtctacggcggcggcgctaatgagctctccccggctacagcaagggcaccggcttgggcgccgagatcatcggaacattcgtactcgtctacacggtcttctccgccaccgatccgaagaggagcgccagagactcccatgtccctgtattggcaccacttccaattgggtttgctgtgtttatggttcacctagccaccattccggtcaccggcactggcatcaaccctgctaggagccttggagctgctgttatttacaaccaagaaaaggcttggcatgaccattggatgttttgggtaggacccttcattggtgcagccattacagccttctaccaccagttcatcttgagagctggagccattaaagctctcgggtcattcagagcagctcccatgtctgatttttc

SEQ ID NO: 11108 - DNA, 849 bp, Ambrosia trifida
gttgaggttggcgagcacgagtatggagcaagagattaccaagaccctccaccggctgacctcttcgacgcggaggaactcaccaaatgggtctttttattagtagccattattgctgaattcgtcgctactctcctttcctttacatcactgtcttgactgtcatcgggtacaagtcccaaaccgaccctagccatagtgctgaccaatgcggtggtgttggcattctaggcattgcttgggcctttggtggcatgatctttgtcctcgtctattgcactgctggcatctcgggtggacacattaaccccgcggtgacatttgggctatttttggctagaaaggtgacactccctagggcgttcatgtacatcgtggctcagtgcttgggtgccgtatgtggatgtggtctagttaaagctttccaaaagacttactacaatacttatggtggtggtgctaatgagctcgcagatggctacagtaaaggcaccggcttgggtgctgaaatcattggcacatttgttcttgtttacaccgtcttctctgccactgaccccaagagaaatgcacgagattctcatgtcccagtattggcacctctccctattggatttgccgtatttatggttcacttggccaccatcccaatcactggcactggaatcaacccggctcgtagttttggtgcggccgtcatgtacggaaagacaaagcttgggatgatcaatggttattctgggtggaccgatgatcggagccgccatccgctgccttctaccaccagtttgtattgagagcaggcgcagtcaaagctcttggatcctctaggagcatataagtgctttt

SEQ ID NO: 11109 - DNA, 930 bp, Euphorbia peplus
gaattctcagcaaaagactaccatgatcctccaccagcacctttgattgatatagaagaactgggtaaatggtcgttttacagagcactgattgcagagttcattgctacccttctcttcctatacataacagtgttgacagtgattggttacaagagccagactgatcctctcaagactaacgacgcttgtggtggcgtcggtgttcttggtattgcttgggcttttggtggcatgattttcattcttgtttactgcactgccggtatctctggaggacacataaacccagcagtgacctttgggctatttttggggaggaaggtgtcactaataagggcaatactgtacatgtagcacagtgtttgggagcaatatgtgggtgtggattggtaaaggcattccaaaaatcatactacaacagatatagaggtggtgccaacgaattggcaggtggatacagcaaaggaactggtttgggtgctgagattattggtacttttgttcttgtttacactgtcttctctgccactgatcctaagagaagtgctagagattcccatgttcctgtgttggcacctctcccaattggatttgcagtgttcatggttcaccttgcaacaattccaattactggaaccggcatcaaccctgctaggagttttggtgctgctgtcatctacaacgaagacaaagcctgggatgatcagtggatgttctgggttggaccattcattggagctgcaattgctgctttctaccaccaattcgttctaagagcagcagctattaaggctcttggatctttcagaagcaatgcttaattaattaaaattaatcaagtttaatgattatgaggatgctttgagaagaataacaatggaatcaccaatgcctgcctgcaaagtctgtctgtttctctctcttctt

SEQ ID NO: 11110 - DNA, 1250 bp, Eschscholzia californica
actacttacttctactctacaaaaaacctctctctagagtctagacagtgagctgctgctcaattctatttgttggagatgggaaagacatagaagcaactgaacagggtgattactcagcaaaggactacactgaaccaccaccagtgccctttttagggttggatgagtttacaaaatggtcattttacagagctataatagctgaatttgttgctacccttttgttcctttatattacagtattgactgtcattggttacaagagccaatctgctactgatgaatgtggtggtgttggaattcttgggattgcttgggcctttggtggcatgattttcgtcctcgtttactgcaccgccggaatttcaggaggacatattaacccagcagtgacttttgggttatttttggcgaggaaggtttcactgattagggcagtattatacatggtggctcagtgtttaggagcaatttgtggtgttggattagtaaaagccttccagaaggcatattacgttaaatttggtggtggggctaacgaacttgccgctgggtacaataagggtactggattagcggctgagatcatcggaacttttgttcttgtttacaccgtcttctctgccactgatcctaaaagaaacgcacgagactcccatgtacctgttttggcaccacttccaattgggttcgctgtattcatggttcacttggctactatccccattaccggtaccggtattaaccccgctaggagtttcggagcggccgttatctacaacaaagacaaagcatgggatgatcagtggatcttctgggttggacctttcattggggcagccattgcagctatttaccaccagtttgtcttgagggctgctgcaattaaagctttgggttcctttaggagcacttcccactaaaatgtcaaaagtttggtgaatatcttttcttctttagatggtgatgatgatgtttgcaaagaataaaaatagtggaagggtgtaagaagggtgtgcctaaaagtccatttattttctctttctctctctctatatgtctcactttctctctctatctcttcaagagaataagttggggaagggttaaaaaagatggtcacatagagttgtagataattagaggtgattggtaagtgtttaatttgtatccatgctctttgctttattttctaaggaattgtgtttaaatgtatctatgtgttgtgattaagatgtctttatttt

SEQ ID NO: 11111 - DNA, 1057 bp, Sarracenia psittacina
cacttcgctctctctatctctcacactagaaagttcggtctcataaagtgatcacatggcgaaggaagtgccgtggggagcagggttctttctcggccaaggactaccacgatccgccaccggcgccgctgatagacccagtggagctggcgaagtggtccttttacagggcgctgattgcggagttcattgccaccctcctcttcctttacattaccgtcctgacggtgattggttacaagagccagacggaccccgccaagaacaccgacgcgtgcggcggcgttggcgttctcggcatcgcctgggcctttggcggcatgatctttgtccttgtctactgcaccgccggtatatccggaggtcacattaacccggcggtgacgttcgggcttgtcttggcccgaaaggtatccctgatccgggcggtactgtacatggtggctcagtgcttgggagccatatgcggcgtggggctcgtgaaggccttccagaaatcaaactacgatcgttatggcggcggcgccaacgagctcgccgtcggctacagcaaaggcaccggattgggcgccgagatcatcggaaccttcgtcctcgtctacaccgtcttctccgccaccgatcccaagagaagcgccagagactcccatgtccccgtgttggcaccacttccgattgggttcgccgtgttcatggttcacctagccaccattccgatcaccggcaccggcatcaacccggccagaagccttggagctgcagtcatctacaacaaggacaaggcttgggatgaccaatggattttttgggttggacccatcattggggcagccattgcagccttctaccaccaatatatcttaagagcaggggcatttaaagctttggcttcatacaggagcaatgcccataactgatttctacgaagtctttccactttaattagtacctgagaggaggaagaaaagaagtctagatgttggagatggtcatcttttcaacccaaaaaaaaaaaaggaaagtaatagagaggggcggacttttagttctgtgtcgg

SEQ ID NO: 11112 - DNA, 1632 bp, Artemisia annua
acacacaaaacattgtttcaaacattgtcaaaatgactaaagatgtccctgagcaaggttcattctcagctaaggactaccatgaccctccaccagcacccttgattgaccctggagagttgacaaagtggtctttttacagggctttgattgctgagttcattgctactcttttgtttctttatataactgtcttgactgttattgggtacaaaagtactactgatcctgatttgaaggcagacccgtgtggtggtgttggtattcttggtattgcatgggcttttggtggtatgatctttgttcttgtttactgcactgctggtatctctggaggtcacattaacccagcagtgacattcggtctattcctagcacgtaaagtgtcactgatccgagcctttatgtacatggtggctcagtgtctaggagccatttgtggtgtgggcttagtcaaggctttcaacaaaagtctatacaacaggtacggcggaggagccaactccctagccgatggttacaacaaaggaaccgggctcggtgctgagattatcggcactttcgtccttgtttacaccgtcttttcggccactgatcctaagagaagtgcccgtgactcccacgttccagttttggcaccacttcctatcgggttcgctgtgttcatggttcacttggccactattcccattaccggaaccggtattaacccagctcgaagtcttggagccgctgttatctacaacaggaaaaaatttgggatgattggatattctgggtgggaccctttattggagcagcaattgcagccttttatcaccaatttatattgagagcaggtgcaatcaaggctcttggatcattcagaagcagtacccctaattaatcacttttttaattttctttaattattgtaccctttatttttaagatcccaaaattgtaatttcaaataatatttatggttgaattttagcctatcaatatattaattcacatatcattttacagcaaacttcattacgcgtaggaccaggcgttgttggcaactgggtcagcaaggtggtcagccaagttctccaatggtccctttccggttacaatggcttgaacaaagaatccaaacattcagcaaaagcctctgggtcatcagcaaggcctaagggtcgaagctaccacctgggtaaagtgggtcaacaacctcacccaaagtgctctgggcatggaccaagcttgggtttcccaagtagtcaaggcaccagccttgaaccatacaacaccgttacgggccaaaagctctgggaagacacatccaagagatggcccatctagagtggatgacctcaagttcacggtttgtctcggggtcagctgaaagcccagcagtgtcccatccgtagtcacctgggaattcaccagtgaggtatgatggggcctcaccagagaatgggcctaggtatttgacacggtctgggccgtaccatgggcttcctgatggtgcaaccttttccgagaagctcggagttcgatggagccgctttcacggcttgtccagcgaaaggagatgttgaagttggttggaagatgctttgattgtttgagttgtccccgtcggagtactgcgttgatacc

SEQ ID NO: 11113 - DNA, 1332 bp, Papaver somniferum
tcctctccacagtactcaactcttcttattttcagtacttctgttctgaatttgtaccgtttctttagaaatcaaatatagggaaaaagacgaaagtagcagaacatggtgtaattctcagcccaaagattatccacgacccaccaccaacaccattttttgatgcagatgagtttaagaaatggtctttctacagagctattattgctgaatttgtagctactcttttgttcctttacattcactgttttgactgttattgggttacaagagccaaagtgaaactgatgacttgtggtggtgtacggtattttggggtatcgcttgggctttttggtggtatgattctttgtcctggtttactgcaccgctggtgtctccggaggacacatcaaccagcagtcacttttgttttatttttggcaagaaaagtttcactgccaagagcagtcttgtacatggtggctcagtgtttgggagcaatctgtggtgttggattagtcaaagctttccaatcagcttactacgttaaatttggtggtggtgccaatacacttgccgctgggtacagtaaaggaactggtctagcagctgaaatcatcggaactttcgttcttgtgtacacagttttctcagccactgaccctaagagaaacgccagagactcccacgttcccgttttggcaccacttccaatcgggtttgccgtattcatggttcacttggctaccattcccgttaccggtaccggtattaacccagctagaagtttcggagctgctgttatcttcaacgaagagaaggcatgggatgaccagtggatcttctgggtcggacctttcattggtgccgcaattgctgctatttaccacctagtttatcctaagggctggtgctattaaagcgtttgggttcctatttaggagcagtgctcgtgtctaagaagtaattattgttggatagagataagggtgtattgtaagtcttgtttgtttttctttttttgttttgtttggaagatggtgatgatgtttgcaaggaataataataatggagctcctcctctaggggtccatataggggtggtggatttgtgacttgtgtatctatctaaaaaatgtacatttattctatctctatctgtctcccttcattcacttttttaaaagagaaaagaaaagagagggtgaaaaatgagtagatgatggataaattggaagtttgtagataaaatctctctatttattagtgtattttcccttttgttttcatgaaagtctttcaagtatcaagtgtaatattatccgctctttcgctatttctctctagtac

SEQ ID NO: 11114 - DNA, 1274 bp, Sarracenia psittacina
acttatcttcaccaaactctctctttagaaagctctgtgaatagccgaagtgcttgtgcttaatcctcatctatggctaagggcacggaggtggcggagcatgggtcgttctccagcaaggactaccacgacccaccgccggcacggctcatcgacccagaggagctgatccagtggtccttctatagggctatcatcgccgagtcatgcacgctctcttcctttacattacggtcctgaccgtgatcggctcaagagccagaccgacccggccaagaagccgacgcgtgcggcggcgttggcattctcggcatcgcctgggccttcggcggcatgatctttgtcctcgtttactgcaccgccggtatttctgggggtcacataaacccagcggtgacatttgggctgtttttggcaagaaaggtgtcgctgatccgggcggtgctgtacatggtggcgcaatgcttgggcgccataagcggagtggggttggtcaaggccttccagaaggcgtattacgaccagtacggcggcggcgccaacgagctggccgctgggtacagcaccggtaccggattgggggcggaaatcatcggaacattcgtcctcgtctacaccgtcttctccgccaccgatccgaagaggaacgccagagactcccatgtccccgtgctggcacctcttccaattggattcgccgtcttcatggttcacctggccaccatccccatcaccggcaccggaatcaaccctgctcggagcctcggcgctgcggtcatctacaacaacgcgaaggcttgggatgatcagtggatattttgggtcggacctttcatcggagcggccatcgcggccttttaccaccaattcatcttgagggcggcggccgttaaagctcttggctcattcaggagcagctcacgtgtttgatttttagaaaaatcttcttgttttctctgcaatttcattttcctaaaaaagaaaaaaaagagtggacaaattaaatttttggtgacgctctttttaaaaagaatatcctcttatgaaaagagcatcactacatttgtgcacattatttatgcatgtattgttcgttttcttttttatcgcaaaaaaagtcagtatgaggggaagaaatcaaggtgattctaattcaaaagtgaataaatacactagttttgccacgtggatatccatcgaacacaaatttggacatgtttttcgcacatgacatagatcttgtacaattaatatatggttgattgattggaaat

SEQ ID NO: 11115 - DNA, 1148 bp, Pteridium aquilinum
ctgttcttgctcacagtttttcaaaggtttttaggaaagaagaggatatggcaaaggaagttgagactgcagagcaaggtggtggagagttctcagccaaggactaccatgatccgccaccagctccattgattgatgcagaagagctcttcaagtggtcgttttacagggcactgattgctgagttcattgctacccttctctttttgtatgtcagtgtgttgactgtgatcgggtacaaggtccaaaccgacactctgaagaacactgttgatgctgactgtggtggtgttggcattcttggtattgcttgggccttcggtggcatgatctttattcttgtttactgcactgctggtatctctggaggacacatcaacccggctgtgaccttcgggctgtcttgggacgcaaggtgtcactcatccgagccatcatgtacatggtagctcagtgcttgggtgccatctgcggctgtgggttggtcaaggctttccaaaagacttactacaacacctacggtggtggtgccaacgagctccaacctggctacaacaagggcaccggcttgggtgctgagatcattggtaccttcgttcttgtctacactgtcttctctgccaccgaccccaagaggagtgcaagggattcccatgttcctgtcttggctccacttcccattggatttgctgtgttcatggttcaccttgccacaatcccaatcactggcactggtatcaaccctgcaaggagttttggagctgctgtgatttacaacagagagaaggcctgggatgaccaatggatcttctgggttggacctttcattggagctgccattgctgcattctaccaccaatacatcctaagagcagcagccatcaaggcccttggatctttcaggagcaatgcttaaaaaaaatcagctctccttttccatggataattcaagaaaaaattatggtcatgatgaattgtgatggagatgtttcccacagagaataacaaatgaagagtgcaagtctgtctgagggggtttccctcttgcaatcttcttctgtctcttacatggggttgaaggcgaagccttgagggagccattgaactgtaaataaattaaaatatatttatggacaagggcgtctctt

SEQ ID NO: 11116 - DNA, 973 bp, Fagus grandifolia
gagcttcaaagcttaagtgagtatgactaaggacgttgaggttgcggagcagggtgagtattctgctaaagactaccatgatccacctccggcgcctttgatcgacgctgaggagctaacccagtggtccttttacagagctcttatagccgagttcattgccactcttcttttcctttacatcacagtactcactgtgaaggcgacaagagccagattgacacagccaatggccccgacgccgcatgtggtggcgtcggcatccttggcattgcttgggcctttggcggcatgatcttcgtccttgtttactgcaccgctggtatctctggaggacatattaacccggctgtgactttcgggttgttcctggcgagaaggtgtcgctcgttcgagccgtgttgtacatggtcgcacagtgcttgggtgcaatcagtggtgttgggttggtgaaggcgttccaaaagtctcactacaacaggtacggtggtggagccaacgagctacaagctgggtacaacaagggcgttggattgggggctgagatcatcggtacctttgttcttgtctacactgtcttctcagccactgatcctaagaggaacgcaagagactcccatgttcctgtattggcacccctccctattggattcgctgtattcatggttcacttggccacaatcccaatcactggcacgggtatcaacccagctagaagttttggagccgcagtgatctacaaccaagacaaggcctgggatgaccaatggattttctgggttggaccttttattggagctgccattgccgcttctaccatcaattcgttcttagagcagcagctattaaggctctaggatccttcagaagcaatgacttaagctttttcatcaatttactttacccaaaagatggagatgattgtttaccaaaaagaataaacaatattgaggagtgctagtctgtctgacgg

SEQ ID NO: 11117 - DNA, 1230 bp, Panax ginseng
aaaatttgtgtgcaaaaacagtactgtatattttttttatatactgttgttgtgcagttatgggaaaggacggagaagtaacggagcagagtgagttctcagccaaggactaccatgatccgccaccggcagcctttatcggcaccgatgagctaaccaaatggtcactttacagggctgtcattgctgagttcatagccaccctcctcttcctttatatcactgtcttgacggtcatcggctacaagagccagtccgccaccgatgagtgcggcggcgttggcctcctcggcattgcctgggcctttggtggcatgatcttcgtccttgtttactgcaccgccggtatctctggaggacacattaaccctgcggtgacgttcgggttgttcttggcaaggaaagtgtcgctaataagggcggtgttttacatggtagcacagtgtttgggtgcaatctgtggagtagggttggtgaaggccttccaaaagtcattatataacaggcatggtggtggagccaacgagctggctgatggttacaacaaaggcactggcttgggagctgagatcattggctacttttgttcttgtctatacagttttctcagccactgatcctaagaggaatgctagagactcccatgtccctgttttggctccacttcccatcggattcgcggtgttcatggttcacctagccacaatcccaattactggaaccggtatcaaccctgctaggagctttggagctgcagtcatctacggcaaacagaaggcctgggatgaccaatggatcttttgggttggacctttcattggtgctgccattgctgcattctaccaccagtatattctgagagcagcagctaagttaaggccttcttggactccttcgaggagcaatgacttaaataaattatgttcaataattacaatgaaggacgtaaatgcttatatgcttcattcgtctatgaagtaattaagaagacaattaattaaggaggatatatgttaaaatatggagatcaggcaggcaattaaggacggacataaatggagttaattgtagatataataataatcaagatttgtagtaatttctatctgtgttgtatttactttctctcccaactgttgctcatcttaatttcattttttaaaattatctccttttcttttttaattaaatattactcaatgtactcagagatcgatgtttgttcataat

SEQ ID NO: 11118 - DNA, 1205 bp, Elaeis guineensis
actaccggtaagaccaatttttactagtctaatgatctgatttcgatctgaaaaaacttttagctgccggggaggatatataggtcgatatagatgaggaaggacatggaggctggggctgagttcacggcaaggactacacggacccgccgccggcgccgctggtcgacgcggaggagctgaccaagtggtcgctgtaccgggcggtgatcgcggagttcatagcgacgctgctgttcctctacatcacggtggcgacggtgatcgggtacaagcaccagtccgatcccaacgtaagcggacccgatgcggcctgcaacggtgtcgggatccttggcatcgcctgggctttcggcgggatgatcttcgtcctcgtctactgcaccgccggcatctccggcggtcacataaacccggcggtgacgttcgggctgctcctggctcgcaaggtctccctgatccgagccctcctctacatgattgcccagtgcctgggagccatctgcggcgtgggcctcgtcaaggccttccagaaggcctactacaatcgctacggcggcggcgtcaacgagctcagctctggctactccaagggaacgggactcgccgcagagatcatcggcaccttcgtcctcgtctacaccgtcttctccgccaccgaccccaagcgcagcgcccgcgactcccacgtcccggttttagctccacttccaattggctttgcggtattcatggtccatctggccacgatcccgatcaccggcaccggcattaaccctgccaggagtttgggacctgccgtaatctacaataatgacaaggcttgggatgaccagtggatcttctgggtgggtcctttcattggggccgccatagccgcagcttatcatcagtatatcctcagagctggcgctatcaaggctcttgggtcttttagaagcaatgcttgatcctgaattctgttgttgtccagctgtagtggtcaatgaaggaataaagaagagtcgcaatgcatatcgagtggaattttgatggggccgcaccatttcagtatttttttttggcttatcaattgtgcaaatcaacaaggaggcatcttttttccattgcccctgcatgcgtttgttgagtatctccacctgatggtctattcactcctggtcttcatgcaattaatgtaagaaatatgttcggtttgcttcctt

SEQ ID NO: 11119 - DNA, 911 bp, Flaveria ramosissima
ggttcattctccgctaaggactaccatgacccgccgccagccccgttgatcgaccccgaggagttctccaaatggtctttctatagagcggtcatcgcggagttcatcgccacccttttgttcttgtatattactgtcttgactgttattggctacaagagcaccactgaccccgcattgaacgctgaccagtgcggtggcgttggtatcctcggtatcgcgtgggccttcggtggcatgatctttgtccttgtttactgcaccgccggtatctctggaggacacattaacccagcggtgacattcggtctatttctggctcgtaaagtgtcgttgatccgagcgtttatgtacatggtggctcagtgtttaggagccatttgcggtgtgggtttggtgaaggctttgaacaaaagcctctacaacaggtacggcggaggggccaacgagctggcggacggctacaacaaaggcaccggcctgggtgctgaaatcatcggcacttttgttctcgtttacaccgtcttttcggccaccgacccaagaggagtgctagagactcacatgttcctgttttggctcctcttccgattgggtttgcggtgttcatggtgcaccttgccactattccgatcaccggaaccggtattaacccggctaggagtcttggagctgcggtcatctacaacaacgaaaaagcatgggacgatcagtggatattctgggttggaccattcgtgggagcagccattgcagccttctaccaccaattcatattgagagcaggtgcgattaaagctcttgggtcattcagaagcagctcacatgtttgagaattatctattgttgtattttcttgcaaaccaaaaataggaaaaatagaaataattattgttattatatttatgttt

SEQ ID NO: 11120 - DNA, 1091 bp, Cyamopsis tetragonoloba
cacgaggaacacacacacctctctgtctctctcacttccatggcaaaagacatcgaaactgcagccgagagtgggttacagcaccacaaggactaccacgacccaccgcctgcgccactcttcgacaccgccgagctccgtaagtggtccttttacagggccctcatcgccgagttcgtcgccactttgctgttcctgtacgtcaccgtcttaaccgtcattggccacagcagccagaccgaccccgctcacaacggcgacggttgtagcagcgtcggcatcctcggcatcgcttgggcttttggcggcatgatctttgtcctcgtctactgcaccgccggcatctccgggggtcatattaacccggcggtgacgttcgggttattcctggcgagaaaggtgtcgttggtgagagctattttatacatggtggctcagtgtttgggtgcgatttccggtgtgggactcgtgaaggctttccagaagagctactacaataagtacaaaggtggtgccaacatgctttctgatggctacagtaaaggaactggtttaggtgctgagattattggtacctttgttcttgtctacaccgttttctccgctactgatcccaagagaaacgccagagactctcatgtccctgtgttggcaccacttccaattgggtttgcagtgttcatgggttcaccttgctactattccaatcaccggtaccggcatcaaccctgctagaagcttcggcgccgctgtcatatacaacaaggagaaggcttgggatgaccagtggatattttgggtgggacccttcatcggtgctgcaattgctgcaatttaccaccagtacgtgttgagagctcaagcagccaaggctctcggttctttcagaagctcctccaacctgtaattttccagtttaattaattaattaattaattaattatttctctatatgctttttcacatggtggaatattggaacttgtatatcctcctcgctgtgtatttactactatttgtgtttctgtgtatttactactatttgtgtttctgtgtattttaattattactactgcctatcctcttatccc

SEQ ID NO: 11121 - DNA, 1091 bp, Echinochloa colona
gccggccggccatgggcaaggacgacgtgatcgagagcggcgccggcggcggcgagttcgccgccaaggactacacggaccctcccccggcgccgctgatcgacgcggcggagctggggtcctggtccctgtaccgcgccgtcatcgccgagttcatcgcgacgctgctcttcctctacatcaccgtgctcaccgtgatcgggtacaagcaccagacggacgtgcagggcgccggcggcgacgcgtgcggcggcgtgggcgtgctgggcatcgcctggcgttcgcggcatgatcttcgtgctcgtctactgcaccgcggggatctccggcggccacatcaaccccgccgtcaccttcggcctcttcctggcgcgcaaggtctcgctggtgcgcgccgtgctctacatcgtggcgcagtgcctcggcgccatctgcggcgtcggcctcgtcaaggccttccagagcgcctacttcgacaggtacggcggcggcgccaactccctcgcctccggctactcccgcggcaccggcctcggcgccgagatcatcggcaccttcgtcctcgtctacaccgtcttctccgccaccgaccccaagcgcaacgcccgcgactcccacgtcccggtgttggcgcccctccccatcggcttcgccgtgttcatggtccacctcgccaccatccccgtcaccggcaccggcatcaacccggccaggagcctcggcgccgccgtcatctacaacaagtccaagccatgggatgaccactggatcttctgggtcggccctctcgttggcgcggccatcgcggcgttctaccaccaatacatcctccgggccggcgccatcaaggccctcggctccttcaggagcaacgcctgatgaggcttcttccttgtcgctgtgagcttgcggaatcagcatgttgaagcaatggcgatcgacgacagacgctggaattgaaggggagaataagtctgcatcgaagttgtgccgctggtcgtttttgtttcagcagctgcgtgcgtgaatttggcttccatcatcatcatcctcctgtaatcaaccgtgtgttcgtaaccttctgtcgaggg

SEQ ID NO: 11122 - DNA, 1725 bp, Amborella trichopoda
ctgaccatacgcggggggatccaatcagtttctctctctacactcggtttcccgaaacccactctctctctaacccctttctccctctaaaactctctctctctctagagctcttccgttttttttccggccaaaaatggggaaggatgtggaggtttcagagcaaccagagttcacggcaaaagactatactgaccctcctcctgccgctctcattgatttggaggagctgacaaaatggtcattttacagggcactgatagctgagttcatagctactttgctgttcttgtatgtgacagtggccacagtgatcggttacaagagggtgagtgaagctgatcagtgtgatggggtgggagttttgggcattgcttgggcttttggtgggatgatttttatcctggtttacgcactgctggtatctcggtgggcacatcaaccctgccgtgaccttcggactcttcctggccaggaaggtgtctctgatcagggcagtgatgtacatggtggctcagtgcctcggtgcgatatgcggtgttggcctggttaagggcttccagagcgcctactacaatcgttacggaggaggggctaataccttgtctaatggttacgacaagggagtggggttgggggctgagattattggcacttttgtgctcgtttacaccgtcttctctgcaactgatcccaagaggagcgccagggattcccatattcctgtgttggcaccattgccaattgggtttgcagtgttcatggtgcacttggccaccatcccaatcactggaacaggtatcaaccctgctaggagctttggagctgctgtcatctacaacaagaagaaagcctggatgacagtggatcttttgggttgggcccttcattggagctgccattgctgctgcatatcaccaatacattttgagggcactgccattaaagctctgggttcattcaggagcaaccccaatgtttaagaaaactccagctctctgtgttttgtgaatgggtttggggatcaaagagtgatttttaggagaaagaataatgaaatggagtgggccactttctctctctcctctctctaactgtttctccctcccggatgtgtgcttgggctgcttctctctagaccatcaggtggcctggaactgtagataaatgttgggttttcctgcatttaatcctctctagagttctctctttctctctctagtttttgggttttgtatgttggtcttgtgttcctgtacttaaaagagaggttctagtgaatagtcatgtgctttctttcacttccaaattcaattggctcgcttgttacctttgatcctttacttatgtttctttttctctctgtaaatcactacgtgcttatgtttctgtttctttctaaatcactacttatgtttctgtttctgtctctaaatcaccaatgtttctgtttctttctaaatcactacttatgtttctgtttctctctctaaatcaccaatgttttcttatctccagcttttctagacacatttctagagcttccatagatggcgcagttgtcgcttatccaaagtataaaaaattattttttgatgttaattgtagttatcattgtgtgtccatgcaacgttattttagcatgagcgtttaaaaaaaaaaaaaaattcaacggtgtgatctgttgaaggttataacactttcttttttttttaggttttttgg

SEQ ID NO: 11123 - DNA, 1078 bp, Cleome spinosa
aggacgtggcggagcatgggtcgttttccggcaaggactaccacgatccgccgccggcgccgcttttcgacgcgacggagctggggaaatggtccttctacagagcactcatcgccgaattcatcgctacgcttctcttcctctacatcaccgtcttgactgttatcggctacaacagccagaccaacaccaccctcaaccccggcgccgaccagtgcggcggcgtcggaatattgggtattgcctgggcattcggtggcatgatctttatcctcgtgtactgcaccgccggaatctctggaggtcacattaatccggcagtgacgttcgggttgttcttggcgaggaaagtgtcgttggtgagagcagtaatgtacatggtggctcagtgtcttggagccatttgcggcgtgggtctggtcaaagcctttcaaagctcctactacacacgttacggtggtggggccaactccttagccagtggttatagtgtcggagtcggtgtcggggcagagatcatcggtacgttcgtcctcgtgtacactgtcttctccgccacggaccctaagaggaacgcgcgtgactctcacgtccccgtactggctccattgccaatagggtttgctgtgttcatggttcacttggccacgatcccaatcactggcaccggcatcaaccctgctaggagtcttggagctgccgtcatcttcaaccaagagaagccttgggacgatcattggatcttctgggtcggaccgttcgctggtgcagccattgcggctttctaccatcagttcgtgttgagggcagctgcagctaaggctcttggttcattcaggagccaatctcatgtctgatttgaacatatatatatatatgtggttggggccatcatggaaacaagaaagatgaagtaataataaaatagaatgccagcttcttagatgagagtttgtatcattgttgtttgaaagaagaggtttgagtgagactccgtgtaccaatttgtaacatacaagcctctcttacatttcatgttgttgtgttttcatcctgtgtactcctaattctatctcct

SEQ ID NO: 11124 - DNA, 1210 bp, Carpinus betulus
cttcttcttcttctcagttctctctctctctttgtggtgttttgagtgttatggctaaagacggggaggtgccagagcatggctcattctcggccaaggactaccacgacccacctccggcgccgctcatcgacgccgtggaggtccgcaagtggtccttctacagggctttgatagccgagtttatagccaccctgctctttttatacgtcacggtgctcaccgtgataggctacaagagccagattgaccccgacaatggcggggaagcctgcggcggtgttgggattctcggcatcgcttgggcattcggcggcatgatctttgttcttgtttactgcactgctgggatttcagggggtcacattaacccggcggtgacgttcgggctgttttggcacgaaaggtgtcactggtgcgggcggtgagctacatggtggctcagtgcttgggagccatcagcggtgttgcgctagtgaaggccttcaataaggcccactacatgagatatggaggtggagccaacacgctgtctgatgggtacagcaaaggcgttggattgggcgccgagatcatcggcaccttcgtgcttgtctacaccgtcttctctgccaccgatcccaagaggaatgctagagactcctatgttccggttttggcaccgctcccaattggattcgcagtcttcatggttcacttggccacaatcccgatcaccggcaccggtatcaaccccgctaggagcttcggagccgcccttatctacgacaagcaagccgcctgggatgaccattggctcttttgggttggacctttcattggtgcagctatagcagctttctaccaccaatacatcttgagggcaggagttgccaaagctcttgggtcattcaggagccaccccattgtttgattaggagaaggatttaatagttcaagaaagaagattaatgggggattgatggctaatcctttggctctctttaatttccttctcatgagagggttgaggataatgttattgtagatgaaaagtctgttctctttgagaaaaagggtgctttttttctgttcatctttgtccttctacccaacttgcctttccatttgcttctatgttgtcttttacccactttgtctctgcggttctttgtagtactcattgctttcttgaagaagtgtgggtcactttctgctttgtttaatgtct

SEQ ID NO: 11125 - DNA, 972 bp, Ambrosia trifida
caccacggaggcgggagcgagtactccgctaaggactaccaccgacccgcctcctgcttcccttttcgatgcggacgagctcaaccaaatggtcattctaccgtgcactgatcgcggagtttgttgccactctcctttttctttatgtcactgttttgactgttatcgggtacaaaagccagactgatcctaagttgaacgcggatcagtgtggtggagttggtatacttggtatcgcttgggcctttggtggcatgatcttcatacttgtttactgcactgccggtatctctggaggacacattaacccggctgtgacgttcgggctgtttttggcaagaaaggtgtcattgatcagggcgttggggtacatgatagctcaatgtttgggcgcaatttgtggtgtgggtctcgtgaaggctttccaaagctcgtactacaacaggtacggtggtggtgcgaatgaattggccgatggctacaacaagggtactgggctcggtgctgagattatcggtacctttgtccttgtttacaccgtgttctctgccactgatcccaagaggagcgcaagagactcccatgttcctgtcttggcaccactgcccataggatttgccgtattcatggtgcacttggccaccattcccatcaccggaacgggcatcaacccggccagaagctttggcgccgcagtgatctacaacaacgaaaaggcctgggatgatcaatggatattctgggttggacccttcatcggagcattcgccgccgcggtctaccaccagtttgtgcttagagccgctgcaatcaaagcacttggttcattcagaagcaatgcttaagcttgatattaagatgttcatccatggtgcttttaattgccttgtagatatctttggaaaaaaatcgtttattgtaattgtgttttttttgttttcttttctaacttcttttattatgtatgcgtta

SEQ ID NO: 11126 - DNA, 1492 bp, Carpinus betulus
tgtggtgttttgagtgttatggctaaagacgggaggtgccggagcatggctcattctcggccaaggactaccacgacccacctccggcgccgctcatcgactgtgtggagctccgcaagtggtccttctacagggctttgatagccgagtttatagccaccctcctctttttatacgtcacggtgctcaccgtgatcggctacaagagccagattgacgtcaacaatgcggggaagcctgcggcggtgttgggtttctcggcatcgcttgggcattcggcggcatgatctttgttcttgtttactgcactgctggcatttcagggggtcacattaacccggcggtgacgttcgggctgtttttggcacgaaaaggtgtcgctggtgcgggcggtgagctacatggtggcccagtgcttgggagccatcagcggagttgcgctagtgaaggcttttaataaggcccactacatgagatatggaggtggagccaacacgctgtctgatgggtacagcaaaggcgttggattgggcgccgagatcatcggcaccttcgtgcttgtctacaccgtcttctctgccaccgatcccaagaggaatgctagagactcctatgttccggttttggcaccgctcccaattggatttgcggtcttcatggttcacttggccaccatcccgatcaccggcaccggtatcaaccccgctaggagcctcggagctgcccttatctacgacaagcaagacgcctgggatgaccattggctcttttgggttggaccattcattggtgcagctatcgcagctttctaccaccaatacatcttgagggcaggagttgccaaagctcttgggtctttcaggagccaccccattgtttgattaggagaaggatttaatagttcaagaaagaagattaatgggggattgattgctaatcctttggctctcttaatttccttcacatgagagtgttgaggatcatgttattgtagatgaaaagtctgttctctttgagaaaaagggagcttttttctgttcctctttgtccttctacccaacttgcctttccatttacttctatgttgtcttttacccactttgtctccgcggttccttgtagtactcattgctttctttaagaagtgtgggtcactttctgctttgtttaatgtctcaattcagtgtgtttggtacgagggggagggggacatgtcccgggaaaatgactttttaacactagggatagatgggaataactttgctatgttaatttatttgtggcatctgactctgtatattgaattaaatgatgtgacagggaaagttaatctaagacgaatgagggttggaatgaaagtttatatgggttaaaataatggaagatttggttttttagaaagaataaaataccttacaatataacataagataatagttggtctatttattggttcgtctttctttctattagtaaagaataataaacaaaa

SEQ ID NO: 11127 - DNA, 1081 bp, Conyza canadensis
taaataccaacacatatcacacttcactcacaaaccattatcacttctcaccctctccataacacttgtgtccaacaacaacaaaaagaaaacatgactaaagatgttgaagtggctgagcaccgcggtggcggcgacgaatacaccgccaaggactaccaagatccacctcccgccccgttgtttgatgcagatgaacttactaaatggtcattctatcgtgcactcatagccgagtttgttgccactctccttttcctatatgttactgttttgaccgttattggttacaaagcccaaaccgatcctactttgaacactgatcaatgtggtggtgttggaatccttggtattgcttgggcctttggtggcatgatctttgtccttgtttactgcactgccggtatctctggaggacatattagcccggctgtgacattcgggctatttgtggcccgaaaggtgtcattgatcagggcccttggatacatgatagcacaatgtttgggtgcaatttgtggtgtgggtctagtaaaagctttccaaagctcatactacaatagatacggcggcggagccaacgaattagccgatggttacaacaaggggactggacttggtgctgagattattggcacctttgttcttgtttacaccgtcttctcggctactgatcctaagaggagtgcacgagactcccatgttcctgtattggcacctctgcccataggatttgcagtgttcatggtgcacttggccactattccaatcaccggtaccggtattaatccagccagaagttttggtgccggcgttatttaaaacaaagataaagcatgggatgatcaatggatcttctgggttggaccgttcattggagcctttgccgctgcaatctaccaccaatttgtattgagagccgcggcgataaaagcacttggttcattcagaagcaatgcttaagtttgaaagatgttcattcatggcttgcgccttgtagatatctttgaaagaaattggtttcatgtaattgtaatttattttaagtcttgttcatgtgtcaaatgcaaggggtgtcttg

SEQ ID NO: 11128 - DNA, 1102 bp, Ambrosia trifida
cataaatacctaccatcacaacacgttcaccacaacttcactcacacaaactattcatctcttctcaattctcctcttctcgccaccacagccatgactaaagatgttgaagtagccgagcaccacggaggcgggagcgagtactccgctaaggactaccacgacccgcctcccgctcccttttcgacgctgacgagctcaccaaatggtcattctaccgtgcactgatcgcggagtttgttgccactctcctttttctttatgtcactgttttgactgttatcgggtacaaaagccagactgatcctaagttgaacgcggatcagtgtggtggagttggtatacttggtatcgcttgggcctttggtggcatgatcttcatacttgtttactgcaccgcgggtatctctggaggacacattaacccggctgtgactttcgggctgtttttggcaagaaaggtgtcattgatcagggcgttggggtacatgatagcccagtgtttgggcgcaatttgtggtgtgggtctcgtgaaggctttccaaagctcgtactacaacaggtacggtggtggtgctaacgagttagccgacggctacaacaagggtactgggctcggtgctgagattatcggtacctttgtccttgtttacaccgtgttctctgccactgatcctaagaggagcgcaagagactcccatgttcttgttttggcaccactgcccataggatttgccgtattcatggtgcacttggccaccattccgatcactggcaccggcatcaaccccgccagaagctttggcgccgctgtgatttacaacaacgaaaaggcctgggatgatcaatggatattctgggttggacccttcatcggagcattcgccgccgcagtctaccatcagtttgtgcttagagctgctgcaatcaaagcacttggttcattcagaagcaatgcttaagcttgatactaagatgttcatccatggtgctttaattgccttgtagatatctttggaaaaaaaaatcgtttattgtaattgtgttctcttttgttttcttttctaaccttcttttaatatgtatgcgttatgcaagtgtg

SEQ ID NO: 11129 - DNA, 1106 bp, Castanea mollissima
ctctctctctcacaccaaagctttatccttttgcttttttctcttaaccatgaccaaggatgttgcagagcatggctcatttccagccaaagactaccacgacccacctccagcaccgttgttcgatcctgtggagctaaccaagtggtccttttacagggctttgatagctgagtttgtagctactttgctctttctatatgtcacggttctgactgtgattggctacaagagccagattgaccctgacttgaaaggtgatgcctgtggtggtgttggctatcttggggttgcttgggcttttggtggcatgatttttgttcttgtttactgcactgctgggatttcagggggtcacatcaacccagcagtgaccttcgggctcttcttggctcgtaaggtgtcgctgattcgggccgtgttgtacatggtggctcagtgcttgggagccatatgtggtgttgcgctcgtcaaggcctttcagagtgcctattatgtgaagtatggtggtggggccaactctctctcagctgggtacggcactggcgttggattgggtgccgagatcgtagggacgtttgtgcttgtgtacaccgtcttctctgccactgatcccaagaggaaagctagagattcacacgttcctgttttggcaccactacccattggatttgcggtgttcattgttcacttggccaccatcccaatcactggcactggcatcaaccccgctaggagtcttggggctgcggttatctacaataaggacaagccctgggatgaccattggcttttttgggttgggccattcattggtgcagctttagcagctttctaccaccaattcatcttgagagctggtgctgcgaaagctcttgggtcattcaggagcaactcctcccatgtttaattaacaaagaggcttagttatttgattccttcttcatggttcttctgagaaatgacattggaagaaggatttgatgtgtttagaagtataatggggtagtgctttatgcttgtgtatgaatgtttctttggctctcttgatttccttaagagggttaaggagcataaaattgtagattaaagtctctttgagaaaa

SEQ ID NO: 11130 - DNA, 909 bp, Cirsium arvense
caacaccacggcgccaaggactaccacgatccacctccttcgccgctcttcgacgccgatgagctcaccaagtggtcccttctaccgagctctcatcgccgagttcgtcgccaccctcctcttcctctacgtcaccgtactaaccgtcattggctacaagagccagaccgatcccctcctcaacaccgatcagtgcggcggcgttggcatcctcggcatcgcttgggccttcggtggcatgatcttcatcctcgtctactgcaccgccggtatctcaggaggacacattaaccctgccgtgacgttcggtttgtttttggcgcgaaaggtgtcgttgatcagggcggtaggttatatggtagcacagtgtttgggagcgatttgcggtgttggtttggtgaaggctttccagagctcgtactacaaccggtacggcggaggtgctaacacgttggccgatggttacaacaaggggaccggactcggtgctgagattatcggaaccttcgtgctggtttacaccgtcttctcggctaccgatcccaagaggagtgcacgagactcccatgttcctgtattggcaccactgcccataggatttgcagtgttcatggtgcacttggccaccattccgatcaccggtaccggaattaacccggccagaagttttggcgccgccgtgattttcaacgacgagaaggcatgggacgaccaatggatattctgggttggaccattcatcggagcgtttgctgccgccgtctaccaccagttcgtactgagagccgccgcgatcaaagcactgggttctttcagaagcaatgcttaaaacctgaaagatttcatggcttgctttgtagatatctctgaaacttccaattgtattttgatgtaatttattttcatgag

SEQ ID NO: 11131 - DNA, 1078 bp, Echinacea purpurea
gttattcgaatcatgattgatcctatgttacaacttcactcacacaactattcacatcttctcatcaccttctcgtcctcacagccatgactaaagatgttgaagtggcggagcaccacggcggcggaagcgaatacgccgccaaggactaccaggacccgcctcccgctcccttttttgatgccgatgaactcaccaaatggtcattctaccgtgctctaatcgccgagtttgtagccacccttcttttcctatacgtcaccgttttgaccgtcatcgggtacaaaagccagactgatccgagtttgaactctgatcagtgtggcggtgttggtatcctcggtatcgcctgggcctttggtggcatgatctttatcctcgtttactgcaccgcgggtatctcgggtggtcacattaacccagcggtgacatttggtctgttcctggcgcgtaaagtgtcattgttccgagccgttgggtacatggtggctcagtgcttaggagccatttgtggtgtgggcttggtcaaggctttcaacaaaagcctctacaacaggtacggcggaggagccaatgagctggcggacggctacaacaccggcactggacttggcgctgaaatcatcggaactttcgtcctcgtttacaccgtcttctccgccactgaccccaagaggagcgcccgcgactcccatgttcccatattggcgcctcttccgatagggtttgccgtgttcatggtgcaccttgccaccattccgatcacgggaaccggtatcaacccggccagaagccttggagccgctgtcatttacaataaagctaaagcctgggatgatcagtggatcttctgggtgggaccattaattggagcaaccattgcagctttctaccaccaatttgttctgagagcaggtggatataaagctcttgaatcatacagaagcagcacccatgtttgagatttattaattgttgtattttgtttcaaacccaaaattaataataatatttatgtttatttaacatattcctttcatgtttcatataatcacataatttatctaataataagtat

SEQ ID NO: 11132 - DNA, 1319 bp, Conyza canadensis
atttacacaccttaccggctctcacccacacacagatctcatttactaccataagttacaaatcaccccttaaacatacatcatctttacattccacccctttctttatatatcctcagcctatatacatacacccctctctaaactcattactcattttattactcaacactctattttcataaaccatggcaaacgaagtaacaaataatcaaggatcactctcggcaaaggactaccatgatccgccacccgcgtcttttatcgacctaaaagagctaaccaagtggtcgttatatagagccgtgattgctgaattcattgccacacttttgtttctttacataactgttttaactataattggttacaacagccaaattgctttgggtgctgacccttgtggtggtgttggggttcttggtatagcttgggctgttggtggcatgatatttgttcttgtttactgtaccgccggtatctctggtggccacattaacccagccgtaacgtttggtctatttttggctcgtaaggtttcactgccacgagccatcctgtacatggtggctcagtgtttaggagcaatttgtggtgttggtttagtcaagtcttttcaaaagacttactttaatacatatggtggaggtgtcaatgtgttggccgatggctacaataaagggaccgggttgggtgcggagatcattggcacgttcgttcttgtctacactgttttctcggcaactgatcccaaaaggagcgctagagactctcacgttcctgtgttggcaccactacctattgggtttgctgtgttcatggttcacctagccactattcacatcactggaaccggtattaacccggcgagaagttttggagccgcggtgatttacaacaaggaaaaagcttgggatgatcaatggatattttgggtcgggcccttcattggtgctgcaattgcggctttctaccatcagtttgtcttgagagctggtgcgattaaagcccttggatcgtttagaagcagcacccatgtttgagattcgatcgatcttttgggagaaaaacatgtttagttatttttgggaggaagttcggaaaagataaataaaagtgtttgtatgtgtatggaaattatgttgcttttaggtattaaaatctcatgtcttgttcattatctaatcaggaaaattcaatctaaatgcttttatagaggtgcccctcatctaaaacgttgcatctatttgaatttgttagcctatattattcaaagtcaaatagaagttattaagattagaaaaattagtttttgttat

SEQ ID NO: 11133 - DNA, 1289 bp, Fraxinus spp
agtattgacgattgagtataccagcttcagacctacaacttctcctctgttttcttcccacaccccgccaatgacgaaagaattcgaatctcacgtggagccagcggaggaatactccaccaaggactaccatgatccaccaccggcgcctctcattgattttgatgagctgagcagctggtcattttacagagcaattattgctgagttcgttgccactttgctattcctttacatcacagttttgactgttattggctacaaaagccagattgacccagctcacggcggcgacgactgcgacggcgttgggattctaggcattgcatgggctttcggtggcatgattttcattcttgtttactgcaccgccggtatctctggaggacatattaacccggcagtgacattcggcctgttcttgggacgaaaggtgtcactgatcagagcagtgctttacatggtagcacaatgttgggtgcagtctgtggtgtgggattggtgaaagcattccaaaaaagcttactataatcggtatggtggtggagcgaatgagcttgctccaggatacaataaaggagttggtttgggtgctgaaattattggtacctttgttttggtctacaccgtcttctcagccactgatcctaagaggaatgccagagactcccatgtccctgtattggccccacttcccattgggtttgctgtgttcatggttcaccttgccaccatccccatcactggaactggcatcaaccctgctaggagctttggagctgctgtcatctacaacaaagacaaggcctgggatgaccattggatcttctgggttggaccattcgttggagctctcattgctgcaatctaccaccaatatatcctaagggcaggagccatcaaggctatgggatctttcaggagcaatgcttaagacaattgtgcatctgtttgatgatccattctcacaagtgcatgaaagtggagaggaccttgaaaactgtacataaattccccgtggatatagggtttcttaatttgtaatcctatcacttcctttctcttctttgagtatttaagttgtgttgtatcccccccccccccctagtactctactcgatgtattcttctataataagtataatagttagtgtactaaaaaaagaaaaaaactaaaaacaatagtacgtaccgacctacgggtacctctaaccttagacgacttcgtaccgtaacggacaacgtaccgagggaagttagggtagtagagagacatacacacacacaca

SEQ ID NO: 11134 - DNA, 1214 bp, Olea europaea
aggtacaccagcttcagccctacaacttcttctctatattcttcacacttccctcaccccacgaatgacgaaagacgtcgaatctcatgtggagccagcggaggaatactccgccaaggactaccatgatccaccaccggcgcctctcattgattttgatgagctgagcagctggtcgttttacagagcacttattgctgagttcgttgccactttgctgttcctttacgtcacagttttgaccgttataggctacaaaagccagattgacccagctcacggcggcgacgactgcggcggcgttgggattcttggcattgcatgggctttcggtggaatgattttcattcttgtttactgcaccgccggtatctctggaggacatattaacccggcagtgacattagggctgttcttgggaagaaaggtgtcactgatcagagcagtgctttacatggtagcacaatgtttgggtgcaatctgtggtgtgggattggtgaaagcattccaaaaatcgtactatcataagtatggtggtggagcaaatgaacttgctccagggtacaacaaaggggttggtttgggtgctgaaattattggcacctttgttttggtctacaccgtcttctcagccactgatcctaagaggaatgccagagactcccatgtccctgtcttggctccacttcccatcggatttgctgtgttcatggttcaccttgccaccatccccatcaccggaactggcatcaaccctgctaggagctttggagctgctgtcatctacaacgaagacaagccctgggatgaccattggatttttgggttggaccattcgttggagctctaattgctgcaatctaccaccaatacatcctaagggcaggagccatcaaggcactgggatctttcaggagcaacgcttaagacaattgtgcatttgtttgatgattcattctcacaagtacacgaaagtggagaggaccttgaaaactgcacatgaattccctgtggatatagggttcctttaatttttattcccatcatttcccttttcctcttgttttggatgtatttaagttgtgttgtatcttctccctttttctctccttttaagtgctgctctatctatgatgtaactcttcgtaaataagtataatggtttgtgctcccttctctctccctctcccccttgattatgtaataacctgatt

SEQ ID NO: 11135 - DNA, 1205 bp, Silene vulgaris
tgtgcattacagtctcacacccaatctggagctaaacttttgtaagcaaattaaatcaataattccaagttgctcaaaaaatggcaaaggacgtggaagcagcagtagcaaaagactatgaagaccctccaccagcagcgttcttcgacatgtcggagctggcgaaatggtcattttacagggcacttatagctgaatttgtagcaacactcttgttcttgtatataactgtattgactgtgattggttacaagagccagagtgctgcattacctgtagatgaatgtgctggtgttggtcttcttggtattgcttgggctttcggtggcatgatctttatccttgtttactgcactgctggtatctctggtggacacataaacccagcagtgacatttgggctactattagcgcgaaaactatcattaatcagggccatattgtacatggtggctcaatgtttaggagccatatgcggagttgggttggttaaggcattccaaagcgcatactatgacaggttcggcggtggggcgaatgagttagctgctgggtacagcaagggtactgggttgggtgctgagattatcggtacttttgttcttgtctacaccgttttctctgctactgaccctaaacgcagcgctagggactcccacgttcctgtactcgcaccacttccaattggatttgctgtgttcatggttcacttagcgacaatccctgtgactggcaccggtatcaaccctgctagaagtttcggagctgctgtcatctacaacaacaaaaaagcttgggctgaccaatggattttctgggtgggaccatacctcggagctgccctagctgcaatataccatcaatacatattgagagcaggattcgcgaaagctcttgggtcattcagaagctcgtccaatgtcgtatgattatcgttaaatcataattaaatcgtcggacaagttagtcatcaccaaattaatactatatggtttttggctcaattgggattcgattgccttcgattaagaaaaaagatgtacataagtttcaaacgatgtcgtcgttagtgtgtcacggtcgatctagtttcattgtgtccgttgagttgattaggtaccattttcaacattgttgctttatgctttttgctgtattattattattatgctcttccgataatgaataaacttttctagtttcct

SEQ ID NO: 11136 - DNA, 1112 bp, Trifolium pratense
atacgcaacgcaacatatcacatgtattgttgtataaaaaagcatacttactatattactgcttcaaaattatcctaaaaacagaacaaccctcacaaacaccactctctctaacttcttcaatggctaaagcttttgaaaccgaacctcaagctggtggtttaccaaacaaggactaccaagacccaccaccagctccactcttcgacactaccgaattcacccaatggtccttctacagagccctcatcgccgaattcgtcgccaccctcctcttcctctacgtcaccattttaaccgtcattggttacaactctcaaactgacccagctcataacggcacccattgtgatggtgtcggtatcctcggcatcgcttgggccttcggtggcatgatttttgttctcgtctactgcactgccggcatatcaggggggcacataaatccggcggtgacatttgggctatttctagcaaggaaggtatcattgataagagctgtattatacatggtggcacagtgtttaggagcaatatgtggggttggattagtaaaagcttttcagaaaagttactataacagatacaaaggtggtgctaacatgttaaatgatggttatagtaaaggaactggtttaggtgctgagattattggaacttttgttcttgtttacaccgttttctctgcaaccgatccaaaaagaagtgctagagattctcatgttcctgttttagcaccacttccaattgggtttgctgtgtttatagttcaccttgctacaattcctatcactggaactggtatcaatcctgctagaagttttggagctgctgtgatttacaacaatgagaaagcttgggatgaccaatggattttctgggttggaccctttattggtgctgccattgctgcaatttaccaccagtttgtgttgagagcacaagcagttaaggctttgggttctttcaggagttcttcaaatctgtaatacaatttcatgtgcccaaattacaaagaagtttaatcacttaattgtatggttagacatggtttgtattggaattctattactatgtatgacattgtttaattatggtttaattaattaatt

SEQ ID NO: 11137 - DNA, 1207 bp, Echinacea purpurea
atctcacaaccaccaccacgaccaccacgatttgctacatctatttctctaaacatgaccaaagacttggcggatcaggggtcgtttttggcgaaggactaccacgacccaccgcccgcagcgttcatcgacaccaaggagctgaccaagtggtctttctatagagctctaatcgccgagttcattgcaacccttctcttcctttacattggtgtcttgactgttatcggttacaagagccaactcgacaagggctccgatccatgtggcggcgttggggtcttgggtattgcttgggcctttggtggcatgatttttgttcttgtctactgtaccgccggtatctctggaggccacattaaccctgccgtgacctttggtctgtttctggctcgtaaagtgtcactacccagagccatattgttcatggtggctcagtgtttgggagccatttgtggcgcgggcttagtcaaggctttgaacaagacttattatgagaactacggtggtggtgccaacgagctggccgatggctacaataaaggcaccgggttgggtgcggagatcatcggaacttttgttcttgtgtacaccgtcttctccgccatcgaccccaagaggaacgctagagactcccatgttcctgtgttggcaccactacccatcgggtttgcagtgttcatagttcatttatccacaatgcatatcactggaagcggtatcaacccggctaggagtttcggagccgcggtgatatacaacaaggagaaagcttgggatgatcaatggatatattgggttggaccgttcatcggtgcggctatcgcggccttctaccaccagttcatcttgagagccggtgcggtcaaagcccttgcatcgttcaaaagcagtagtccccatgtttgagatcatttcaatctttcagatcgggataataatgtttgtatgtgtacaaatcttatgagttgtattaggaagttttcacttaaaaaggataagttgttaactattaagctcatgttctattaacaaaaaacatcccatcaactcatctaacatgcattgtattgtatactatgttaaacatgaatgtcggtgttcctttgccaccgatcatactcacccccaactttctcaaagttcgtatttacaccctgtaatattcattacatcctcttaagttaagaaaatatcattttcaccc

SEQ ID NO: 11138 - DNA, 918 bp, Cucumis sativus
cctctcctctctttctatttactctctttgctcccctatggccaaagacgacgtcacgacggcaagagggttctccggcaaggactaccacgaccctcctccagccccgctcttcgacgcggcggagctaggcaagtggtccttttacagagccatcattgctgagttcattgccactcttctttttctctatgtcactatcttgactattatcggctaaaacagccagaccgataccgacaagcccggcgccaacgcttgcgatggcgttggcattctcggcatcgcttggtcctttggcggcatgatcttcgtccttgtctactgcactgctggcatttcaggagggcacataaacccggcggtgacgttcgggctgttcttggctcgtaaagtgtcgttggtgcgagcagtagcgtacatggtggctcagtgtttgggggccgtttgcggtgcggggctagtaaaagccttccaaaagggttactacaacaagtacggtggcggtgcgaaccaactcgcccatggctactccaaaggcaccggtttaggagctgaaatcgttggtacctttatcttggtttacaccgtcttctccgccaccgattccaagagaaatgccagagactcccatgttcctgtattggctccactcccaattgggtttgctgtgtttatggttcacttggccaccatccccatcaccggcacaagcatcaaccctgcaagaagcttcggccctgctgttatcttgaatagggaaaaaccttgggatgaccattggatattctgggttgggccatttgtgggagcggccatcgcagcgttctaccaccagttcatcttgagggcgggcgcggccaaagctctgggctctttcaggagcaacccctccgtctgatcgcattccataagcaa

SEQ ID NO: 11139 - DNA, 1231 bp, Brassica napus
ctcagcttattccttcaactttctcctctcgtcccatcatcatcatgtcctcccataccaatctccactctcctaaccggatcaccgtaccaccggacaccccataccaaaaaaccaccgtcctcctccacctctcaagaccaacaaaccctaaaatgccctcgttgcaactcctcaaacacaaagttctgttactacaacaactacagcctctctcagcctcgtcacttctgcaaagcttgccgccgttactggacacgtggtggtgccttaagaaacgtccccatcggtggaggatgtcggaaaaccaaaaaaacattcaaacctaacgcagtaacaactccttcttcatctcagagatttttctcttcaatcatggaagactccaccaagttcttccctcctccaacaacaatggattttcagctcgctggtttgtctctcaacaaaatcaacgatcttcaacttatgaataatcaagaagttcttggccttaggcccatggaccaggtcgagacaacacccgttgatgtcgggccgggtttatctttaatgggttttggagattacagcaaccaacaaccattcaacggggacgttcacaaccgccggagcaaccgacggaaacttagcaacttcgatagaaactttgagctctttaaaccaagatttgcactggagacttcagcaacagaggatggctatgctttttggtagctctaaagaagagactgtcgttgtggagaggccacagccgatactttacaggaatctcgagatcgtgaactcatcgcagtcgccgacgaagaaaggagataatcagacagaatggtattttggtaataataatgatactgaaggggtggctaataataataataatacaggaggaagtgagcaatggaacaatggagttcaagcttggactgaccttaaccattataatgctttgccatgattattggtaagttaaaaggaactatattatgtgatcagatatttaaaattatgtgtgtttcttatgtaatgccaaagaatatttatgtttgtagtatttgttgggttgggtgtcctttgtagtcagtttttgttgttgttgttggttaccatttagaattataaatttcaatttgtaaacaaaaatttaagaattgagagatatactataatagattctctaaacttgcgacttttctgtactcataattatctcaatgttggaaatattcga

SEQ ID NO: 11140 - DNA, 1117 bp, Brassica rapa
acgaaaccctttttaccaactgttcctcaatctctctcgctctcatcatacttttcttgttcctttatttctctcgtcccatcattatcatgtcctcccataccaatctccactctcctaaaccggatcaccgtatcaccggtgcgtcccataccaaaaaaccaccgtcttccaccgcttctcaagaccaacaaaccctaaaatgccctcgttgcaactcctcaaacacaaagttttgttactacaacaactacagcctctctcagcctcgtcacttctgcaaatcttgccgccgttactggacacgtggcggttccttaagaaacgtccccatcggtggcggttgtcggaaaaccaaaaaatcaataaaacctaacattatagctccttcttcttcttcatctcagagatttttctcttcaaccatggaagaagcatctaaattcttcactcctccaacagcaatggattttcagctcgctggattatctctcaacaaaataaacgatcttcaacttatgaataatcaagaagttcttggccttaggacgaccatggagcaggtcgaaacaacacctgttgatgtcggatcaggtttaaccctaatgggtttcggagattacaacagcaacaacaacaaccattcaccggcgactttcacaaccgatggaaacttagctacgtcgatagaaactttgagttgtttaaaccaagatttacactggaggcttcagcaacagaggatggctatgttttttggcaactctaaagaagagactgttgttgtggagaggccacagccgcttctttaccggaatctcgagatcgttaactcatcgccgtcgccgacaactaagaaaggagagaatcagacagagtggtactttggtaataataacgacaacgaaagggtgattaataacaatgaaaataataacacaggaggaagcgatcaatggaacaatggacttcaagcttggactgatcttaatcattataattaatgctttgccatgattcttggtaagtttaagataaactatatttatatgatcaagatttaaaactatgtgtgtttgtgatgtcacttccaaaaatatttatgtttgtagttttg

SEQ ID NO: 11141 - DNA, 932 bp, Hordeum vulgare
ccctcccccctccctgcatcgtcgcggaacagtgctcccaccgccggcgccatgagtaagttgcagagcgatgccctgagggaggctatcacaaacattaccaatgactgccgtgagaagaaccgcaagttcgttgaaaccattgagctgcaaattggtctgaagaactatgacccgcaaaaggacaaacgtttcagtggctctgttaagcttcctcacatccctcgcccaaagatgagggtttgcatgcttggtgatgcccagcatgttgaagaggcagggaaaatgggccttgactgtatggatgtggaatcgctgaagaagatgaacaaaaacaagaagctagtcaagaagcttgcaaagaagtatcatgctttccttgcatctgaggctatcattaagcagattccccgacttcttggacctggtcttaacaaggcaggaaagtttccaactttggtgtctcaccaggagtcccttgagtccaaggttaatgagaccaaggccacagtcaagttccagttgaaaaaggtgctttgcatgggtgttgccgttggccacctgggtatggaggagaagcagatcttccagaacgtgcagatgagcgtgaacttccttgtctctctgttgaagaagaattggcaaaacgtgcggtgcctgtacctgaagagcacaatgggaaaggtgtaccggttgttctagactctagtcttctaggatttccaggagattgacaacttgggaacttttgttgctttctcaattatcaaattttcgtgcgcgtcgagtgacaattattgtcttgtactgagatggtttgttctattgtctggaacttcatgacattttatccgttgtccctgtgccttcctactgttctgctagctgtcaatcatcagcttaacgctagattcagcattggtccattgata

SEQ ID NO: 11142 - DNA, 894 bp, Zea mays
ctgcttgccttcgtcgcaccgcacgcactgattggtccagcagccctccagcggatcgtcccttcggaacccgcaaccaacctctcatccaaccgtccatcattctgccgatcggaccgtccattggactcacacgcggatcgacgggcccacccacacggatttaaaaggatcccgccgcggttgcatttggcactcatacatttcgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgctaagtcccccaagaaggcgtagagtgatctcctgtcttagaacaatattaccattagcaatcgtgcagttagactagatcatgtttagtgtagatccgcaatgttcttgtccctgcagccatctggaacggtttatctagtacatccgtgcactttccttgctaattgcaaaaaaagcggtctaatcttttgtttc

SEQ ID NO: 11143 - DNA, 2277 bp, Triticum aestivum
cgccgccgccgtcaatctcctcggtatatcaagccactccagatggcaacctatgagcccaagaacatcctcataaccggtgccgcaggtttcatcgcgtcccacgtggcaaaccgtctggtcaggaattacccgcgctacaacatcgtcattctcgacagggtcgactattgctccagccttagaaacctcgacccttctcgtggatccccgaatttcaagtttgtcaggggcgacatcgccagtgccgacttggtgaaccacctcctggtcaccgagtcgatcgataccgtcatgcactttgctgcccagactcatgtggataattcgtttggcaattcctttgagttcacaaagaacaacatatatggcacccacgttctccttgaggcgtgcaaggttactggccagatcagaagatttatccacgtcagtactgatgaggtgtatggagaaactgatgaggatgctgtggttggtaaccatgaggcctcacagttgcttccgacaaatccatattcagctaccaaagctggggctgaaatgcttgtgatggcttatgggaggtcttatggtcttcctgtgattacaacccgaggcaacaatgtgtatggaccaaatcagttccctgagaagctcatcccaaaatttatccttttggccatgaaaggcttgccccttccaattcatggtgatggctctaatgtcaggagctacctgtactgtgaggatgttgctgaagcttttgaggtagttcttcacaaaggagaggttggacatgtgtataatattggtactgtgaaggagaggagggtaattgatgtggccagtgacatatgcaagctatttggcttggacaccgaaaaggtcatcaggtttgtcgagaacaggcccttcaatgaccagaggtacttcctggatgatcagaaactgaagaagttaggatgggcagagcgcacgacatgggaagagggtttgaagaaaacaattgaatggtacaccagcaatcctgattactggggagatgttgccggtgcattgctccctcatccaaggatgttgatgacgcctggagttgaaaggcataactggactgaggaaatcaaatctcttgcttcttctccagctgaagccaaggaatgcagtacagtacctgctgcagccacatccaagagtaccagcagtgtccctcaaaaggccacctacaagttcttaatatatggcaagactggatggattggtggcctacttgggaagatatgtgagaagcaaggcataccttatgaatatggtaaagggcgcctgcaagagcgctctcagctcttgcaggacattagaaacgtgaagccgactcatgttttcaatgctgctggtgtcactggaaggccaaatgttgactggtgtgagacccacaaacaggacactatccgcaccaatgttgtaggcaccttgaatcttgctgatgtttgtcgtgagcaggggttgctcatgattaattatgctacaggttgcatatttgagtataatgctgaacaccctgaagggtctggaattggttttaaagaggaggacacgcccaactttgtaggttcattttattccaaaaccaaagccatggtggaagagttattgaaggactatgataatgtctgtactcttagagtcaggatgcccatatcatcagacctgagcaatcctcgtaacttcatcacaaaaatagcccgctatgacaaggtggtgaacattccgaacagtatgacaattttggatgaattgttgcctatctctgttgagatggcgaagcgggattgtaggggcatatggaatttcaccaacccaggggttgtcagtcacaacgagattctggagatgtacaaggaatacataaacccggacttcaagtggaccaacttcacgctcgaagagcaggccaaggttatagttgcaccaagaagcaacaacgaaatggacgcgtcaaagctgaagtccgagttccctgagctactgtccattaaggaatctttgatcaggaatgtctttgagccaaacaggaaggtgtctactaattgaggattcatgtgacacaggtctgctataagctatttctaattagctaatatattgcacggtggcagctgtggtcaattttattgtggtatagcatgcatacatatttaccattttttgttacgcgttatgtttcacttgagtattatcagatgttctatgtagtggtggatatgtttgctggcctggttatctatgagaacagatctt

SEQ ID NO: 11144 - DNA, 1593 bp, Hordeum vulgare
cacattcaattccggcgtccatccgtccatataaactcctcttcctccgtccgttgcaagtcgccaaccagccagccagccattgaacccctctcctctcctctcctctccgcgtcaaatccaccccggcgtccgttgtccggaagccccaccagctcggcgcgccgcacgtgcgtacgcataccgcgtcggtggaccgatcaatggccctgctcaaggccgcgcgcgtcgccgacgtgcccaccctcgacgtcgtcgtgccggaccacctcgccgccgccgcgcgcgtccgcctcgacgcggagtcggcggcgacgacgaagaggcagcagcgcggcgcggggcggcggttcgcggtgatcgggcaccggggcaaggggatgaacgcgctggcgtcgccggaccggcggctgcaggaggtcaaggagaactctgtccggtccttcaacgaggcggcgcgcttcgccgtcgactacgtcgagttcgacgtgcaggtgaccaaggacggctgcccagtcatcttccatgacgacatcatccttactgaagaacatggcaaaatttcagataagcgtgtcactgatcttcagttggaagacttcctccagtacggcccacaaaataagcaaggaaagaatggaaagcctttgctgcggaaaatgaaggacggtcgggtgttgaattggaacgtccagtcagatgatcccctttgcacccttcaagaagcattcgagaaggtcactccaagattgggcttcaatgtcgagctgaagttcgatgaccatcttgcatacgaagaggaagagctcactcacatcctccaggccatcctcaaggttgtcttcgagtgtgccaaggataggcctatcatcttctctagcttccagcccgatgctgcgcaactcatgcgaaaactgcagagtacatacccagtgtacttcttgacgaacggagggacggagatctacgccgacgtgcggaggaattcgttggaagaggcggtcaagctgtgcctctccactggcatgcaagggatcgtgtccgaggcccgcgcagtcttcaggtttccgaccgccataccgatgatcaaggaggctgacctctccctactaacttacgggacactcaataacgtgccggaggcagtgtacatgcagcacctcatgggggtgaacggggtgatcgtcgacctcgtgccggagatcacgggggccgtctctgacctcatcgcctccccggagaccgacacggagatcaatgatctgagcagccaagtggtgaaagatgccgcgtcgacgccgaatttcacgcagcgggagatttcattcctgctgaggctgatgccggagcttgtgcaataacacagattgcaccccgttcatggccttggatgtaactgactgattggcatacaggaagaggagccacttgtggagggaagtacaagtatacgtactgggtgggttggtgtgcttcggtgagctctctccctggagaattgggaattggggattgatttatacatgttgtagcgagggtgatgatttttttggatatacagtgaatgtcaccgtcacaatggcggtgttacta

SEQ ID NO: 11145 - DNA, 1893 bp, Setaria italica
gcctgctgctactgctactgtgctggctgacgccggcggtggggcttgggcgtgagcggattgcgagctgccactgcccgctgctgcggtcggcgacgacgagatggacgctcggtgggcggtgctgctcgcgctgctggtggcgagcgccggcgcgggcggcgcgcgcgccgcgggggtgaagggcgcgaactggctcggcgggctgagccgcgcgtcgttccccaaggggttcgtgttcgggacggcgacgtcggcgtaccaggtcgagggcgccgcgtccaccaacggccgggggccctccatctgggacgcattcgcgcacatcccaggaaaagttgcgggaaatcaaaatggagatgtcgcagtggatcaataccatcgctacaaggaagatgttgatctcatgaaaagtttgaattttgatgcctaccgattttcaatctcatggtccaggatcttcccagatggcgagggaagagtcaacccagaaggtgtagcgtattacaacaatctgataaactacctgcttcagaaaggcatgactccttacatcaacctttaccactacgatctacctcttgcactcgagcagaaatatggagggtggttaagctcaaagatggcggacctctttacagagtatgttgacttctgttttaagacctatggcgatcgtgtaaagcactggtttacattcaatgagccaaggatagtagcactgcttggttatgacgcagggtcaaatcctcctcaaaggtgcaccaaatgtgctgccggtggcaattcagcaaccgaaccttatattgttgcgcataattttctcttggcacatgctgctgcagctgcaagataccgtacaaagtaccaggctgctcagaagggtaagattggaatagtcctggacttcaactggtatgaacctcttacaaactcaactgacgaccaagcagcggctcaaagagctagggacttccatattggttggtttgttgatccattgataaatggacattacccacagataatgcaagatcttgtgaaagagaggctgccaaggtttactcctgagcaagctaaattggtcaagggctcagcagactatattgggatcaatcaatacacagccagctacatgaagggccagaaattgctccagcagacacctactagctactcagctgattggcaagttcaatatgttttagcacgaaatggcaagccaattggaccacaggcgaattctaattggctttacatcgtcccgtggggaatgtacggatgtgtgaactatctcaaggagaagtacggaaacccaactgtctacataaccgagaatggaatggatcaacctggaaacctgacccgcgaccagtacctgcgcgatgtgacaagggtgcggttctacaaaagctacctcgcccagctgaaaaaagccatagatcagggcgcaaacgtggctggctacttcgcctggtctctccttgacaacttcgagtggctatcaggatactcttccaagtttggcattgtctacgtcgatttcaacaacaagctcgaacggcacccgaaggcttcagcctactggttcagggacatgcttaagaagaattgaggttcctagaggcgaagcgcgaagttaacatttttctctgctttgcctagtgttttggatggcccaatggttcgaatccagctcagtgctaggctatcaaaatgggaataaaagaagacgaacagccactccaattgattgtgcattccgttccatgtaatggtcagaaatgttgtgacttgtgagtatgttttctgtggagttcgagctgtggttatttatcttgtggattcaacatatttgaaagaatgcttgatcacgagtgatatcttgatgaa

SEQ ID NO: 11146 - DNA, 2155 bp, Setaria italica
cgcgcgcccctccccaacccctccgctcccgagtattctattctatattccattcccctgggggccgagcgggccgaaccgattcaacacgctgtgcgcgtctcgtgtcgggcggggtcgcggatataagcccgcgcgcgccgctcgtcaaggaggacggcagcgcgagatcactcgatcgcgcgcccacacaacacgcacagaggcggcagaggaaagcggcgcgcggcagagcaggttgccagagcagagcacagcggcggtggggcatccacggcacatgcgagcaggagcagcggcgcggaggcagccgcatgcggaggcgccgcgcggggtctctcctcgtgcaatgagcggcgcgggcgccgcgtcgtcgtgccggcggcggcagctcggggtcgcggttctgctgctgctggttgctctcgcggccggtcttggtggagcagaggggaaggcgcacaactacgaggacgcgctgcagaagagcctgctctacttcgaggcgcagcggtcggggcggctcccgcacagccagcgcgtcgcctggcgccaccactccggcctcaccgacggcctcgagcaaggggtggacttggtgggcggctactacgacgccggggaccatgtcaagttcggcctgcccatggcgttcacggtgacgatgctgtcgtggagcctgatcgagtacggcggcgacgtcgcggcggccggcgagctcggccacgcgctcgaggccgtcaagtggggcaccgactacttcatcaaggcgcacaccaagcccgacgagctctgggccgaggtgggtgacggcgacacggaccactactgctggcagcggccggaggacatgacgacgtcgcggcaggcgtacaaggtcgaccgcgaccacccgggctccgacgtcgccggcgagactgcggccgccatggccgccgcctccatcgtcttccgcgactccaacccgcactacgcgcacctcctcctccaccacgcccagcagctgttcgagttcgccgacaagtacaggggcaaatacgacagcagcatcgcggaggtgaagagctactacgcgtcggtgagcgggtacaaggacgagctcctgtgggccgccctgtggctccaccgcgccaccggcagggccgactacctcgactacgtcgtcgacaacgcccactccttcggcggcaccggctgggccatcaacgagttcagctgggacgtcaagtacgccggcgtccagatcctagcaacaaggttgctgctgagaggggagcacgcggcgcgccaccggagcacgctggagcagtacagggcgaaggcggagcactacgtgtgcgcgtgccttggccggaacgcggacggcggcgcggacgccaacgtggagcgcagccccggcgggatgctctacatccggcagtggaacaacatgcagtacgtgaccagcgccgcgttcctgctctcggcctactccgactacatggcagaggccggcgtcgtcaccgtgcagtgtggcggcggcgaggccgtggcggcggaggaggtgtttgcgctggccagggcgcaggtggactacgtgctgggcaccaaccccaggggcgtcagctacctggtcgggtacggccccaagtaccccaaccgggtgcaccaccgcgccgcctccatcgtgccgtacaagcacagcaaggagttcatcggctgcacgcaggggttcgaccactggttcggccgccggagctccaaccccaacgtgctcgtcggcgccatcgtcggcgggccggaccgccgggacaggttcagggacaacagggagaactacatgcagacggaggcgtgcacgtacaacaccgcgcccatggtcggcatgttcgccaagctgcaccggatggcgcggcaggagccggaacgggggccgacgccggcagcgccggtgacgtcggcggcgtctgaggtgtaaatagataggacgtagaggggggcctgtacaattttccccattctttggttcaattcttttgggctttggattccattttacacagatcggagatgattgtatacaaaaaggaagaagaaaaggggtggaggcattgacatgcaaatgtaaattcgctaccagtacatacgaggaggaaaaaaaaattgacatgcttaa

SEQ ID NO: 11147 - DNA, 805 bp, Zea mays
cttgccctcaggtctccccaccgcccccgatccaccattcctcctccggatttcgcagtcagcggtggtgaaggtagcgggcgcggaggaagatggggctcgcgttcgggaagctcttcagccggctcttcgccaagaaggggatgcggattcttatggtcggtctcgacgccgccggtaaaaccaccatcctctacaagctcaagctcggcgagatcgtcacaaccatccccaccatcggtttcaatgttgaaactgttgagtacaagaacattagcttcacggtctgggatgtcgggggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgagggcctggactggctgtccagcaacattgcgagcaaggcttgaatatcaaatgcgaactgactaggagctccggatgtatcatggaaacttaggacagaatcgcctctacaacctgttaggtgtcttctaccggcacaatatattttttgtttggaatatgtaatgatgttacggttcaacgtttattctaccctactatactgttggat

SEQ ID NO: 11148 - DNA, 1881 bp, Oryza sativa
cggaagccctcaccctcccaaaactcccacgcacaccaccaatggccgccgccgccgccgccgccaccgccaccgcctcctccggcctcatccgctgcgccacgggaggcgcgccggcgcacggccaccaccaggtgttcaggtgctccgccgccaagccgtcccctctcgcgctgcgccaccgcgcgggccgccccgcgccgctgcaggccttccccgaatacgaccgcgtcacgcctttcgactatgacggtgaggtggacggcggcgacggcgacgaccacccgcgcgaggagtgcggcgtgttcggcgtcgtcggggacccggacgccacgtcgctctgctacctcggcctgcagaagctgcagcaccgcggggaggagggggctggcatcgccgccgcgggggacgacggcacgatcaagctggagaggggactggggctcgtcggggacgtgttcggcgacccggcccgcctcggcaagctccccggccaggccgccatcggccacgtgaggtactccaccgccggcgccgccgcctccctgcgcaacgtgcagccgttcctcgccgggtacaggttcgggcagctcgccgtggcgcacaacggcaacctggtgaactaccaggcgctgcggaacaagctggaggcgcagggctccatctttagcacgtcgtcggacacggaggtgatcctgcacctcatcgccacctcgctctcgcgccctctgctcgcgcgcatctgcgacgcctgcgagcgcctcgccggggcctactcgctgctgttcctgacggcggacaagctcctggccgtgcgcgacccgttcggcttcaggcccctggtgatgggccgccgcgccaacggcgccatcgtgttcgcgtcggagacctgcgcgctcgacctcatcgacgccacgtacgagtgcgaggtggagccaggggaggtcgtcgtcgtcgaccgccgcgacatgtcggtgtcctccgcctgcctcgtcccgcaccgcccccgcaagtcgtgcgtcttcgagcacatctacttcgcgctcccaaactccgtggtgttcggccacgccgtccacgagcgccgcaacgcctacggccgcgcgctcgccgaggagtcccccgcccccaccgccgacgtcgtcatccccgttccggactcggggttctacgccgcgctgggattctcgcagacgtcggggctcgagttccagcaaggcctcatccggtggcactacagcggccgcagcttcatccagccgtcgcaggcgatccgcgacctcgccgtcaagctcaagctcgcgcccgtgcacggcgtcatcaggggcaagagcgtggtggtggtcgacgactcgctcgtccgcggcaccacctcgagcaagatcgtgcgcctgctccgcgacgccggcgcgcgcgaggtgcacatgcggatcgccagcccgccggtcatcggctcctgcctctacggcatcgacacgcccagcgagggcgagctgatatcaaacaggatggacctcgagggagtccgcagggcgatcggctgcgactccctcgcgttcctctcgctcgacaagctccacaccatctatggcgacgaggcgcatgagctctgcgacgcctgcttctcgcggaattacccggtgctccccaccgtgccggagccggtgccggagttggtgtccgccttcgaagactgacatgaactcgcaactaggggaagtggctctactatactctgcaatctgcatatgcttatatagaaattttagactcaattttggggcttggtggcaatatttgtccttgcaattgcattcatcaatctgaattttgggagtaaggtttaggtattggatattgatcgagctgatacggttaagt

SEQ ID NO: 11149 - DNA, 1208 bp, Sorghum bicolor
tcaatggcttctctgccagccgccggcggtgctgcaggtggcgattcttcagaccagcttttggtagaagcagatggctcaacacggacacttattttgaataggccaaagaagcttaatgtactctcctccgcaatgattaagggactcctcaggtgtttcactgtttatgagaaagatgacagaattaaattgttgattatgaagggtaaaggaagagcattttgtgctggtggtgatattactggctgtgtccggtctatacataacgaaagttggatagggggtgctgatttcttccgacatctatatttgttaaactacagaattgcaacctatatcaaacctcaggtttctcttcttactggaatcgtcatgggtggaggtgctggtgtttctttacatggaagatttcgagttgtcactgataacacgatttttgcaatgccagaaacagctctgggtctgtttccagatgtaggcgcctcatattttctatctcggctccctgggttctacggggagtatcttggtctttctggtgccagattggatggcgcggaaatgcttgcatgtggtctggcgactcattttgtcccatcaaataggctgctattgctggaagagtcccttaaaaaggtaaacacctcgaatccttttgttgtgggtagtactatcgatcagtttgctcaacagccatcactgaaagaaaacagttccttgaataggatggaaatcatcaacaaatgcttttctaaaaggacagttgaggaaattatatcctctcttgaggaagtggcctcagatttggctgatgaatgggttgctgcgacaatccagtatttgaaaaaggcttctcctactagtttgaaaatctctctgagatcgataagagaagggagaactcaaactgttggggagtgcttgcatcgggaatatagaatggtttgccatgtcatgcgcggtgacttcagcccagacttctttgagggatgcagggctgtactagtagataaagataaaaacccaatgtggatgcctccaaggttggaacaagtgcatgacaaggccgttgaagaatatttctcaagaattgatgatccagagtgggaagatttgaacctacctgccagacgttccaatggaagaattgttgagtctatgctttgatggaagtctttggtgaagtgttcaatggagcctccgtt

SEQ ID NO: 11150 - DNA, 1375 bp, Gossypium hirsutum
ccatccccattctttcaaagaaaaagacctcggcaaaggcagtccacaaaatctttctctcttctctcctattttaaccattccttccttgtcctcgccccttccctagcaagctacatttccatggccccccctgaattggttcgacccagtgataaatcaaacgttttcgctaaacaagtcactttgcgtaatcgtgcatatgttacgttcttggccggaaatggggactacgtcaaaggagttgtagggttagccaaagggttgaggaaagtgaaatcggcgtaccctttagtggttgctgttttacccgacgtgcctgaggagcataggcggatcctggagaaccagggttgtatcgtccgagagatcgaacctgtttacccgcctgagaaccagacccagttcgccatggcctattacgtcatcaattactccaagcttcgtatttgggagttcgtggagtacagtaaaatgatatacttggacggcgacattcaggtatacgacaacatcgatcacctatttgatctgcctgatgggcatttctacgcagtaatggattgcttctgtgagaaaacatggagccactccccacaatacaagatcggttactgccaacaacgccctgacaaggtgaagtggcccaccgagatgggaaatccccctgcactttacttcaatgctggcatgttcgtgtttgagcccagccttgtgacttacgaatctctcttgaagactctcaaaatcacacaacctaccccatttgcagagcaggactttttgaacatgttctttaaggacatttacaagccgattcctttaatttacaaccttgttctcgccatgttatggcgtcatcccgagaatgtggagcttgaaaaagtgaaagttgttcactattgtgctgcgggatcaaagccttggaggtacacagggaaggaggataacatgcaaagagaagatattaagatgcttgttcagaaatggtgggacgtttacaacgacgagtcacttgattatggtaccagcgcggctgaaggagggacagagaccgttaacctgcagccgtttctggcggcactctctgaagctggggcagtccatttcgtggccgctccatctgcggcgtaaatatgttctgtaacgacgataaaaaacagtccataggtgtaaagaaatattgtaagaatcgagaaaggggcgatcctatgtggaaaacaaaggtggttttaaacaagggttgaggaattggtgaaaagctcttaggggtttttaaactatttagggcgttgtttttacttgatgaatggtgatgaaggtcgagtgtggggtcaaagtgggtgtttgtttattgtgtggctctggcaaaaag

SEQ ID NO: 11151 - DNA, 1348 bp, Sorghum bicolor
ggcgcccgtccgtttccgcttcctcctctccctgtctccgctccactccattccagtgggcgccgccgccgaccgaatccaggtgaccgaccgcctctccctcctgcaactgacgccgtgccgcccccttcttttttatatcactaaagcaccaagaatataagagaccggcacgatcgcctccgcagcgctcttccattcgtccccaactccctatggcgccgccggtcgccctgctccttctcgccgccatcgtgctcgcgcgggtcgtcacccacgcccacggtggcggcggcggcttctatgatccggcgcgcgtcacccagctctcctggcgccccagggcgttcctctacagcggcttcctgtcggacaccgagtgcgaccacctcatcaacctggcgaaaggcagcatggagaagtcgatggtggcggataacgactccgggaaaagcctcatgagccaagtgcgcaccagctccggcgcctttttggccaagcacgaggatgaaattgtctctgcaattgagaaacgcgtagctgcttggacatttcttccggaagaaaacgctgaatcaatgcaggttctgcgctatgaaatcggtcagaagtatgatgcccactttgattattttcatgacaaaaataacgtgaagcatggcggtcagcgatttgcaactgtccttatgtacttgacagatgtcaagaagggtggagaaactgtatttccaaatgctgagggaagccatttacagtacaaggatgaaacttggtcagagtgttcaagatctggcctggcagtgaagccaaaaaaaggagacgcgctactgttcttcggtcttcatctcaatgcaacaactgatacaagtagtcttcatgggagctgcccagtaattgagggtgagaagtggtctgcaacgaaatggattcacgtcagatcattcgataatcctccaaatgtaaggatggacgcgccatgttccgatgacaatgagctctgccctaaatgggctgctattggggaatgttacaagaacccaacatacatggttggcaccaaggatactaatggattttgccgcaaaagttgtgggctctgtgatgcttgaactcctcaaccaatctgaatatggtttggggtgttaagccactcactataggttttgaccccatcatgtgtttcactctgctgagttgtagataacagatgaaccaggtccctgagtaatacaggagtgatgtttactcctttccatatgacctgtaaatttacctgacagcatcttgagataataaaagtaaaaaatttctgtcaggacgacgcaaactcgttctgtgttacttgcca

SEQ ID NO: 11152 - DNA, 1555 bp, Sorghum bicolor
gtcgagcacaagcaagaattggctcgatcctcatccctgctgtaagtgtgtttcagagtgctgctgtgctactggcgacggcattgagccgcttgcctgctcgtcgtctcgtccaaggaaggaagagaccgatggcttctctgccagtcgccggctgtgctgcaggtggctattcagaacagcttttggaagaagcagatggctcaacacggacacttattttgaataggccaaagcagcttaatgtactctcctctgcagtgattaagggactcctgaggtgtttcattgtttatgagaaagatgacagagttaaattattgattatgaaggggaacggaagagcattttgtgctggaggtgatattactgaatgtgtccggtatatacataacgaaagctggaaatggggtgctgatttcttcagagatctatatttgttaaactacattagtgcaacatatatcaaacctcaggtttctcttcttactggaattgtaatgggtggaggtgctggggtttctttacatggaagatttcgagttgccactgataacacggtttttgcaatgccagaaacagctcttggtttccttccaggtgtaggggccacatattttctgtctcggcttcctgggttctatggagagtatgttgctcttactggtgccagattggatggtgctgaaatgctggcatgtggtctggctactcattttgtcatgtcaaatatactactattgcttgaagaatcccttaaaaatgtggacacctccaatacttttgctgtgcgtagtactatcgatcagtttgctcaacagccatcactgaaggaaaacagttccttgaataggatggaaatcatcaacaactgcttttctaaaaggacagttgaagaaattataagcgcgctagagcaagtggactcaaatttgtctgatgaatgggttgctaggacaatccagtgtttgaaaaaggcttctcctattagtctgaaagtcactctgagatcgataagagaagggagaacacaaactgttggtgagtgcttgcatcgggaatatagggtgatttgccatctcatacgtggtgacttcagccgagacttctttgagggatgcagagctatacttgtagataaagatcgaaacccaatgtggatgcctccaagtttggaacaagtacatgaggaggtagttgaagaatatttctcaagaattgatgatccaaagtgggaagatttgaacctaccatacagacgttcccatggaagaattatggagtccaagatttgatggaagtctttgggaagagtttaacggagcctcggttgtggtcagaataacgaatcatctcatctttgaagagcctatgtagactgaagactactgctacaataaaactgattgtgccatattggtccacttatatcacaaatgatactctttgttattcaatttgtattgctagactatcagtcagctcatcttgtctgaccactcgagtttgattgtttagttcacaagctatactactacagtgctagaggatgggc

SEQ ID NO: 11153 - DNA, 991 bp, Zea mays
aaccagcaaacaaataccagtaccgctccactacttgattgccgcctcactggcaccgctggtccgctcccagttccagtgacactgcaccagaccacccggctccagcgagatccagacccaaaacctcacctcgcagccaacctctgctcggaggggaagggaagggaagggaagcaatggcggccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacccgcagtctccaggtcgacggcaaggtcatcaaggcccagatttgggacaccgccggccaggagaggtaccgtgcaatcacaagtgcctattaccgaggagccgtaggggcactgcttgtctacgatgtcacccgtcgcgccacgttcgacaacgtgggccgttggctgagggagctcagagaccacaccgaccagagcatcgtcgtgatgctggtcggcaacaagtccgatctccggcacctggtggccgtctcgactgacgacgccaaggagttcgccgaggccgagtccatgtacttcatggagacgtccgccctcgacgccaccaacgtggacagctccttctcggaggtgctgacccagatataccagatcgtgagcaagaagacggtggaggcctccgaggagggggcggccgcccctggcaagggggagaagataaacgtcaaggatgacgtttctgcgatgaagagggttgggtgctgctcaaactaaggcgaatagccggatacgaactgtttgttcgattgtctttctgtggatgctgagggttagaggaccgttgagagagactatcagcttaaattatttattatcagctctgaattcgtggttctgtcaaattcaatcatttttttgtgttc

SEQ ID NO: 11154 - DNA, 544 bp, Medicago truncatula
tgacaacgttgaagaagccgcaaatatgcagatcttcgtgaaaaccctaaccgggaaaaccatcaccctcgaggttgagagcagtgacacaatcgacaatgtcaaggccaaaattcaagataaggaaggtattccaccggatcagcagcgattgattttcgctggtaagcagcttgaagatggacgcaccttagctgattacaatatccagaaggaatcgactcttcatctcgttctcaggcttcgtgggggtatcattgaaccttctttgatggctttggcaaggaaatacaaccaagacaaaactatatgccgcaaatgttatgcccgtcttcatcccagggctgtgaactgccgcaagaagaagtgtggtcatagcaatcaattgaggccaaagaagaagatcaagtaaactttggttgatattgcttctttcctgtgttttgttctgagatacttttgatggttttggtttctgcttatcttttctttggatcacttgttttaatatgttgaatgtagttggaacttattttggtatcaa

SEQ ID NO: 11155 - DNA, 1475 bp, Solanum lycopersicum
gtgaccaaacctctgccagtaccagtagttctacagactaaaaattcccaaaattgaacttcttaatggctcttcaggcttcttctctacttccttctactttctccaagggcaaagctagtgcaactttgaagaattctagtatttttggagcttctctttctgattatactaaatctgattttggttcatcttcatttagagttaagaaccaaagaagatcgtcaaatggcggtgttgtaagagctacaatggttgcttctcctggtgtaactactaactctccatcaggaaaaaaaacactaagaaaaggttgtgtaatagtcactggtgcctcatcaggattaggcttagccacagcaaaagctctgtctgaaacagggaaatggcatgttattatggcatgtagggactttttaaaagctgagaaagctgcaaaatcagttgggatgcctaaggagaattacaccatcatgcatttggacctcgcctcgcttgacagtgtacgtcaattcgttgataacttcaggaggtcgggacgacctcttgacgtgttggttgctaatgctgctgtttaccaaccaactgctaaagagccttcatttactgcagaaggatttgagcttagtgttggaactaaccatcttggacattttcttctttcgagattgttgcttgatgacttgaagcaatctgattatccttcaaagagactcatcattgttggttcaattacagggaacacgaatactctggctggaaatgtacctccaaaggccaatctcggcgacttgaggggtatggcgggaggtttaaatggaattaacagctcagcgatgatcgatggaggtgaatttgacggtgcaaaagcatacaaagacagcaaggtgtgcaacatgcttacgatgcaggaattccatcgtcgataccacgaggaaactggtatcacatttgcctctctttaccctggctgcattgcaacaacagggctattcagagaacacatccccttgtttaggcttcttttcccaccatttcaaaagtatattacgaagggatatgtctctgagactgaatctggaaagagacttgctcaggttgtgagtgatccaagcttgacaaaatcaggtgtctactggagctggaacaaagactcagcttctttcgaaaaccagttgtccgaagaagcaagtgatgcagagaaagcgcgtaaagtgtgggaagtcagtgagaaactcgttggtttggcttaaattttgaactaaccttagtcatcgtcgatgaaaacaggaaaaatgacttcgcgagtgagaatttgtaaccgaaatttctaggatgttgtaaagagaagtgtcattgtagttaggattgaaaataaagatcactcaacttgttttgttttgtgtttggaaaatgtcactaatttgcctttgaagttaaatgaagtgatggttcatgagcattgttcaattaaa

SEQ ID NO: 11156 - DNA, 5110 bp, Oryza sativa
cgcttcgcgtgcgcattcgcagctaccagtttggtttgcggcgccaagaattggtggctatagccttgccttttcttttcttttcttttcttttttgcatgtttgggcggcggcgatcgagctgagtcgatcggccggagtggatcgacgacggaaatggggacgccggtgaacatcatcgtcgggtcgcatgtctgggcggaggatcccgacgacgcgtggatcgacggggaggtcgtcgagatcaggggcggcgacgccaccatcgtcagcaccgatggcaaaacgattgtggcgagcctcgcaagcatttaccccaaggatacggaagcgccacctgcaggagttgacgacatgacgaagctggcttacctccatgaacctggagtcttgcataacctcgcttgtcggtacggtattaacgagatatatacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagagtctaatccagtactggaagcatttggaaatgcgaagacggtgaagaacaacaactcgagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggattgtggacaagattaacaactcaatcggtcaagatccagatgcaactaatattataggagtacttgatatatatggatttgagagtttcaagattaacagcttcgaacaactatgtatcaacttgacaaacgagaagttgcagcagcactttaaccagcatgtattcaagatggagcaagaagactatacaagggaggaaatagattggagctatgtggaatttgtggacaatcaagatgtgctggacttaattgagaaaaaacctggaggaataattgcactactggatgaagcatgcatgtttccaaagtccacacatgaaacatttgcccaaaagatgtatcaaacatacaaggcacataagcgcttcagcaaacccaaacttgctcggacagcctttacaatcaaccactatgcaggagatgtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaagcaacaactacaagctctcatggaaacactgagtacgacagaaccacactacattagatgtgtgaaacccaatgctgtacttaaaccaggaatctttgagaatttcaatgtccttaaccaattgagatgcgggggtgttctggaagcaatccggatcagttgtgctggctatccaacaaaaaggacatttgatgagttcattgatcggtttggaatgcttgcagcagagcttgtcgacagctctgatgagaaggctgcctgtgcagcaatatgtgataaaatgggtttgaagggatatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggagggcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccagactcgatggcgccaacacaaagcttatgttgattacaaaaagcaaaaaagagctactttgattcttcagtgcctgtggagagcacgtattgcaagaaaggaacttcgaaagctcaaaatggaagcaagagagactggcgcactgaaagaagcaaaagacaaacttgaaaaaagagttgaggaactcacatggcgattagatgttgagaaacacttgaggattgaccttgaagaagccaaggggcaagagatttcaaacttgaaatctgtgttgcaagaaatgcaagaaaagctttcggaagcacatgcagcaatagaaaaggagaaagaagatgcaaaactagcaattgaacaggcaccaccaaagatagtagaggtgccggtggtggacaatgcaaaagttgagctgctgactagacaaaataaggaacttgaggatgaacttgttacatttagaacaaaggctgaagatctagaaaagagacttctagaggttcaaaaggagtccgatgaattgtcgagggaaattctagaaaaggactccaaacttaatcaacttcaggagatgatagaaaggcttgaaacaaatttatccagcttggaatctgaaaaccaggtcctacgtcaacagtcactacttgcatctgcagatgacgataaatcaaagcaaatagagagtctggaaagcaagattgccatcttggagtcagaaaaccagttgctccgcagtaaatcttctgtagctgttcaagcagtaattactcctgaagtgattcagccatcagcaatggagggccttgtgaatcgatatcagcttgaagaacataaaatcctcattgaggaggtggttgttcctcctataaagaatttaagcaaacaaaagtcgctcacggatcgacaacaagaaaatcatgatgtcctgatcaaaagtctggctgaagacaggagatttgacaacggcagaccagctgcagcatgcatcgtgtacaaatcactcctgcactggcactcatttgaagcagagaagactaacatatttgaccgaatcatccatacaattaggtcatcaattgagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggctccaagggctgttcgtgtgagatcatccaggggatcgttgaaaagtgtacattctaattcactatcaaggcaaacatcaagtgtgcattggcaaagcatcattaagtgcctgaaccatacactcgaaacaatgaacaataatcacgtacctccaatgataatcaggaaaacattcaatcaagcatttgcctttatgaacgttcaactcttcaatagtttgctactccgtcgagaatgctgctcctttagcaatggggaattcttaaaggctggtttacaagaattagagcagtggtgctctgtaacaactgaagagtatgcaggaacgtcttgggatgaatttcagcacatcagacaggcagttggatttctggttttgcatcagaagacacataaaaccttggaggaaatcactgatgagctttgcccagttttgagcatcactcaaatatatcgcattggaacaatgttctgggatgataaatacggtgcacaaggtctatctcaggaggtcattggaaagatgagaacaatggccactgatgactcaataactactccaaatagttcgttcttgttagatgacgactcaagcatacctatatcgttggatgatatagcacgactgatgcttgacatagacctatctgacgtggaaccaacaccactgctcaggcagaactctcagttccactttctactgcagcaccacgccacacagactgatggcattgtttgttaatgcaaagttgaaaacataattaaacaggttccgctattttgtgaagttcctcggtggtgatttcccttttttttatgggagtgcaggcttgccttttttttgttggcaatttcaggtgggagattttacaagaaagaaaaatatagaagatttttttaccattcttttcatttgttctgattgtttgaaagaggaaaggttgtatttttaatgtaaaagtgtacaagcgaaagtaaatatatgtatattttcagctaaa

SEQ ID NO: 11157 - DNA, 1247 bp, Sorghum bicolor
tccaaaatcaacgaaatataatactaatacctccaaaagtttttttggttctttttttttgaaaataatcgtctcggaaatttgcacaagtttccaaatctcccactatataaggagacacagctaggtggttgatctcaaaagccattcaatcattcaagagaaacaaccaagagcccgcactctcactgtgactccgtgagcacactcgccgcacagccgcaccagctcagctcagtaatcatggctcgcccgggtagtagtgccgctgctcccctcctcctgctgctcgccgccgcggcggcgtcgatcctggcagcggcagccgcgtcgccggcgccgagcgacttcgtccgcaagtcgtgccgcgcgacgcagtacccgtcggtgtgcgagcagagcctggcgtcgtacgggggctccccggcgccgcggagcccgcgggagctggcgcgcgccgcgctgtccgtgagcgcggaccgcgcgcgcgccgcgtcggcctacgtgggccgcctgtgcggcggctccagcagctccgccggccacaagaagggcgctgctgcgaggaagggcggcgcgcccgggtcggcggcgggacccgtgcgcgactgcctggagaacctggcggacagcgtgggccacctccgcgacgcggcgcaggagatgggcggcgccgggatgtcccgctccgggacgcccgcgttcaagtggcacctcagcaacgtccagacctggtgcagcgccgcgctcaccgacgagaacacctgcctcgacggcctctcctcccgcggcgtcgacgccggcacgcgcgccgccatccgcggcaaggtcgtcgacgtcgcgcaggtcaccagcaacgccctcgcactcgtcaacaaggtcgggccagggtactagcccaggcccaggcccagcccaaatagccctcgctacttagtccatacacgtattatacttcggtgcgtcggttaagtacgtagaccagttttccacgtgttgcttctgcttatgattcctcgtgtttgtaagatgtcgttaagggcgacaatgataaagcttgtaatattatggacttatgacaacaagtacagtaagcatgtactacaaaataagtctcatcgttacgttcatatggtcttcgagaaacgaaaattttcttttactaccgatctttctccaatgtgggggtgtcactcatttttaacagatggagtaaatattattgttcactgaacaacgtttttgct

SEQ ID NO: 11158 - DNA, 1157 bp, Solanum lycopersicum
aattccactgcactctgtttttctcaaatcacaaaattaacctattctttatctttctttttggtgtacaatacaaatggcaaaagatatggaggttggtactgaatatgcaccaaaagactaccaagacccacctccagcacccttaattgatcctgaagagttaggaaaatggtcattttacagagctataattgctgaattcatagctactctgttatttctctacataactgtccttactgttattggctacaaaagccagagctccactgatcaatgtggtggagttggtattcttggaatcgcttgggcatttgggggtatgatctttgtacttgtttactgtactgcgggtatttctggtggacacattaaccctgctgttacattcggccttttcttagctcgaaaagtatcgttggttcgagctatcatgtacattgtagctcaatgtttaggagccatttgtggttgtggattagtaaaagcttttcaaaaagcttattatgtcaaatatggcggtggtgccaatacgttgaacgatggatatagtactggtactggtttgggtgcggagatcattggaacattcgttcttgtttacactgtttttgctgctaccgatcctaagaggaacgccagagactcacacgttcctgtacttgcgcctctacccattggatttgcggtgtttatggttcacttggctacaattcctgtaactggaactggaattaatcctgcaaggagttttggtgctgctgttgtttatggacataacaaagcttgggatgatcaatggatattttgggttggaccatttattggtgctgcaattgctgcattttatcatcagtttattttgagggctggagctgttaaagcacttggttcattcaggagcaatgcttaattagtacaattatcatgaagaattgaaaattgtatatataagtatttgagaagaaaaaaaagtctctttgaattatgttgttagagttgtgttggatgtttggcacttaattttagatttgccaaacactacatttctactttatttcccttttttctttgtgtgtgttggtgtttttgtaatttttactatgctaatgttttaagcatctaaataatgaaaatagcaaggctattgtcca

SEQ ID NO: 11159 - DNA, 1382 bp, Arabidopsis thaliana
ctctcctctcctactttacttatttcattcaaagcaagaaatcgaaaaaggaccccaaacttttttcttccttcatctttctctcctcccatcatcatcaccatgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttgaatcttggtaagtttaagaaactatataatctataatttcatataatctatttgctatgtgttgtgatgtaatgccaaaactatttatgtttgtagtttttttttttttttgtattctttttgttgtcgttgttggttactattctagtattttaagtttcaatttgtaaacaaaaaaacaaaattgggggagatattcaagaatggagagagatacttacattatatactggtgatttgtctgtattgaattgaaaggtggaacagaacttactgtgtttaattatcggaaagctcttggtttggtgatgaaatgttcacttaatgact

SEQ ID NO: 11160 - DNA, 1797 bp, Oryza sativa
atcgtcgtcatcgtccacacgtacggtgagtcgagtgagctagccatagctagctatgaagaaggcggccgccggcggcatggcgcctcttcctccgtcgtcgtctcctccgtcgtgcaaagccggcggtggtggtggcagcccgaggtggtcgttgcttcacggcggcggcggcgagtggggcgtcgtggtgcggcggaacgtcgtcaagtcgtcgtcgctgctgctgctggtgttctccaccttcttcgtcttctccgtcttgcgctcgtcgcagacgagcttagtcccgccgccgccgccggctgctgccggccccggcgagccggcgctggcgcagagtggtcacgacgttgccggcgatgatggcggcgaacatgtcgccgtcgcagtcaacaatgtggcagctgagacgcagagcacgccggatgacatctcgctgccgtcgacgaactcatcggctgcagctgttccaacaacaacaaacaaagctgaacaacaacaaacaggagcgaacaacatggaggagaaatgcgacatgtcgatggggaagtgggtgagggagcccaagggcccggtgtacaccaacacgacgtgcccgacgctgccggacttcaagaactgccagaagcacggcaaggatcccggccacctctactggcggtggcagccccacggctgcgacctcccgcgcttctcgccggaccgcttcctcgccgccgtccgtggcaagcgcctcgccttcatcggcgactcgctggctcgcaaccagatggactcccttctctgcctcctctctcaggccgagacgccgacggaggtgtaccgcgacgcgcacgacaagttccagacgtggcggttcgcggcgcacgagttcacgctgatggtgatgtggacggagttctacgtgcacgcggagccggtggtgggcgccgacggcaagccgacgccgtcgttcgacatccacctcgacaggctgagcgccaactggacgcgccgcctgccggagctcgactacgcggtcatctccggcggcaactggttcaaccgccccaactacctctgggagggcggccgccgcgtcggctgcgtcaagtgcggcggcgcagccaacctcaccgacgttggcgtcccctacgccgtccgccgcgtggtgcgcgccgctgtcgagggcatcgcgcggtgcaccggctgcaaggccggcctcgtcgcgttcctccggaccttctcgccggaccacttcgagcacggcgcgtggttcagcggcggctactgcaaccgcacgcggccgctggaggaggacgaggtgagcccggacagcgccgcgtgggagctgaggagggtgcagcgagaggaggtgatgcgggtgaaggagacggcggcggcggcggccgcggcgagcgggaacgcgaggaggttcgaggtgctcgacgtgacgaaggccatgatgctgcgcgccgacggccaccccggcgcggccatcgacaagaggtggcagaagaacatcgtcagcgactgcctccactggtgcatgccgggccccgtcgacatgtggaacgagatgctgctccagaggctcaccgagatctccacgctggaccaggatgcttccatctttgaggcaccttaactttgtcacttacatgtaggtccggatcattaatgtatcactgcatacaatcatacggggaacgatgcatgactggtgatgctataggggaggtcttcctatccattgagaggacgtgcatatctctcaaatggttataaattttttgaaaaacaatctagatcaat

SEQ ID NO: 11161 - DNA, 659 bp, Hordeum vulgare
gcgccatgagtaagttgcagagcgatgccctgagggaggctatcacaaacattaccaatgactgccgtgagaagaaccgcaagttcgttgaaaccattgagctgcaaattggtctgaagaactatgacccgcaaaaggacaaacgtttcagtggctctgttaagcttcctcacatccctcgcccaaagatgagggtttgcatgcttggtgatgcccagcatgttgaagaggcagggaaaatgggccttgactgtatggatgtggaatcgctgaagaagatgaacaaaaacaagaagctagtcaagaagcttgcaaagaagtatcatgctttccttgcatctgaggctatcattaagcagattccccgacttcttggacctggtcttaacaaggcaggaaagtttccaactttggtgtctcaccaggagtcccttgagtccaaggttaatgagaccaaggccacagtcaagttccagttgaaaaaggtgctttgcatgggtgttgccgttggccacctgggtatggaggagaagcagatcttccagaacgtgcagatgagcgtgaacttccttgtctctctgttgaagaagaattggcaaaacgtgcggtgcctgtacctgaagagcacaatgggaaaggtgtaccggttgttctagtag

SEQ ID NO: 11162 - DNA, 605 bp, Zea mays
atttcgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgctaagtcccccaagaaggcgtagagtgatctcctgtcttagaacaatattaccattagcaatcgtgcagttagactagatcatgtttagtgtagatccgcaatgttcttg

SEQ ID NO: 11163 - DNA, 2051 bp, Triticum aestivum
tccagatggcaacctatgagcccaagaacatcctcataactggtgctgcgggtttcattgcatctcatgtggcgaaccgtctaattaggagctatcctcactacaagattgtcgtcctcgacaagattgactactgctccaacctgaaaaatctcaacccctcccggccatcgccaaatttcaagtttgtcaagggcgacatcgcaagtgctgatctggtgaactatcttctcatcactgagtcgattgacaccatcatgcactttgctgcccagactcatgtggataattcgttcggcaattcctttgagtttacaaagaacaacatatatggcacccatgttctccttgaggcgtgcaaggttactggccagatcagaagatttatccacgtcagtactgatgaggtgtatggagaaactgatgaggatgctgtggttggtaaccatgaggcctcacagttgcttccgacaaatccatattcagctaccaaagctggggctgaaatgcttgtgatggcttatgggaggtcttatggtcttcctgtgattacaacccgaggcaacaatgtgtatggaccaaatcagttccctgagaagctcatcccaaaatttatccttttggccatgaaaggcttgccccttccaattcatggtgatggctctaatgtcaggagctacctgtactgtgaggatgttgctgaagcttttgaggtagttcttcacaaaggagaggttggacatgtgtataatattggtactgtgaaggagaggagggtaattgatgtggccagtgacatatgcaagctatttggcttggacaccgaaaaggtcatcaggtttgtcgagaacaggcccttcaatgaccagaggtacttcctggatgatcagaaactgaagaagttaggatgggcagagcgcacgacatgggaagagggtttgaagaaaacaattgaatggtacaccagcaatcctgattactggggagatgttgccggtgcattgctccctcatccaaggatgttgatgacgcctggagttgaaaggcataactggactgaggaaatcaaatctcttgcttcttctccagctgaagccaaggaatgcagtacagtacctgctgcagccacatccaagagtaccagcagtgtccctcaaaaggccacctacaagttcttaatatatggcaagactggatggattggtggcctacttgggaagatatgtgagaagcaaggcataccttatgaatatggtaaagggcgcctgcaagagcgctctcagctcttgcaggacattagaaatgtgaagccgactcatgttttcaatgctgctggtgtcactggaaggccaaatgttgactggtgtgagacccacaaacaggacactatccgcaccaatgttgtaggcaccttgaatcttgctgatgtttgtcgtgagcaggggttgctcatgattaattatgctacaggttgcatatttgagtataatgctgaacaccctgaagggtctggaattggttttaaagaggaggacacgcccaactttgtaggttcattttattccaaaaccaaagccatggtggaagagttattgaaggactatgataatgtctgtactcttagagtcaggatgcccatatcatcagacctgagcaatcctcgtaacttcatcacaaaaatagcccgctatgacaaggtggtgaacattccgaacagtatgacaattttggatgaattgttgcctatctctgttgagatggcgaagcgggattgtaggggcatatggaatttcaccaacccaggggttgtcagtcacaacgagattctggagatgtacaaggaatacataaacccggacttcaagtggaccaacttcacgctcgaagagcaggccaaggttatagttgcaccaagaagcaacaacgaaatggacgcgtcaaagctgaagtccgagttccctgagctactgtccattaaggaatctttgatcaggaatgtctttgagccaaacaggaaggtgtctactaattgaggattcatgtgacacagg

SEQ ID NO: 11164 - DNA, 1175 bp, Hordeum vulgare
gatcaatggccctgctcaaggccgcgcgcgtcgccgacgtgcccaccctcgacgtcgtcgtgccggaccacctcgccgccgccgcgcgcgtccgcctcgacgcggagtcggcggcggcggcggcgacgacgaagaggcagcagcgcggcgcggggcggcggttcgcggtgatcgggcaccggggcaaggggatgaacgcgctggcgtcgccggaccggcggctgcaggaggtcaaggagaactctgtccggtccttcaacgaggcggcgcgcttcgccgtcgactacgtcgagttcgacgtgcaggtgaccaaggacggctgcccagtcatcttccatgacgacatcatccttactgaagaacatggcaaaatttcagataagcgtgtcactgatcttcagttggaagacttcctccagtatggcccacaaaataagcaaggaaagaatggaaagcctttgctgcggaaaatgaaggacggtcgggtgttgaattggaacgtccagtcagatgatcccctttgcacccttcaagaagcattcgagaaggtcactccaagattgggcttcaatgtcgagctgaagttcgatgaccatcttgcatacgaagaggaagagctcactcacatcctccaggccatcctcaaggttgtcttcgagtgtgccaaggataggcctatcatcttctctagcttccagcccgatgctgcgcaactcatgcgaaaactgcagagtatatacccagtgtacttcttgacgaacggagggacggagatctacgccgacgtgcggaggaattcgttggaagaggcggtcaagctgtgcctctccactggcatgcaagggatcgtgtccgaggcccgcgcagtcttcaggtttccgaccgccataccgatgatcaaggaggctgacctctccctactaacttacgggacactcaataacgtgccggaggcagtgtacatgcagcacctcatgggggtgaacggggtgatcgtcgacctcgtgccggagatcacgggggccgtctctaacctcatcgcctccccggagaccgacacggagatcaatgatctgagcagccaagtggtgaaagatgccgcgtcgacgccgaatttcacgcagcgggagatttcattcctgctgaggctgatgccggagcttgtgcaataataa

SEQ ID NO: 11165 - DNA, 1520 bp, Setaria italica
acgagatggacgctcggtgggcggtgctgctcgcgctgctggtggcgagcgccggcgcgggcggcgcgcgcgccgcgggggtgaagggcgcgaactggctcggcgggctgagccgcgcgtcgttccccaaggggttcgtgttcgggacggcgacgtcggcgtaccaggtcgagggcgccgcgtccaccaacggccgggggccctccatctgggacgcattcgcgcacatcccaggaaaagttgcgggaaatcaaaatggagatgtcgcagtggatcaataccatcgctacaaggaagatgttgatctcatgaaaagtttgaattttgatgcctaccgattttcaatctcatggtccaggatcttcccagatggcgagggaagagtcaacccagaaggtgtagcgtattacaacaatctgataaactacctgcttcagaaaggcatgactccttacatcaacctttaccactacgatctacctcttgcactcgagcagaaatatggagggtggttaagctcaaagatggcggacctctttacagagtatgttgacttctgttttaagacctatggcgatcgtgtaaagcactggtttacattcaatgagccaaggatagtagcactgcttggttatgacgcagggtcaaatcctcctcaaaggtgcaccaaatgtgctgccggtggcaattcagcaaccgaaccttatattgttgcgcataattttctcttggcacatgctgctgcagctgcaagataccgtacaaagtaccaggctgctcagaagggtaagattggaatagtcctggacttcaactggtatgaacctcttacaaactcaactgacgaccaagcagcggctcaaagagctagggacttccatattggttggtttgttgatccattgataaatggacattacccacagataatgcaagatcttgtgaaagagaggctgccaaggtttactcctgagcaagctaaattggtcaagggctcagcagactatattgggatcaatcaatacacagccagctacatgaagggccagaaattgctccagcagacacctactagctactcagctgattggcaagttcaatatgttttagcacgaaatggcaagccaattggaccacaggcgaattctaattggctttacatcgtcccgtggggaatgtacggatgtgtgaactatctcaaggagaagtacggaaacccaactgtctacataaccgagaatggaatggatcaacctggaaacctgacccgcgaccagtacctgcgcgatgtgacaagggtgcggttctacaaaagctacctcgcccagctgaaaaaagccatagatcagggcgcaaacgtggctggctacttcgcctggtctctccttgacaacttcgagtggctatcaggatactcttccaagtttggcattgtctacgtcgatttcaacaacaagctcgaacggcacccgaaggcttcagcctactggttcagggacatgcttaagaagaattgataa

SEQ ID NO: 11166 - DNA, 2031 bp, Setaria italica
gaaccgattcaacacgctgtgcgcgtctcgtgtcgggcggggtcgcggatataagcccgcgcgcgccgctcgtcaaggaggacggcagcgcgagatcactcgatcgcgcgcccacacaacacgcacagaggcggcagaggaaagcggcgcgcggcagagcaggttgccagagcagagcacagcggcggtggggcatccacggcacatgcgagcaggagcagcggcgcggaggcagccgcatgcggaggcgccgcgcggggtctctcctcgtgcaatgagcggcgcgggcgccgcgtcgtcgtgccggcggcggcagctcggggtcgcggttctgctgctgctggttgctctcgcggccgttcttggtggagcagaggggaaggcgcacaactacgaggacgcgctgcagaagagcctgctctacttcgaggcgcagcggtcggggcggctcccgcacagccagcgcgtcgcctggcgccaccactccggcctcaccgacggcctcgagcaaggggtggacttggtgggcggctactacgacgccggggaccatgtcaagttcggcctgcccatggcgttcacggttacgatgctgtcgtggagcctgatcgagtacggcggcgacgtcgccgcggccggcgagctcggccacgcgctcgaggcagtcaagtggggcaccgactacttcatcaaggcgcacaccaagcccgacgagctctgggccgaggtgggtgacggcgacacggaccactactgctggcagcggccggaggacatgacgacgtcgcggcaggcgtacaaggtcgaccgcgaccacccgggctccgacgtcgccggcgagactgcggccgccatggccgccgcctccatcgtcttccgcgactccaacccgcactacgcgcacctcctcctccaccacgcccagcagctgttcgagttcgccgacaagtacaggggcaaatacgacagcagcatcgcggaggtgaagagctactacgcgtcggtgagcgggtacaaggacgagctcctgtgggccgccctgtggctccaccgcgccaccggcagggccgactacctcgactacgtcgtcgacaacgcccactccttcggcggcaccggctgggccatcaacgagttcagctgggacgtcaagtacgccggcgtccagatcctagcaacaaggttgctgctgagaggggagcacgcggcgcgccaccggagcacgctggagcagtacagggcgaaggcggagcactacgtgtgcgcgtgccttggccggaacgcggacggcggcgcggacgccaacgtggagcgcagccccggcgggatgctctacatccggcagtggaacaacatgcagtacgtgaccagcgccgcgttcctgctctcggcctactccgactacatggcagaggccggcgtcgtcaccgtgcagtgtggcggcggcgaggccgtggcggcggaggaggtgtttgcgctggccagggcgcaggtggactacgtgctgggcaccaaccccaggggcgtcagctacctggtcgggtacggccccaagtaccccaaccgggtgcaccaccgcgccgcctccatcgtgccgtacaagcacagcaaggagttcatcggctgcacgcaggggttcgaccactggttcggccgccggagctccaaccccaacgtgctcgtcggcgccatcgtcggcgggccggaccgccgggacaggttcagggacaacagggagaactacatgcagacggaggcgtgcacgtacaacaccgcgcccatggtcggcatgttcgccaagctgcaccggatggcgcggcaggagccggaacgggggccgacgccggcagcgccggtgacgtcggcggcgtctgaggtgtaaatagataggacgtagaggggggcctgtacaattttccccattctttggttcaattcttttgggctttggattccattttacacagatcggagatgattgtatacaaaaaggaagaagaaaaggggtggaggcattgacatgcaaatgta

SEQ ID NO: 11167 - DNA, 644 bp, Zea mays
agtcagcggtggtgaaggtagcgggcgcggaggaagatggggctcgcgttcgggaagctcttcagccggctcttcgccaagaaggagatgcggattcttatggtcggtctcgacgccgccggtaaaaccaccatcctctacaagctcaagctcggcgagatcgtcacaaccatccccaccatcggtttcaatgttgaaactgttgagtacaagaacattagcttcacggtctgggatgtcgggggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgagggcctggactggctgtccagcaacattgcgagcaaggcttgaatatcaaatgcgaactgactaggagctccggatgtatcatggaaacttaggacagaatcgcc

SEQ ID NO: 11168 - DNA, 1690 bp, Oryza sativa
ggatccacgcacaccaccaatggccgccgccgccgccgccaccgccaccgcctcctccggcctcatccgctgcgccacgggaggcgcgccggcgcacggccaccaccaggtgttcaggtgctccgccgccaagccgtcccctctcgcgctgcgccaccgcgcgggccgccccgcgccgctgcaggccttccccgaatacgaccgcgtcacgcctttcgactatgacggtgaggtggacggcggcgacggcgacgaccacccgcgcgaggagtgcggcgtgttcggcgtcgtcggggacccggacgccacgtcgctctgctacctcggcctgcagaagctgcagcaccgcggggaggagggggctggcatcgccgccgcgggggacgacggcacgatcaagctggagaggggactggggctcgtcggggacgtgttcggcgacccggcccgcctcggcaagctccccggccaggccgccatcggccacgtgaggtactccaccgccggcgccgccgcctccctgcgcaacgtgcagccgttcctcgccgggtacaggttcgggcagctcgccgtggcacacaacggcaacctggtgaactaccaggcgctgcggaacaagctggaggcgcagggctccatctttagcacgtcgtcggacacggaggtgatcctgcacctcatcgccacctcgctctcgcgccctctgctcgcgcgcatctgcgacgcctgcgagcgcctcgccggggcctactcgctgctgttcctgacggcggacaagctcctggccgtgcgcgacccgttcggcttcaggcccctggtgatgggccgccgcgccaacggcgccatcgtgttcgcgtcggagacctgcgcgctcgacctcatcgacgccacgtacgagtgcgaggtggagccaggggaggtcgtcgtcgtcgaccgccgcgacatgtcggtgtcctccgcctgcctcgtcccgcaccgcccccgcaagtcgtgcgtcttcgagcacatctacttcgcgctcccaaactccgtggtgttcggccacgccgtccacgagcgccgcaacgcctacggccgcgcgctcgccgaggagtcccccgcccccaccgccgacgtcgtcatccccgttccggactcggggttctacgccgcgctgggattctcgcagacgtcggggctcgagttccagcaaggcctcatccggtggcactacagcggccgcagcttcatccagccgtcgcaggcgatccgcgacctcgccgtcaagctcaagctcgcgcccgtgcacggcgtcatcaggggcaagagcgtggtggtggtcgacgactcgctcgtccgcggcaccacctcgagcaagatcgtgcgcctgctccgcgacgccggcgcgcgcgaggtgcacatgcggatcgccagcccgccggtcatcggctcctgcctctacggcatcgacacgcccagcgagggcgagctgatatcaaacaggatggacctcgagggagtccgcagggcgatcggctgcgactccctcgcgttcctctcgctcgacaagctccacaccatctatggcgacgaggcgcatgagctctgcgacgcctgcttctcgcggaattacccggtgctccccaccgtgccggagccggtgccggagttggtgtccgccttcgaagactgacatgaactctaggaattc

SEQ ID NO: 11169 - DNA, 1253 bp, Gossypium hirsutum
ttaaccattccttccttgtcctcgccccttccctagcaagctacatttccatggccccccctgaattggttcaacccagtgataaaacaaacgttttcgctaaacaagtcagtttgcgtaatcgtgcatatgttacgttcttggccggaaatggggactacgtgaaaggcgttgtagggttagccaaagggttaaggaaagtgaaatcggcgtaccctttagtggttgccgttttacccgacgtgcctgaggagcataggcggatcctggagaaccagggttgtatcgtccgagagatcgaaccagtttacccgcctgagaaccagacccagttcgccatggcctattacgtcatcaattactccaagcttcgtatttgggagttcgtggagtacagtaaaatgatatacttggacggcgacattcaggtatacgacaacatcgatcacctgtttgatctgcctgatgggcatttctacgcagtaatggattgcttctgtgagaaaacatggagccacaccccacaatacaggatcggttactgccaacaatgccctgacaaggtgaagtggcccgccgagatgggaaatcccccttcactttacttcaatgctggcatgttcgtgtttgagcccagccttgtgacttatgaatctctcttgaagactctcaaaatcacacaacctaccccatttgcggagcaggactttttgaaaatgttctttaaggacatttacaagccgattcctttaatttacaaccttgttctcgccatgttatggcgtcatcccgagaatgtggagcttgaaaaagtgaaagttgttcactactgtgctgcgggatctaagccttggaggtacacagggaaggaggctaacatgcaaagagaagacattaagatgcttgttcagaaatggtgggacatttacaacgacgagtcacttgattaccgtaccagcgcggctgaaggagggacagagaccgtgaacctgcaaccgttcctggtggcactctctgaagttggtgcagtccatttcgtggccgccccatctgcggcgtaaatatgttgtgtaacgacgataaataccagttcataggtgtaaagaaatattgtaagaatcgagaaaggggcgatcctatgtggaaaacaaaggtggttttaaacaagggttggggaattggtgaaacgcttttagggggtttaaaaactatttagggcgttgtttttacttgatgaatggtgatgaaggtcg

SEQ ID NO: 11170 - DNA, 902 bp, Sorghum bicolor
tccctatggcgccgccggtcgccctgctccttctcgccgccatcgtgctcgcgcgggtcgtcacccacgcccacggtggcggcggcggcttctatgatccggcgcgcgtcacccagctctcctggcgccccagggcgttcctctacagcggcttcctgtcggacaccgagtgcgaccacctcatcaacctggcgaaaggcagcatggagaagtcgatggtggcggataacgactccgggaaaagcctcatgagccaagtgcgcaccagctccggcgcctttttggccaagcacgaggatgaaattgtctctgcaattgagaaacgcgtagctgcttggacatttcttccggaagaaaacgctgaatcaatgcaggttctgcgctatgaaatcggtcagaagtatgatgcccactttgattattttcatgacaaaaataacgtgaagcatggcggtcagcgatttgcaactgtccttatgtacttgacagatgtcaagaagggtggagaaactgtatttccaaatgctgagggaagccatttacagtacaaggatgaaacttggtcagagtgttcaagatctggcctggcagtgaagccaaaaaaaggagacgcgctactgttcttcggtcttcatctcaatgcaacaactgatacaagtagtcttcatgggagctgcccagtaattgagggtgagaagtggtctgcaacgaaatggattcacgtcagatcattcgataatcctccaaatgtaaggatggacgcgccatgttccgatgacaatgagctctgccctaaatgggctgctattggggaatgttacaagaacccaacatacatggttggcaccaaggatactaatggattttgccgcaaaagttgtgggctctgtgatgcttgatag

SEQ ID NO: 11171 - DNA, 1172 bp, Sorghum bicolor
gaccgatggcttctctgccagtcgccggctgtgctgcaggtggctattcagaacagcttttggaagaagcagatggctcaacacggacacttattttgaataggccaaagcagcttaatgtactctcctctgcagtgattaagggactcctgaggtgtttcattgtttatgagaaagatgacagagttaaattattgattatgaaggggaacggaagagcattttgtgctggaggtgatattactgaatgtgtccggtatatacataacgaaagctggaaatggggtgctgatttcttcagagatctatatttgttaaactacattagtgcaacatatatcaaacctcaggtttctcttcttactggaattgtaatgggtggaggtgctggggtttctttacatggaagatttcgagttgccactgataacacggtttttgcaatgccagaaacagctcttggtttccttccaggtgtaggggccacatattttctgtctcggcttcctgggttctatggagagtatgttgctcttactggtgccagattggatggtgctgaaatgctggcatgtggtctggctactcattttgtcatgtcaaatatactactattgcttgaagaatcccttaaaaatgtggacacctccaatacttttgctgtgcgtagtactatcgatcagtttgctcaacagccatcactgaaggaaaacagttccttgaataggatggaaatcatcaacaactgcttttctaaaaggacagttgaagaaattataagcgcgctagagcaagtggactcaaatttgtctgatgaatgggttgctaggacaatccagtgtttgaaaaaggcttctcctattagtctgaaagtcactctgagatcgataagagaagggagaacacaaactgttggtgagtgcttgcatcgggaatatagggtgatttgccatctcatacgtggtgacttcagccgagacttctttgagggatgcagagctatacttgtagataaagatcgaaacccaatgtggatgcctccaagtttggaacaagtacatgaggaggtagttgaagaatatttctcaagaattgatgatccaaagtgggaagatttgaacctaccatacagacgttcccatggaagaattatggagtccaagatttgatag

SEQ ID NO: 11172 - DNA, 879 bp, Zea mays
taccgctccactacttgattgccgcctcactggcaccgctggtccgctcccagttccagtgacactgcaccagaccacccggctccagcgagatccagacccaaaacctcacctcgcagccaacctctgctcggagggggagggaagggaagcaatggcggccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacccgcagtctccaggtcgacggcaaggtcatcaaggcccagatttgggacaccgccggccaggagaggtaccgtgcaatcacaagtgcctattaccgaggagccgtaggggcactgctcgtctacgatgtcacccgtcgcgccacgttcgacaacgtgggccgttggctgagggagctcagagaccacaccgaccagagcatcgtcgtgatgctggtcggcaacaagtccgatctccggcacctggtggccgtctcgaccgacgacgccaaggagttcgccgaggccgagtccatgtacttcatggagacgtccgccctcgacgccaccaacgtggacagctccttctcggaggtgctgacccagatataccagatcgtgagcaagaagacggtggaggcctccgaggagggggcggtcgcccctggcaagggggagaagataaacgtcaaggatgacgtttctgcgatgaagagggttgggtgctgctcaaactaaggcgaatagccggatacgaactgtttgttcgattgtctttctgtggatgctgagggttagag

SEQ ID NO: 11173 - DNA, 395 bp, Medicago truncatula
caaatatgcagatcttcgtgaaaaccctaaccgggaaaaccatcaccctcgaggttgagagcagtgacacaatcgacaatgtcaaggccaaaattcaagataaggaaggtattccaccggatcagcagcgattgattttcgctggtaagcagcttgaagatggacgcaccttagctgattacaatatccagaaggaatcgactcttcatctcgttctcaggcttcgtgggggtatcattgaaccttctttgatggctttggcaaggaaatacaaccaagacaaaactatatgccgcaaatgttatgcccgtcttcatcccagggctgtgaactgccgcaagaagaagtgtggtcatagcaatcaattgaggccaaagaagaagatcaagtaataa

SEQ ID NO: 11174 - DNA, 1460 bp, Solanum lycopersicum
aacctctgccagtaccagtagttctacagactaaaaattcccaaaattgaacttcttaatggctcttcaggcttcttctctacttccttctactttctccaagggcaaagctagtgcaactttgaagaattctagtatttttggagcttctctttctgattatactaaatctgattttggttcatcttcatttagagttaagaaccaaagaagatcgtcaaatggcggtgttgtaagagctacaatggttgcttctcctggtgtaactactaactctccatcaggaaaaaaaacactaagaaaaggttgtgtaatagtcactggtgcctcatcaggattaggcttagccacagcaaaagctctgtctgaaacagggaaatggcatgttattatggcatgtagggactttttaaaagctgagaaagctgcaaaatcagttgggatgtctaaggagaattacaccatcatgcatttggacctcgcctctcttgacagtgtacgtcaattcgttgataacttcaggaggtcgggacgacctcttgacgtgttggttgctaatgctgctgtttaccaaccaactgctaaagagccttcatttactgcagaaggatttgagcttagtgttggaactaaccatcttggacattttcttctttcgagattgttgcttgatgacttgaagcaatctgattatccttcaaagagactcatcattgttggttcaattacagggaacacgaatactctggctggaaatgtacctccaaaggccaatctcggcgacttgaggggtatggcgggaggtttaaatggaattaacagctcagcgatgatcgatggaggtgaatttgacggtgcaaaagcatacaaagacagcaaggtgtgcaacatgcttacgatgcaggaattccatcgtcgataccacgaggaaactggtatcacatttgcctctctttaccctggctgcattgcaacaacagggctattcagagaacacatccccttgtttaggcttcttttcccaccatttcaaaagtatattacgaagggatatgtctctgagactgaatctggaaagagacttgctcaggttgtgagtgatccaagcttgacaaaatcaggtgtctactggagctggaacaaagactcagcttctttcgaaaaccagttgtccgaagaagcaagtgatgcagagaaagcgcgtaaagtgtgggaagtcagtgagaaactcgttggtttggcttaaattttgaactaaccttagtcatcgtcgatgaaaacaggaaaaatgacttcgcgagtgagaatttgtaaccgaaatttctaggatgttgtaaagagaagtgtcattgtagttaggattgaaaataaagatcactcaacttgttttgttttgtgtttggaaaatgtcactaatttgcctttgaagttaaatgaagtgatggttcatgagcattgtt

SEQ ID NO: 11175 - DNA, 4853 bp, Oryza sativa
attcgcagctaccagtttggtttgcggcgccaagaattggtggctatagccttgccttttcttttcttttcttttcttttttgcatgtttgggcggcggcgatcgagctgagtcgatcggccggagtggatcgacgacggaaatggggacgccggtgaacatcatcgtcgggtcgcatgtctgggcggaggatcccgacgacgcgtggatcgacggggaggtcgtcgagatcaggggcggcgacgccaccatcgtcagcaccgatggcaaaacgattgtggcgagcctcgcaagcatttaccccaaggatacggaagcgccacctgcaggagttgacgacatgacgaagctggcttacctccatgaacctggagtcttgcataacctcgcttgtcggtacggtattaacgagatatatacatacaccggcaatatcttgattgcagtcaaccctttccggaggctgcctcatctgtatgacgtgcacatgatggagcagtacaaaggtgctgcatttggggagctcagccctcatctgtttgcgatcgcagatgcttgttacagggcaatgatcaatgaacaagggagccaatcgatattggtgagcggtgagagtggtgctggtaagacagagacgaccaagatgctcatgaggtatcttgcattcatgggaggaaggtctggaacagagggtcggactgttgaacagcaggttttagagtctaatccagtactggaagcatttggaaatgcgaagacggtgaagaacaacaactcgagtcgattcggtaagtttgttgaaatccaattcgacaaatatgggaagatatccggggctgctgttcgaacgtacctccttgaaagatcgcgagtatgtcaggtctctgatcctgaaaggaactaccattgcttttacatgctatgttctgcaccaccagaggatgtgaaaaagtttaaggtgggagacccaagatcattccattatttgaaccaaacaaactgctatgaagtagctaatgtggatgacgcaagagaatacctagaaacaagaaatgctatggatgttgttggcattggtcaagaagagcaggatgcaatctttagagtagtagctgcaatccttcatctgggaaacatcaatttctcgaaggggcaagaaattgattcatcgaagctgagggatgagaaatcagtctatcacctgaaaatagtagcagaacttctaatgtgtgatgaaaaggctcttcaagattcgctttgtgagcgtgttattgtaacacctgatggaaatatcacaaagccacttgatccagattctgcagcactgagtcgtgacgccttagcaaagactgtgtattcacgactgtttgactggattgtggacaagattaacaactcaatcggtcaagatccagatgcaactaatattataggagtacttgatatatatggatttgagagtttcaagattaacagcttcgaacaactatgtatcaacttgacaaacgagaagttgcagcagcactttaaccagcatgtattcaagatggagcaagaagactatacaagggaggaaatagattggagctatgtggaatttgtggacaatcaagatgtgctggacttaattgaaaaaaaacctggaggaataattgcactactggatgaagcatgcatgtttccaaagtccacacatgaaacatttgcccaaaagatgtatcaaacatacaaggcacataagcgcttcagcaaacccaaacttgctcggacagcctttacaatcaaccactatgcaggagatgtcacatatcaagctgatcagtttcttgacaagaacaaagactatgtggtggcagaacatcaggctctacttaattcctcaaggtgcccttttgttgcaaatctctttcctccattacctgaggaaacctctaaacagtccaaattctcttccatcggtactcgctttaagcaacaactacaagctctcatggaaacactgagtacgacagaaccacactacattagatgtgtgaaacccaatgctgtacttaaaccaggaatctttgagaatttcaatgtccttaaccaattgagatgcgggggtgttctggaagcaatccggatcagttgtgctggctatccaacaaaaaggacatttgatgagttcattgatcggtttggaatgcttgcagcagagcttgtcgacagctctgatgagaaggctgcctgtgcagcaatatgtgataaaatgggtttgaagggatatcagataggaaaaacaaaggtattcctaagagctggtcagatggcagagctggatgctcgaagagcagaagtattggccaatgctgcacggcttatccagagacgtataaagacacatcttacaagaaaggaattcatcaacttaagaaaagcctcaattcagtctcagaagttttggagggcacgcctagctagaatatttttcgagcatatgagaagaaatgctgcttcaatcaggatacagaagcatgcacgtactcattcagccaggaaatcttaccttcaaatgtatgagtcagccatagtaatacagacaggattacgtgcaatggcggcttgcaatgaacacagattcagacgagagaccaaagcttccataataatccagactcgatggcgccaacacaaagcttatgttgattacaaaaagcaaaaaagagctactttgattcttcagtgcctgtggagagcacgtattgcaagaaaggaacttcgaaagctcaaaatggaagcaagagagactggcgcactgaaagaagcaaaagacaaacttgaaaaaagagttgaggaactcacatggcgattagatgttgagaaacacttgaggattgaccttgaagaagccaaggggcaagagatttcaaacttgaaatctgtgttgcaagaaatgcaagaaaagctttcggaagcacatgcagcaatagaaaaggagaaagaagatgcaaaactagcaattgaacaggcaccaccaaagatagtagaggtgccggtggtggacaatgcaaaagttgagctgctgactagacaaaataaggaacttgaggatgaacttgttacatttagaacaaaggctgaagatctagaaaagagacttctagaggttcaaaaggagtccgatgaattgtcgagggaaattctagaaaaggactccaaacttaatcaacttcaggagatgatagaaaggcttgaaacaaatttatccagcttggaatctgaaaaccaggtcctacgtcaacagtcactacttgcatctgcagatgacgataaatcaaagcaaatagagagtctggaaagcaagattgccatcttggagtcagaaaaccagttgctccgcagtaaatcttctgtagctgttcaagcagtaattactcctgaagtgattcagccatcagcaatggaggaggaggtggttgttcctcctataaagaatttaagcaaacaaaagtcgctcacggatcgacaacaagaaaatcatgatgtcctgatcaaaagtctggctgaagacaggagatttgacaacggcagaccagctgcagcatgcatcgtgtacaaatcactcctgcactggcactcatttgaagcagagaagactaacatatttgaccgaatcatccatacaattaggtcatcaattgagcacgctgaaagttctacagaactggcttattggctgtcgactacatcaactcttctctacctattacaaaatactcttaagtctagcagttcagcaggtaaaggatcaaatcgcagccgaaccacaacaggcaacctgttcagtaggatggtgcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggctccaagggctgttcgtgtgagatcatccaggggatcgttgaaaagtgtacattctaattcactatcaaggcaaacatcaagtgtgcattggcaaagcatcattaagtgcctgaaccatacactcgaaacaatgaacaataatcacgtacctccaatgataatcaggaaaacattcaatcaagcatttgcctttatgaacgttcaactcttcaatagtttgctactccgtcgagaatgctgctcctttagcaatggggaattcttaaaggctggtttacaagaattagagcagtggtgctctgtaacaactgaagagtatgcaggaacgtcttgggatgaatttcagcacatcagacaggcagttggatttctggttttgcatcagaagacacataaaaccttggaggaaatcactgatgagctttgcccagttttgagcatcactcaaatatatcgcattggaacaatgttctgggatgataaatacggtgcacaaggtctatctcaggaggtcattggaaagatgagaacaatggccactgatgactcaataactactccaaatagttcgttcttgttagatgacgactcaagcatacctatatcgttggatgatatagcacgactgatgcttgacatagacctatctgacgtggaaccaacaccactgctcaggcagaactctcagttccactttctactgcagcaccacgccacacagactgatggcattgtttgttaatgcaaagttgaaaacataattaaacaggttccgctattttgtgaagttcctcggtggtgat

SEQ ID NO: 11176 - DNA, 813 bp, Sorghum bicolor
gtgactccgtgagcacactcgccgcaccagctcagctcagtaatcatggctcgcccgggtagtagtgccgctgctcccctcctcctgctgctcgccgccgcggcggcgtcgatcctggcagcggcagccgcgtcgccggcgccgagcgacttcgtccgcaagtcgtgccgcgcgacgcagtacccgtcggtgtgcgagcagagcctggcgtcgtacgggggctccccggcgccgcggagcccgcgggagctggcgcgcgccgcgctgtcggtgagcgcggaccgcgcgcgcgccgcgtcggcctacgtgggccgcctgtgcggcggctccagcagctccgccggccacaagaagggcgctgctgcgaggaagggcggcgcgcccgggtcggcggcgggacccgtgcgcgactgcctggagaacctggcggacagcgtgggacacctccgcgacgcggcgcaggagatgggcggcgccgggatgtcccgctccgggacgcccgcgttcaagtggcacctcagcaacgtccagacctggtgcagcgccgcgctcaccgacgagaacacctgcctcgacggcctctcctcccgcggcgtcgacgccggcacgcgcgccgccatccgcggcaaggtcgtcgacgtcgcgcaggtcaccagcaacgccctcgcactcgtcaacaaggtcgggccagggtactagcccaggcccaggcccagcccaaatagccctcgctacttagtccatacacgtattatacttcggtgcgtcggttaagtacgtagaccagttttccacgtgttgcttctgcttatg

SEQ ID NO: 11177 - DNA, 1008 bp, Solanum lycopersicum
ttctcaaatcacaaaattaacctattctttatctttctttttggtgtacaatacaaatggcaaaagatatggaggttggtactgaatatgcaccaaaagattaccaagacccacctccagcacccttaattgatcctgaagagttaggaaaatggtcattttacagagctataattgctgaattcatagctactctgttatttctctacataactgtccttactgttattggctacaaaagccagagctccactgatcaatgtggtggagttggtattcttggaatcgcttgggcatttgggggtatgatctttgtacttgtttactgtactgcgggtatttctggtggacacattaaccctgctgttacattcggccttttcttagctcgaaaagtatcgttggttcgagctatcatgtacattgtagctcaatgtttaggagccatttgtggttgtggattagtaaaagcttttcaaaaagcttattatgtcaaatatggcggtggtgccaatacgttgaacgatggatatagtactggtactggtttgggtgcggagatcattggaacattcgttcttgtttacactgtttttgctgctaccgatcctaagaggaacgccagagactcacacgttcctgtacttgcgcctctacccattggatttgcggtgtttatggttcacttggctacaattcctgtaactggaactggaattaatcctgcaaggagttttggtgctgctgttgtttatggacataacaaagcttgggatgatcaatggatattttgggttggaccatttattggtgctgcaattgctgcattttatcatcagtttattttgagggctggagctgttaaagcacttggttcattcaggagcaatgcttaattagtacaattatcatgaagaattgaaaattgtatatataagtatttgagaagaaaaaaaagtctctttgaattatgttgttagagttgtgttggatgtttggcacttaatt

SEQ ID NO: 11178 - DNA, 959 bp, Arabidopsis thaliana
tcaccatgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttgatga

SEQ ID NO: 11179 - DNA, 811 bp, Echinochloa colona
gcagcatcccaaggagaacggccgcgcggcggcgggggacgctgtggccgtggccgtggcggtggtcgaggccgcggcggcagcacccgttgccgccgcggcggccgacccgcggctgcagggcatctccgacgccatccgtgtcgtgccccacttccccaaggaaggcatcatgttcaacgacatcaccacgctgctgctgcgccccggggtgttcaaggacgccgtcgacctcttcgtcgagcgctaccgcgggatgggcatccacgccgtcgccgggattgaggccaggggattcatatttggcccggcaattgcattggccatcggcgccaagttcataccgctgcgcaagccgaggaagctcccaggcgaggtgatttctgagaaatatgtgctcgagtatgggaccgattgtttagagatgcacgttggagctatcgaacctgctgagcgtgtgatcattgtcgatgacttggttgcaaccggtgggacactttgtgccgcgatcaggcttcttgaacgtgctggcgctgatgtggttgagtgcgcatgtctcattgggctccctaaatttaagaatttctacaagctcaatggaaagcctgtctacgtgctggtggagtcccgtgaatcggataaataagaagttatggtcaggagtgctggcgagttcattccttgatgctactgcaaacgaacggtggacggacatggacaactatgggtacattactaaggctaagctgataagtcttgatgaggggagaggttagagggtgttgagagtgtagtcttgtaggctgagtag

SEQ ID NO: 11180 - DNA, 2733 bp, Setaria italica
ggttgttgcgctggtgcctggtggtcgaggatttctgcgccctcacccattcctcctccacttcaaaacccgctcctctctctctcctccgccctcctcgcgattgcggcgaagaggcggcgagagagagctccccctccggaaaaaaactggataagagagggagaagttgacagggaggggagacggaggaccaggagcggcgtcgagctagaagcgctgccgccggccatggcgaccgcggaccggaaccggagcttcatgaaggacgtgaaacgcgtcatcatcaaggtgggcactgcagttgtcaccagacacgatgggcgattggctttgggtaggcttggagctctttgcgagcaggtgaaggaactgaacacccttggatacgaggtgattatggtcacctcaggtgctgttggtgtggggaggcagaggctcaagtaccggaagcttgtcaatagcagctttgctgatctgcaaaagccacagatggagctggatggaaaggcttgtgctgctgttggtcagagtggcctcatggctctttacgacatgttatttactcaacttgatgtgtcctcttctcaacttcttgtgacagacaatgattttgagaatccaaatttccgggagaggctccgtgagactgttgagtcactgttagatcttaaagttgtgcctgtatttaatgaaaatgatgctatcagcactagaaaggctccatatgaggattcatctggtatattttgggataatgacagtttagcaggtctgctagcaattgaactcaaagctgatcttcttgttctactaagtgatgtggatggcctctacagtggtccaccaagtgaacctcaatcaaagctcatacatacctacattaaggagaaacatcacaatgaaattacatttggggacaagtcacgtgtaggtagaggaggaatgactgctaaggtgaaggctgcttttgtggcttcaaatagtggcacgcctgttgttattacaagtggatttgcatctcagagcattgttagagttcttcaaggagagaaaattggtactctcttccataaggacgcaaatttgtgggcaccatccaaggatgttagtgctcgtgaaatggctgttgctgcaagagaatgttccaggcgtctacagaatttgtcatcggatgagcgcaagaaaatattgttagacgttgctgatgctctagaggcaaatgaggatttaattagagctgagaatgaagcagatgtagttgcagcacaagatgctggatatgagaaatctttggttgctagattgaccctgaagccaggaaagatagcaagcctcgcaaaatccatccgcactcttgcaaacatggaagaccctatcaaccagatactcaaacgaacagaggttgctgaagatttagttctggagaaaacatcttgccctttgggtgtgctcttgattgtttttgagtctcggcctgatgccttggtccagattgcatctttagcgattcgaagtggtaatggccttctcctaaaaggtggaaaagaggctatgagatcaaatacaatactgcataaggttataactgatgcccttcctgacactgttggtaaaggacttattggccttgttacaagtagagatgagattgctgacttgctaaagcttgatgatgtcattgatcttgtcattccaagaggtagcaataagctggtttcgcaaatcaaggcatcaactaagatcccagttcttggccatgccgatggtgtctgccatgtatacattgacaaatcagctaacatggatatagcaaaacgaattgtgattgatgccaaaattgattacccagcagcctgcaatgcaatggaaacattacttgttcataaagatcttataaagtccccaggtcttgatgacatactgctatcactcaaaacagaaggagttgctatctatggagggcctgttgcgcatgaagtactgtccattccaaaagcagattcattccatcatgagtacagctctatggcttgcacagttgaatttgttgatgatgtacaatcagcaattgaccatatacatcgttatggaagtgcacatacagattgcattgtcactacagatagtaaagtcgcagaaacttttctgcgtcaagttgatagtgctgctgtgtttcacaatgcaagtacgcgattctctgatggggctcgctttggattgggtgctgaggttggcataagcacagggcgcatacatgctcgtggaccagtgggtgttgaaggtctcttaacaacacgctggatcatgcgtggaagtgggcaagtggtgaatggtgacaaggatgttgcctacacccacaagaaccttcctttgcaatgaggttgcttttgagattgatcaggattcagtgcccagtaaagtctgatagtttcatcagacaagtagaaatggtgaatctttggagatcgaggattggaatcaatagactgcatattcagtattgtgcaaaaacatattattgcggcgtttccgtaggtcattctgtaggagagtggaggccttggcctccccagcgttacaataaagtaaagcagtgctgagagtaagagggtgcgcactattgtaccgaagctatgtgtaggttgaaaccagagataccgattgcattgttttgtttagtttattttggtctgatcgaaccatataatatcgtaattcttgtgctcgctt

SEQ ID NO: 11181 - DNA, 3249 bp, Panicum virgatum
acacccttcactctctctccctctcctctagcatcggatgcttggataggataccggtgctagcaatcgctaaactaagagctaactgatcattagagtccattagtcctagattagctctcatcagtctaagtttggcccattagcgtatattgatctaaattttagcacctccattttagcatatccaaacagcctcctggatatccctttcatctgtctccacttccgctgtttgagtatcaacgctacgtacactgcttccattcaactcttttttttaatgtatcgtagtcagcctcccttccattaaaaccccagcgcgaagaccgccattatcgacctctgaccgtccttcttttgcctaaaattattttttttaaaaaatatggtcaatacacatcttgaccgcattttgcaacaaaatctctactccttgaagtccaacgacctaccaaacgccgccggcaccgtggcggcggcgcagcccgcggcaggttgttgcgctggtgcgatttctgcgcccagcgccctcacccatcccaccaggccaccaccacttcaaaatccgctctctctctcctccgccctcctcgcgattgcggcggcgagagagagctcgcccccacccgaaaaatactggataagtgacggggagggcagacggaggagcaggggcggcgtcgagctagaagcgccgccgccggccatggcgaccgcggaccggacccggagcttcatgaaggacgtgaaacgcgtcatcatcaaggtgggcactgcagttgtcaccagacacgatgggcgactggctttgggcaggcttggagctctgtgcgagcaggtgaaagaactgaacactcttgaatacgaggtgatcatagtcacctctggtgctgtcggtgtggggaggcagaggctcaagtaccggaaacttgtcaatagcagctttgctgatctgcaaaagccacagatggagctggatggaaaggcttgtgctgctgttggtcagactggcctcatggctctttacgacatgttatttaaccaacttgatgtgtcctcttctcaactgcttgtgacagacagtgattttgagaatccaaacttccgggagaggctccgcgagactgttgagtcactgttagatcttaaagttgtaccagtatttaatgaaaatgatgctatcagcactagaaaggctccatatgaggattcctctggtatattttgggataatgacagtttagcaggtctgctagcaattgaactcaaagctgacttacttgttctactaagtgatgtggatggcctctacagtggtccaccaagtgaacctcaatcaaagatcatacatacctacattaaggagaaacatcacaatgaaattacatttggggacaagtcgcgtgtaggtagaggaggaatgactgctaaagtgaaggccgcttttgtggcttcaaacagtggcacgcctgttgttattacaagtggatttgcatctcagagcatccttagagttcttcaaggagagaaaattggtactctctttcataaggatgcaagtttgtgggaaccatccaaggatgttagtgcccgtgagatggctgttgctgcaagggaatgttccaggcgcctacagaatttgtcatcagatgagcgcaagaaaatattgttagatgttgccgatgctctagaggcaaatgaggatttaattagagctgagaatgaagcagatgtacttgcagcacaagatgctggatatgagaaatctttggttgctagattgaccctaaagccaggaaagattgcaagccttgcaaaatccatccgcactcttgcaaatatggaagaccctatcaaccaaatactcaaacgaacagagattgctgaaaatttagttctggagaaaacatcttgccctttgggtgtcctcttgattgttttcgagtcacggccagatgccttggtccagattgcatctttagcaattcgaagtggtaatggccttctccttaaaggtggaaaagaagccatgagatcaaatacaatactgcataaggttataactgatgcccttcctgacagtgttggtaaaagacttattggccttgttacaagcagagatgagattgctgacttgctaaagcttgatgatgtcattgatcttgtaattccaagaggtagcaataagctggtttctcaaatcaaggcatcaactaagatccctgttcttggccatgcagatggtgtctgtcatgtatacattgacaagtcagctgacatggatatagcaaaacgaattgtgatggatgccaaaattgattacccagcagcctgcaatgcaatggaaacattacttgttcataaagatcttataaagtccccaggtcttgatgacatactgatatcactcaaaacagaaggagtttctatttatggagggcctgttgcgcatgaagtactgtccattccaaaagctgattcattccatcacgaatatagctctatggcctgcacagttgaatttgttgatgatgtacaatcagcaattgaccatatacatcgttatggaagtgcacatacagattgcattgtcactacagatagcaaagtagcagaaacttttctgcgtcaagttgatagtgctgctgtgtttcataatgcgagtacacgattctctgatggggctcgctttggattgggtgctgaggttggcataagcacagggcgcatacatgctcgtggaccagtgggtgttgaaggtctcttaacaacacgttggatcatgcgtgggagtgggcaagtggtgaatggtgacaaggatgttgcatacacccatcagaaccttcctttgcaatgaggttgcgtttgagcctgatcgatgattcagtgcttatcctgtgaagtctgatagtttcatcagacaacaagcaggaaatggtgaatcttttggagattgaggacggagaatccatagactgtattattcggtcattctgcaaaaaaaaaacatcttattgcggcgtttcagtaggtcattcagtatgagagtggaggccccagctgcctccccagtgttacaataaagtaaagcggtgctgagagtaagagtgagcactattgtaccgaatctgtgtgtaggttgaaacagagaaactgattgcattgttttgtttagtttatttcagtctaatcgagccatataatatcgtaattcttgtgttaacttagttgcttgctagtatcacg

SEQ ID NO: 11182 - DNA, 2666 bp, Oryza sativa
agagccacttctgccttcataaacccttcctcttttctcctcctcctatctatcccccctctactcgcggctgcggcggcaaggcggcgagacgtgggagagggatttacaggtagagggagagggtggaggaggagaggctgaggctaggaagcggtttcgccatggcgagcgtcgacccgtcccggagcttcgtgagggacgtgaagcgcgtcatcatcaaggtgggcactgcagttgtctccagacaagatggaagattggctttgggcagggttggagctctgtgcgagcaggttaaggaactgaactctttaggatacgaagtgattttggtcacctcaggtgctgttggagtggggcgacagcgacttaggtaccggaagcttgtcaatagcagctttgctgatctgcaaaagccacagatggagttagatggaaaggcttgtgccgctgttggtcagagtggactgatggctctttacgatatgttgtttaaccaactggatgtctcgtcatctcaacttcttgtcaccgacagtgattttgagaacccaaagttccgggagcaactcactgaaactgttgagtcattattagatcttaaagttataccaatatttaatgaaaatgatgccatcagcactagaaaggctccatatgaggattcatctggtatattctgggataatgacagtttagcaggactgttggcactggaactgaaagctgatctccttattctgctcagtgatgtggatgggttgtatagtggtccaccaagtgaaccatcatcaaaaatcatacacacttatattaaagaaaagcatcagcaagaaatcacttttggagacaaatctcgtgtaggtagaggaggcatgacagcaaaagtgaaggctgctgtcttggcttcaaatagcggcacacctgtggttattacaagtgggtttgaaaatcggagcattcttaaagttcttcatggggaaaaaattggtactctctttcacaagaatgcgaatttgtgggaatcatctaaggatgttagtgctcgtgagatggctgttgccgcaagagattgttcaaggcgtctacagaatttgtcatcagaggaacggaaaaagatattgctagatgttgcagatgctttggaggcaaatgaggatttaataaggtctgagaatgaagctgatgtagctgcggcccaagttgctggatatgagaagcctttggttgctagattgactataaaaccaggaaagatagcaagccttgcaaaatctattcgtacccttgcaaatatggaagaccctataaaccagatacttaaaaagacagaggttgctgatgatttagttcttgagaaaacatcttgcccattaggtgttctcttaattgtttttgagtcccgacctgatgccttggttcagattgcatctttggcaattcgaagtggtaatggtcttctcctaaaaggtggaaaagaagctatcagatcaaacacgatattgcataaggttataactgatgctattcctcgtaatgttggtgaaaaacttattggccttgttacaactagagatgagatcgcagatttgctaaagcttgatgatgtcattgatcttgtcattccaagaggaagtaataagcttgtctctcaaatcaaggcgtcaactaagattcctgttcttgggcatgctgatggtatatgccacgtatatattgacaaatcagctgacatggatatggcaaaacatattgtaatggatgcaaaaattgattacccagcagcctgcaatgcaatggagaccttactagttcataaggatcttatgaagagtccaggccttgacgacatattagtagcactaaaaacagaaggagttaatatttatggtggacctattgcgcacaaagctctgggatttccaaaagctgtttcatttcatcatgagtatagttctatggcctgcactgttgagtttgttgatgatgttcaatcagcaattgaccatattcatcgttatggaagtgctcatacagattgtatcgtcactacagatgataaggtagcagagacttttctacgcagagttgatagtgctgctgtatttcataatgcaagtacgagattctctgatggggctcgttttggattgggtgctgaggttggcataagcacagggcgtatccatgcccgtggaccagtgggtgttgaaggtctcttaactacacgatggatcttgcgagggcgtgggcaagtggtgaatggtgacaaggatgtcgtgtacacccataagagtcttcctttgcaatgaggtcaaatgctccttttagcctgttcaggagtaggtgaatatccttttaagaatggattgactactttattttgtcatcttgtacaagcatcttattgcggcattccgatggattattgattttgggggtcccactttcaaatgtgacaccaaaaataaattcatcagttctgagagcaagattttggaggttcagcttctccatgtaataagtaaattcagttctgagaacttgtgtaccaacgcgctatgttgcttgtaatgagcgatactaacatctgtgattgcacatatactaattgctatctccactttttcaatcatgctacgacatatcgccgtggatgcata

SEQ ID NO: 11183 - DNA, 3223 bp, Oryza sativa
cccgcacgcgcgaggcgccccccgcaccgggatatggatatctattccccggcttatccgcgctcgcgcggctgagcggctcacgttttctcgtgccaaaacgacggatggatcggtctgggccaacgaccccattcccccctgtatctcggtgcgccgccacctaacagctttaacagcttaacaagtcacagtaacacgcataccgtgtggcgggcgcgggcgcagaggatcccgggggtcgttgggcattttgcgccctgggtttccgcctttccggtcacgggagccagagccacttctgccttcataaacccttcctcttttctcctcctcctatctatcccccctctactcgcggctgcggcggcaaggcggcgagacgtgggagagggatttacaggtagagggagagggtggaggaggagaggctgaggctaggaagcggtttcgccatggcgagcgtcgacccgtcccggagcttcgtgagggacgtgaagcgcgtcatcatcaaggtgggcactgcagttgtctccagacaagatggaagattggctttgggcagggttggagctctgtgcgagcaggttaaggaactgaactctttaggatacgaagtgattttggtcacctcaggtgctgttggagtggggcgacagcgacttaggtaccggaagcttgtcaatagcagctttgctgatctgcaaaagccacagatggagttagatggaaaggcttgtgccgctgttggtcagagtggactgatggctctttacgatatgttgtttaaccaactggatgtctcgtcatctcaacttcttgtcaccgacagtgattttgagaacccaaagttccgggagcaactcactgaaactgttgagtcattattagatcttaaagttataccaatatttaatgaaaatgatgccatcagcactagaaaggctccatatgaggattcatctggtatattctgggataatgacagtttagcaggactgttggcactggaactgaaagctgatctccttattctgctcagtgatgtggatgggttgtatagtggtccaccaagtgaaccatcatcaaaaatcatacacacttatattaaagaaaagcatcagcaagaaatcacttttggagacaaatctcgtgtaggtagaggaggcatgacagcaaaagtgaaggctgctgtcttggcttcaaatagcggcacacctgtggttattacaagtgggtttgaaaatcggagcattcttaaagttcttcatggggaaaaaattggtactctctttcacaagaatgcgaatttgtgggaatcatctaaggatgttagtactcgtgagatggctgttgccgcaagagattgttcaaggcatctacagaatttgtcatcagaggaacgaaaaaagatattgctagatgttgcagatgctttggaggcaaatgaggatttaataaggtctgagaatgaagctgatgtagctgcggcccaagttgctggatatgagaagcctttggttgctagattgactataaaaccaggaaagatagcaagccttgcaaaatctattcgtacccttgcaaatatggaagaccctataaaccagatacttaaaaagacagaggttgctgatgatttagttcttgagaaaacatcttgcccattaggtgttctcttaattgtttttgagtcccgacctgatgccttggttcagattgcatctttggcaattcgaagtggtaatggtcttctcctaaaaggtggaaaagaagctatcagatcaaacacgatattgcataaggttataactgatgctattcctcgtaatgttggtgaaaaacttattggccttgttacaactagagatgagatcgcagatttgctaaagcttgatgatgtcattgatcttgtcattccaagaggaagtaataagcttgtctctcaaatcaaggcgtcaactaagattcctgttcttgggcatgctgatggtatatgccacgtatatattgacaaatcagctgacatggatatggcaaaacatattgtaatggatgcaaaaattgattacccagcagcctgcaatgcaatggagaccttactagttcataaggatcttatgaagagtccaggccttgacgacatattagtagcactaaaaacagaaggagttaatatttatggtggacctattgcgcacaaagctctgggatttccaaaagctgtttcatttcatcatgagtatagttctatggcctgcactgttgagtttgttgatgatgttcaatcagcaattgaccatattcatcgttatggaagtgctcatacagattgtatcgtcactacagatgataaggtagcagagacttttctacgcagagttgatagtgctgctgtatttcataatgcaagtacgagattctctgatggggctcgttttggattgggtgctgaggttggcataagcacagggcgtatccatgcccgtggaccagtgggtgttgaaggtctcttaactacacgatggatcttgcgagggcgtgggcaagtggtgaatggtgacaaggatgtcgtgtacacccataagagtcttcctttgcaatgaggtcaaatgctccttttagcctgttcaggagtaggtgaatatccttttaagaatggattgactactttattttgtcatcttgtacaagcatcttattgcggcattccgatggattattgattttgggggtcccactttcaaatgtgacaccaaaaataaattcatcagttctgagagcaagattttggaggttcagcttctccatgtaataagtaaattcagttctgagaacttgtgtaccaacgcgctatgttgcttgtaatgagcgatactaacatctgtgattgcacatatactaattgctatctccactttttcaatcatgctacgacatatcgccgtggatgcatatatttggtagcatagattcctcagctgaggctctacttgagcttccccttttgttctgataaacatcactaattgtggggttccgctttcagttctgagaaggttccgctttcaaacgtgacactacaaataaattcagttctgagcaatattttggaggttccgctgctccaatgttgtaataaagtaaaatcaggctgtgttcttccccaagttttcctaactcacaaatctcatttttcgcgcgcactgttttcaaactgtta

SEQ ID NO: 11184 - DNA, 634 bp, Lippia dulcis
ccaaatccgtctcccgctcctcgaaagctggtctccagtttcccgttggcagaattgctcgttttctcaaggccggtaaatacgccgagcgcgttggagcaggtgcccccgtctatctctccgccgtcctcgagtacctcgccgccgaggtgttggaacttgctggaaatgctgctagagacaacaagaagaacagaattgttcctcgccacatacaactcgcagtgaggaacgacgaagagttgagtaaactgttgggccatgtcacaatagctaatggaggtgttctgccaaatattcaccagactttgttgccaaagaaggcgggcggtagggacaaggagatcggttccgcgtcgcaagaattttagggttttgttgtgaattaagttggaagggtatttggatcgttcaaatgtcgatccatgtacaaccctaattttgttttggctggaatatataaataggcgttttactaaagagatccaattcatttcaacatttctattccgctgtgttcgcccttcacattattatgtttattttgtttgctgaatttttcagtcctaaatctttcgttattagtagttgtttaaaaaatactatagtaactaattttatttagtgaatgaat

SEQ ID NO: 11185 - DNA, 559 bp, Brassica napus
acgctaccaagtccgtctctcgttcctccaaggccggtctccagttccccgtcggaagaatcgcgagattcctcaaggccggtaaatacgcagagcgtgtcggtgccggagctccggtctacctctccgccgttctagagtacctcgccgccgaggtgttggagctagctggaaacgcggcgagggataacaagaagacgcgtattgtcccgaggcatatacagcttgcggtgaggaacgatgaggagcttagtaagcttctgggagctgtgacgattgctaacggaggagtgttgccgaatattcattcgaatcttttgccttccaaggttgggaagaacaagggagatattggatctgcttctcaagagttttgagtttctttttagctcttgtttttttggatgtaactttagctaatatatgcttcttgattaatcaatcgtaaggtttgccaaaaaaaaaaaacgaaatcaaacttttatcatcgatgatgctgtatgtgtatgtttgtggtcggcttgttagtcttctacgcctaaaactataactattaacc

SEQ ID NO: 11186 - DNA, 381 bp, Tripterygium wilfordii
gaggctcgacgaagggaggaagaggaaagccgaaggcaacgaagtctgtttcacggtcttcgaaggcggggctccagtttcccgtcggcaggattgccaggttccttaaggccggaaagtatgctgagcgtgtcggtgctggagctccggtctatctctctgccgttcttgaataccttgctgccgaggttctggagcttgcagggaacgcagcaagagataataaaaagaatcgtattgtgccgaggcacatacagcttgcagttaggaacgatgaagagctgagcaagcttttgggttcagtgaccattgcaaatggtggtgtgttgcccaacattcaccagactcttctccccaagaagatgggcaagggaaaaggcg

SEQ ID NO: 11187 - DNA, 548 bp, Selaginella moellendorffii
atcgattcgagagcgcgtagggtttgccatggctgctggaggaggaggtcggggtaaatccgccgggaagaaggctacttcgaggagttccaaggccggattgcagtttccagtgggtaggatcgccagatttctcaaggcgggcaagtatgccgagcgtgttggtgctggagcgccagtctatctcgccgcggttctcgagtacttggcggcagaggtgctcgaattggccgggaatgcggccagggataacaagaagaacaggattgttccacggcatatccagctcgccgtgaggaacgacgaagaactctccaagctcttgggcagcgtcactattgctgctggcggcgtgctgcccaacatccacaatgtcttgctaccgaagaagactggcactgggagctccaagaaggacgccgccggagacgagagcccctaaatcgatgggaagttcgatcgattcggtcgaactggcacgaagaaccctaaaaattctcttcacgtgtacattaacttgtacggtaggaaatgccgtaattattctc

SEQ ID NO: 11188 - DNA, 605 bp, Selaginella moellendorffii
ggaaacgatcgattcgagagcgcgtagggtttgccatggctgctggagggggaggtcggggtaaatccgccgggaagaaggctacttcgaggagttccaaggccggattgcagtttccagtgggtaggatcgccagatttctcaaggcgggcaagtatgccgagcgcgttggcgctggagcgccagtctatctcgccgcggttctcgaatacttggcggcagaggtgctcgaattggccgggaatgcggccagggataacaagaagaacaggattgttccacggcacatccagctcgccgtgaggaacgacgaagaactctcgaagctcttgggcagcgtcactattgctgctggcggcgtgctgcccaacatccacaatgtcttgctaccgaagaagactggcactgggagctccaagaaggacgccgccggagacgagagcccctaaatcgatgggaagttcgatcgattcggtcgaactggcacgaagaaccctaaaaattctcttcacgtgtacattaacttgtacggtaggaaatgccgtaattattctccctccctgtctgacgcgtcttggaaatctgacgtggaatgctgactgcgc

SEQ ID NO: 11189 - DNA, 540 bp, Oryza sativa
gaacacacgagtcggcggcggcgcggcgatggggagcaacacggaggtggagaagaagaaggccccaacggcgctcgcgcccatcgcgaagcctctcgccggcaagaagctctgcaagcgaaccctcaagctcgtccggcgagcatcggaggccaagtgcctgaagcggggagtcaaggaggtggtcaagagcatccgtcgtgggaacaaagggttgtgtgtaattgctgggaatatttctcctatcgatgtgattacacatgttccaatactttgtgaggaagctaatattccttacatatatgtgccatcaaaagaggatcttgctactgccgggactactaagaggcctacctgttgcgtcctggttatgaccaagcctgccaagggggagatcaatgaagaggtgaaggagaaactgaagtcagactacgaccatgttgtagctgaagttgcagaggttacatcttcaatgttctgagtacaacgcccagccccagggccatagtaaattagtgatagaaacccaggcaccatggc

SEQ ID NO: 11190 - DNA, 845 bp, Oryza sativa
aaaagccctaaaaactccagaaccaaccaaaaggcgcgcgaacacacgagtcggcggcggcgcggcgatggggagcgacacggaggtggagaagaagaaggccccaacggcgctcgcgcccatcgcgaagcctctcgccggcaagaagctctgcaagcgaaccctcaagctcgtccggcgagcatcggaggccaagtgcctgaagcggggagtcaaggaggtggtcaagagcatccgtcgtgggaacaaagggttgtgtgtaattgctgggaatatttctcctatcgatgtgattacacatgttccaatactttgtgaggaagctaatattccttacatatatgtgccatcaaaagaggatcttgctactgccgggactactaagaggcctacctgttgcgtcctggttatgaccaagcctgccaagggggagatcaatgaagaggtgaaggagaaactgaagtcagactacgaccatattgtagctgaagttgcagaggttacatcttcaatgttctgagtacaacgcccagccccagggccatagtaaattagtgatagaaacccaggcaccatggctgctcacatctttctatatgtattatgtgaacatgaaggttgctctactagtttacccctgtcggatcatgctgtttctctgttgattagcataagctagtcaattgtaatgaaacctggtgagctgatcatttactctccagtaagaagtccctgtcccaaggcccagatatgcaatacctgggcaccccagatcagaaaactcaccaaagtcatgaggtgttgtgtgttaagttgctcgtggttatgttcatatcctgtatcca

SEQ ID NO: 11191 - DNA, 2207 bp, Cajanus cajan
cagtgttgtgttagtgttgcagtcttgcagaggaggaccccatatctttgagcggagattactgagtttcagctcaggtgctgctccctctgttctttctgccccctatccctacccttactcacttcccaatccatctacccttcaagccttttaccccctttttctttttcttttatttttttattatttttcttattttcatctacttaatgtgatctgttacttttccccttttcagttttaatttctgggttttgtgagttactcggttttaagggttgttgggctgtaaagttgtggtttttaggttttatttgggaatttgccatctggggtggtggtgtttggaattgatgatatctgggtttggtactgtggttctctagggatggggctgggtgctcagaatggtaaggtggtggagtcttgggatgtgtgtaaatcaaaggggaggaagaagaagaaacagggggatgaggaggtggaaggggctgaggctgggtgttgggttaggctgaggttcattgggagctgcatttcttcaagatccaaggttgatagctcagtcagcggcagtggcaccagtactcattatgctgagagtaaatcaactaatgatacaagtagagaccaaccaacagttccagcagtctcttctacaaccactagtaatacagaaagcaattcatccacttccaaacttgaagaagagcttaaaattgcttccaggctgcgaaagttctctttcaatgatctaaagttagcaacaagaaattttcggcctgagagttttcttggtgaaggtgggtttggctgtgttttcaaggggtggattgaagaaaatggaactgccccggtgaaaccaggcacgggccttactgttgctgttaaaaccctcaaccatgacgggctccagggtcataaagaatggctggctgaagtaaattttcttggtgatctagttcatcaaaaccttgtaaaacttgtaggttactgcattgaagatgatcaaaggttgctagtgtatgagttcatgcctcggggtagcctggaaaatcacttatttaggagatccctgcctcttccatggtccattagaatgaaaattgcactaggagctgctaagggtcttgcttttcttcatgaagaagctgaaagaccagtaatatatagggattttaaaacttcgaatatattattagatgcagactacaatgccaagctctcagactttggtcttgccaaagatggtccagaaggtgataaaacccatgtgtctactcgagtgatgggaacctatggttatgcagcaccagaatatgtcatgacgggtcatcttacatcaaaaagtgatgtgtacagttttggagtggtactacttgagatgttgaccggcagaagatccatggacaaacaccgacccaatggtgagcataaccttgtggaatgggctcgaccacatcttggagagaggagaaggttctacaggttgatagaccctcgtcttgaaggtcacttttccataaaaggagctcagaaagctgctcaactggctgctcactgccttagtagagatccaaaagccagacccctaatgagtgaagttgttgaagctttgaagcctttgccaaaccttaaggacatggcaagctcttcatattatttccaggcaatgcaagctgatcgctttggcgcgagcccaaacacaagaaatgggcgaacacaaggcgcattgctcacccgcaatggacagcagcaaaggagcctctcaataccaaatggtacttatgcatctccatatcatcagtttccccaaccatcaccgaaacctaatggcaaagcatagagctggtgaaaattttatttttctctttcaccctttttttatgccacttcttagtttctccttgtagatgtaccttctttcaaagcatttgttcatggagaacttgagagcaaaagaagcattttgctttatgattttatgttatgggtgttgaccccctttagcttgaaagaatgtgagggtgagggcaggtgaacaagtcaaattgtcaaccaatattttcttcaggttgtttggaaatattgaacactatcaaatactcatccttattttattgtttttcacatttgccacaggaagtgttatgttatctcctgatttattagtgtatgtttggatttcagttaggagagttcaa

SEQ ID NO: 11192 - DNA, 2292 bp, Glycine max
tccgactctcatctcatcatccaacaataatagcagcagcaaccaacgaacgagaccgagtatcgtaattcgtataatattattattagtattattatatgaatatatttaaattttgaaaaaccccacattaattaaatattaaaaagaaaatccgaatagtatttttgttttatcagagttgtgttgtgtaatgtgctagtgtttttgttgttgctgcatagagaggaccccatatctgttatgtagcggagattactcagttcagctcagtttcaatttctggggtttgtgggttacccggtttcaagggttgttggcatgtaaagttgtgatttttaggtttcatctgggaatttcccatctgggggttgtggtctttggtatttgatggtatctgggtttctagggattgattgatcattgattggtagagataatagatggggttgggtgctgagaatggcaaggtggtggagtcttgggatgtgtgtaaatcaaaggggaggaagaagaagaagggggatgaagggggtgaggctgaggctgggtgttgggttaggttgaggttcattgggagctgcatttcttcaagatccaaggttgatacctcagtcagtggcagtggcaccagtactcattatgctgaaagtaaatcaactaatgatactagtagagaccaaccaacagccccagcagtctcttctacaaccactagtaatgctgaaagcaattcatcatccacttccaagcttgaagaagagcttaaaattgcttccaggctgcgaaagttctctttcaatgaactcaagttagcaacaagaaatttccgacctgaaagttttcttggtgaaggtgggtttggttgtgttttcaaggggtggattgaagaaaatggaactgctccagtgaaacctggcacaggacttacggttgctgtaaaaaccctaaaccatgatgggctccagggtcataaagaatggctggctgaagtgaattttcttggtgacctagttcatccaaaccttgttaaacttgtaggttactgcattgaagaggatcaaaggttgctagtgtatgagttcatgcctcggggtagcctggaaaaccacttatttaggagatccattcctcttccatggtccattagaatgaaaattgcactaggagctgctaagggtcttgcttttcttcatgaagaagctgaacgaccagtaatatatagggattttaaaacttcaaacatattactggatgcagagtacaatgccaagctctcagattttggtcttgccaaagatggtccagaaggtgataaaacccatgtgtctactcgagtgatgggaacctatggttatgcagcaccagaatatgtcatgacgggtcatcttacatcaaaaagtgatgtgtacagtttcggagtggtactacttgagatgttgaccggcagaagatccatggacaaacaccgacccaacggtgagcataaccttgtggaatgggctcggccacatctaggagagagaagaaggttctacaggttgatagaccctcgcttggaaggccatttttcggtaaaaggagctcagaaagctgccctactggctgctcactgccttagtagagatccaaaagccagacccctaatgagtgaagttgtggaagctttaaagcctttgccaaacctcaaggacatggcaagctcttcatattatttccaggcaatgcaagctgaccgcattggagcgagcccaaacacaagaaatgggcgaatgcaaggagcgttgctcacccgcaatggacagcagcaaaggagcctttcaataccaaatggtacttatgcatctccatatcaccatcagtttccccaaccatcaccaaaacccaatggcaaagcatagagctgatgaaaattttctttttctttttctctttcaccctttacaccatttcttagtttcttcttatagatgtaccttctcttaaagcatagcatatgctgctttatgatgttatgttaacttatgggtgttgaccccctttatcttgaaagaatgtgagggtgagagcaagtgaagcttattgagctactatgtcttatctcaaattgtcattcaatattttcttcaggttgcttggaaatattgaacaccatcaaatcctcatccttattttattttgtttttcacattagtccccggaaatgttatctcctgatttatttaggcttttcttgtgatatcaaacactgcatctccccttaaattaatcactagcttttgtttatgaaaa

SEQ ID NO: 11193 - DNA, 2319 bp, Phaseolus vulgaris
attaaatattattaatacgtttaatttaaaagaaaattcataaatttttgttcagcatgttgtgtgttgtgctattgttgcagaggaggacccatttcagttatgtatctttgagcggagattactgagttcagcccaggtgctgttcactctgttctctctgcccccactctcctcacttcactttttatttcccaattcccaatccatctaccgttcaagatttttttttttgggtattttcacttacttaatgtgatctgttacttttccccttttcgatttttatttctgggtcttgtgggttactcggtttcaagggttgttgggttgtaaagttgtgatctttaggttttacttgggaatttgccatctgggctcgtgggagggtaggaggaggtggtatttggaattgatgatatctgggtttggttgtctaggaacttgtagagatgggcttgggtgctgagaatggtaaggtggtggagccttgggatgtgtgcaaatcaaaggggaggaagaagaagaaaggggatgaggaagtggaaggggctgggtctggttgttggcttaggctgaggtttattggcagctgcatttcctcaagatccaaggtcgacacctctgtcagtggcagtggcaccagtactcattatgctgaaagtaaatcaactaatgatactagtagagaccaaccaacggctccagcagtctcttctacaaccactagtaatgcagaaagtaattcatccacttccaaacttgaagaggagcttaaaattgcttccaggctgcgaaagttctctttcaatgatcttaagttagctaccagaaattttcggcctgaaagttttcttggtgaaggtgggtttggttgtgttttcaagggttggattgaagaaaatggaactgctccagtgaaacctggcacagggcttacggttgctgtaaaaaccctcaaccatgatgggctccagggtcataaagagtggctggctgaagtaaattttcttggcgatctagttcatccgaacctagttaaacttgtaggttactgcattgaagatgatcaaaggttgctagtgtatgagttcatgcctcggggtagtctagaaaatcatttgtttaggagatccctgcctcttccatggtccattagaatgaaaattgccctaggagctgctaagggtcttgcttttcttcacgaagaagccgatcgaccagtaatatatagggattttaaaacttcaaatatactattagatgcagagtataatgccaagctctcagactttggtctagccaaagatggcccagaaggtgataaaacacatgtgtctactcgagtgatgggaacctatggctatgcagcaccagaatatgtcatgacaggtcatcttacatcaaaaagtgatgtgtacagttttggagtggtactacttgagatgttgtctggcagaagatccatggacaaacacagacccaatggtgagcataaccttgtggaatgggctcgccctcatctaggagagaggagaaggttctacaagttgatagaccctcgtttggaaggccatttttcggtgaaaggtgctcagaaagctgcccaactggctgctcactgcctttgtagggatccaaaagccaggcctctgatgagtgaagttgtagaagctttaaagcctttgccaaacctcaaggacatggcaagctcttcatattattaccagacaatgcaagctgaccgcattggagcgagcccgaacacacgaaacgggcgaacacaaggagcattgctcacccgcaatggacaccagcaaaggagtctttctataccaaatggtacctatgcatctccttatcatcagtttcctcaaccatcaccaaaacccaatggcaaagcgtagtagagctggtgaaaattctctttttccctttcaccttttatgtcatttcttagtttttccttgtagatgtaccttctgtcaaagcttctgttcatggagatgttgaaagcaaaagaagcatgttgctttatcatattatgttatggcttttgcttgaaagaatatctgggtgggagcaaagaagcttattgagctactatctcttctgtcaaattgttattcaatattttcatcaggttgtttgaaaatattgaacattatgaaatcctcatccttattttattttgtttttcacatttgtgatcggaaaatgttatctcctgatatatctaggatttgcttgtgatatcaaaccctgcagctccttaaattaaacgctgtcttttgtttataaaaagatgagaaagaagct

SEQ ID NO: 11194 - DNA, 1488 bp, Tabernaemontana elegans
ataccaaagtggatagttccatcagtggtatcagtactcactgtgaaagtaaatctgcaaatgatactagtcgagatcaaccagtagctgcaattatttcatcaacggctacaagtaatggcgaaagtaattcatccactaccaaacttgaagaggagcttaaagttgcttcacggcttcgtaaattcacatttaatgatcttaagttagcaaccagaaattttagaccagaatctcttcttggggagggaggttttggctgtgtattcaagggctggattgaagagaatggaacagcccctgtgaaacctgggacagggttaaccgttgctgtgaaaaccctcaatcacgatgggcttcagggtcacaaagaatggctggctgaagtaagctttcttggtgatcttattcatcctaatttggttaagctgattggttactgtattgaagatgatcaaaggctgctagtctatgagttcatgcctcgaggaagcttggagaatcacctattcaggaggtctctgcctcttccatggtccatcaggatgaaaattgctctaggtgctgcaaagggtcttgctttccttcacgaggaagcagaaagacctgttatatatcgtgactttaaaacctccaacattttgttagatgcagattacaatgccaaactctctgattttggccttgccaaagatggtccagagggagataagactcacgtctctacccgtgtgatgggaacatatgggtatgcagccccagagtatgtgatgaccgggcatcttacatcgaagagtgatgtctacagctttggcgttgttctgctcgaaatgctaactgggagaagatccatggacaagaatcggcctaacggagagcataaccttgtagagtgggcacggcctcatcttggtgagagaagaaggttttatcggttgatagatcctaggcttgaaggtcatttttcaattaagggtgcgcagaaagctgcccagttggctgctcgctgccttagccgcgatccaaaagccagacctctcatgagtgaagttgtcgaagccttaaaacctttgccagccctgaaggacatggcaagctcctcctactatttccaaaccatgcaagctgatcgtgttggatctagtccaaataccagaaatggtattagatcacaggcagcaacattttcgaggaatggacagccacatccgaggagtctgtcaataccaaatggttctcatgcttctccatatcatcatcagtttccacacaactcaccaaaaccaaatggtaaacaatagaggtagaccggcaacaatgcgtttctttcaccaatcttcattctttttcttttcccccagctatgaacatattttgtcagctcattgttgttagatgaaagagaaagggaataggagtacacagttcattatgttgttgtgatcctgagtgatgtaacctccattgggggagaatgtaatgtaagcg

SEQ ID NO: 11195 - DNA, 1501 bp, Malus domestica
aaattaaatctataaatgatacaagcagagaccaaccaacagctactgtagtctcttcatcaaccactagtaatacagaaagtaatgcatccacttccaaacttgaagaggaacttaaagttgcttcacggttgcgaaaattcacatttattgatcttaaattggcaacaagaaatttcagacctgaaagtcttcttggtgaaggtggttttggttgcgtgttcaaggggtggatagaagaaaatggaactgctccagtaaaacctggcacaggtcttactgttgcagttaaaactcttaaccatgatggacttcagggtcataaagaatggctggctgaagtaaattatcttggtgaccttgtccatccaaacttagttaaacttataggatactgcattgaagatgatcaaaggctgctagtgtatgagttcatgcctcgagggagcttggagaaccatctatttaggaggtcgttgcctcttccatggtctattcgaatgaagattgcattaggtgctgcaaagggccttgcttttctccatgaggaagcagaaagacctgtgatctatcgtgactttaaaacctctaacattttattggacgcagattacaatgccaagctgtctgactttggacttgccaaagatggtcccgagggtgataaaactcatgtctccacccgtgtgatgggaacttatggttatgcagctccagaatatgtaatgactggacatcttacatctaagagtgatgtctatagttttggtgtggttttactcgagatgctgactggcagaagatccatggacaaaaatcgacccaatggcgaacataaccttgtggagtgggcacggccacatctaggagaaagaagaagattctaccggttgatagatcctcggcttgaaggccacttttcaataaaaggtgttcaaaaagccgcacaactagctgctcactgccttagtcgagatccaaaggccagacccttaatgagtgaagttgtcgaagccttaaagccgctgccagccctcaaggacatggcaagctcgtcatattatttccagaccatgcaaggtgaccgtgtcgggtccagcccaaataccagaaacggcgtcagaccacagggaggattgctgacgaggaacgggcataatcagcagaggagcctttcgataccaaatggtacccatgcttctccatatcaccttcaacatccccaaccatcaccaaaacctaatggcaaatcgtaagatagggttggcagctgtctgtatcaattcccacctcctgtcagcaatcattttcttcttctttttccccgtttttcgcttcttcgatccgtatagatgtaattttcggttaaagcatttgttcttggacagctggaaaagcagcagggattcatgtttgctttgatgttatgtttagaatgcaagggcaggtgaagcttctttgagcaaaaatgtcttctgccatatttggttggaaataccat

SEQ ID NO: 11196 - DNA, 1872 bp, Triticum aestivum
tctcctctcctctccgaatccaccccggcgctcgctgtccgaaatccccaccaattcggcacgccgcacgtgtgcgtacgtatataacacatcggtcgaccgatcaatggccctgctcaaggccgcgcgcgtcgccgacgtccccaccctcgacgtcgtcgtgccggaccacctcaccgccgccgcgcgggtcctcgacgcggagtcggtggcgacgatgaagaggcagcagcgcggcgcgggccggcggttcgcggtgatcgggcaccgcggcaaggggatgaacgcgctggcgtcgccggaccggcggctgcaggaggtgaaggagaactcggtccggtcgttcaacgaggcggcgcgcttcgccgtcgactacgtcgagttcgacgtccaggtcaccaaggacgtctgcccaatcatcttccatgacaacttcatcattactgaggagcatggcaaaatttcagagaagcgtgtcactgatcttcagttggaagatttcctccagtatggcccacaaaacaagcaaggcaagaatgggaagcctttgctgcggaaaatgaaggacggccgggtgttgaattggagcgttcagtcagatgatcctctttgcacccttcaagaagcattcgagaaggtcaatccaagattgggcttcaatgtcgagctgaaattcgatgacaatcttgtgtaccaagatgaggagctcactcacatcctccaggccatcctcaaggtggtcttcgagtgtgccaaggataggcctatcattttctctagcttccagcccgatgctgcgcagctcatgcgaaaactacagagcacataccctgtgtacttcttgacgaacggagggacagaagtctacgccgacgtgaggaggaactcgttggaggaggcggtcaagctgtgcctcgccactggcatgcaagggatcgtgtccgaggcccgcgcggtcttcaggttcccgactgccataccgaagatcaaggaggctgacctctccctactaacttacgggacactcaataacgtgccggaggcggtgtacatgcagcacctgatgggggtgaacggggtcatcgtcgacctcgtgccggagatcacgggggccgtctcggacctcatcgctgtcccggagatcgacacggagatcaatgatctgagcagccaagctgtgaaagatgccgcgtcgacgccaaatttcacgcagcgggagatttcattcctactgaggctgatgccggagcttgtgcaataacacagactgcaccccattgatggctttggatgtaactgactgattggcatacaggaagaggagccccttgtggagggcagtacaagtatacgtactgggttggtgtgatctccttcggtgagccctggtcctaggagaattggggattgttttatacatgttgtagcgagggggcattgatttatacatgttgtagcgagggtggtgatttttctggatatacagtgaatgtcatcgtcacaatggcggtgttattactacgctagtactccctcatattggatgtaggtcatctccaacacccttcccattaaatccccctttccggtcccattttctttcattccgtcccttatcatccgcaccctcctctgacaccgttgctgtacctctttggtcggcatactggcatcgtcggacctccgcaaccagtacactctgtccccatgtatggacgccacacgcattaggtgttcaatcaaatgccattgagcttattttcgaacaccacgcaatagggttcactcaaatgccattgagcttattccgaacacacgtctttttacgaacaaaatgatggtggggtaccgacaagcacgatgactgtgcga

SEQ ID NO: 11197 - DNA, 1567 bp, Triticum aestivum
cagccattgagcccctctcctctcctctcctcgccgaatccaccccggcgctcgctgtccgagatccccaccaattcggcacgccgcacgtgtgcacgtataacaacacatcgggtcgaccgatcaatggctctgctcaaggccgcgcgcgtcgccgacgtccccagcctcgacgtcgtcgtgccggaccacctcgccgccgccgcgcgggtcctcgacgcggagtcggcggcggcgatgaagaggcagcagcgcggcgcgggccggcggttcgcggtgatcgggcaccgcggcaaggggatgaacgcgctggcgtcgccggaccggcggctgcaggaggtgaaggagaactcgatccggtcgttcaacgaggcggcgcgcttcgccgtcgactacgtcgagttcgacgtccaggtcaccaaggacgtctgcccagtcatcttccatgacaacttcatcgttactgaagaacatggcaaaatttcagagaagcgtgtcactgatcttcagttggaagatttcctccagtatggcccacaaaacaagcaagggaagaatgggaagcctttgctgcggaaaatgaaggacggtcgggtattgaattggaacgtccagtcagatgatcctctttgcacccttcaagaagcattcgagaaggtcaatccaagattgggcttcaatgtcgagctgaaattcgatgacaatctcgtgtaccaagatgaggagctcactcacatcctccaggccatcctcaaggtggtcttcgagtgtgccaaggataggcctatcattttctctagcttccagcccgatgctgcgcagctcatgcgaaaactgcagagcacataccctgtgtacttcttgacgaatggagggacggaagtctatgccgacgtgaggaggaactcgttggaagaggcggtcaagctgtgccttgccagcggcatgcaagggatcgtgtccgaggcccgcgcggttttcaggttcccgacagctatacccaagatcaaggaggccgacctctccctgctaacttacgggacactcaataacgtgccggaggcggtgtacatgcagcacctgatgggtgtgaacggggtcatcgtcgacctcgtgccggagatcactggcgctgtctccgatctcatcgccgtcccggagaccgatgtggagatcaatgatctgagcggccaggtggcaaaagatgccgcgtcgacaccgaatttcacgcagcgggagatctcgttcctgctgaggctcatgcccgagcttgtgcaataacacagattgcacaccattaactcatggctttggatgtaactgattgtttggcatacaggacaggaggagccccttgtggaaggaagtacaggtttacatactgggttggtgtgatgtccttcggtgagccctggtactgggagaattggggattgatatgatatgttgtagtgtgggtggcgaaatttttggatatacatgttgtagtgaatgtcaccgtcacaatgggccgtgttactaaactaatacatgatcctgagtctggtaaccagcattttcgatcaac

SEQ ID NO: 11198 - DNA, 1673 bp, Secale cereale
cgaataccccggaggataaacccgagagccccgagcggcaccctggaatattcccgctccggcatcacattcagttccggcgtccatccgtccatataaagtcctctctccgtccgttgcaactcaccacccagccagccattgaacttccctctccaatcctcgccgaatccaccccggcgttcgctgtccgaatcccccaccaatccggcacgccgcacgtgcgtacgtataacacgtcgaccggccgatcaatggctctgctcaaggccgcgcgcgtcgccgacgtccccaccctcgacgtcgtcgtgccggaccacctcgccgccgccgcggcgcgcgccctcgatgcggaggcagcagcgacgatgaagaggcaccagcgccggcagttcgcggtgatcgggcaccgcggcaaggggatgaacgcgctggcgtcgccggaccggcggctgcaggaggtgaaggagaactcggtccggtcgttcaacgaggcggcgcgcttcgccgtcgactacgtcgagttcgacgtccaggtgaccaaggacggctgcccagtcatcttccatgacaacttcatcattactgaagaacatggcaaaatttcagataagcgtgtcactgatcttcagttggaagactttctccagtatggcccacaaaataagcaaggcaagaatgggaagcctttgctgcggaaaatgaaggacggccgggtgttgaattggaacgtccagtcagatgatcctctttgcacccttcaagaagcattcgagaaggtcaatcctagattgggcttcaatgtcgagctgaaattcgatgacaatcttgtgtaccaagatgaagagctcactcacatcctccaggccatcctcaaggtggtctttgagtgtgccaaggataggcctatcattttctctagcttccagcccgatgctgcgcagctcatgcgaaaactgcagagcacataccctgtttacttcttgacgaacggagggacggaaatctacgccgacgtgaggaggaactcgttggaagaggcggtgaagctgtgccttgccactggcatgcaagggatcgtgtccgaggcccgcgcaatcttcaggttcccgaccgctataccgaagatcaaggaggctgacctctccctgctaacttacgggacactcaataacgtgccggaggcggtgtacatgcagcacctcatgggggtgaacggggtcatcgtcgaccttgtgccggagatcacgggggccgtctcggacctcattgccatcccagagaccgacacggagatcaatgatctgagcagccaggtggtgaaagatgccgcgttgacgccaaatttcacgccgcgggagatttcattcctgctgaggctgatgccggagcttgtgcaataacacagattgcacccccgttcatggctttggatgtaactgactgattggcatacatgaagaggagcccgttgtggagggaagtacaagtatatgtactgggttggtgtaatgcccttcggtgagccttggtcctaggggaattggggattgatttatacatgttgtagcgagggggcattgatttatacatgttgtagcgagggtggtgtttttttggatatacagttaatgtcaccgtcacaatggcggtgttattactaaacaagtact

SEQ ID NO: 11199 - DNA, 1717 bp, Triticum aestivum
ccggcgctcgctgtccgaaatccccaccaattcggcacgccgcacgtgtgcgtacgtatataacacatcggtcgaccgatcaatggccctgctcaaggccgcgcgcgtcgccgacgtccccaccctcgacgtcgtcgtgccggaccacctcaccgccgccgcgcgggtcctcgacgcggagtcggtggcgatgatgaagaagcagcagcggggcgcgggccggcggttcgcggtgatcgggcaccgcggcaaggggatgaacgcgctggcgtcgccggaccggcggctgcaggaggtgaaggagaactcggtccggtcgttcaacgaggcggcgcgcttcgccgtcgactacgtcgagttcgacgtccaggtcaccaaggacgtctgcccagtcatcttccatgacaacttcatcattactgaggagcatggcaaaatttcagagaagcgtgtcactgatcttcagttggaagatttcctccagtatggcccacaaaacaagcaaggcaagaatgggaagcctttgctgcggaaaatgaaggacggtcggttgttgaattggaacgttcagtcagatgatcctctttgcacccttcaagaagcattcgagaaggtcaatccaagattgggcttcaatgtcgagctgaaattcgatgacaatcttgtgtaccaagatgaggagctcactcacatcctccaggccatcctcaaggtggtcttcgagtgtgccaaggataggcctatcattttctctagcttccagcccgatgctgcgcagctcatgcgaaaactgcagagcacataccctgtgtacttcttgacgaacggagggacggaagtctacgccgacgtgaggaggaactcgttggaagaggcggtcaagctgtgccttgccagcggcatgcaagggatcgtgtccgaggcccgcgcggtcttcaggttcccgaccgctatacccaagatcaaggaggctgacctctccctactaacttacggaacactcaataacgtgccggaggcggtgtacatgcagcacctgatgggggtgaacggggtcatcgtcgacctcgtgccggagatcacgggggccgtctcggacctcatcactgtcccggagaccgacacggaggtcaatgatctgggcagccaagctgtgaaagatgccgcgtcgacgcccaatttcacgcagcgggagatttcattcctactgaggctgatgccggagcttgtgcaataacacagattgcaccccgttgatggctttggatgtaactgactgattggcatacaggaagaggagccccttgtggagggaagtacaagtatacgtactgggttggtgtgatctccttcggtgagccctggtcctaggagaattggggattgttttatacatgttgtagcgagggggcattgatttatacatgttgtagcgagggtggtgatttttctggatatacagtgaatgtcaccgtcaaaatggcggtgttattactacgctagtactccctcatattggatgtaggtcatctccaacacccttcccattaaatccccccttccggtcccattttctttcattccgtcccttatcatcctcaccctcctctgacgccgctgatgtacctctttggttggcatactggcatcgtccgacctccgcaaccgcaaccagtacactccgtccccatgtatggacgccacacgcaataggtgt

SEQ ID NO: 11200 - DNA, 1608 bp, Triticum aestivum
ccctctcctctcctctccgaatccaccccggcgctcgctgtccgagatccccaccaattcggcacgccgcacgtgtgcacgtataacaacacatcgggtcgaccgatcaatggctctgctcaaggccgcgcgcgtcgccgacgtccccagcctcgacgtcgtcgtgccggaccacctcgccgccgccgcgcgggtcctcgacgcggaggcggcgtcgatggtgaagaagcagcggggcgcgggccggcggttcgcggtgatcgggcaccgcggcaaggggatgaacgcgctggcgtcgccggaccggcggatgcaggaggtgaaggagaactcggtccggtcgttcaacgaggcggcgcgcttcgccgtcgactacgtcgagttcgacgtccaggtcaccaaggacgtctgcccagtcatcttccatgacaacttcatcattactgaagaacatggcaaaatttcagagaagcgtgtcactgatcttcagttggaagatttcctccagtatggcccacaaaacaagcaagggaagaatgggaagcctttgctgcggaaaatgaaggacggtcgggtattgaattggaacgtccagtcagatgatcctctttgcacccttcaagaagcattcgagaaggtcaatccaagattgggcttcaatgtcgagctgaaattcgatgacaatctcgtgtaccaagatgaggagctcactcacatcctccaggccatcctcaaggtggtcttcgagtgtgccaaggataggcctatcattttctctagcttccagcccgatgctgcgcagctcatgcgaaaactgcagagcacataccctgtgtacttcttgacgaatggagggacggaagtctatgccgacgtgaggaggaactcgttggaagaggcggtcaagctgtgccttgccagcggcatgcaagggatcgtgtccgaggcccgcgcggttttcaggttcccgacagctatacccaagatcaaggaggccgacctctccctgctaacttacgggacactcaataacgtgccggaggcggtgtacatgcagcacctgatgggtgtgaacggggtcatcgtcgacctcgtgccggagatcactggcgctgtctccgatctcatcgccgtcccggagaccgatgtggagatcaatgatctgagcggccaggtggcaaaagatgccgcgtcgacaccgaatttcacgcagcgggagatctcgttcctgctgaggctcatgcccgagcttgtgcaataacacagattgcacaccattaactcatggctttggatgtaactgattgtttggcatacaggacaggaggagccccttgtggaaggaagtacaggtttacatactgggttggtgtgatgtccttcggtgagccctggtactagggaagaattggggattgatatgatatgttgtagtgtgggtggcgaaatttttggatatacatgtcgtagtgaatgtcaccgtcacaatgggccgtgttactaaactaatacatgatcctgagtctggtatccagcattttcgatcaacattcgtcaatgtgtttgctacaatatttttggaaattaagaaaatccccaggttttcac

SEQ ID NO: 11201 - DNA, 1526 bp, Brachypodium distachyon
ccaccccggcctcgcgctttgccctgcccaatttccccacgcccgacgtcctcggcacgtgcctctagcaaaccaattcttcgttcgattcctcctatagcagatcggtcggtccaccaatggctctgctcaaggccgcccgcgtcgccgaggtgcccaccctcgacgtcgtcgtcccggacctcgccgccgcctccgcacgcattctcgaggtggacgcggcggtgaagaagcgcgcgggcgggcggttcgcggtgatcgggcaccgcggcaaggggatgaacgcgctggcgtcgcccgaccggcggctgcaggaggtgaaggagaactccgtcaggtccttcaacgaggcggcgcgcttccccgtcgactacgtcgagtttgacgtccaggtgaccaaggacgggtgtccaatcatcttccatgacaacttcatctttactgaagaacatggtaaaatttcagataagcgtgtcacagatcttcagttagaagacttcctcatgtatggcccacaaaataggcaggggaagaatgggaaacctttgctgcggaaaatgaaggatggtagaatgttgaattggaatgtgcaatcagatgatcctctttgcacgcttcaagaagcatttgctaaggtcaatccaagattgggcttcaatgttgagctgaaatttgatgactatcttgcataccaggaggaagagctctctcgcatcctccaggccatcctgaaggtggtgtttgagtatgccaaggataggcctattattttctccagcttccaacccgatgctgcacaactcatgcgaaaattgcaaagcacataccctgtttatttcttgacaaatggaggaacagagatatacaccgacgtgaggaggaattcgctggaagaggcggtcaagctatgcctcaccagcggcatgcaaggtattgtgtccgaggcccgagcaatattcaggtttccagcggccataccgaagatcaaggaggctgacctctccctgctgacttacggaacattgaataatgtgccagaggcagtgtacatgcagcacctgatgggggtgaacggggtcatcgtcgacctcgtgcaggagatcaccgaggccgtcactgatctcatcgcggtcccggagcctgatccggaagccaaggactcgagcagccaggtgacaagagatgccgcgtctacgcccaacttcactcagcgcgagatctcgttcctgctgaggctgatccctgagcttgtacaatagcgcaatgtccattgatggctttggagtagcatacaggaagaacccattggggagggcagtacaagtttatgtgaagtcctaaggcgaggtcctcttttgtttgtcttgggagaactggtgatggatatgttatatgtgtacatgtcgtagcgaggggaggggtccaattgaaactaccccagaaggaggatgattgttgtaccttcaacgacgtgtctaactgaaattacaaatctattgttgaatttggtatgggcagttctgcag

SEQ ID NO: 11202 - DNA, 1946 bp, Lolium multiflorum
taggacaaggaagcggaacgggaagctgtccggaaggcaatgcggccaccgaatatccacgaggataaacccagggacagccatggcaccctggaatattcccgcgcccctaccacattcgatttcggcctctccctctttataacgctcctggttcctttccttgtccggcgacattcaactccctccctccctcctcttcaatccaccccggcctgcgctgcccaaatccacaccaattcctccgcacgtgtaccaactacctagccgtaacagccaattccttgacacaaatagatcgatcatcgaccaatggctctgctcaaggccgcccgcgtctccgacgtcccaaccctcgacgtcctcgtccctgacctcgccgcagccgcgcgcattggcccgggcgcgaagcagcagcgcgcggcgggccggctcgcgttgatcgggcaccggggcaaggggatgaacgcgctgtcgtcgccagaccgccgcctgcaggaggtcaaggagaactccgtcaggtccttcaacgaggcggcgcgcttcgccatcgactatgtggagttcgacgtccaggtcaccaaggacgcctgcccaatcatcttccatgacaactttatctttactgaagaacagggtaaagtttcagacagacgtgtcacagatcttcggctggaagaattcctccagtatggacctcaaaataaggaggggaagaatgggaagcctttgttgcggaaaatgaaggatggtagagttttgaattggaatgtgcaatcagatgatcctctttgcacccttcaagaagcattcgagaaggtcaatccaagattgggcttcaacgttgagctaaaatttgatgacaatcttgtataccaggaggaagagctcagccacatcctcgaggccatcttgaaggtggtctttgagtatgccaaggacagacatatcattttctctagcttccagcccgatgctgcacagctcatgcgaaaaatgcaaagcacataccctgtttacttcttgacaaatggtgggacagaaatctatactgacgtgaggaggaactcgttggaagaggcagttaagctttgtcttgccagcggcatgcaaggaattgtctcggaggcccgtgcaatattcaggttcccggcagctataccaaagatcaaagaggctgacctctccctattgacctacggaacattgaataatgtgccggaggccgtgtacatgcagcacctgatgggagtgaacggggtcatagtggacctcgtgccggagatcaccaaggccatctctgatctcatcgccaccccccagaccgacatcgaaatcgaagacttaagcagcaaggtgatgaaagatgccacgtcaacaccaaatttcacgcacagggagatctcattcctgctgaggctgatgcctgagctcgtgcaatagcgcactccattctggctttggatgtaactgaatgacgaaaacgaagaggaaccctttgagggtagtaaattttacgtaggttcgtgcctttatgggatagggggagcccttggggtttatatttacattttgtagcgaggggagtggtttccaattgaaaccacctttaatgtactccccccgtttttatatacaaggccaccacacattgtgaggtaatgtttttaataacataatatgattatatgtcaccaaaggcatatccgtagattcatcatatctgaaagatgtttccactgatatgatttggtgttatataacttgtttagattgtggtttaagttttggcataaaatatttagcggccttatacataaaaatagagggagtataatggattaacaggataaaaaaggtaatgagttaactgaatacacaaagcaattacttcctacgtctcggtttgacaggctttgtctattattttggtcaaaataagaaag

SEQ ID NO: 11203 - DNA, 1912 bp, Cenchrus ciliaris
ccccggctagtgcgccagcacagtcttgtcagtctagcctgctgctactgctgcccgctgctgctggctgacgccggcggggctgccactgccactgcccactgctgagcggggagcgacgagatcgagatggacgcccggtgggcggtgctgctgctcgcgctgctggtggcgagcgccggcgcaggcggcgcgggcgccgcgggggtgaagggcgcgagctgggtcggcgggctgagccgcgcgtcgttccccaaagggttcgtgttcgggacggcgacgtcggcgtaccaggtcgagggcgccgcgtccaccaacggccggggaccctccatctgggacgcattcgcgcacatcccaggaaaagttgcgggaaatcaaaatggagatgtcgcagtggatcaataccaccgctacaaggaagatgttgatctcatgaaaagtttgaattttgatgcctaccggttttcaatctcatggtccaggatcttcccagacggtgagggcagagtcaacccagaaggtgtagcgtattacaacaatttgataaactacctgcttcagaaaggcatgactccttacatcaacctttaccattacgatcttcctcttgccctcgagcagaaatatggaggatggttaagctcaaagatggcggacctcttcacagagtatgctgacttctgctttaagacctatggcgatcgtgtaaagcactggtttacattcaatgagcctaggatagtagcaatgcttggttatgacgcaggatcaaatcctcctcaaaggtgcaccaaatgcgctgccggtgggaattcagcaactgaaccttatattgttgcgcacaattttctcttggcacatgctgctgcagctgcaagataccgtacaaagtaccaggctgctcagaagggtaagattggaatagtcctggacttcaactggtatgaagctcttacaaactcacctgacgaccaagcagcggctcaaagagctagggacttccatattggctggtttgttgatcctttgataaatggacattacccacagataatgcaagaccttgtgaaagagaggctgcccaggttcactcccgagcaagctaaattggtcaagggatcagcagactatattgggatcaatcaatacacagccagctacatgcagggccagaaattgctccagcagacgcctactagctactcagctgattggcaagttcaatatgtttttgcacgaaatggcaagccaattggaccacaggcaaattctaattggctttacatcgttccttggggaatgtacggttgtgtgaactacctcaagcagaagtacggaaacccaacagtctacataaccgagaatggaatggatcaacctggaaacctgacccgcgaccagtacctgcgcgacgtgacaagggtgcggttctacaaaagctacctcggccagctgaaaaaggccatagatcagggcgcaaacgtggctggctacttcgcctggtctcttcttgacaacttcgagtggctatcaggatactcctccaagtttggcatcgtctacgtcgacttcaacaagaacctcgaacggcacccaaaggcttcggcctactggttcagggacatgcttaagcattgagatttctgaaggccgaggccgaagttaacattttgctcagctttgcctagtgttttggatggcccaatggttcaaatccagctcggtgctaggctgtcaaaatgggaataaaagaagatgaacagccactccaattgattgtgcattccattccgtgtaatggtcagatatgttgcgacttgtgagtatgttttctgtggagtttgagctgtggttatttatcgtgtggattgaacatatttaaaatgcgaacagtcggaatccatgagcc

SEQ ID NO: 11204 - DNA, 1879 bp, Pennisetum glaucum
ggtgggcaacaaataggacgcacagtcctgtcagcctagcctgctgctagcctgctactgccgcccactgctgctgacgccggcggggctgccactgcccactgctgtgctgtagcggggagcgacgagatggacgcccggtgggcggtgctgctcgcgctgctggtggcgagcgccggcgccgcgggggcgaagggcgccaacggggtcggcgggctgagccgcgcgtcgttccccaaggggttcgtgttcgggacggcgacgtcggcgtaccaggtcgagggcgccgcgtccaccaacggccggggaccctccatctgggacgcattcgcgcacatcccaggaaaaattgccggaaatcaaaatggagacgttgcagttgatcagtaccatcgctacaaggaagatgttgatctcatgaaaagtttgaatttcgatgcctaccggttttcaatctcatggtccaggatcttcccagatggtgagggcagagtcaacccagaaggtgtagcctattacaacaatttgataaactacctgcttcagaaaggcatgactccttacatcaacctttaccactacgatcttcctcttgcccttgaacagaaatatggaggatggttaagctcaaaaatggtggacctgttcacagagtatgctgacttctgttttaagacctatggtgatcgtgtaaagcactggtttacatttaatgagccaaggatagttgcactgcttggttatgacgcaggttcaaatcctcctcaaaggtgcaccaaatgtgctgccggtgggaattcagcaactgaaccttatattgttgcgcataattttctcttggcacatgctgctgcagctgcaagataccgtacaaagtaccaggctgctcagaaaggtaagattggaatagtcctggacttcaactggtacgaagctcttacaaactcacctgacgaccaagcagcagctcaaagagctagggacttccatattggctggtttgttgatccattgataaatggacattacccacagataatgcaagatcttgtgaaagagaggctgcccaagttcactcctgagcaagctaaattggtcaagggctcagcagactatattgggatcaatcaatacacagccagctacatgcagggccagaaattgctccagcagacgcctactagctactcagctgattggcaagttcaatatgtttttgcacgaaatggcaagccaattggaccacaggcaaattctaattggctttacatcgttccttggggaatgtacggttgtgtgaactacctcaagcagaagtacggaaacccaacagtctacataaccgagaatggaatggatcaacctggaaacctgacccgcgaccagtacctgcgcgacgtgacaagggtgcggttctacaaaagctacctcggccagctgaaaaaggccatagatcagggcgcaaacgtggctggctacttcgcctggtctcttcttgacaacttcgagtggctatcaggatactcctccaagtttggcatcgtctacgtcgacttcaacaagaacctcgaacgacacccaaaggcttcggcctactggttcagggacatgcttaagcattgagatttctgaaggccgagcccgaagttagcattttgctcagctttgcctagtgttttggatggcccaatggttcaaatccagctcggtgctaggctgtcaaaatgggaataaaagaagatgaacagccactccaattgattgtgcattccattccgtgtaatggtcagatatgttgcgacttgtgagtatgttttctgtggagtttgagctgtggttatttatcgtgtggattgaacatatttaaaatgcgaacagt

SEQ ID NO: 11205 - DNA, 1896 bp, Echinochloa colona
cagctagtgcgccagcacaatctagcgtgctgctgctactgctactgctgacgccggtggtgcgcgagcgggttgagagctgccactgctctccggccgcggccgcgcgcgcgagatggacgcgcggtgggcggcggtgctgctggcgctgctggtggcgagcggcggcggcgtgcgcgccgcgggggtgaagggcgcgaactggctgggcgggctgagccgcgcgtcgttccccaaggggttcgtgttcgggacggcgacgtcggcgtaccaggtcgagggcgccgcgtccaccaacggccggggaccctccatctgggacgcattcgcgcacaccccagggaaaatcgcgggaaatcaaaatggagatgttgcagtggatcaataccatcgctacaagcaagatgttgatctcatgaaaagtctgaatttcgacgcctaccggttttcaatctcatggtccaggatcttcccagatggcgagggaaaagtcaatccagaaggtgtagcatattacaacaatttgataaactacctgcttcagaaaggcatgactccttacatcaacctttaccactacgatcttcctcttgcgcttgagaagaaatatggagggtggttaagcgcaaagatggcggacctgtttacagaatatgctgacttctgttttaagacctatggcgatcgtgtaaagcactggtttacattcaatgagccaaggattgtagcactgcttggttatgattcagggtcaaatcctccacaaaggtgcacccagtgtgctgccggtgggaattcagcaacggaaccttatattgttgcccataattttctcttggcacatgctgctgcagttgcaagataccgtgcaaagtatcaggctgcccagaagggtaaggttggaatagtcctggacttcaactggtatgaacctcttacaaattcacctgacgaccaagcagcggctcaaagagctagggacttccatattggctggtttgttgatccattgataaatggacattatccacagataatgcaagatcttgtgaaagagaggttgcccaggttcactcctgagcaagctagattggtcaagggctcagcagactatattgggatcaaccaatacacggccagctacatgaagggccagaaattgctccagcagactcctactagctactcagctgattggcaagttcaatatgtttatgcacgaaatggcaaaccgattggaccacaggcgaattctaattggctttacatcgtcccgtggggaatgtatggatgtgtgaactacctcaaggagaagtatggaaatcccgttgtctacattaccgagaatggaatggatcaacctggaaacctgacccgcgatgagtacttgcgcgacgtgacaagggtgcggttctacagaagctacattggccagctgaaaaaagccatagatcagggcgccaacgtggctggctacttcgcgtggtctctccttgacaacttcgagtggctgtcagggtacacgtcaaagtttggcatcgtctacgtcgacttcaacacgctcgaacggcacccgaaggcttcggcctactggttcagggacatgcttaagcattgagatttctagaggccaagccagaagttaccattttgctcagctttgcctggtgttttggatggcccaatggttcagatccagctcggtgctaggctatcaaaatgggaataaaagaagatgaacagccactccaattgattgtgcattccgtatttccgtgttatggtcagaacattgtggcttgtgagcatgttttccgtggagtttgagctgtgcgtatttattgagcatatttgaaacgcttaatcaggagcgatatcttgagtgttcgtctcatc

SEQ ID NO: 11206 - DNA, 2526 bp, Sorghum bicolor
cgcggccccacacgggcacgctcatcaatcaccggcaccggtcgtgtgctcgtgccggcggcggcccccacgcccgccgcacaaaggatacttagtaccgtacaaaggatactaccggcaccggtcgagactcgagcggccggggcgcgcaccggcaccgcccgggggtccccatcacacaaaagatgcctcgatccaccgctaccgcaccgacacgcgaccctactcattgatgacgcgacgtgagcaccaataaataggggcacgccagctagttcgccggcacagtcagtctagcgctgaaggcctgaagcgcctctgctactgtgctgcgctgacgcggtgacgccggtggggtgtgtgtgtgagcgaactgcgagctgccactgccgcggtcgacagccgggccgccggcagccgtgcgtgcgcgcggagccgagatggacgctcggtgggcggtgctgctcgcgctgctggtcgccagcggcggcggcggcggtgtccgtgtctgcgccgcgggggcgaagggcgccaactggctggccgggctgagccgcgcgtcgttccccaaggggttcgtgttcgggacggcgacgtcggcgtaccaggtcgagggcgccgcgtccaccaacggccggggaccctccatctgggattcattcgcgcacgtcccaggaaatattgcggggaatcaaaatggagacgttgcagtggatcaataccatcgctacaaggaagatgttgatctcatgaagagtttgaattttgatgcctaccggttttcaatctcgtggtccaggatcttcccagatggcgaggggaaagtcaatccagaaggtgtagcatattacaataatctgataaactatctgcttcagaaaggcatgactccttacatcaacctttaccactatgatcttcctcttgcgcttgagaagaaatatggagggtggttaagcgctaagatggcggacctgtttacagactatgctgacttctgttttaagacctacggtgatcgcgtaaagcactggtttacattcaatgagccaaggatagcagcgctacttggctatgacgtgggatcaaatcctcctcaaaggtgcaccaaatgtgctgctggtgggaattcagcaaccgaaccttatattgttgctcataattttctcttggcacatgctgctgcagttgcaagataccgtacaaaatatcaggctgcccagaagggtaaggttggaattgtcctggacttcaactggtatgaagctcttacaaactcacctgatgaccaagcagcagcccaaagagctagggacttccacattggctggtttgttgatccattgataaatggacattatccacaaataatgcaagatcttgtgaaagagaggctacccaggttcactcctgagcaagctaaattggtcaagggctcggcagactacattggtatcaatgaatacacatccagctacatgaagggacagaaactgctccagcagacgcccagtagctactctgccgattggcaggtccaatatgtttttgcacgcaatggcaaaccaattggaccaaaggcgaattctaattggctttacatcgtcccgacggggatgtatggatgtgtgaactacctcaaggagaagtatgggaatccaactgtctacattaccgagaatggaatggatcagcctggaaacttgacccgtgaccagtacctgcgcgatgccacaagggtgcggttctacagaagctacattggccagctgaaaaaagccatagatcagggcgcaaacgtggctggctacttcgcctggtctctccttgacaacttcgagtggctgtcaggatactcgtccaagtttggcatcgtctacgttgacttcaatacgctcgaacggcaccccaaggcgtcggcctactggttcagggacatgcttcagaagcattgagatctctagggccatcgagcctgaaggtagtactattttgttcagctttgcctcgtgttttggattgcccaatggttcaaatccagccttgtgcttggctagcaaaatgggagtaaaagagagccactccgatgaattgtgcattccgagttatggtcagaatgttgtgagtttgtgagtatgttctctgtggcgtttgagatgtggttattttatcgtgttgattgatcttatttgaaatgcttagtcaggaacgtgacatctcgagggttttttaaccaaatatatcacttctaagaactacactgagccttggtaattggatcaaatctgatcgtcgaggcattgccatcagtatttttttttaaaggtggcaaaaagcttttgcggaatttttttagacgagtaagaaaaaaagactaaaaaatacaaaagcccacaagcttcactccgcaaaccccaccaaacactaccaaaactaccataagataactccaccttactattcactaaacagactgaaaaaaaaggaaaaaaagggaagagagagaaaagaaaaaattacatagtg

SEQ ID NO: 11207 - DNA, 1891 bp, Saccharum officinarum
caccagtgaaggcctgctgcgcctctgctactgtgctgtgctggctgacgcggtgacgccggtggggtgtgtgtgagcgaactgcgagctgccactgccgcggtcgaccgccggcggccgcgcgcgcgcggagcgagatggacgctcggtgggcggtgctgctcgcgctgctggtcgccagcggcggtgtccgtgtctacgccgctggggcgaagggcgccaactggctgggcgggctgagccgcgcgtcgttccccaaggggttcgtgttcgggacggcgacgtcggcgtaccaggtcgagggcgccgcgtccaccaacggccggggcccctccatctgggattcattcgcgcacgtcccaggaaatattgcgggtaatcaaaatggagacattgcagtggatcaataccatcgctacaaggaagatgttgatctcatgaaaagtttgaattttgatgcctaccggttttcaatctcatggtccaggatcttcccagatggcgaggggagagtcaatccagaaggtgtagcatattacaacaatttgataaactatctgcttcagaaaggcatgacgccttacatcaacctttaccactacgatcttcctcttgcgcttgagaagaaatatggagggtggttaagcgctaagatggcggacctgtttacagactatgctgacttctgttttaagacctacggcgatcgcgtaaagcactggtttacattcaatgagccaaggatagtagcgctacttggctatgacgtgggatcaaatcctcctcaaaggtgcaccaaatgtgctgctggtgggaattcagcaaccgaaccttatattgttgctcataattttctcttggcacatgctgctgcagttgcaagataccgtacaaaatatcaggctgcccagaagggtaaggttggaatagtcctggacttcaactggtatgaagctcttacaaactcacctgatgaccaagcagcagcccaaagagctagggacttccacattggctggtttgttgatccattgataaatggacattatccacagataatgcaagatcttgtgaaagagaggctgcccaggttcactcctgagcaagctaaattggtcaagggctcagcagactacattggtatcaatgaatacacagccagctacatcaagggagggaaattggtccagcagacgcctagtagctactctgctgattggcaggttcaatatgtttttgcacgcaatggcaaaccaattggaccacaggcaaattctaattggctgtacatcgtcccgacggggatgtacggatgtgtgaactacctcaaggagaagtatgggaatccaactgtctacataaccgagaatggaatggatcagcctggaaatttgacccgtgatcagtacctgcgcgataccacaagggtgcggttctacagaagctacatcggccagttgaaaaaagccatagatcagggcgcaaacgtggctggctacttcgcctggtctctccttgacaacttcgagtggctgtcaggatactcgtccaagtttggcatcgtctacgttgacttcaacacgctcgaacggcacccgaaggcgtcggcctactggttcagggacatgctccagaagcattgagatctctagggcagagcctgatggtagtactattttgttcagctttgcctagtgttttggatggcctaatggttcaaatccggccttgtgcttggctagcaaaatgggaataaaagagagccactccgatcaattgtgcattcagagttatggtcagaatgttgtgagtttgtgattatgttctctgtggaatttgagctgtggttatttatcgtgttgattgatcatgcatatttgaaatgcttaat

SEQ ID NO: 11208 - DNA, 1927 bp, Zea mays
agcccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccaacggccggggcccctccatctgggattcattcgcgcacgtcccaggaaatattgcagggaatcaaaatggagacgttgcagtggatcaataccatcgctacaaggaagacgtcgatctcatgaaaagtttgaactttgatgcctaccggttctcaatctcatggtccaggatcttcccggatggcgaagggaaagtcaatccagaaggtgtagcgtattacaataatttgataaactatctgcttcagcaaggcatgactccttacatcaacctttaccactatgatcttcctcttgcgcttgagaagaaatatggagggtggttaagcgcgaagatggcggacttgtttacagactatgctgacttctgttttaagacctacggcgatcgcgtaaagcactggtttacattcaatgagccaaggatagtagcgctacttggctatgacacagggtcaaatcctcctcaaaggtgcaccagatgcgctgctggtgggaattcagcaaccgaaccttacatagttgctcataattttctcttggcacatgctactgcagttgcaagataccgtacgaaatatcaggctgctcagaagggtaaggtcggaatagtcctggacttcaactggtacgaggctcttacaaactcacctgatgaccaagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacatccagctacatgaaggggcagaagctggtccagctggcgcccagtagctactctgccgattggcaggttcaatatgtttttgcacgcaatggcaaaccgattggaccacaggcgaattctaagtggctctacatcgccccgacggggatgtacgggtgcgtgaactacctcaaggagaagtatgggaatccaacgatctacataacggagaacggaatggaccagcctggaaacttgacccgagaccagtacctgcgcgacgccacgagggtgcggttctacaggagctacatcggccagctgaagaaggccatagaccagggagcgaacgtggctggctacttcgcctggtctctcctcgacaacttcgagtggctggcagggtactcgtccaagttcggcatcgtctacgtggacttcaacacgctcgaacgccacccgaaggcgtcggcctactggttcagggacatgcttcagaagcattgagatctccagagccgagcctgagcacggaaggtaccattttgttcagcttcgcctagtgtttgggatggcccaatggttcaaatccggctcagtgcctggctaccaaaatgggaacaaaggacagctaccccgatcaattgtgatgttgtgtgtttgtgggtatgttctctctggagtttgagctgtggttattttatcgtgttggttgatcgtgtttgaaatgcttaattcaggactgtgacatctcgagttgttttaactaaatcttataagaacta

SEQ ID NO: 11209 - DNA, 1897 bp, Oryza sativa
gtggctgcgtgtgcttgcgctactgcttggtctcactgtgtgaacaactgctgccgccgcctgccggcggtgtgctccggccgcgcgcggtcgtgatggctgcacggcgagcgaactgcgcgctggtgctggtgctggcgctcgcgctgttggcggcgcgggatgctggtgccgcggcggtgcccaagcccaactggctgggcgggctgagccgcgccgcgttccccaagcggttcgtgttcgggacggccacgtccgcgtaccaggtcgagggcatggcggcgtccggcggccgcgggccgtccatctgggacgccttcgcgcacaccccgggaaatgttgcaggaaatcagaatggagatgttgcgacagatcaatatcatcgctataaggaagatgttaatctcatgaaaagtttgaattttgatgcctaccggttttcaatctcatggtccaggatcttcccagatggtgagggacgagttaaccaagaaggcgtagcatattacaacaatcttataaactaccttctgcagaaaggtatcactccttatgtcaatctttaccactacgatctccctcttgcgcttgagaagaagtacggaggctggttgaatgcaaaaatggcggatctattcacggagtacgcggacttctgtttcaagacctttggcaatcgtgtcaagcactggtttacatttaatgagccaaggatagtagcacttcttggttatgaccaaggaacaaatcctcctaaaaggtgcacaaaatgcgctgctggtgggaactcagcaacagaaccatacattgttgctcataattttctcttatcacatgctgcagctgttgcaagataccggactaagtatcaggcagctcagcaaggcaaagttggaatagttctggacttcaattggtatgaagctctttccaactcaactgaagaccaagcagcggctcaaagagccagggacttccacattggttggtatcttgatccattgataaatggacattacccgcagataatgcaagatcttgtgaaagataggctgcccaagttcactcctgaacaagctagattggtcaagggctcggctgactatattggcatcaaccaatacacagctagctacatgaagggccagcaattgatgcagcagacaccgacgagttactcagccgattggcaggttacctatgtttttgcgaaaaacggcaaaccaattggaccacaggcaaattctaattggctttacatcgtgccatgggggatgtacggatgtgtgaactacatcaagcagaagtacgggaatccgacagtcgtcataactgaaaacggaatggatcaacctgcgaacctcagccgcgaccagtacttgcgcgacaccacgagggttcatttctacaggagctacctcacccagctgaagaaggccatcgacgagggcgccaatgtggctggctacttcgcctggtctctcctggacaacttcgagtggctgtcaggttacacgtccaagtttggtatcgtctacgtcgacttcaacacgctcgagcgccaccccaaggcgtcggcctactggttcagggacatgctaaagcactgagaatgaaagacacgcagactgaagttgaagttgccatccattgatcatcatgttcagttctaggctgccgcttggatggcatcagagctggctatgaactatgtgatggaaataaaaggactgcaaattgattcgattatgcaattcgtgtctatgatcagaattgtggccgtctagtgaacttgtagaagtgtactcttgatgtgtgatcgatcttgagtaatcaatgtttgatcagatttcgccttataatttattagttgatgagatttggcttggtgatttta

SEQ ID NO: 11210 - DNA, 1906 bp, Oryza sativa
gcgtggctgcgtgtgcttgcgctactgcttggtctcactgtgtgaacaactgctgccgccgcctgccggcggtgtgctccggccgcgcgcggtcgtgatggctgcacggcgagcgaactgcgcgctggtgctggtgctggcgctcgcgctgttggcggcgcgggatgctggtgccgcggcggtgcccaagcccaactggctgggcgggctgagccgcgccgcgttccccaaccggttcgtgttcgggacggccacgtccgcgtaccaggtcgagggcatggcggcgtccggcggccgcgggccgtccatctgggacgccttcgcgcacaccccgggaaatgttgcaggaaatcagaatggagatgttgcgacagatcaatatcatcgctataaggaagatgttaatctcatgaaaagtttgaattttgatgcctaccggttttcaatctcatggtccaggatcttcccagatggtgagggacgagttaaccaagaaggcgtagcatattacaacaatcttataaactaccttctgcagaaaggtatcactccttatgtcaatctttaccactacgatctccctcttgcgcttgagaagaagtacggaggctggttgaatgcaaaaatggcggatctattcacggagtacgcggacttctgtttcaagacctttggcaatcgtgtcaagcactggtttacatttaatgagccaaggatagtagcacttcttggttatgaccaaggaacaaatcctcctaaaaggtgcacaaaatgcgctgctggtgggaactcagcaacagaaccatacattgttgctcataattttctcttatcacatgctgcagctgttgcaagataccggactaagtatcaggcagctcagcaaggcaaagttggaatagttctggacttcaattggtatgaagctctttccaactcaactgaagaccaagcagcggctcaaagagccagggacttccacattggttggtatcttgatccattgataaatggacattacccgcagataatgcaagatcttgtgaaagataggctgcccaagttcactcctgaacaagctagattggtcaagggctcggctgactatattggcatcaaccaatacacagctagctacatgaagggccagcaattgatgcagcagacaccgacgagttactcagccgattggcaggttacctatgtttttgcgaaaaacggcaaaccaattggaccacaggcaaattctaattggctttacatcgtgccatgggggatgtacggatgtgtgaactacatcaagcagaagtacgggaatccgacagtcgtcataactgaaaacggaatggatcaacctgcgaacctcagccgcgaccagtacttgcgcgacaccacgagggttcatttctacaggagctacctcacccagctgaagaaggccatcgacgagggcgccaatgtggctggctacttcgcctggtctctcctggacaacttcgagtggctgtcaggttacacgtccaagtttggtatcgtctacgtcgacttcaacacgctcgagcgccaccccaaggcgtcggcctactggttcagggacatgctaaagcactgagaatgaaagacacgcagactgaagttgaagttgccatccattgatcatcatgttcagttctaggctgccgcttggatggcatcagagctggctatgaactatgtgatggaaataaaaggactgcaaattgattcgattatgcaattcgtgtctatgatcagaattgtggccgtctagtgaacttgtagaagtgtactcttgatgtgtgatcgatcttgagtaatcaatgtttgatcagatttcgccttataatttattagttgatgagatttggcttggtgattttataggaaa

SEQ ID NO: 11211 - DNA, 1779 bp, Triticum aestivum
cagagggtgggtgtgaacagtgagcaagagtgtgccaccgcgtcgtgcgagcgcgcgagcggggtttgtcggtcggccgcgagatggccgcgaggtccgcggtgctgctgctgctcgcgctggtggcggcggcgtgccatggcgtgggagccgcgggcgcgggggcgtcgccgcgccggcccaactggctgggcgggctgagcagggcgtccttccccaagggcttcgtcttcgggacggccacgtcggcgtaccaggtggagggcatggccgccggcggcggccgcgggccttccatctgggacgcgttcgcccacgtcccaggaaatattgcgggcaatcaaaatgcagatgttactacggatcaatatcatcgctacaaggaagatgttaatctcatgaaaggattgaatttcgacgcctatcggttttctatctcatggtccagaatcttcccagatggtgacggaaaagttaacaaagaaggcgtcgcgtattacaataatctgataaactaccttcttcagaaaggcattactccttatatcaatctttaccactatgatctccctcttgcactcgagaagaagtatggaggctggttaaatgcaaagacggtgggactatttgcagactatgctgacttttgttttaagacctttggcgatcgtgtaaagcactggtttacattcaacgaaccaaggatagttgcgcttcttggttacgatgtagggtcgaatcctcctcagagatgcagcaaatgcgctgccggtggcaactcagcaacagaaccttacatcgttgctcacaattttctcttagctcatggttatgcagttgcaagataccggactaagtatcaggcagctcagaaggggaaggttggaatagttctggacttcaactggtatgaggctcttaccaactcaactgaagaccaagcagcagcccaaagagccagggacttccatgttggctggtttgtcgacccgctaataaacgggcattacccacagataatgcaagaccttgtgaaagagaggttgcccaggttcactcccgatgaagctaaattggtcaagggctcagcagactacattgggatcaaccagtacacggccagcctcatgaaggggcagaagttgacgcagcagacgccgaccagctactcagccgattggcaggttacctatgcctttgagagaaatggcaaaccgattggaccaaaggcgaattctaactggctttacatcgtcccgtcggggatgtacggatgcgtgcactacctcagccagaagtatggaaacccagctattgtcataaccgaaaacggaatggatcagccggggggcctcacccgcgaccagtacttgcgggacgcgacgagggtccggttctaccggagctacctcagcgagctgaagaaggccatcgacggcggcgccaacgtcctcggctacttcgcgtggtctctcctcgacaacttcgagtggatctccggctactcatccaagtttggcatcgtgtacgtcgacttcaacagccccaccctggatcggcaccccaaggcgtcggcctactggttcagagacctgctgcagcactgatatatatggagtgcttctgaattacccaaccatcctgatgttgtcatcatcttgctgagtttatgcctactgttgttcgaatggaaccatatgcctactgttgttcgaatggaaccataattcagacttcagagcatgctttgctctaccaaatgagaataaaagttggcat

SEQ ID NO: 11212 - DNA, 1770 bp, Secale cereale
ctaccagtcgcaggccagtgggtggtgggcgtgaacagtgaccaagcaagagtgccactgcttcgtgcgagcagcgccgagcggggtccgtcggtcggtcggcggcgagatggccgcgaggtcggcgctgctgctgctgctcctcgcgctggtggtggcggcgtgccatggcgtgagcgccgcgggcgcgggggcgtcgccgcgccgggccaactggctgggcgggctgagccgggcgtccttccccaagggcttcgtcttcgggacggccacgtcggcgtaccaggtggagggcatggccaacgccggcggccgcgggccttccatctgggacgccttcgcccacgtcccaggaaacatcgcgggcaatcaaaatgcagacgttactacggatcagtatcatcgctacaaggaagatgttaacctgatgaaaggattaaatttcgatgcctaccggttttctatctcatggtccagaatcttcccagacggtgatggaaaagttaaccaagaaggcgtcgcgtattacaataatctgataaactaccttcttcagaaaggcattactccttatatcaacctttaccactacgatctccctcttgcgcttgagaagaagtatggaggctggctaaatgcaaagacagtgggactatttgcagactacgctgacttttgttttaagacctttggcgatcgtgtgaagcactggtttacgttcaacgaaccaaggatagttgcgcttcttggttacgatgtagggtcgaatcctcctcagaggtgcagcaaatgcgctgccggtggcaactcagcaacagaaccttacatcgttgctcacaattttctcttagcacatggttatgcagttgcaagataccggactaagtatcaggcagctcagaaggggaaggttgggatagttctggacttcaactggtacgaggctcttaccaactcaactgatgaccaagcagcagctcaaagagccagggacttccatgttggctggtttgtcgaccccctaataaacgggcattacccacagataatgcaagaccttgtcaaagagaggctgcccaggttcactcccagtgaagctaaactggtcaagggctcagcagactacattgggatcaaccagtacacggccagcctgatgaagggccagaaattgctgcagcagacgccgaccagctactcggccgattggcaggttacctatgcctttgagagaaatggcaaaccgattggaccaaaggcgaattctaactggctttacatcgtcccgtcggggatgtacggatgcgtgcactacctcagccagaagtatgggaatccacctattgtcataaccgaaaacggaatggatcagccgggggggctcacccgcgaccagtacttgcgggacgcgacgagggtccggttctaccggagctacctcggcgagctgaagaaggccatcgacggcggcgccaacgttctcggctacttcgcgtggtctctcctcgacaacttcgagtggatctccggctactcgtccaagttcggcatcgtctacgtcgacttcaacagccccaccctggaccggcaccccaaggcgtcggcctactggttccgagacctgctgcaacactgatgttgtcatcatcatcaccacgatcattctgagtttgtgcctactgttgttcgaatggaaccataattcagactgctaccaaatgagaataaaaagttggcatgatagttcagtgttgacaaaaaaaaaactga

SEQ ID NO: 11213 - DNA, 1781 bp, Hordeum vulgare
gccacaaaagatgccctccgcccccgccccaccgcgccggcaattatttctcggacgccgcaattattaggccgcgcccacgaccgctgccactacttcttgaagagcgcgccgctgctctggcactggcaccggcactagccagcgagtagcgagcgagccgccactagtaccagtcgcaggccagcggggtgggtgggcgtgagcagcggacaagagcgcgcgagcggggctaggttggtcggtcggtcggcggcgagatggccgcgaggtcggcgctgctgctcgcgctggtggcggcggcggcggcggcgtgccatggcgtgggagccgcgggcgccaactggctgggcgggctgagccgggcgtccttccccaagggcttcgtcttcgggacggcgacgtcggcgtaccaggtcgagggcatggccaccggcggcggccgcgggccctccatctgggacgcgttcgcccacgtcccaggaaacattgcgggcaaccaaaatgcggacgttactacggatcaataccatcgatacaaggaagatgttaacctcatgaaaggattgaatttcgatgcctaccggttttctatctcatggtccagaatcttcccagatggtgacggaaaagttaaccaagaaggtgtcgcgtattacaataatctgataaactaccttcttcagaaaggcattactccttacatcaatctttaccactacgatctccctcttgcacttgagaagaagtatggaggctggttaaatgcaaagacggtgggactatttgcagactatgctgacttttgttttaagacctttggcgatcgtgtaaagcactggtttacattcaatgaaccaaggatagttgcgcttcttggttacgacgtagggtcgaatcctcctcaaaggtgcagcaaatgcactgccggtgggaactcagcaacagaaccttacattgttgctcacaattttctcttagcacacggttatgcagttgcaagataccggaccaagtatcaggcagctcagaaggggaaggttggtatagttctggatttcaactggtacgaggctcttaccaactcaactgaagaccaagcagcagctcaaagagccagggacttccatgttggctggtttgtcgacccgctgataaacgggcattacccacagataatgcaagaccttgtgaaagagaggttgcccaagttcactcctgctgaagctaaaatggtcatgggctccgcggactatattgggatcaatcagtacacagctagcctcatgaagggccagaaattgctgcagcagacgccgaccagctattcagccgattggcaggttacctatgcctttgagagaaatggcaagccgattggaccaaaggcgaattcgaactggctctacatcgtcccatcggggatgtatgggtgcgtgcactacctcagccagaagtacgggaacccgccgatcgtcataactgaaaacggaatggatcagccgggggggctcacgcgcgaccagtacctgcgggacacgacgagggtccggttctaccggagctacctcagcgagctgaagaaggccatcgacggtggcgccaacgttctcggctacttcgcgtggtctctcctcgacaactttgagtggatgtccggctactcgtccaagttcggcatcgtctacgtcgacttcaacagccccaacctggatcggcaccccaaggcgtcggcctactggttcagagaccttctgcgacactgaatatggatggagcac

SEQ ID NO: 11214 - DNA, 1951 bp, Hordeum vulgare
gccacaaaagatgccctccgcccccgccccaccgcgccggcaattatttctcggacgccgcaattattaggccgcgcccacgaccgctgccactacttcttgaagagcgcgccgctgctctggcactggcaccggcactagccagcgagtagcgagcgagccgccactagtaccagtcgcaggccagcggggtgggtgggcgtgagcagcggacaagagcgcgcgagcggggctaggttggtcggtcggtcggcggcgagatggccgcgaggtcggcgctgctgctcgcgctggtggcggcggcggcggcggcgtgccatggcgtgggagccgcgggcgccaactggctgggcgggctgagccgggcgtccttccccaagggcttcgtcttcgggacggcgacgtcggcgtaccaggtggagggcatggccaccggcggcggccgcgggccctccatctgggacgcgttcgcccacgtcccaggaaacattgcgggcaaccaaaatgcggacgttactacggatcaataccatcgatacaaggaagatgttaacctcatgaaaggattgaatttcgatgcctaccggttttctatctcatggtccagaatcttcccagatggtgacggaaaagttaaccaagaaggtgtcgcgtattacaataatctgataaactaccttcttcagaaaggcattactccttacatcaatctttaccactacgatctccctcttgcacttgagaagaagtatggaggctggttaaatgcaaagacggtgggactatttgcagactatgctgacttttgttttaagacctttggcgatcgtgtaaagcactggtttacattcaatgaaccaaggatagttgcgcttcttggttacgacgtagggtcgaatcctcctcaaaggtgcagcaaatgcactgccggtgggaactcagcaacagaaccttacattgttgctcacaattttctcttagcacacggttatgcagttgcaagataccggaccaagtatcaggcagctcagaaggggaaggttggtatagttctggatttcaactggtacgaggctcttaccaactcaactgaagaccaagcagcagctcaaagagccagggacttccatgttggctggtttgtcgacccgctgataaacgggcattacccacagataatgcaagaccttgtgaaagagaggttgcccaagttcactcctgctgaagctaaaatggtcatgggctccgcggactatattgggatcaatcagtacacagctagcctcatgaagggccagaaattgctgcagcagacgccgaccagctattcagccgattggcaggttacctatgcctttgagagaaatggcaagccgattggaccaaaggcgaattcgaactggctctacatcgtcccatcggggatgtatgggtgcgtgcactacctcagccagaagtacgggaacccgccgatcgtcataactgaaaacggaatggatcagccgggggggctcacgcgcgaccagtacctgcgggacacgacgagggtccggttctaccggagctacctcagcgagctgaagaaggccatcgacggtggcgccaacgttctcggctacttcgcgtggtctctcctcgacaactttgagtggatgtccggctactcgtccaagttcggcatcgtctacgtcgacttcaacagccccaacctggatcggcaccccaaggcgtcggcctactggttcagagaccttctgcgacactgaatatggatggagcacctctgaatcaaccaacctgatgctgtcatcatcatcatgatcatgatcttgctgagtttctgcctactgttgttcgaatggaaccatgattcagacttcagagataccaattggaattggaaataataaaaagatggcacgatgtttgagtcctgcattatttcatgttt

SEQ ID NO: 11215 - DNA, 2097 bp, Secale cereale
cccggccgtgcccgtccgtcagcctcgaccacgcgcgcgcaccgccagaaaagatgccctccgccaattattaggacgcgcccacaaatactgcttgaggagcgtaccgctgctctgccattactagcgagctaccagtcgcaggccagtgggtggtgggcgtgaacagtgaccaagcaagagtgtgccactgcttcgtgcgagcagcgccgagcggggtccgtcggtcggtcggcggcgagatggccacgaggtcggcgctgctgctgctgctgctgtcgctggtggtggcggcgtgccatggcgtgagcgccgcgggcgcgggggcgacgccgcgccgggccaactggctgggcgggctgagccgggcgtccttccccaagggcttcgtcttcgggacggccacgtcggcgtaccaggtggagggcatggccgccggcggcggccgcgggccttccatctgggacgccttcgcccacgtcccaggaaacatcgcgggcaatcaaaatgcagacgttactacggatcagtatcatcgctacaaggaagatgtcaatctcatgaaaggactaaatttcgacgcctaccggttttcgatctcatggtcgagaatcttcccagatggtgacggaaaagttaaccatgaaggcgtcgcgtattacaacaatctgataaactaccttcttcagaaaggcattactccttatatcaacctttaccactacgatctccctcttgcgcttgagaagaagtatggaggctggttaaatgcaaagacggtgggactatttgcagactacgctgacttttgctttaagacctttggcgatcgtgtaaagcactggtttacattcaacgaaccaaggatagttgcgcttcttggttacgacgtagggtcgaatcctcctcagagatgcagcaaatgcgctgccggtggcaactcagcaacagaaccttacatcgttgctcacaattttctcttggcacatggttatgcagttgcaagataccggactaagtatcaggcagctcagaaggggaaggttgggatagttctggacttcaactggtatgaggctcttaccaactcaactgaagaccaagcagcagctcaaagagccagggacttccatgttggctggtttgtcgacccgctaataaacgggcattacccacagataatgcaagaccttgtgaaagagaggctgcccaggttcactcccagtgaagctaaactggtcaagggctcagcagactacattgggatcaaccagtacacggctagcctcatgaaggggcagaaattgctgcagcagacgccgaccagctactcggccgattggcaggtcacctatgcctttgagagaaatggcaaaccgattggaccaaaggcgaattctaactggctttacatcgtcccgtcggggatgtacggatgcgtgcactacctcagccagaagtatgggaatccacctattgtcataaccgaaaacggaatggatcagccgggggggctcacccgggaccagtacttgcgggacgcgacgagggtccggttctaccggagctacctcggcgagctgaagaaggccatcgacggcggcgccaacgttctgggctacttcgcgtggtctctcctcgacaacttcgagtggatctccggctactcgtccaagttcggcatcgtctacgtcgacttcaacagccccaccctggaccggcaccccaaggcgtcggcctactggttccgagacctgctgcaacactgatgttgtcatcatcatcaccacgatcattctgagtttgtgcctactgttgttcgaatggaaccataattcagactgctaccaaatgagaataaaaagttggcatgatagttcagtgttgcatttcatgtgtccttggccaatcggcaaatttagccaggtgacaagcaccccaaattagggggtgcggcccatggcatcctagaggaaaaaacgagctcattcgcctctgtccgctgtctaagtttgtcttcctccgctgtggcctccctcgagcccaaggaaggatcacggcgaacatgcatgagcgaggcttggtggcggcgcgcgg

SEQ ID NO: 11216 - DNA, 2174 bp, Triticum aestivum
tccttccttctccaccgtgggacaccgtgacccacgcggcgttatcgccggcgcccggccgtgtcagccagccactggagcacccaccacgtccgtgccgccagcctcgaccacgcgcgcgcaccgccagaaaagatgccctccgccccgccccgccccaccgcgccggcaattattaggacgcacgcgcccacaaaactgcttgaagagcgtgccgctgccctggcattactactagcgagtagtagcgagctgccagtggccagtgggtgggcgtgaacagtgaccaagcaagagtgtggggtcggtcggtcggtcggcggcgagatggccgcgaggttggtggtggtgctgctgctgctcgcgctggtggcggcgtgccatggcgtgagtgctgcggccgcgggggcgtcgccgcgccggcccaactggctgggcgggctgagccgagcgtccttccccaagggcttcgtcttcgggacggccacgtcggcgtaccaggtggagggcatggccaacgccggcggccgcgggccttccatctgggacgccttcgcccacgtcccaggaaacattgccggaaatcaaaatgcagacgttactacggatcagtatcatcgctacaaggaagatgttaatctcatgaaaggattgaatttcgatgcctaccggttttctatctcatggtccagaatcttcccagatggtgacggaaaagttaaccaagaaggcgtcgcgtattacaataatctgataaactaccttcttcagaaaggcattactccttatatcaatctttaccactacgatctccctctggcgcttgagaagaagtatggaggctggttaaatgcaaagacggtgggactgtttgcagactacgctgatttttgttttaagacctttggcgatcgtgtaaagcactggtttacattcaacgaaccaaggatagttgcgcttcttggttacgacgtagggtcgaatcctcctcagaggtgcagcaaatgcgctgccggtgggaactcggcaacagaaccttacatcgttgctcacaattttctcttagcacatggttatgcagttgcaagataccggactaagtatcaggcagctcagaaggggaaggttggaatagttctggacttcaactggtacgaggctcttaccaactcaactgaagaccaagcagcagctcaaagagccagggacttccatgttggctggtttgtcgacccgctaataaacgggcattacccacagataatgcaagaccttgtgaaagagaggctgcccaggttcactcccagtgaagctaaattgctcaagggctcagcagactacatcgggatcaaccagtacacggctagcctcatgaagggccagaaattgctgcagcagacgccgaccagctactcggccgattggcaggtcacatatgcctttgagagaaatggcaaaccgattggaccaaaggcgaattctaactggctttacatcgtcccgtcggggatgtacggatgcgtgcactacctcagccagaagtatggaaacccacctattgtcataactgaaaacggaatggatgagccggggggcctcacccgggagcagtacttgcgggacgcgacgagggtccggttctaccggagctacctcggcgagctgaagaaggccatcgatggcggcgccaacgtcctcggctacttcgcgtggtctctcctcgacaacttcgagtggagctccggctactcctccaagttcggcatcgtgtacgtcgacttcagcagccccaccctggaccggcaccccaaggcgtcggcctactggttcagagaccttctgcagcactgatatgttgtcatcatcttcatcatcttgctgagtttctgcctactgttgttcgaatggaaccataattcagacttgagagcatgttttgctctgccaaatgagaataaaagttgcatgatattttgagcgttgcatttcatgtgttcttgggcgatcggcaaatttagccaggtgagaaaacaccccaaaattagggggtgcgacccatggcctagaggggggaaaacgagctcattcgccgctgtccgctgtctaagtttgccttcctccgctgtggcctccctcagcccaagggaaggatcacggcgaaacatgcatgagcg

SEQ ID NO: 11217 - DNA, 1828 bp, Brachypodium distachyon
gggcggcactgtgcgagcgcgtcttactagttggcaggaggcgagatggtagccgcggcgaggtcgacggcgaggtggctgctgctgcttgccctggtggccgcgtaccacggcggaggagcttccgtccgggctgccgcgggtgccggtgctcattggctgggcgggctgagccgggcgtcgttccccaagggcttcgtcttcggtacggccacgtcggcgtaccaggtcgagggcatggcggcctccggcggccgcgggccctccatctgggacgcattctcgcacatcccaggaaacgtcgtgggaaacacaaatgcagacgtcacaacggatcaataccatcgctacaaggaagatgttaatctcatgaaaggattgaatttcgatgcctaccggttttctatctcatggtccagaatctttccagatggtgaaggaaaagttaacgaagaaggtgtagcgtattacaataatctgataaactacttgcttcagaaaggcattactccttatatcaatctttaccacgctgatctacctcttgcacttgagaagaagtatggaggctggttgagtgcaaagacagtggaactattcgcagactatgctgacttctgttttaagacctttggcaatcgtgtaaagcactggtttacattgaatgaaccaaggatagcttgtcttcttggttacgatgtagggtccactcctcctcaaaggtgtaccaaatgtgctgctggtgggaactcagcaacagaaccttacattgttgcacataattttctcttagcacatggttatgcagttgcaagataccggaacaagtaccaggcagctcagcaagggaagattggaatcgtcctggacttcaattggtatgaagctctcacaaattcagctgaagacgaagcagcagctcaaagagccagggacttccatgttggttggtttgttgatccactaataaatggacactacccacagataatgcaagaccttgtgaaagagagattgcccaggttcacttctgatgaagttaaaatagtcaagggatcagcagactatattgggatcaatcaatacacagctagctacataaagggccagaaactggtgcagcaggcgccgactagctactcagccgattggcaggttacttatgcctctctgcgtaatggcaaacctattggaccaaaggcaaattctgattggctttacatagtcccgacagggatgtacggatgtgtgaactacctcagagtgaagtatggaaatccagcaatcgtcataaccgaaaacggaatggaccaacctgggaacctcacccgtgatgagtacttgcgcgatgtcacgagggttcggttctaccggagttacctggccgagctgaaaaaggccatcgacggtggcgctaacgtgcttgggtactttgcgtggtctctcctcgacaactttgagtggggatctggctacacatccaagtttggcatcgtgtatgtcgacttcaactcaaccaaactcgaacggcacccgaaggcatcggcctactggttcagagacatgctgaagggctaacactgaaggggtgcccgtgagttagcctaacgccattatcatcctattgagtttttacccactgttgtatgggtggcaccataattcagatggcacaataattcactctttcgtttcatatcgtgtatcgattatggccagaatggcatccctttgttgcatgaattttgagctgtggtcatgttgacttgttaagtgctcgatattgagtttgatcagacttttttttcgaaaaggaggatgaacggcc

SEQ ID NO: 11218 - DNA, 1861 bp, Brachypodium distachyon
aaatagcagcagcccagggtggctctggcacagcgtgaatgttttaccagttggcaggggagagatagagatggcgaggtcgacgacgacggcgaggtggctgctgctgcttgccctggtggccgcgtaccatggaggaggggcttccgtccgtgctgccgcgggcgcgggcgctggctctcattggctgggcgggctgagccgggcgtcgttccccaagggcttcgtcttcgggacggccacgtcagcgtaccaggtcgagggcatggccttctccggcggccgcgggccctccgtctgggacgcattcgcgcacaccccaggaaatattgtggggaatcaaaatgcagacgtcacaacagatcaatatcatcactacaaggaagatgttaatctcatgaaaggattaaattttgatgcctaccgattttctatctcatggtccagaatcttcccagatggcgaaggaaaagttaacgaagaaggtgtagcgtattacaacaatctgatagattacttgcttcagaaaggcattactccttatatcaatctttaccactatgatctccctcttgcacttgagaagaagtatggcggatggttaaatgcaaagacggtggaactattcgcagactatgctgacttctgttttaagacctttggcaatcgtgtaaagcactggtttactttcaatgaaccaaggatagttgtgcttggtggttatgatgtagggtccaatcctcctcaaaggtgcaccaaatgcgctgccggtgggaactcagcaacagaaccttacattgtggcacataattttatcttagcacatggttacgcagttgcaagataccggaataagtataaggcagctcagcaagggaaggttgggattgttctggacttcaattggtatgaagctctcaccaattcaactgatgacgaagcagcagctcaaagagccagggacttccatgttggttggtttgttgatccactaataaatggacactacccacagataatgcaagaccttgtgaaagagagattgcccaggttcactcctgatgaaactaaattggtcaatggatcagcagactatattgggatcaatcaatacacggctaactacatcaaggggcagaaactggtgccgcagaagccaactagctactcagccgattggcaggttacttatgcttctgaccgtaacggcataccaattggaccaaaggcaaattctaattggctttacatagtcccgacggggatgtacggatgtgtgaactacctcagggagaagtatggaaatccagcagtcgtcataaccgaaaacggtatggatcaacctgggaacctcacccgcgatgagtacctgcacgatatcaccaggatccggtactaccggagttacctcgccgagctgaaaagggccattgacggcggcgctaatgtgcttggctactttgcgtggtctctcctcgacaactttgaatggatatctggctacacatccaagttcggcatcgtctatgttgacttcaactcaaccaaactcgaacggcacccgaaggcttcggcctactggttcagagacatgctgaaggtctaaaactgatggagtgtcagtgagttagcctagcctaatgccatcatcatcctattgtgcttgtttgcccactgttgtttggctggcatcacaattcagagctagttctgccctgagagctacaaaaaatggaaataaaatatggctcaataattcagtcgttcggtacctatctatgatggccagaatggcatcccttttgttacatgaattctgagctgtggttgtcttgtcaagtgctcgatcagaagagtgtga

SEQ ID NO: 11219 - DNA, 1560 bp, Avena sativa
ctggctgggcgggctgagccgggcgtccttccccaagggcttcgtgttcgggacggcgacgtcggcgttccaggtcgagggcatggccaacggaggcggacgcgggccctccatctgggacgagttcgcgcacaccccagggaagattgcagggaatggaaatgcagacgtcacgacagaccagtatcatcactacaaggaagatgttaatctcatgaagggattaaatttcgatgcctatcgcttttctatctcatggtccagaatcttcccggacggtgaaggaaaagttaacgaagaaggtgtagcgtactacaacaatctgataaactacctgcttcagaaaggcattactccttatatcaatctttaccactacgatctccctcttgcacttgagaagaagtatggaggctggttaaacgcaaagacggtggaactattcacaaactatgctgatttctgctttaagacctttggcaatcgagtaaagcactggtttacattcaacgaaccacgtatagtttcgctccttggttatgatgcagggagcaatcctcctcaaaggtgcaccaaatgtgcagccggtgggaactcagcgacagaaccttacattgttggtcacaattttctcttagcgcatggttatgcagttgcaagataccgaagcaagtatcaggcagctcagcaagggaaggttggaatagttctggacttcaattggtatgaggctcttacaaactcaattgaagaccaagctgcagcacaaagagccagagacttccatattggttggtttgttgatccactaataaatggacattacccacaaataatgcaagaccttgtgaaagagaggttgcccaagttcactcctgatcaagctaaaatgatcaaaggctcagcagactatattgggatcaatcaatacaccgctagttatatgaagggacagaaattgctgcagcagacgcccactagctactccgctgattggcaggttacttatgcatatgcacgtaatgggaaaccaataggacctaaggcgaattctgattggctttacatggctccatttgggatgtacggatgtgtgaattacatcaagcagaagtatggtaatccagcagtcttcataactgaaaatggaatggatcaacctgggaacctcacccgtgatcagtacttgcgcgataccacgagggttcggttctaccggagctacctcaacgaactgaagaaaggcatcgacaatggcgcaaacgtggttggctactttgcatggtctctgctggacaactttgagtggagctctggctacacatccaagttcggcatcgtctatgtcgacttcaacagcccctccctagagcgtcatccgaaggcgtcggcctactggttcagagatctgctgcaggtcaagcactgatggagtgcctggcagttcacctaatggtatcaccattctgttgagtttgtccctaccattgttcggcaccgcaattcggaaccaactctgttatctagagctaccagaaggaaataaaagatggcatgatt

SEQ ID NO: 11220 - DNA, 2153 bp, Oryza sativa
caccgagcaagcagaggaggagtattatattcttcgcggggccgagccgattcaacgcgcagtgctcgctcgcgcgcgcgcgggagcgtctcggggttggacaccggccggcccagcttcctgtgaaggatataagctccctgcctcgttgttcaactgctcggcgtcgatcacgcagcgcgggagatcgcacaaagaaccgagaagagctcatctcatccaccatcactcgcgcagagagatcgatagccacagcgcacaagcaacgcgccgccaatcacatgcgcgcggcggtgcaggggcgggcacatgcgtggacgacgacgacgacgacaccgccgggcgcgatgagaggccgggcgctggtcctcgtggccgcgctgctgctgcagctgcttctcctcgccgctgccggtggcgcgggcgcggcggcgacggagaggaaggcgcacaactacgaggacgcgctgcggaagagcctgctctacttcgaggcgcagcggtcggggcggctcccgcacaaccagcgcgtcgcgtggcgcgaccactccggcctcaccgacggcctcgagcaaggggtggatttggtgggaggctactacgacgccggcgaccatgtcaagttcgggctgcccatggcgttcacggtgacgatgctgtcgtggagcatgatcgagtacggcgacgacgtcgaggccgccggcgagctcggccacgcgctcgaggccatcaagtggggcactgactacttcatcaaggcgcacaccaagcccaacgagctctgggctgaggtcggggacggcgacacggatcactactgctggcagcggccggaggacatgacgacgtcgaggcaggcttacaaggtggaccgggagcggccgggctccgacgtcgccggcgagacggcggcggcgatggccgccgcgtccatcgtcttccgcaagtccaacccgcactacgcgagcctcctcctgcaccacgcccagcagctgttcgagtttgccgacaagtacagagggaagtatgacagcagtatcgccgaggtgaagagctactacgcgtcggtgagcgggtacaaggacgagctcctttgggccgcattgtggctgcaccgggccaccggcaaggcccattacctcgactacgtcgtggacaacgccgactgcttcggtggcaccggctgggccatcaccgagttcagctgggacgtcaagtacgccggcgtccagatcctcgccgcaagactgctgctgagaggagagcacgaggagcggcacaggagcacgctggagcagtacagggcgaaggcggagcactacgtgtgcgggtgcctggggcggaacgcggacggcggcgcggacgcgaacgtggagcggagcccgggcgggatgctgtacgtgaggcagtggaacaacatgcagtacgtgaccaacgcggcgttcctcctcgcggcgtacgcggactacctgggcgacgacgcggacggcgccgtgtcgtgcgcgggcggcgagacggcgggcgcgggcgaggtggcggcgctcgcgagggcgcaggtggactacgtgctgggcaccaacccgagggggatcagctacctggtcgggtacggcgccaagtacccgaacagggtgcaccaccgcgccgcgtccatcgtgccgtacaagcacagcaaggagttcatcgggtgcacgcaggggttcgaccactggttcggtcgccggagctccaacccgaacgtcctcgtcggcgccatcgtcggtgggccggaccggcgggacaggttcagggacaaccgggagaactacatgcagacggaggcgtgcacgtacaacacggcgcccatggtcggcatgttcgccaagctgaacaggatggcccggcaggagagggagcaggaggaggtggcggctccggcgaggagtacggcggccgatgtgtaaatagattaggttatagagggggggctgtacaattttccccattcttttgttcatttttcttctccttctttggagatcttcttttcacacagattggaaaaattcattttgtatacaaaaagagaaagggacgggtggaggcattcgcatgcaaatgtaaattcgccaccggtacatacgaagaaaaagaattttatcatttggcttccc

SEQ ID NO: 11221 - DNA, 843 bp, Cenchrus ciliaris
cggatcctcatggtggggctcgacgccgccggtaaaaccaccattctctacaagctcaagctcggcgagatcgtcaccaccatccccaccatcggtttcaatgttgaaactgttgagtacaagaacattagcttcaccgtctgggatgtcgggggtcaggacaagatcagacctctctggaggcattacttccagaacacacagggtcttatcttcgttgtggacagcaatgaccgtgaccgtgttgttgaagccagagatgagctgcacaggatgctgaacgaggatgagctacgtgatgctgtgctgcttgttttcgccaacaagcaagatctgcccaacgctatgaatgctgctgagattactgacaagcttggattacactccctgcgtcagcgacactggtacatccagagcacttgtgccacaactggtgagggtctgtacgagggtctggactggctgtccagcaacattgctagcaaggcttgaggggcagggctttggatatcaactgcgaactgactaggagctccggatgtatgatggaaacttaggacagaatcgcttctgcaatctgttgcgtgtcttctgttggcacgatatattttttgtttggaatatgtaatgatgtcactgttaaatgtttgttctaccctactctactgttgaatgttctttggacctgttcattttgcacaagaattggagttccagtatcatgctacttcgaaaaagctattgtatacattcgtgattagtacaccgtctggttcaacaattattatcttgtcgctagagtgtagaggcgtgcttgaatgtaattcagaatcgttgaacgtc

SEQ ID NO: 11222 - DNA, 731 bp, Heritiera littoralis
tttacaaggctctttagccggcttttgccaagaaggagatgcgtattttgatggtgggtcttgatgctgctggtaaaaccactatcttgtacaagctcaagctcggcgaaatcgtcaccacaatcccaacgattggattcaatgttgagacagtggaatacaagaatatcagctttactgtttgggatgttggtggtcaggacaagatccgtcctttgtggaggcactatttccagaatactcagggtctcatttttgtggtggatagcaatgatagggaccgtgttgttgaggcaagggatgagttacacaggatgttgaatgaggatgaattgagagatgctgttttgcttgtatttgccaacaaacaagatcttcccaatgcaatgaatgctgctgaaataactgataagcttggtcttcattctctccgccagcgccactggtatattcagagtacttgtgcaacttccggagaaggcctttatgaggggcttgattggctttccaacaacatcgctagcaaggcatgagagaggatcaatgcttttgttgttagttagacttgttcgagttctggcaactctggagaggacagcttccaccttatccaggaacttttgtaatgacagaatgtttactagataataggtacaatatgcgcttgtttaacctctgctgctttagcaaatactttagttgtacacaaacgcttcattactccagctttt

SEQ ID NO: 11223 - DNA, 1014 bp, Conyza canadensis
ggaccagatctgcaattaacttgagagcaaatattcgaaatagaaaagaaattagacggtgcataaacgtccgtcagtcaccgggatctcaaatctcataaatacaatcaacgctctccctgcatcacacacactcccgatatataaatatctgacgcgctctttctctcgtttgctaactgatttggtcggtggtcgataggtttcttcatttacaaccgatctccgtcgctctcttcaaccgtcaaccgatcgtattaagatgggtttgtcgtttaccaagctttttagccgtttgtttgctaagagagacgcgctctttctttttaccaacagatttggtcggtggtcgataggtttttcatttacaaccgatctctcttcaaccgtcaaccgatcgtattaagatgggtttgtcgtttaccaagctttttagccgtttgttttgctaagagagagatgcgtattttgatggttggtctcgatgcagctggtaaaacaacaatcttgtacaagctcaagttgggagagattgtaaccacaattccaactattggctttaatgtcgagactgttgagtacaagaacatcagctttactgtttgggatgttgggggtcaagacaagatccgaccattgtggagacactactttcaaaacacacaagggcttatctttgtggttgatagcaacgatcgtgatcgtgtggtggaggctagagacgagctgcaccggatgcttaatgaggatgaactaagagatgcagtgctacttgtgtttgccaacaagcaagatcttccgaatgcgatgaatgctgctgaaatcaccgataagcttggccttcattctctccgacaacgacactggtacatccagagcacatgtgccacctctggggaaggtctatacgagggactggattggctttccaacaatatcgcaaacaaggcataagcaggagttggatcatccctactgttagtttgtttcgagttgagacttttattttttcct

SEQ ID NO: 11224 - DNA, 797 bp, Carthamus tinctorius
gcatgtgatatcacgcgaatttcgtcgttgatagcattcaaacgatctccgtcactctccggccgatcatatcaagatggggttgtcattttggcaagctttttagccgcatgattgctaagaaagagatgcgcattttgatggttggtctcgatgcagctggtaaaacaacaattttgtacaagctcaagttgggagagattgtaaccacaattcccactattggctttaatgtggagactgttgagtacaagaacatcagctttactgtttgggatgttggtggtcaggacaagatccgacccttgtggaggcactacttccagaacacacaggggcttatctttgtggtcgatagcaatgaccgtgaccgtgtggtggaagctagagacgagctgcacaggatgcttaatgaggatgaactaagagatgcagtgttgcttgtgtttgccaacaaacaagatcttccaaatgctatgaatgctgctgagatcactgataagcttggcctgcattctctcagacaacgacactggtacatccagagcacatgtgccacctctggagaaggtctatatgaaggactggattggctttccaacaatatcgctggcaaggcataaacagggctgggtgatgaacttcctgctagttagtgtggtttctttttacttaatgttacgaatgacatgacattttaatccctccgaccgacctctgttcttgaatgaatccgtttgatggttggtcgttctttgtaatctaaattctgcagggttgattttattgtatccttg

SEQ ID NO: 11225 - DNA, 814 bp, Gerbera hybrid cultivar
cgacggctcccgatttcaaacaacctccttcacctttttccgatcgccggccgatcattcaaagatggggctgtcttttggtaagctattcagccgctagttcgctaagaaagagatgcgtattctgatggttggtctagatgcagctggtaaaaccacaattttatacaagctcaagttgggggaaattgtcaccactattcctactattggattcaacgtcgagactgttgagtacaagaacatcagcttcactgtgtgggatgttggtggtcaagacaagattcgacctttgtggaggcattacttccagaacacacagggtcttatctttgtggttgacagcaatgatcgtgaccgtgtggttgaggctagagatgagctacacaggatgcttaacgaggatgaattaagagacgcagtgttgcttgtttttgccaacaaacaagatcttccaaacgctatgaatgctgctgagataactgataagcttggcctacattctctccgccagcgtcactggtatatccagagcacgtgcgccacctctggggaaggtctatatgagggactggattggctttccaacaacattgctaacaaggcttaaaaggggactcggacaactattgtcaacgtttcttctatgcttcaagttgtggacgttttatcatgttgagaagaaaaaaatgattttcttcatggcgaaaacaacataatatgtcgaatttgtgggtttctgtaatctaatgttttgtataattgttgagttgactcaaacttagtcaaactaattcttgcagacagtcttccc

SEQ ID NO: 11226 - DNA, 990 bp, Primula obconica
tatttttgagctctatatttatctctcgtaagaatcgcaataagcgttggtctcaggctttcttcttcccccatctctctctctctctcttctctttctctcactagatccctctctagacaccctctgccagggatcaatacaaaaaaaacgaaagtggggttgacattcacaaagtcttttcagtcggctctttgccaagaaagagatgcgtatccttatggtgggtctcgatgcggctggtaagaccacaattttgtataagctgaagcttggagagattgtgaccacaattcccaccattggattcaatgtcgagactgttgagtacaaaaacatcagtttcacagtgtgggatgtcgggggtcaggacaagattcgcccattgtggaggcattatttccagaacacacaaggtctcatattcgtggttgatagcaacgatagggaccgtgttgtcgaagcaagagatgaactgcatcgcatgttgaatgaggatgaacttcgtgatgcggtgctgcttgtgtttgctaacaaacaagatcttcccaatgctatgaacgctgctgaaataactgacaaactcggtctacactctctccgacagcgccactggtacatccagagcacctgtgctacatctggcgaggggctctacgagggtctggattggctctccaataacattgctaacaaggcttgaagcagttcaagattttcatgggagtgatcatgaatgaaggtggcttttatcaaatttttttgcctttatttttttctgtcttacctctttatcagatggtgtggttatgaattgcaacaaaattttcttttaatgtacttctcgtttcgtctagggattcgaattggcttgtctaatagatttatggtggaatatgtttatgtgtactagcaaggctgtttagatttgaatataatgtttgttatatggaaactgatatggttgtggtataatacagtgtcgttatc

SEQ ID NO: 11227 - DNA, 1033 bp, Trifolium pratense
ggagtttgatttggtttcttctaaattaggattcagctcttcccttctacttcataatgtaagacgtttttccaattcagaagctaatggaaatcagatttcacttgagtgagattgttaggagttgtttagtcggttattcgcgaagaatgaaatgagaattttgatggttggtctcgatgctgctggtaagacaactatcctctacaagctcaagcttggagaaatcgtcactaccatccctaccattgggttcaatgtggagaccgttgagtacaagaacattagtttcactgtttgggatgttggaggtcaggacaagatccgtcccttgtggaggcactacttccagaacactcagggtcttatatttgtcgttgacagcaatgacagggatagagttgttgaggccagagatgagttacataggatgttgaatgaggatgaattgagagatgcagtattgcttgtttttgccaacaaacaagatcttccaaatgcaatgaatgctgccgaaattactgacaagttgggtcttcactctctgagacagcgccactggtacatccagagcacctgtgcaacatctggggagggtctttatgaaggtttggactggctttccaacaacatagccaataaggcttaatgcttattgggagtatttggattggcgattctggatgcaggggtgaatattatctagctttgctttttgagtcatgtggatcggtaattctggatgcaggggcaaatattatctagcttttatttcttggtcatcttctgaaacaacttgaatttgtgttcatgtattgtggtttaggatgtcttggtggctaaaattgtagcaggaatttgtttcatgggatttgtaatatttctgacttctgcgctttctattgggtttttgacgctgtccataactgtaatggagatacaattaaatgtgcctcaagttctaatatttagttttgttttggtcatatacatatacatatacctttcatataatggagtatttgttgagtaa

SEQ ID NO: 11228 - DNA, 1394 bp, Amaranthus tuberculatus
ggctgctgttcccaccattagttacttgactggttatggtgctaaagtcattctctgcagtcatttgggacgtcccaaaggtgtcacacctaagtacaagcttgaagcctcttatcccaaggctttctgagcttcttggaatcgaggttaaaatggcaaatgattccattggtgaggaagttgagaaattggtagctgagttgcctgaaggaggtgttctgctccttcagaatgtgaggttctataaagggggctgtcatttaccaaattgttcagtcggttgtttgcgaaaaaggaaatgcgtattcttatggtaggtctcgatgccgctggtaaaactacaattctgtataaactcaagctcggagagattgtcaccactattcctactattggatttaatgtcgagactgtggagtacaaaaacatcagcttcactgtatgggatgttggaggtcaggataagattcgtccattgtggagacattacttccaaaacacccaaggacttatctttgtggttgacagtaatgatcgtgaccgtgttgttgaggccagggacgagctgcataggatgttaaatgaggatgaattgagggaggcagtgctgttggtgttcgctaacaagcaagatcttccaaatgcaatgaatgctgctgagatcaccgacaagcttggcctccattctttacgtcaacgtcactggtacattcagagtacatgtgccacctccggagaagggctttacgagggcctggactggctctcgaacaatattgctagcaaggcttaaatgtaacaaatcacaaatcgagttacgctagctgttctcaggatgagaagctggagttaaaattaataagaaaactgggtacatacagatacagtatccctacacacaagatgttgaacaatataattaccggctcagagaatctcaacaaagctttgatcatcatcatcaccatcaccatttttaagacccaataaccaacatcatgtagcactatacttctgctacaacatcaaaaggaaaaaacaacacaacatatactacaagtttataggttgaaacattaattaataatcatgatcagcttaacgattataattaaaaggttggtacgactccataacccgagtcggagttgaaaaggctgtcaacggaggcgggggcgtccacatctgtacgcttggcaaatcggcccttaatgcgaggcctagtctcagcataggctttcctagaagcgtaacggattgttttttcaaacttgcgggtttttctttctctctgtaccttaacactcttgcttctctgtccatccctatcatcttcatttgttgcttgttttgtcgtaattccagtagacgctacatccgccagtcgtgggagg

SEQ ID NO: 11229 - DNA, 900 bp, Bupleurum chinense
aatatccaggtacattttttattctgtgtatcacacacacacacacaccccttacatctctttgcatctaattatatgaatatccttcctttcacttgattttcaaagattaaaataatctacaaaacgctgtgctttctgtctgtgattcaggagtgctaaagatggggctgtcctttacaaactctttagtcggcttttgccaagaaagagatgcgaatactgatggtgggtctcgacgcagctggtaagacaaccattctgtacaagctcaagctgggagagatagttacaacaattcctactattggatttaatgtggagactgtggaatataagaacataagcttcactgtctgggatgttggaggccaggacaagatccgtcctttgtggagacattacttccaaaatactcagggcctcatttttgtggttgatagcaatgatcgagatcgtgtagttgaagccagagatgagctgcacagaatgcttaatgaggatgaactaagggatgccgtcctacttgtttttgcaaacaagcaagatcttccgaatgcaatgaatgctgctgagattactgacaaacttggccttcactctcttcgtcagcgccactggtacattcagagcacatgtgcaacttcaggtgaaggtttatacgagggtctggactggctctcaaataacattgcaaacaaggcatagaaagcttgaacagagttcggaacttctctgcatcaagacaaggttcttcgtatttcccttgttttgatgtcattacagatggatagagttgttttttgtttcatattttccaatgtccgggatttgtgtaccatgtgttttttgttgatgtcttactatgtttcatttataccttgtaggcatgttatgctt

SEQ ID NO: 11230 - DNA, 900 bp, Vinca minor
gaaggccaatctcgagggatcatccataagaaagcaatatgggattaacgtttacgaagctcttcagccggcttctttgccaagaaggagatgcgaattctgatggtaggtcttgatgcagctggtaagaccaccatcttgtacaagctcaagctcggagaaatagtgaccacaattcccactattggttttaatgttgagactgttgaatacaagaacattagcttcactgtttgggatgtcgggggtcaggacaagatccgtcccttgtggaggcactacttccaaaacacacaaggtcttatttttgtggtggatagcaatgacagagaccgtgttgtggaagccagggatgagttgcataggatgttgaatgaggatgagctgcgtgatgcagtgttgcttgtatttgccaacaaacaagatcttcccaatgccatgaatgctgctgagataacagataagcttggtctgcactccctccggcagcgccactggtatatccagagcacctgcgcaacttctggagaaggactttacgagggactggattggctttctaacaacattgctaataaggcataaagcaagacaggaaatattttcaatgggttgacactggatgcaggcggctttttatctagaattttcctgttttggtgtttatggatttaaattttaatcagtatatcttttaaccgaccagttgtattgaagtgctcggttttatgtaattgcaatgtgttttgtctaggtttttgaatataatgattaatgccagaaggttatgagcatgtgaacaaagattttattgctggtagtattgtaaacagagattttaagctgttatttgccttggtttcttaatggctagtattcttttttagtacttgtattcat

SEQ ID NO: 11231 - DNA, 821 bp, Cynara scolymus
tctctttggaatctgcgagagagtgtccagtcaagaagtacttaataaccatttgaagcaacaccaagacggggctgacttttaccaagttgtttagccggttatttgccaagaaagagatgcgaattcttatggtaggtcttgatgctgctggtaagactactatattgtacaagttgaagcttggagacattgtgacaacgattcctaccattggattcaatgttgagactgttgaatataagaatatcagcttcactgtttgggatgttggtggccaagacaagattcgtccattgtggaggcactacttccaaaacacacaagggcttatctttgtggtggatagcaatgacagggatcgagttgtcgaggcaagggatgaattgcataggatgttgaatgaggatgaacttagagacgctgttttgctggtctttgctaacaaacaagatcttcctaatgccatgaatgctgcggaaattaccgacaaacttggtcttcattcgctccgtcaacgccactggtacattcagagcacatgcgcaacatctggcgaaggtctttatgaagggctcgattggctttccaacaacattgctaacaaggcataaagtacaaacggttttggttgccggtggagaggagacatcgtttgccgttttagtaaaatatcagaatttatatacatctctcgtaccgatcgtaggtaaaactaatgtccgttattcttcccgctcaaatactactgtagatggaaaatatcgtgttgtcgagtgattgacccgatatgctcgaactacttgaggaatcagtgtctg

SEQ ID NO: 11232 - DNA, 2226 bp, Panax ginseng
cctaaatcatatcatatcctctcttacttatttaattactttgtccaaccttcatactgtatatatagtcttaatttactttattaatctagaataccactaataattactctcttcttcgtctacgaaatcccttggagatcagtactgcaacatgtctgtcagaagccataataggctgcgggtttgcataaagatgataattcataggattattcatgttcaagttcatgttcatgttcatgttcatgttcatgttcatgttgaacatgaaaaaatcagcagcaggctacagtaaaaacattgcaagtaggctcctcctctgtcccaaaattagtgccattattagcatccatgaaactgatgatttcattgagggactgcaatctgttgctgagttcagccattttgagctcttcaagattgaattttcagcctcaatgttgaggtaattctgggtagtgacactcattgcttgtgatgatttggttgttttcctttctgagttgagccagctgagtctttagatcatccaaatgcttctgcttcctcatccgagaccgccttgccgattcgcgattcgaaatcattcttttcctcttcctctggtccatcaattgctgaagatcttcttcagaacctgagttctgaagcagagatgaccctgaagaggtggttgttgttgttccactggaggaagccattaaaacttgagaaaattgtgcacaattatccaagatttagagagaaaggttgaaaatagcaggacccagattgtaaaataactagatatagtagtaaagtaattcaaattatacaagtagatatatagatataatactaatagtaatagttatatagaggggataagggtcaagctatgaaacaaagtacagccagtagaggaagacaactgagaaggattgaactaaatgggtcctgcgcctgtatgtagaatttatcataaacccagaaacaaacagttcactaagaatttgagacatcaatttcatacatcaagaacaatagattgagcatcaagcttaatataaagaaacccaatagatatcaaaaataacagtgaggttggcgcttggaatagttgccaaaaaacccaaatccaggagaaaaaaagtgatccttttaaaaaacactaaaaatttcaagagattcagactaaaccagacatgaagaacaaatggctaactgattttggatccagaatacccttgatattataagtgcaatttgcaaagcataagcagaaagaaaaacagcctcaaggaaacggaaatgagaatgggaagaggactggtaacataaatagacctcgccctgttttcattcatctctgctccgtatctgataggtgttcggtggtggacgacagctccattcgagatctctgattcttttactcgtatcgctcacctcattatacaaagatggggttgtctttcaccaagcttttcagtcgcctgtttgctaagaagaatgcgtattctaatggttggtctcgatgctgctggtaaaaccacaattttgtacaagctcaagttgggagaaatcgtcaccactatccctacaattggctttaatgttgagactgttgagtacaagaacattagtttcactgtgtgggatgttggtggtcaggacaagatccgaccgttgtggaggcactacttccaaaacacacaggggcttatctttgtggttgacagcaatgatcgagaccgtgtggttgaggctaaagatgaactgcacaggatgttgaatgaggatgaattgagagatgctgtgctccttgtgtttgcaaacaagcaggatcttccaaatgccatgaatgctgctgagatcaccgacaagcttggtttgcattctcttcgacagcggcactggtatattcagagcacatgtgccacatctggagaaggtctatacgagggactggattggctttcaaacaatattgctaacaaagcttgatggactactctgctggttcagttggtactttatgaagtgtatgggtgcagttatcgtctgggtataggtgttgctacaattattatttctataattgcttttgatgttttggattctctttttccatgttgtgctgcaattacatataggatttattgttcctttttgagttgtaaagctttatgccagggctctggtggattgctattaaagtagttatacaagctactgggttta

SEQ ID NO: 11233 - DNA, 1208 bp, Panax ginseng
tttcgtttggaccacaggactttggtatataaataacggattcatattcatcgtcaccttggaacttggtattgtaagggcgagtctcaaaagatctgcccctttctctctcgtcgtcgttcaaattatctgttgatcatcatacattaggaaaaatagggtttgtcgttcggcaagctctttagtcggctgtttgcgaagaaggagatgcgtatacttatggtgggtcttgatgctgctggtaagaccaccatattgtacaagctcaaactgggagagattgttaccaccattcctacgattgggtttaatgtggagactgtggaatacaagaacatcagcttcaccgtttgggacgttggtggtcaagacaagattcgacccttgtggagacactactttcagaatactcaagggcttatctttgtggttgacagcaatgacagggaacgtgtggttgaggctagggatgagttgcacaggatgttgaatgaggatgagttgagggatgctgttctgcttgtatttgctaacaaacaagatcttccaaatgccatgaacgctgctgagataactgacaagctaggtcttcactccctcaggcaacgtcactggtatatccagagcacatgtgccacctctggggaagggctgtacgaggggctggactggctctccaacaatattgctaacaaggcttgatggcatgcttttccatgacattttgagctgaagttacgtctaaatggagttactattgtgtttcttggcagtttgtaatttgttcttcccgtgaataatatttttatcgtgttcagtttattggttcttgttagttttgcaccgacttttgttgatttatattcatgtttattcttcatagggttaggacaagtacagtggtgcttaatgcatgagtttgtgtaagcatttgctattgtattgaggttattattagtaaatgaaatgaagctcttttagtaaaaccaaaaaaaaaaaaaaaaacaaaaaaaaaaacaaaaaaaaaaaacaaaaaaaaaaacaaaaaaaaacaaaaaaacaaaaaaacaaaaaaacaaagaacaacgtacagacagagacagagaagacagacactcacgcaatcacataggacacagaccggaccaggctaggatacccgtaccggatgacaacaagcaataggccgtaaacaccagagagaccca

SEQ ID NO: 11234 - DNA, 986 bp, Lippia dulcis
cgctgctcagatattacgctcgcacacggcttcatcgttattttggagagatctctaaacgccgatccatcctcgctgctcctcttttaaaaggtggggctgtctttcacgaagcttttcagccggctgtttgccaagaaagagatgcgcatactcatggtaggtctcgatgctgctggtaaaacaaccattttgtacaagctcaaacttggagaaattgtcaccacaattcctaccattgggttcaatgtcgagactgttgagtataagaacattagcttcactgtttgggatgttgggggtcaggacaagatccgtccgttatggaggcattatttccagaatacccagggccttatctttgttgttgacagcaacgatcgtgatcgtgttgttgaagcaagggatgaattgcacaggatgctgaatgaggacgagttgagggatgctgtcctgcttgtttttgccaacaagcaggatcttccgaatgcaatgaacgctgcagaaataactgacaagctgggacttcattctctccgtcaacgccattggtacatccagagcacatgtgcaacttccggtgaaggtctctacgagggattggactggctttcgaacaacattgccaacaagagttaagctcttcagcccatgatgaccttgcactatggcctgtggggctttcattctttctcactcggatcatctagcattactatgctgacagcctcggatccagtcgagaacgttgccatctttcggccttccgtatgtagttaataataatttttagtttttcttgtcaaccgtgtgtcttttcctcctcctgtttcgtggtataggatctgagttctgtaatagaaactacctaccaatatcgattttcacttttgatgagacagtcatgttaataaattacattctcagggatctattttgctgagtatataaagatagtcggattggctacttcatttaaaaaagaa

SEQ ID NO: 11235 - DNA, 938 bp, Orobanche aegyptiaca
tcgtaagatctctatttttgacattttcaggcaaaaaaatggggttgtccttcaccaagctttcagccggctgttgccaagaaggaaatgcgtattcttatggtaggtctcgatgctgctggtaagaccactatattatacaaactcaagcttggagaaatagtgacaaccattcctacaatcggattcaatgtggagactgtggaatacaagaacataagcttcactgtctgggatgtcgggggtcaagacaagatacgaccattgtggaggcattactttcagaacactcaagggttgatctttgtggttgatagtaatgatcgggatcgtgttgttgaggctagggatgagctccacaggatgttaaatgaggatgaactgagggatgcagtgcttcttgtttttgcaaacaaacaagatcttcctaatgctatgaatgctgctgagataaccgacaagcttggacttcaatctctccgccaacgccactggtatatccagagcacatgtgccacgtctggggaagggctgtacgaagggcttgactggctctccaacaacattgctaacaaggcgtagaagagatttgaagaatttattattaggtgtcgtgatcctttctcgaattcggaggttgtcttatcaatgttattgcttttttttttcagattaattaatctcatactacgacgtagtttttaaaccagcagattgtcatctccatttgtggggattgagatttgcattatgtaatttcagcacttaaataatgtctttgcttgtgttacttttggctttatgaactctagaatggtattactagcaatctagcatgttatgaattgattttcaaatggacttttgatgtgtttgaaaatttcagtagtttatttcatctgtcaaataaggtgcgtgctgtatgactcgaatattta

SEQ ID NO: 11236 - DNA, 1027 bp, Rosmarinus officinalis
cggccgggggctcccgaaaattgttattagtatctcgcgttattctcaggcagctccacatttctctctctcgcgctagcagaacatactttctctctctagcgctctcaccaaatctatcgttccaagatcaaaagtaagaaagggaaatggggttgacattcacaaagcttttagccggctttttgccaagaaggagatgcgcattttgatggttggtcttgatgctgctggtaagaccaccatcttgtacaagctcaagctcggagagattgttaccactattcctaccattggcttcaatgtggagactgtcgaatacaagaacattagcttcaccgtttgggatgtcgggggtcaggacaagatccgcccattgtggaggcactacttccagaccactcaggggctcatatttgtggtggatagcaatgatagggaccgggttgtggaggcaagggatgaactgcataggatgttaaatgaggatgagctgaaagatgctgtattacttgtatttgccaacaaacaagatcttcctaatgcaatgaacgctgctgaaatcactgacaagcttggcctacactcgctcaggcagcgccactggtacatccagagcacttgtgccacctcaggtgaggggctctatgagggactcgattggctctccaacaacattgctaacaaggcttaaagcttttctggagttgtttacgcgagagctaatactggaaactgtcgaagttttatctagttttttcttaaccatatattgctttgaaacaaatattatttttttcatttatgtttaggaccttcaaaatgtcgttatatcagacaatggtttgttttatatgttttcctacatttgcgtggttttgaatgtaatattcagactcgcagactagggttttgcattattatttgtttaccaacgcttctctctacttgtaaactgcatgatctctacgacgtaagtgctgaaaacgcttaattttatcatatctctacaattttttcttcattg

SEQ ID NO: 11237 - DNA, 1111 bp, Brachypodium distachyon
aagctcttcagccggctcttcgccaagaaggagatgcggatcctcatggtcggtctcgacgccgccggaaagaccaccattctctacaagctcaagctcggcgagatcgtcaccaccatcccaaccatcgggttcaatgttgaaactgtggagtacaagaatattagtttcaccgtctgggatgtcggtggtcaggacaagatcagaccactctggaggcattactttcagaacacacaggggcttatctttgttgtggacagcaatgacagggatcgtgttgttgaagctagagatgaactccataggatgcttaatgaggatgagttgcgtgatgctgtgttgcttgtgtttgctaacaagcaagatcttccaaatgcaatgaatgctgctgagattactgacaagcttgggttacattccctacgccagcgacactggtacatccagagcacttgtgccacatctggcgagggtttgtacgagggtctggactggctgtccagcaacattgccagcaagtcttgaggcttggaactatcaaggtcgtcgaatcaactaggagctctggatgtatcagttccctaggtgcatcagacgctgctacttattccacaagctcgaacattgttctgagcttgttatatataactaaggggtccatataactaaggattttaatattccctgtagtttcaaatgttattgcacatttttcacttttgctttagggtctttccagtggaatgtacttttggccattcttgaagtctgatgaactcaggatgttttatcgcaaacttcttaaagtctgaaagttacccattaatgtaatggtcgttgcttttgtcaaattattcagatgtttgagatatgatgcgtgcgggttttcagattcaggtttctttccccttgtggggtctaggtccagagttttccatatgtgtttggtcctcaaattccttttcagcataagaggaaccgtgaggtgaggtgaggtcatcctaatcatggttaaaagctgagagcacatgcaatagtgactgtctggcactggcagaaaccggttacgttgttcagggcttttggcaaagtatatcgcttggcagat

SEQ ID NO: 11238 - DNA, 783 bp, Flaveria ramosissima
tattgatggtgggtcttgatgcagctggtaagacaaccattttgtacaagctcaagctcggggagattgtgactaccatccctaccattggatttaatgtggagactgttgagtacaaaaacatcagcttcactgtgtgggatgtagggggtcaggacaagatccgtccactatggaggcactacttccaaaacacacagggtcttatctttgtggttgatagcaatgatagggatagagttgttgaagcaagagacgagctgcacaggatgttgaacgaggatgagctaagggatgcagttcttctggtatttgccaacaaacaagatctgcctaatgcaatgaatgccgctgaaattactgataagcttggccttcactctcttcgacagcgccattggtacatccagagcacctgtgccacctctggggaaggactttacgagggtttggactggctttccaacaacattgctaacaaggcatgaggtgttgattgaactgtatttgagggtggaaaaaccggaggcaggttttgctttttgtgcggtcggtcactttcttgtactagttctcgttcttctgtgacgggggtgcgagtggttatggaactttgttaaaaaaggcattttgcgttttatatatagtccttgtatgataaaatctttggttggaactttgtcgtcgtactttaatggtttatttcacataaccaagagattaattttgcttgtttatgtaagagattaattttggtcgtttataacatgctttatttagcgg

SEQ ID NO: 11239 - DNA, 794 bp, Fraxinus spp
aagcttttcagccgtctgttcgcaaagaaagagatgcggatacttatgtgggtcttgatgctgctggtaagaccactatattatgcaagctcaagctgggagaaatagtaacgaccattcctacaattggattcaatgtggagacagtggaatacaagaatatcagcttcacagtctgggatgttgggggtcaagacaagatccgaccattgtggaggcattactttcagaacactcaagggctaatcttcgttgtagatagtaatgatcgagaccgtgtggttgaggctagggatgagctgcacaggatgttgaatgaggatgaactgagggatgcagtgcttcttgtttttgcgaacaaacaagatcttccaaatgctatgaatgctgctgagataactgacaagcttggacttcactctctccgtcaacgccattggtatatccagagcacatgtgccacctccggggaaggactttatgagggactggactggctgtcgaacaacattgccaacaaggcataaaagagactatattggatgattatgatagcttaattctcatcgaagaggagattgtccttcaatttttaggcttttgtatctcaccatcttgaaaactccgtactttgatctctttatttgttttcttagaaatttgtcatttctgtcgtgtagatttatattcgaaatcctgtaatttcaacattcttgaataccttttggattgattagttttcaaaatgacgctctactgctcattgagtgaaatggaaagtactgcattttgcc

SEQ ID NO: 11240 - DNA, 776 bp, Heritiera littoralis
gcgtatactgatggttgggcttgatgctgctggtaaaaccaccattctttacaagcttaagttgggagagattgtcactaccattcccaccattggtttcaatgttgagaccgtggaatacaaaaacatcagctttactgtttgggatgttggtggccaggacaagatccgaccattgtggagacattacttccaaaacacacaaggacttatttttgtgatcgatagcaatgatcgcgatcgtgtggttgaagctagagatgagttgcacaggatgttgaatgaggatgagttgagggatgcagtgctgctagtatttgcaaacaagcaagatcttccaaatgctatgaatgctgctgagatcactgacaagcttggccttcatactctccgccagcgccagtggtatatccagagcacatgtgctacttctggtgaaggactgtacgagggactggactggctctcgaacaacattgcaaacaaggcatagacggcataattgagttgtcaatcacactaataccggccccttttggagttatggatgtctaccccttttaaagtgtttttggttttgcatgtttcttgtttctttcaaacattgccatttgttacttgtagtttcagaataattgataaattttctggtttctcctgtggtattatctcgataggtaccaaaaaacaattccccaagcttaggcccgttctttccttgtgtgaaaattgatggttagccaatttctttactctaatgttaatatacagtataa

SEQ ID NO: 11241 - DNA, 679 bp, Utricularia gibba
gatgaggatcctcatggtgggattggacgcggcaggaaaaaccaccatcttgtataagctgaaactcggagagatcgtgacaaccatcccaacaatcggatttaacgttgagacggtagagtacaagaacatcagtttcactgtgtgggatgtgggaggccaagacaagatccgacccctgtggaggcactactttcagaacactcagggtttgatcttcgtggttgacagtaacgatcgtgatcgtattgtggaagccagggatgaactacatcgtatgctcggagaggacgagttgagagacgctgttcttctggtttttgccaacaagcaagatctgccaaatgcaatgaacgctgcagaaatcactgacaaacttggactccactcacttcgtcaacgtctctggtacatccaaagcacttgtgccacatctggggaaggtctttatgagggacttgattggctttcttcaaacatcggtccaaagggttaatttgagttctgttaattccgcatcagtgtagagaatgttgtgttactttgttctgcgtggtgcatagagggatagttaactttgcatcagcaggaatgtttccaatatttgttgttttctttttttttttttacaatgttactttgttgctgagcagagactgagaaacaccgtatgttgacc

SEQ ID NO: 11242 - DNA, 691 bp, Allium cepa
atggttggtctcgatgctgctggtaaaactacgattttgtataagttgaagcttggcgagatcgtcactacaattcctactattgggttcaatgtggagactgttgagtacaaaaacataagcttcaccgtgtgggatgtcggaggtcaggacaagattagacctctatggaggcattacttccagaacacacaaggccttatatttgtcgttgacagcaacgacagagaccgtgctgttgaggctagagacgagctccataggatgcttaatgaggatgagttgcgcgatgctgtcctacttgtatttgcaaacaaacaggatctgccgaatgcaatgaatgctgctgaaatcacggataagcttggccttcactcccttcgtcagcggcactggtacattcagagcacctgtgctacatcgggggaggggttgtatgagggacttgactggctctccagcaacatcgctagcaagagctaaggcatccttgtgtcgagtatcatcttgcggagccagtaaattaatattaaaatgctatgttatttatttctttaaaggtagcagcagccactttggtatattgcaattcgacagctatattttttatcaggatactgtatcacataatcatttatgctcttgacaactaaaacatcatctggtatttgattgtttctttatatatttg

SEQ ID NO: 11243 - DNA, 880 bp, Trifolium pratense
tttgggttgattttttgggctaaatttttcttgaacaaaaggcaaaaatgggattgacagtgtcaaggctaatgagattattttatgcaaagaaagatatgaggattctgatggtgggtcttgatgcagctggaaaaacaacaattctctacaaactgaagcttggagaaattgtcactaccataccaaccataggcttcaatgtagagactgttgagtacaaaaatattagcttcactgtctgggatgttggaggacaagacaagattcgaccattgtggagacactactttcaaaatacacaaggccttatctttgtggtagatagtaatgatagagaaagaattttagaagccagagatgagctccatcgtatgttaagtgaggatgaacttcgtgatgccactttacttgtatttgccaataagcaagaccttccaaatgctttgaccgtttcagagattactgataaacttggtttacattcacttcgtcagcgccgttggtacatccagtcaacttgcgccacatccggccaaggactctatgaaggccttgattggttgtcaagtaacatatcaaacaagataagatgaatcaaagatctgagtttactttgtgatctttatcatatgaatattgaaacttggtgcacattttgcttatatattggtataaacttgcgtgttaccattttgttaatttgaactatgaaccaattgtgatatcaaccactatgtacactttctaaaagttcagggtattcaatcactatgtatgctttctaaacgttcatggcttgtaagtattacactcattaagagttctgtgtatacaacccattgcagctttaaataatgttacagtaacttttgttttt

SEQ ID NO: 11244 - DNA, 801 bp, Centaurea maculosa
ggtctcgatgcggctggtaagacaaccattttgtacaagctcaagcttggtgagatcgtgacaacaatccctaccattgggtttaatgtggagactgtcgagtacaagaacatcagcttcaccgtgtgggatgttggtggtcaagacaagattcgtccactatggaggcactacttccagaacacacagggtcttatctttgtggttgatagtaatgacagggatagagttgttgaggcaagagatgaattgcacaggatgttgaatgaggatgagttaagagatgcagttctccttgtgtttgctaacaaacaagatctcccaaatgcaatgaatgctgctgaaatcactgataagctcggcctccactccctccgacagcgccactggtacatccagagcacttgtgcaacctctggagaagggctttatgaaggactggattggctgtccaacaacatagcaaacaaggcatgaagcggtgattgattttgttgtgagggtggaggtggatgcaagttttgcttttagcttggccagtttatcgttgttcgttcgttcgttgtgcttctgtgcactacctgtggtttgggaaacatgttcttttaaaaggtctttggcttttgatatagaagttatggatgtgtctaattgaatatattgtttgttcttttttttctgtttggattgcaagtattatgtactaggttttgattcatatatctgaagttgtaagagattattattaagtttttagaagtatgtagtttgctggtattattcttataccaatttatatgc

SEQ ID NO: 11245 - DNA, 1522 bp, Capsicum annuum
caagaatcatatacccttagtttccccgttaagattcgaagaaatgtgattaactatttgtatttaaaaacttaaaggctattggcaaataccgcaaaactaagtgaattctcagaagaagttagttattgtgtgttgcgccacttgtatccatcgatcaatataatgggtatgtcaatatccaagtttgtaaaaatgctatttgcaaagaaagatatgagaattttgatggtaggactcgatgccgctggcaagacaactatcttgtacaagttgaaacttggggaaattgttaataccattcctaccattggatttaacgtggagacagtggaatacaagaattcgagctttacagtatgggatgtgggtggacaagataagatccggcctctatggaggcattattttcagaacacacagggtctaatatttgtggtagatagtaatgatagagatcgaatttcagaagctagagatgagctccatcgcatgattaacgaggaagaactacgaggtgccacaattcttgtatttgctaataaacaagaccttccaaatgctatgaatgttgcagaaatcactgataaacttggtctgcattcactccgtcaaagacgctggtacatccagagtgcttgtgcaacatctggacaggggctttatgaaggtcttgattggctatcacataatatcactggcaaggcataaattcagagctatatccagctcaagaaaatcttggtcttgaaacccaaacgcgttgattttacagaagctgtggttataagtatattgtgatgcaagtatcattattgtaaactttagtgttaaatcccatatatttgcttatctgtgtatgaatgaacttttcgctcataatttatatatatggttgaaaaattaaagtcactggacttcccataatgtggactatcgggtaaatacaatatgatacaacactcgtggggctcaagtcttctttctccttttgaggcttatccgaaagagaatccagtaattcttgatcgtgaatatctaaacaggttattttatgatcaagattaattatttaggaagttcatatcatccacacacatagtactttgatctgagatttcaactcttttgagttttagcagtaacatatttttgcatagagctaaggcccaaaatttgaaagaaataaaatgttttaacgactctatcgccaaatcaattttggagagaggtagttgtacatgacatgatgcagctctagcttactaaagacatggctttagataggagtgtatggaagtcgcggattaggatagaagagcagtaggtagttgagttttgactcgctttttggcgggtctaggcttggtgggagcctaggtgcactgtatttattataatactagtcttatacatgtatttccttttttagttaccgcaatatttcattgttgttgttgttgttgtttcatttctctgtatgcgttgtaatgccttattaattgacatgttttctccactg

SEQ ID NO: 11246 - DNA, 667 bp, Rosmarinus officinalis
gatggttggtcttgatgctgctggtaaaaccaccatcttgtacaagcttaagctgggggagatcgtaacaacaattcctaccataggctttaatgtggagactgttgagtataaaaatatcagtttcacggtttgggatgttggtggtcaggataagattcgtccattgtggaggcactacttccaaaacacacaaggtctcatatttgtggtggatagcaatgacagagaccgaattgtggaagcaagggatgagttgcataggatgctgaatgaggatgagctgcgagatgcagtgttgcttgtattcgccaacaaacaagatcttcctaatacaatgaatgctgctgaaataaccgataagcttggtctgcactccctccggcagcgccactggtacatacaaagcacctgcgccacttctggagaaggactttacgagggactggattggctttctaacaacattgctaataaggcataaatgaagactggaaatattttcatgggttgacactggatgcaggctgctaattacaattgtttgtctaggttttgaatataatgccagaagttatgggcctgtgaacacagattttcttgtgaacagggattaagctgttattcaccttggtttgttaatggctcaatactagtattctttttg

SEQ ID NO: 11247 - DNA, 942 bp, Picea glauca
atggttggtcttgatgcggctggaaagactactattttatacaagttgaagctgggagagatcgttacaacaattcccaccattggatttaatgtggagactgtggaatacaagaacatcagcttcacagtttgggatgtggggggtcaggataagattcgaccactgtggaggcactactttcagaatacacagggtcttatctttgtggtggatagcaatgacagagaccgtgtagctgaggcaagggatgagttgcacaggatgttgaatgaggatgagttacgagatgcagtcctgctagtgtttgcaaacaagcaggatctcccaaatgcgatgactgctgctgaaatcaccgataagcttggtctgcactctttacgtcagcggcactggtatattcaaagcacttgtgcaacttctggtgaaggcctttatgaaggcttggattggctttcaaacaacattgccaacaaggcataatttggaatgcgtctaatttctatattgggcacgaagtttattagccatgaagtagattccttcagaattacaatgatcgacagccaccggcatggattttttaaagaagaccttgactcgattcattttcttgatagcttgattgctatgtattttacaacttgtcattattgtgcgagaatctgggatttttctgtctgccagtcgtgctatattgactatattagctctgctacacatctaactattatcttctgattgagaagacttgtataattagattttagtggattgaaaggcttttctatgttcaataggaacaaatataatgctgctttccaaatttattagttaggaaaaacagaaagtagttcagtatttacattagtatctgaagcttctataagatatttatatctgtattcttttcctgtgacaaaaaaaaaaaaaaagtaacta

SEQ ID NO: 11248 - DNA, 716 bp, Centaurea maculosa
ggtctcgatgcggctggtaagacaaccattttgtacaagctcaagcttggtgagatcgtgacaacaatccctaccattgggtttaatgtggagaccgtcgaatacaaaaacatcagcttcacagtgtgggatgtggggggtcaagacaagattcgtccactatggaggcactacttccagaacacacaaggtcttatctttgtggttgatagcaatgacagggacagagttgttgaggcaagagatgagttgcacaggatgttgaatgaggatgagctaagagatgcagtacttcttgtatttgccaacaaacaagatctgccaaatgcaatgaatgctgctgaaatcactgataagctcggcctccactccctccgacagcgccactggtacatccagagcacctgtgccacctccggggaaggactttatgaggggttggactggctttccaacaacattgcaaacaaggcataaggtgacaattgaatttgtattttgagggtggattctggaggcaagttttgctttatttggtgtagccactttttcctgttctcgttcttcatcgtctgaggtgcaagtgggtattaaaaactttgttgcttaaaaaaaagggtttttgcatttgataatataggacatcatgtatgatacaacgtttggttgggttgcaagtattttaaaaggtatgatgtgtcttcttcttcttcttg

SEQ ID NO: 11249 - DNA, 648 bp, Triticum aestivum
cccttctctctcttttgtatccttcaccacaagccgccgccatgggtctctctttcggcaagctgttctcgcgcctgttctccagcaccaaggacgttcgcatcctgatggtcggtctcgacgctgctggcaagaccaccatcctgtacaagctgaagctgggcgagatcgtcaccacgatcccgacgatcggcttcaacgtggagacggttgagtacaagaacatcagcttcaccgtgtgggacgtcggaggccaggacaagatccggccgctgtggcgccactacttccagaacacgcagggcctcatctttgtggtggactctgccgaccgcgagcgcgtcaccgaggccgccgaggagctgcagaagatgctcaacgaggacgagctgcgcgacgccgtgctgctggtgtttgccaacaagcaggatctgcccaacgccatgaccgtcgccgaggtcaccgacaagctcgggctgcactcgctgcaccgccggaaatggttcatccagagcacctgcgccaccaacggcgagggcctctacgagggcctcgactggctcagcaacgtgctgtcgggcaagtcctaagccgtctgccggcgggtgcggcgtgcgtacgaattgagtcttcttttttttaaaaaaa

SEQ ID NO: 11250 - DNA, 1209 bp, Papaver somniferum
catacttgttctgtttctccttcgattttaattcggtttagaggatcgatcaatcaggattaaatgggtgttacgttcacaaagcttttcagccagctttttgccaagaagagtatgcgtattctgatggttggtcttgatgccgctggtaagactactatattgtataagctcaggctcggagagatcgtctcaactattcctaccatcggttttaatgtggagaacgtggaatacaagaacatcagcttcactgtttgggatgtcggaggtcaggacaagatccgtccattgtggaagtactactaccaaaacacacaagggttgatctttgtggtggatagcaacgacagagaacgaattgtagaagctcgtgatgagttgcacaagctgatgaatgaggatgagttgcgaaatgctgtgttgctcatattcgcaaacaaacaggatcttcctaatgcaatgagtgctgctgagatcactgacaagcttggtcttcactcagtccgtaaacgccgctggtacatccagagcacatgtgcaacctctggagaaggtctttatgagggtctagagtggctttccagcaatgctgctaacgtggcttgagttgtggcagttgaagattgtgttttggttgcttattgttatgggacctttgacctttggccaatgctgtaatataactggttcgggtatatatgtgcgtcttttctattttgtttcaacaaggatttatatattggatttaattcactgtgaaatttaatttttctatagttagtagacaatctctctgtatggtggtcttttttttctttaaagaagaaggttatataatcaaattctctgtggtattctttttgattgccaatgtgttattaattctcgaaatgagaattctgagaaccacttcgatttggaccctgaaaggaatagatggctcttgacctctatgatcaaatcctctgtagacctgcctgttttttggccttccaatccacaaagttcagctgattgcagagaaaatcgcaggccaaaattttcttgcagctgttgacatagagtttgttgctcgacccaacgacagtgaattgggagatggtttactgtctattcttcattgttgcagaagcaacaaattttgtttcaatgcatctttgagcaatgatatgctttcctatgcatctttgaacaatgatatgcttt

SEQ ID NO: 11251 - DNA, 472 bp, Ambrosia trifida
cgatgcagctggtaagaccaccattttgtataagctgaagctcggcgagattgtcaccactattcctaccataggttttaacgtggagactgttgagtacaaaaacattagcttcaccgtgtgggatgtcgggggtcaggacaagatacgtccgctatggaggcattacttccagaacacccaaggtcttatctttgttgttgatagcaacgacagggacagagttgttgaggcaagagatgaattgcacaggatgttgaacgaggatgagttaagagatgcagttctccttgtatttgctaacaaacaagatctccctaatgcaatgaatgctgctgaaatcactgataagctcggtctccactctcttcgacagcgtcactggtacatccagagcacttgtgcaacctctggagagggactttacgagggactggattggctttccaacaacatagcaaacaaggcatga

SEQ ID NO: 11252 - DNA, 2688 bp, Amborella trichopoda
tttttttttaataatttacaaagatgcatttattattaaataagatacataaaaatagtttatatggctttactatcacttacttatctctcaactatttctagaggtatcacattgcaacctaagagacctttgccgacccaggggcgtggagttaatgagagaactatgctattggatccacgtttgatttttagattaactgtcttgtatctgctattctccactaactttccaatgtctgttaaagatttgaagtttcggtaatgaatggatccaaattccagtatcagatcttcgacttgaattcctgcaatttctgctggtgaaccaggtgaaactaaattcactctgaggaaaggctccagcgagacactttctatttcctggctatcagatacattgggtacaggctcttgtgcttcacttcccattgccaaaccatgaactttgtgcaatccttcctctatctttttcatcaatgctttatgatcgtttgtgagacataccatttgtgccttgtgtgtctcacttgataaacatcgatatcctgtctgggatatccttcggagtccaccagtggctcatccatgtcgacatgattgctatctaagatctccttcagcgttcgcagatcagattcaatcttttctttatccttcatcaattgaaggacagcatctttagcttcttgcagctccatgtcgaccaccattttcgttttggttgagcaacataacataggtcgggaaatgaatcagcaagtacgtatacttgtgtctctcgggcctatcttcaaattgcgcgcgtcacggacacgttaccaacaaagttggcaacacttcgaaattgactcacttctcgccgtgcgacaacgagaatacgagatccgcgctttgtcatcctctacatggtggtctccgcgattttgacgcgagaaagctccatataagagcgatattcgatcggagaagctaaagtcgcgagtgccgacgtcgacgagaattgatcagcgggcttcccgacttgcagcggacgagtgtggcgttgcgtggcgaatcttgccaactatttccggcggcttggtcgcctccggtcgcgaggtgacgtttactgttcgccgtggtttttggtctgggtgtgttgctgccgtagtcggcggggcgagaggtgagagacacgtctgtctgtgtacgtcagctagacgaaaatattttgtgcgccaagcgcacaaagctaaacggctcgaaatatagatatatacattgtcgcgaatcggcaggagaattctgtccacatcggctccgtggcgagcggcttccttttgaagttctgcgcgacgtacctctgcttgcgcctcgaccgcggaaaagatgggcctcacgatcagcagcttgctaacccggctgttcggcaagaagcagatgcggatactgatggtgggtctggacgccgccggtaagaccaccatactctacaaactgaaactcggcgagattgtcaccaccatacccacgatcggtttcaacgtcgagacggtcgagtacagaaatatttgcttcaccgtgtgggacgtgggcggccaggacaagatccggccactctggaggcactactttcaaaatactcagggtctcatctacgtagtggacagtaacgatcgcgaacgtatcggcgaggcggaacgagaactggcgaacatgttgaaggaggacgagttgcgggacgcagtgctgttggtgttcgccaataagcaggatctacccaatgccatgaccgcagcagaactcacggataagctgggcctaaattcgttgagaggacgtcactggtacatacagagtacctgtgctacgcaggggcacggattgtacgagggtctggactggttgagtaacgagctagccaaaaagtgatagcgcctcactgtaaccggtatccttaaggacaacttattcatccaatatggacgtagaatgggcagaagtcactcaacaatttccatcttcaatcaaattgcatcatctataacagtatagtaatagtcatgtacagtttaacagtcgctgcgattataattgcttacagaaattggcgcaaatgaaaacagagaaaattaaagcggtctgtcgacttttttacctcctaggtacagtaaaattcatgtgaactgtgttccaaaagcgaaacttgtttcatggaaaagaaatgtgtgaaagcattaggataatatagatgttcttgcatcatttataagaatatatatagaggttgtacataagttcctttatacatacttatcattagatcaatggatgcattgccgactgtcaattctaattctgctttttgatacattgagtgacaaaatactgtctccatcaacagatttaattgcgaaaattttatttatttatatgttatattagacatataaaaaaatcattggatgacaatttattttctatattttactctacgtccgttcatcagaaatgacataatgtgtattatgtgatgttatatacacgggtcgtttgcactctttcttgttctaacagataagtaaatttttgagataaataattactagtttataaggcttatagataagtacttgattattatcatgaaaagaaataaaacttaatgatggtttttgagctgcaattttcatttttaataaaa

SEQ ID NO: 11253 - DNA, 984 bp, Gerbera hybrid cultivar
ctccaacgctcgcttgctttttgatcgacccctctcaaaaagctttatctcagggatccttaccagcaacaaaagggggctgacattcaccaaactatttagccggctctttgccaaaaaaaaaatgcaaattctgatggggggtcttgatgcagctggaaaaacaaccattttgtacaagctcaagcttggggaaatcgggacaacaatcccaaccatcgggtttaatgtggaaactgttgagtacaagaacatcagcttcactgtgtgggatgttgggggtcaggacaagattcgtccactatggaggcactacttccagaacacacaagggcttatctttgtggttgatagcaatgacagggatagagttgttgaggcaagagacgagttgcacaggatgttgaacgaggatgagctgcgagatgcagtgttgcttgtatttgctaacaaacaagatcttcctaatgcaatgaatgctgctgagatcactgacaagctcggcctccattccctccgacagcgccactggtacatccagagcacctgtgcaacctccggtgagggactttacgagggtctcgattggctctctaacaacatcgctaacaaggcataaggtgatgttgaactgtttgatgagggtagatcttggatgcaagttttgcttttatttggtcaccttcccccattctcgttcttctcttagctgtgtgcgattctgggatttcttcgttaaacaactttttctgttttctcgtagcaatgtgtttggttaaattgcaactaccttaaaagtattgtctaggttttgtttcttcatatgcctaaagttgtaacagaggttaattttgcttgttttatatgtttcttagaagtttcagtatccatgtggtagtatgctatgcttcgttcattttccatgatatttgataaataccattcaccatatgtttttaataaaatttgcttggttcatacctc

SEQ ID NO: 11254 - DNA, 824 bp, Bupleurum chinense
agtagtgttaaagatggggctgtcctttaccaaactcttcagccggctctttgccaagaaagaaatgcgcatactgatggtgggtctcgatgcagctaggtaaaacaaccatattatacaagctcaagctgggagagatagttacaacaattcctactattggatttaatgtggagactgtggaatacaagaacattagcttcactgtctgggatgttggaggccaggacaagatccgtcctttgtggagacattacttccaaaatactcaaggcctcatatttgtggttgatagcaatgatcgagatcgtgtagttgaagcaagagatgaactgcacagaatgcttaatgaggatgaattaagggatgctgtcctacttgtatttgctaacaaacaagatcttcccaatgcaatgaatgctgctgagattactgataagctaggccttcattctcttcgtcagcgccactggtatattcagagcacatgtgccacttcaggtgaaggtctatatgagggcctggactggctctcaaataacatagcaaacaaggcgtagacagcttttgattggagtttgactcttctaaggaagcagataagagttcttcaatatctcttgtttttgagatcttcatgacaatgggattgagtttctcatatttctcttcttccagagatgtgtaccatgtgtttatgttggcttctttactatgtttgaggtctcttaaaagttacgtatggtttcttctaggttcattataggtagtagtattactcatttcatgtgattctccatgtgaccatgtcgtccgacgacggt

SEQ ID NO: 11255 - DNA, 498 bp, Panax ginseng
gagaggatgcgcattctgatggttggcttggacgccgccggaaagacgacaattctctacaagctcaagctcggtgaaatcgtcaccaccatccccaccattgggttcaacgttgagaccgttgagtacaagaacatccagttcaccgtgtgggacgtcggtggccaggacaagatccgcccgctctggaggcattacttccagaacacccagggtatcatcttcgtcgttgacagcaacgatcgcgatcgtgttgtcgaggcccgtgaggagctccagcgaatgctcaacgaggacgagctccgggatgcccttctcttggtgttcgccaacaagcaggatttgcctaacgccatgaacgccgctgagatcactgacaagcttggcctccacagcctccgacaacgcgcctggtacatccagtccacctgcgccacatccggtgacggtctgtacgagggtctcgaatggttgagcaactcgctccgcaaggctggc

SEQ ID NO: 11256 - DNA, 623 bp, Pteridium aquilinum
taagactaccatcttatacaagctcaagctaggagagattgtcaccacaattcctaccattgggtttaatgtggagactgtggaatataagaacatcagtttcactgtgtgggatgttggtggtcaggacaagattcgtcccttgtggaggcattacttccagaatacgcagggtctcatctttgtggttgacagcaacgacagagaccgtgttgttgaggctagggatgaattgcatagaatgttgaatgaggatgagctgcgagatgcagtcttgcttgtatttgcaaacaagcaggatcttccaaatgcaatgaatgctgcagaaattactgataagcttggcctccattcccttcgacagcgtcactggtacatccagagcacctgtgcaacctctggtgaggggctttatgagggtctggactggctttcaaacaacatagctaacaaggcctgaagccattgagaagatttttgcaatatgggaaaatctggatgcaggggtgaatattatctagtttcttttctttctttctttttattaatatcgttctcctttccccctaacttttctatcttgagacagttggattgttgttatgcctttttctttggttgat

SEQ ID NO: 11257 - DNA, 689 bp, Castanea mollissima
tttccctcttactccacaacaatgggtttatcttttggaaattgtttgccagactctttggcaagaaggatatgcgtattttgatggttggattggatgctgctggtaaaaccaccatcctctacaagcttaagcttggtgagattgtaacaactatccccaccatcggcttcaacgtggagactgttgagtacaagaacattaacttcacagtttgggatgttggaggtcaagacaagatccgtcccttgtggagacattatttccaaaacacacaaggtttaatcttcgtggtggattccaacgacagggaaagaatcaatgaggccaacgaggaattgcaaaagatgctcaatgaggatgagctcagagatgccgtgctccttgtcttctgcaacaagcaagatttgcccaatgccatgagcgtagctgaggtcactgacaagcttggtttgcactcactccgcaacagaaagtggtacatccagagcacatgcgccacaagcggtgatggcctttacgagggcttggactggctttcaaacactctctcgtcctccaagtaaagtatgcgttgaagtgctgttaaattattttgtcgtgaagtattgattggtcaattgatgataacctctcccttttgtccaagtgatgattcccttgtattaattcttccaattgaaaacgtg

SEQ ID NO: 11258 - DNA, 447 bp, Ocimum basilicum
tgatgctgctggtaagaccacaatattgtacaaactcaagttgggagaaatagtgaccactattcctacaattgggttcaatgtggagacagtggaatacaagaacataagcttcacggtttgggatgttggaggtcaagacaagattcgaccattgtggaggcattacttccagaacactcaagggctgatttttgtggtcgacagcaatgatcgagatcgtgttgttgaggctagggatgaactgcataggatgttaaatgaggatgaacttagggatgctgtgctactagtgtttgctaacaaacaagatcttccaaatgctatgaatgctgctgagataactgacaaacttgggcttcactccctccgtcaacgtcattggtatattcagagcacctgtgccacctccggtgaagggctatatgaggggctcgactggctctc

SEQ ID NO: 11259 - DNA, 472 bp, Picea glauca
agaatcttgatggtcggtctcgatgccgccggaaagaccacaatcttgtacaaactcaagctgggcgaaattgtcactaccatccctaccatcggtttcaacgttgagacggttgagtacaagaacattcaattcacagtgtgggatgttggtggtcaggacaagatcagaccgctctggagacattacttccagaacacccaaggtatcatcttcgtcgtcgattcgaacgacagagatcgtatcgtcgaagcacgtgaagagctgcagcgcatgctgaacgaggatgagctgcgtgatgccctcctgctcgtctttgcgaacaagcaggatctgcctaacgccatgaacgccgcagaaatcaccgataagcttggtcttcactctctccgacagcgcgcctggtacatccagtcaacctgcgccacttctggagatggcctttatgaaggcctggattggctttcaaacg

SEQ ID NO: 11260 - DNA, 485 bp, Taxus baccata
gaatcctgatggttggtcttgatgccgccggaaagacaaccatcctatacaagttgaagctgggtgagattgtgactacgatcccaaccatcggcttcaacgttgaaacagtcgagtacaagaacatccaattcacggtgtgggacgttggtgggcaagacaagatccgacctctctggagacactacttccagaatacccaaggcatcatcttcgttgtcgactcgaacgacagagatcgtattgtggaggcccgcgaagaacttcagcgcatgttgaacgaggacgaactccgtgatgcccttctattggtcttcgccaataagcaggatcttcctaacgccatgaatgccgccgagatcactgacaaacttggtcttcacagtctacgacaacgtgcctggtacatccaatcgacttgcgctacctctggtgatggtctctacgaaggactcgaatggctcagcaactctctacgcaaggca

SEQ ID NO: 11261 - DNA, 480 bp, Taxus baccata
agaattttgatggtcggattggacgccgccggaaagaccaccatcctctacaagctgaagctcggtgaaatcgtcaccacgattcctaccattggtttcaacgtcgaaacagtcgagtacaagaacatccagttcacagtgtgggacgtcggaggccaggacaagatccgtcctttgtggaggcattacttccagaacacccagggtatcatcttcgttgtcgacagcaacgatcgtgatcgtgtggtcgaggcacgcgaggagctgcagcgcatgctgaacgaggacgagctgagagatgcgcttctcttggtctttgccaataagcaggatttgccaaacgccatgaacgctgctgaaattaccgacaagcttggtctgcacagcttgaggcaacgcgcttggtacatccaatcgacttgcgctacatctggtgacggtctctatgaaggtctcgagtggctcagcaactcgctgcgc

SEQ ID NO: 11262 - DNA, 728 bp, Allium cepa
atcttgtataagctcaagcttggtgaaatcgtcactaccattcctacaattggatttaatgtggagactgtggaatacaagaacattagttttactgtttgggatgtcgggggtcaagataagatcagacctttgtggaggcactacttccagaatacacagggcctcatctttgttgttgatagtaatgatagagatcgtgttgtcgaggcaagggatgagctccataggatgctaaacgaggatgagttgcgggatgctgtactgcttgttttcgcaaacaaacaggatcttccaaatgcaatgaatgcagctgaaatcactgacaagcttggcttgcattctctccgtcaaaggcactggtatatacagagcacttgtgctacatctggagaaggattgtatgaaggtctagattggctctctagtaacattgccagcaagggttgaaaacttggaagggatagccgagtatgtaacccggggatgaagaggacttgtaatattttaaactttttatattaaagtggttattacatgtttgatcaatatttgtgttgtttcttgtacttattcagggttgattataaattcatttcatgcagttttattatattatagtatttgatatattgttactgataaactgttgctgttgattaattttgttcattttggtttggttgtatgcttgtagaatgagcatgatttcatgataaaacacacac

SEQ ID NO: 11263 - DNA, 710 bp, Cenchrus ciliaris
tcctctacaagctcaagctcggcgagatcgtcaccaccatccccaccatcggattcaatgttgaaactgtggagtacaagaacatcagcttcaccgtttgggatgtcgggggtcaggacaagatcaggccgctgtggaggcattacttccagaacacacagggtctcatctttgttgtggacagcaacgatagggaccgtgttgttgaagccagggatgagctccaccggatgctgaatgaggatgaattacgtgatgctgtgttgcttgtgtttgctaacaagcaagatcttccgaatgctatgaacgctgctgagattactgataagcttggactgcactcacttcgccagcgtcactggtacattcaaagcacttgtgctacatctggtgagggattgtacgaaggcctggactggctgtccagcaacattgccagcaagtcttaaattttcaagaggtttggatcatctaggagcttttggatgatgatattgctggatatttagggttgggttgatattcccgtatgtaaggtgtatgccctgagctcaatagttattgagcttggttaagatttcacagttaaaattgttttgtgtaatttgggcccttgagatgtttccgaaccaaacagctaaatagtgttccgttgagttaattggttggggaatgcgtgccggtatgcagcatcacattgctgttatgaa

SEQ ID NO: 11264 - DNA, 445 bp, Avena sativa
ccggaaagaccacaatcctctacaagcttaagctcggcgagatcgtcaccaccatccccaccatcggattcaatgttgaaactgtggagtacaagaacattagcttcactgtttgggatgtcgggggtcaggacaagatcagaccactgtggaggcattacttccagaacacacagggtcttatctttgttgtggacagcaatgatagggaccgtgttgttgaagctagagatgagctccacaggatgctaaatgaggatgagttgcgtgatgctgtgttgcttgtctttgccaacaagcaagatcttccaaatgctatgaatgcggctagaattactgataagcttggattacattcccttcgccagcggcactggtacatccagagcacctgtgctacatctggtgagggtctgtacgagggcctagactggctttccagcaa

SEQ ID NO: 11265 - DNA, 745 bp, Triticum aestivum
cccgacacccatcctctacaagctcaagctcggagagatcgtcaccaccatcccaaccatcggatttaacgtcgaaactgttgaatacaagaacatcagcttcactgtttgggatgtggggggccaagacaagatcaggcccctgtggaggcactacttccagaatacgcagggcctcatttttgttgtcgacagcaatgatagggaacgtgttgttgaggctagggatgagctccacaggatgctgaatgaggatgagctgtgtgatgctgtgttgcttgtatttgcaaacaaacaagatcttcctaatgccatgaatgctgctgaaatcaccgacaagcttggtctgcactccctgcgccagcggcactggtacattcagagcacttgtgcaacgtctggcgaagggttgtacgagggacttgactggctctccaacaacattgccaacaaggcttgaagcgtctcgacaagtgcttcatcaagaaacaaacgtgctggatgtctcaacaactcactgctaccattttacatattgtgatatatatacactgcacaagagatagtatgtgtgcgtatgtgacaggcagaagctcccttctttaagtgagctagtatcaggtcaggttgtcttttttgtatggatattatcagctgctgttcggtggttttcaaggtttaatgtgtcgacaatgtgtgtctgaacccctatcttttgagttttagtaagattggattatggttg

SEQ ID NO: 11266 - DNA, 448 bp, Cirsium arvense
tttgtacaagctcaagcttggtgagatcgtgacaacaatccctaccattgggtttaatgtggagactgtcgagtacaagaacatcagcttcaccgtgtgggatgttggtggtcaagacaagattcgtccactatggaggcactacttccagaacacacaggggcttatctttgtggtcgatagcaatgaccgtgaccgtgtggtggaagctagagacgagctgcacaggatgcttaatgaggatgaactaagagatgcagtgttgcttgtgtttgccaacaaacaagatcttccaaatgctatgaatgctgctgagatcactgataagcttggcctgcattctctcagacaacgacactggtacatccagagcacatgtgccacctctggagaaggtctatatgagggactggattggctttccaacaatattgctggcaaggcataa

SEQ ID NO: 11267 - DNA, 2159 bp, Oryza sativa
ggggaaacccatccattcccccccaatccctcgcgccgctccccttcccccactcaccaatggccgccgccgccgccgccgcgtcaacgtcgcgcctcctcctcctccgccaccaccaccacgccgccgccgacgggtcgaagcagcagcagcagctcaggtattcctccaagccgtcttctctcgctctgccccggctgcgccttttgccggcggccggggcgctgctgcccgaccgggtcaccccgttctcctacgaggaggacgacgagtccgacgaccacccgcgcgaggagtgcgggctggtcggggtcgtgggggaccccgacgcgtcgtcgctctgctacctcgggctgcagaagctgcagcaccgcggggaggagggtgccgggattgtcgccgtcgggggtgacgggaagctcaagtcggtcaccgggctcggcctcgtcgccgacgtgttcggtgaccccgcacggctggcatcgctccccgggccagccgccatcgggcacgtgaggtactccaccgccggcgccgccgcgtcgctgcggaacgtgcagccgttcctggccgggtacaggttcgggcaggtcgccgtcgcgcacaacggcaacctcgtcaactaccaggcgctgcggaacaagctggaggcgaggggctccatcttcaacacctcgtcggacacggaggtcatcctccacctcatcgcgacgtcgctgtcgcggccactgctgtcccgcatctgcgacgcgtgcgagcgcctcgcgggggcctactcgctgctgttcctgacggccgataagatgttcgccgtgcgcgacccgcacgggttccgcccgctggtgctcggccgccgccgcaacggcaccgtcgcgttcgcgtcggagacttgcgcgctggacctcatcgaggcgacctacgagcgcgaggtggagcccggggaggtggtcgtcgtcgaccgccgcgacatgtccgtctcctcagcgtgcctcgtcccgcaccgcccccgccgctcctgcgtcttcgagcacatctacttcgccctcccaaactccgtcgtcttctcgcacgccgtccacgagcgccgcaccgccttcggccgcgcgctcgcggaggagtcccccgccgcgggcgccgacgtggtcatcccggttcccgactcggggttctacgccgcgctcgggttcgcgcgcgcgtcggggctggagttccagcagggcctcatccggtggcactacagcggccgcagcttcatccagccgacgcaggcgatccgcgacctcgccgtgaagctcaagctggcaccggtccacggcgtgatccgcgggaagagcgtggtggtggtggacgactccctggtgcgcggcaccacctcgagcaagatcgtgcggctgctccgcgacgccggcgcgcgcgaggtgcacatgcggatcgcgagcccgccggtggtgggctcgtgcctgtacggcatcgacacgcccagcgagggggagctcatctccaaccggatggatctcgagggcgtccgccgcgagatcggcagcgactcgctcgccttcctctcgctcggcaagctccacagcatctacggcgccgaggcggagggctactgcgacgcctgcttctcgcgcaactaccccgtgctgcccacgctgcccgagccggtcgtagagctcgaggagtgaactggtcacactggtgagtgagtgagtgatcgagtaggtcagctctgctctgctatgctctacggcttctctgcatccgtcgtaatgttaggcaatggatcagaatttgtatggacatggaattttggtgctactactacttcagtatatttgatcagggcaatttttatccggtgttgaattactatttcgagaggggataaagggataaagctccagtgtctgtttgagggatccggctcctctgcctttgtaggcatcagaggatccaaatccctgtttgagtgtatgtttagctccagtgctttacacgttttatgctgtggtggcttgagagtcgagaacatcagatgcttgtgtgccttgagctactggcagttattatcccatcaatttctgagactttgccatgattgaaggagtctccacgcgatttttaaaatcttactaatgctgaactttccacgatttaag

SEQ ID NO: 11268 - DNA, 2415 bp, Triticum aestivum
ccagagtacaaaatgacgacgggagtcaaaatatcgtggattcactcgtgcgtagggcatacggcctccacacgcctggcggcgacctctttaaatcctgtccgttcacgcgccttcgggagggcatcctcgagagccctcaccctcccaatcccgccgcgctccagggatggccgccgccgccgccgccccgcccgccacgccctcctcccgtcccctccgcgcgccccccgcgccgtccaccgtccatcgacagctcaggtgccacgccggccccagcccctcgctcctcgcgctgcgccaccgcgccgcccgcgccgcgccggcccgggccctgctcgacaaggtcacgcccttcaacttcggcgaggaggaggacgacggcggcgatgaccacccccgcgaggagtgcggcgtgttcggcgtcgtgggcgacccggaggcctcgtcgctgtgctacctgggcctgcagaagctgcagcaccgcggggaggaaggcgccggcatctgcgccgccggggacgacggcaagctcaagtccgtgacggggctggggctcgtcagcgacgtcttcagggacccggcgcacctcgggagcctccccgggcaggccgccatcggccacgtccgctactccacctcaggcggcgacgcccagctgtgcaacgtgcagccgttcctcgccgggtaccggttcgggcagctcgcggtggcgcacaacggcaacctggtgaactacctgccgctgcgccacaagctggaggcgcagggctccatcttcaacaactcgtcggacacggaggtcatcctccacctcatcgccacgtcgctctcgcgcccgctgctcgcccgaatctgcgacgcctgcgagcgcctccagggcgcctactcgctgctcttcctcacggccgacaagctcttcgccgtgcgcgacccgttcggcttccgcccgctggtcatgggccgccgccccaacggcgccgtcgtgttcgcgtcggagacctgcgcgctggacctcatcgacgccgtgtacgagcgagaggtggagcccggggaggtgatcgtcgtcgaccgccgggatatgtccgtgtcctcggcttgcctcgtcccgcaccgcccgcgcaagtcgtgcgtgttcgagcacatctacttcgcgctgcccaactccatcgtgttcgggcacgcagtccacgagcggcgcaccgcctacggccgtgcgctcgccgaggagtcccccgccccaaccgccgacgtggtcatccccgtgccggactctggcttctacgcggcgctcggcttcgcgcaggcctcggggctcgagttccagcagggcctcatccggtcgcattacacgggccgcagcttcatccagccgacgcaggcgatccgcgacctcgccgtcaagctcaagctcgcgccggtgcgcggcgtcatcacgggcaagagcgtggtggtcgtggacgactcgatagtgcgcggcaccacgtcgagcaagatcgtgcgcctgctccgcgacgccggggcgcgcgaggtgcacatgcgcatctccagcccgccggtggtgggccgatgccactacggcatcgacacgccggacgagaaggagctgatatccaaccggctggacgtcgagggcgtgcgcgagatgatcggctgcgactcgctcggcttcctgacgctggacaagctgcacagcatctacggcgacgaggcggacgagctctgcgacgcctgcttctcgcggaactacccagtgcctatgccggagaaggtgccggcgatggcatccgccgatgatgaagactgaccagaatgtgcgactagggaacggcatccgcatctgtactccgcatgcttctataggattttcggcgtggcgaactgtgtcgtggcaattgcattcttcatctgaatttttgcaggtcttaagtttgtatcgctgagcggctagcgttccatggcctctcaaattcgaggtttctaaacctttttcttgggtcaatttatatactgtaagaaaggttgacaagtcagacatctaatattgtttcgtcgtcgacgtgaattgctaatgaattgcatttttcaagctcctgtgattcgggagcatttctattagttacatctgcaaagccaagcaaaaaattcatgtggaggtagtgttagttgtgtactgacggtgtggaacctgcgcattgctgattttgagtcaacgatgtaactagatagaagtcaaccggcaacattcctagcttggacactaaaccaacttgcatctggaaccaagtaagtgagcatgacattgacatgtatcatgagtcgagtgtaatcttggctacaacgaatatgttgtacggtagctagctgcttatgctgtcaggatttgctagtctgatgcttctgcttcagctctca

SEQ ID NO: 11269 - DNA, 1901 bp, Saccharum officinarum
agcaaaagcaaccagtagttgagcacaagcaagtatttgtttcagagtgagagtgctagtggtacctggcggctggtcgaaggaaaagcaagaaatggcctctctacctgccagcggcgctgcgggtggcgattcagaccagcttttggtagaagcagatggctcgacaaggacacttattttgaataggccaaagaagctgaatgcactctcctccacaatgattaagggactcctaaggtgttttgctgcttatgagaaagatgatggagttaaactgttgattatgaaggggaaaggaagagcattttgtgctggaggtgatgttactgcttgtctccagtctgtgcaaaatgaaagctggaagtggggtgctgatttcttccacgatgaatattttttaaactacataattgcaacatatatcaaacctcaggtttctcttcttaatggaattgtcatgggtggaggagctggtatttctttacatggaagatttcgagttgtcactgataacacggtttttgcaatgccagaaacagctttgggtcactttcccgatgtaggagcctcatattttttgtctcggcttcctggcttctatggagagtatgttgctcttgctggtgccagattggatggtgaagaaatgcttgcatgtggtctggcaactcattttgtccagtcaaataggctactattgctggaagaatcgcttaaaaaactggatacctccaatacttctgatgtgtgtggcaccatcgatcagtttgctcaacagccgtcactgaaagaaaacagttccttgtataggatggaaatcatcaacaaatgctttgctaaaaggacagttgaagaaattatatccactcttgagcaagtagcctcaaatttggctgatgaatgggttgctacgacaattcagtgtttgaaacaggcttctcctactagtctgaaaatcactctgagatcgataagagaagggagaacacaaactgttggggagtgcttacatcgggaatatagaatggcctgccatgtcttacgtggtgatttcagccgagactgctatgagggatacaggtctatacttgtagataaagatcgaaaaccaatgtggatgcctccgaggttggaacaagtgcatgatgaggcagttgaagaatatttctcaagaattgatgatccacaatgggaagatttgaacctacccgccagacattccaacggaataattattgagtccaagctttgatggaagtctttggcgaagagtttaatggagcttcggttgtagtcaaaataaaacatcatgtcatgtttgcagagtttgtgtagattgaagactgctgctgaaacaaaacagaatatgttggtaaaggaccccatctgcaatggatcctaccccaatgatgccgccgcacctagagggcaacactacactgactatctaccgtccatcaccaaagaggcaagggatgctacaccaactaactacctgcaaacaccgacgaggaaggagatgctacaccaactacctaccggcgaatgctgatgaggaaggtgatgctgcaccgactacataccggcgaacaccgacgaggaaggcgacgctacaccaactatgtgccgatggacaccgacaagtcaggcgaagctacaccgactccatatctacttcaacattacacaagccggagccgatgtgatgatgacacggcggacttgccggtggagtatcgatgttcgttgatgctgccgaattgctgcgagtggagcggcgggatgacgatcttccaaatgagaacttcttccagctcatcctcccaacaaggattccgaattttgagtccaccgaaccaaacttccaatttggttaatcttcggatgcattctcttgt

SEQ ID NO: 11270 - DNA, 1565 bp, Setaria italica
gcagcagtcttctcgttttcctcctccggcgtcccgtccctgggagcctccagcgccatcctcgggcccgcttgcctgcacctcccgaggaaggaatggcctcgcttcctcccgccggcgccgcgggcgccgactccgaccagcttttggtagaagcaaatgattctacacggacactgattttgaacaggccaaagcagctgaatgcactctcctccgcaatgattatgggactcttgaggtgtttcactgcttacgagaaagatgatggagttaaattgttgattatgaaggggaaaggaagagcattttgcgctggaggtgatgttgctgcagttgtccgggctataaacaatggcagctggaaatatggtgctgatttcttccgaaatgagtttttgttaaactacatcattgcaacgtatagcaaacctcaggtttctcttcttgctggaattgttatgggtggaggcgcaggtgtttccttacatggaaggtttcgagttgtgaccgagaacacggtttttgcaatgccagagacagcattgggactctttccagatataggggcttcttattttctgtctcggctacctggtttctatggagagtatgttgctcttgctggtgcaagattggatggtgcggaaatgcatgcgtgtggtctggcaactcattttgtccagataaataggctgccatcactggaggaatcacttaaaaaggtggacacctccaatccttttgttgtgtgtggtattattgatcaatttgctcaacagccatcactgaaagaaaacagctctctgaacaggctggaaatcatcaacaaatgcttttccaaaagaacagttgaagaaatcatatctgctcttgaacaagaaacttcaaattcggcagatgaatggattgcttctacaatccagtccttgaaaaaggcctctcctaccagtctgaaaatctctctcagatcgataagagaagggagaatacaaactgttggggagtgcttgcgtcgggaatatagaatggtttgccatgtcatgcgtggtgacttcagccgtgacttctttgagggatgcagggctatactggtagataaagatcgaaacccaaagtggatgcctccaaggttggaacaagtgcatgatgaggcggttgaacaatatttctccagaatcgatgacccacagtgggaagatttggacctacctgcaagacgttcctatggaagaattattgagtccaagctttgattggaagtatcacactgctgataaaataaaagctgaacatatcttgtaggtcaaacttctgtcacacaagaaattctattgtttattgaagagagctgtggctattttaaaatcggtggaaaactttttctcgtagtcagatcttgcttaagctggtgtgttatcgcctcatcgcgtcatcatcgttgtgatcttctacccaatttcaagaggggctcctatgtaacatccgtgtgctggataagcaacatggttttaaagtccattagaccataagctcaccttataaataaataaatttaacatttc

SEQ ID NO: 11271 - DNA, 1469 bp, Sorghum bicolor
cctcttcgcagttcgcacccttcccattcgagggccccctccattgccgtcctcgagcagcttgcccgtccgcggaagcggatggcctcgatgcctcccccaagcgctgcgggcgccgactctgatcagattttggtagaagtgaatggctttacaaggacactgattttgaataggccaaagcagctaaatgcgctctcctcaaccatgattatgggactcttgaggtgtttcactgcttacgagaaagatgatggagttaaattgttgattatgaagggtaaaggaagagcattttgtgctggaggtgatgttgctggagttgtccgatctatacataaagacagctggaaatatggtgctgatttcttccgaaatgaatttttgttgaattacataattgcaacttataccaaacctcaggtttctcttcttactggaatcgtcatgggtggaggtgctggtgtttctttacatggaaggtttcgagttgccactgataacacggtttttgcaatgccagaaacagctctcggtctctttccagatataggggcctcatattttctgtcccggcttcctggattctatggagagtatgttgctctcgctggcgccagattggatggtgtggaaatgcttgcatgtggtctggcaactcattttgtccattcaaataggctgctattgttggaagaatcacttaaaaaggtggatacttccaacacctttgctgtgtgtggtatcatcgatcaatttgctcaacagccatcactgaaagaaagcagctcattgaataggttggaaatcatcaacaaatgcttttccaaaaggacagttgaagaaattatatccgctcttgaactagaggccacaaatttggcagatgaatgggttgccacgacaatccagtccttgaaaaaggcttcacctaccagtctgaaaatctctctgagatcgataagagaagggaggacacaaactgttggggagtgcttgcagcgggaatatagaatggtttgccatgtcatgcgtggtgacttcagcagagacttctttgagggatgcagggcaatattgatagataaagatcgaaacccaaagtggatgcctccaaggttggaacaagtgcatgacgaggctgttgaacaatatttctccagaattgatgatccacagtgggaagatttgaacctaccacccagacgttcccatggaagaaacatcgagtccaagctttgattgaaggttacgggagaagggtggaacactggaacggggcatcggtagtggtcagaataacacattattacacatcatctcaagtttggagagtctgcagataaaataaacctgaatgtgccatatagatcaacttttatcacagtagaaactcatttctgtttatacgtggaattgtattcatttttaaataatatagcatttgcaaaaaaaaaagtaattggtgg

SEQ ID NO: 11272 - DNA, 1302 bp, Pennisetum glaucum
gtctactccggactccctgccgtccctggagcctccagcgccatcctcgcgcccgcttgcctgcagctcccgaggaaggaatggcctcgcttcctcccgctggcgccgactccgaccagcttttggtggaagcaaatggctctacacggacactgattttgaacaggccaaagcagctgaatgcactctcatctgcaatgattatgggactcttgaggtgtttcactgcttacgagaaagatgatggagttaaattgttgattatgaaggggaaaggaagagcattttgtgctggaggtgatgttgctgcagttgtccgggctataaacaatggcagctggaagtatggtgctgatttcttccgaaatgagtttttgttaaactacatcattgccatgtatagcaaaccccaggtttctcttcttgctggaattgttatgggtggaggtgcaggtgtttccttgcatggaaggtttcgagttgcaaccgagaacacggtttttgcaatgccagagacagcattggggctctttccagatataggggcttcttattttctgtctcggctacctggattctatggagagtatgttgctcttgctggtgcaagattggatggtgcggaaatgcatgcgtgtggtctggcaactcattttgtccagataaataggctgccatcactggaggaatcacttaaaaaggtggacacctccaatccttttgttgtatgtggtattattgatcaatttgctcaacagccatcactgaaagaaaacagctctctgaacaggctggaaatcatcaacaaatgcttttccaaaagaacagttgaagaaatcatatctgctcttgaacaagaaacttcaaatttggcagatgaatggattgcttctacaatccagtccttgaaaaaggcctctcctaccagtctgaaaatctctcttagatcgataagggaagggagaacacaaactgtcggggagtgcttgcgtcgggaatatagaatggtttgccatgtcatgcgtggtgacttcagccgtgacttctttgagggatgcagggctatactggtagataaagatcgaaacccaaagtggatgccaccaaggttggaacaagtgcatgatgaggctgttgaccaatatttctccagaatcgatgacccacagtgggaagatttggacctacccgcaagaccttcctatggaagaattattgagtccaagctttgattgaaaagtatcacactgctgataaaataaaatctgaatgtgtcaaacttgtaatacagaagaacctatt

SEQ ID NO: 11273 - DNA, 1411 bp, Echinochloa colona
ccagtcttctcgtctccctcctccgcgtgccgtctcgtcccgtccccttcggagcaggcctccactaccgtgctcgggccgcttgcctgctccgcccgagagaaggaatggctccactgcctcccgccggcgccgactccgaccagcttttggtagaagcaaatggctctacacgaacactgattttgaacaggccaaagcagctgaatgcgctctcatccgcaatgattacgggactcttgaggtgtttcactgcttatgagaaagatgatggagttaaattattgattatgaaggggcaaggaagagcattttgtgctggaggtgatgtggctgccgttgttcggtctataaacaatggcagctggaactatggtgctgatttcttccgaaatgaatttttgttaaactacataattgcaacctatagcaaacctcaggtttctcttcttgctggaattgttatgggtggaggcgctggtgtttctttacatggaaggtttcgcattgcgactgagaacacggtttttgcaatgccagagacggcattgggactctttccagatataggggcttcttattttttgtctcggcttcctggtttctatggagagtatgttgctcttgctggtgcaagattggatggtgcggaaatgctcgcgtgtggtctggcaactcattttgtccagttaaatagtctgtcatcactggaggaatcacttaaaaaggtggacacctctaatccttttgctgtgtgtggtattgtcgaccaatttgctcaacagccatcactgaaagaaaaaagttctctcaataggctggaaatcatcaataaatgcttttccaaaagaacagttgaagaaatcacatctgcacttgaacaagaaaattcaaattcaagtgatgaatgggttgctgctacactccagaccttgagaaaggcctctcctaccagtctgaaaatctccctgagatcgataagagaagggagaacacaaaactgttggggagtgcttgcgtcgggaatatagaatggtttgccatgtcatgcgtggtgacttcagccgtgacttctttgagggatgcagggctatactggtagataaagatcgaaacccaaagtggatgcctccaagattggaacaagtgcatgatgaagctgttgaacaatatttctccagaatcgatgatccacagtgggaagatttgaacctacctgacagacgttcccatggaagaaatatcgagtccaagctttgattggaaatattaggcgaagtgtttgaacttgaatggagcctccttcctacaactactgataaaaataaagctgaacatgtcttataggtcaatttttattacagaagaaactcattgttgtttattgaataaagctgtgcccattttagaa

SEQ ID NO: 11274 - DNA, 1455 bp, Panicum virgatum
gagactccaccaggcaccagtcttctcgtcttcctcctccggcgtcccgtcccctcccagcgccgtcctcgagccgcttgcctgccccgccgaagggcggaatggcctcgctgcctcccggcgccgactccgaccagcttttgatagaagcaaatggctctacacggacactgattttgaacaggccaaagcagctgaatgctctctcctcctcaatgattatgggactcttgaggtgtttcactgcttacgagaaagatgatggagttaaagtgttgattatgaaggggaaaggaagagcattttgtgctggaggtgatgttgctgctgttgtccgggatataaacaatgacacctggaaatacggtgctgatttcttccgaaatgaatttttgttaaactacatcatcgcaacttatagcaaacctcaggtttctcttcttgctggaattgttatggggggaggtgctggtgtttctttacatggaaggtttcgagttgcgaccgaaaacacggtttttgcaatgccagagacagcattgggactctttccagatataggggcttcttattttctgtctcggctacctggtttctatggagagtatgttgctcttgccggtgcaagattggatggtgcagaaatgcatgcgtgtggtctggcaactcattttgtccagttaaataggctgccgttactggaggaatcgcttaaaaaggtggacacctccaatccttttgctttgtgtggtattattgatcaattttctcatcagccatcattgaaagaaaacagctctctgaataggctggaaatgatcaacaaatgcttttccaaaagaacagttgaagaaatcatatatgctcttgaacaagaaacttcaaattcggctgatgaatgggttgcagctacaatccagtccttgaaaaaggcctctcctaccagtctgaaaatctccctgagatcgataagagaagggagaactcaaactattggggagtgcttacgtcgggaatatagaatggtctgccatgtcatgcgcggtgacttcagccgtgacttttttgagggatgcagggctatactgttagataaagatcgcaacccaaagtggatgcctccaaggttagaacaagtgcatgatgcagccgttgaacaatatttctccagaatcaatgacccacagtgggaagatttgaacctacctgccagacgttcccatggaagaaatgttgagtccaagctttgattggaggtattaaggaaaagagttgaacggagccttggtgtccgtctagaataacaatcgtcttgtgtgatgagtcctgactacgactactgacaaaataaagcttaatatgtcttgtaggtcaaacttttactgcatcaaaattttaaaaaaacttttatgacagaaaaaactcctttattgaaggaatccatgccatttagta

SEQ ID NO: 11275 - DNA, 1353 bp, Ricinus communis
agcccaagaaaacaacagtcagtacagctctctctttctctctctagctgtatctcaccagctttctcttcagttctcctaagtctcaccgctatcattcactcgcctttctcgtcctgatcatggctcctgagcttgttcatgctgcactaaaacccgccagtttcaccaaacctcccactttgcccagccgggcttatgttactttcttggctggcaatggagattacattaaaggcgttgttgggttggctaaaggtttaagaaaagtcaaaactgcatacccattagtggtggcagtcttacctgatgtccccgaggagcataggaagattctcgagtcacaaggctgtatagtccgagagatcgaacccgtttacccacccgaaaaccagacccagtttgccatggcatattatgtaattaattactctaagctccgtatatgggagtttgtcgagtacagtaagatgatatacttagacggggacatccaggtttttgataacatagaccaccttttcgatttgcctgatggacatttctacgcagtaatggattgcttctgcgaaaaaacatggagccacactccacaatataagatcggctactgccagcagtgccccgacagagtcaagtggcctgccaagttaggtcagcctccatctctctatttcaatgccggaatgtttgtgttcgagcctagcatctccacttaccatgatcttctaaagaccgtccagatcacacctcctaccccctttgcggagcaggatttcttgaacatgtactttagggatatttataagccaattcctgttgtttataatcttgttcttgcaatgttgtggcgtcatccggagaatgttgagcttgacaaggtgaaagttgttcactactgcgcagcgggatctaagccatggagatatactggcaaagaagagaatatggagagggaggacataaagatggtggtgaagaaatggtgggacgtttacaatgatgaatcacttgactataagaaacagccagcggcagatggtgatgctgagccaatgaacttgcagccattcatcgcagctctctacgaggctggtgctgttcaatatgtcacagcaccatcagctgcttgaagatgcaagatgtcgatcagtagaagaggaaaagcaactaattgtagatgtagaaatgagagtcaaaaattccttttccacattgaaatggggtgatgatgatggtcatatatcatggaagaggaataagcccaacagaggcgtggatgttgggatgtatattctgttgttagcgtttgtgttagaaaatgtatgtaatctcatggaggaatggtgaatt

SEQ ID NO: 11276 - DNA, 1289 bp, Castanea mollissima
aaacataaacataaacacaacacacaaccttcattttaaagcttatcaccacctcacgtttgagtcttttttgggttttgaaatggctcctgagctagttcctgctgctgtgaaaccagctagctttagcaagcccgtacagaccatgtcgaaccgagcatatgtgactttcctagctggtaatggagactatgtgaagggcgttgttggattggccaaagggttgagaaaggtcaaaacggcctacccattagtcgttgcagtgttgcctgacgtgcctcaagagcaccgtcggattttggagtctcagggctgcatagtccgtgagatcgaacccgtttacccgcctgagaaccagacccagttcgccatggcctattatgtcatcaactactctaagctccgtatttgggagtttgtggagtatagtaaaatgatttacctggacggagacattcaggtgtttgacaatattgaccacctctttgatctacctgatgggcatttttatgctgtgatggattgcttctgtgagaaaacatggggtcacaccccacaatacaagattgggtactgccagcagtgccctgacagggtcaggtggcctgctgagatgggccagccaccttctctttacttcaacgctggaatgtttgtgtttgagcccagtctgtacacctatcatgacctcttaaagactgtcaaaatcaccactcctaccacatttgctgagcaggacttcttgaacatgtactttagggatatttacaagcctcttcctttaatttacaatcttgtacttgctatgttgtggcgtcatcctgagaatgtagaacttgacaaagttaaagttgctcactattgtgcaacggggtcaaagccatggaggtatacagggaaggaagagaacatgcagagagaggacataaagatgcttgtgaagaagtggtgggatatatacaacgatgaatcattggaatacaaaaggccagtaggggtggctgacggtgaagaggtgaaaatgcagccattcttggctgctctttcggaggctggtgctgttcagtatgtaacagcaccatcagcagcttagctagcttgggctttttaaggatgaattggacactaaaattactcagaaagttagaaatgtagttgaagtgagagagagttaatttgttaagaagaatatatattccttttttccttaagaaggatgtgaaaatgtgtcggggattagggaatgggaataagcttaattttgcttttttgctttgtctattttaatc

SEQ ID NO: 11277 - DNA, 1537 bp, Quercus alba
acaaaaaactcccacaagtctatagccatatcccaccgaacacacaaagcaaccaaaccctctctccctctctcacacacacactcacaaacataaacgcacacaaccttcattctaaagcttatcacaacctcgcgtttgagttttttatttttgggttttgaaatggctcctgagctagttcctgctgctgtgaaaccagctagctttagcaagcccgtacagaccatgttgaacagagcatatgtgactttcctagctggtaatggagactatgtgaagggcgttgttggattggccaaagggttgagaaaggtcaaaacggcgtacccattagtcgttgcagtgttgcccgacgtgcctcaagagcaccgtcggattttggagtcccagggctgcatagtccgtgagattgaacccgtttacccgcctgagaatcagacccagttcgccatggcctactatgtcatcaactactctaagctccgtatttgggagtttgtggagtatagtaaaatgatttacttggacggagacattcaggtgtttgacaatattgaccacctctttgatctacctgatgggcatttttatgctgtgatggattgcttctgtgagaaaacatggagtcacaccccacaatacaaggttgggtactgccagcagtgccctgacagggtcaagtggcccgctgagatgggccagccaccttctctttacttcaacgctggaatgtttgtgtttgagcccagtttctacacctataatgacctcttaaagactgtcaaaatcaccactcctaccacatttgctgagcaggacttcttgaacatgtactttaggaatatttacaagcctctccctttaatttacaatcttgtccttgctatgttgtggcgtcatcccgaaaacgtagaatttgacaaaattaaagtggttcattactgtgcagcgggatcaaagccatggaggtatacagggaaagaagagaacatgcagagagaggacataaagatgcttgtgaagaagtggtgggatatatacaacgatgaatcattagactacaaaaagccagtagaggtggctgatggtgaagaggtgaaaatgcagccattcttggctgctctttccgaggctggtgcggttcagtatgtaacagcaccatcagcagcttagctagcttgggcatctaaggatgaattggacactaaaattactcagaaagttagaaatgcagttgaagtgagagagttaatttgttaagaagaatatatattccttttttccttaagaaggatgtgaaaatgtgtcggggattagggaatgggaataagcttttgctttgtctattttaatctttttgttggtgccgtagtcctttcctaaatgaatgtttataatgtgtgctgtagagccttgcaatagttaaatatgaatacatgtgttttttacttgcctttttttctctgggttggtgtgacattgtgggcttttaagagcatctttagctaaatttattaaattttgtattgaatgt

SEQ ID NO: 11278 - DNA, 1539 bp, Cajanus cajan
ttcaccatccaaacacacaacaacctctgcatcattttctcactcttttcaacctctcttcaatcctcactgtacacttttcactactcttaaatccagaacaccaacatggcccctgagcttgtccccaccctggcgaaatccggtgccgccttcaccaaacccgcgactctggcgaggcgcgcctacgtcacattcctcgccggaaacggtgactacgtgaaaggggtcgttggcctcgccaaagggctgcgaaaggtgaaaacggcgtaccccttggtggtggccgtgctccccgatgtgccgcaggagcaccgtaacatcctggagtctcagggctgcatcgtccgtgagatcgaacccgtttacccacccgaaaatcagacccagttcgctatggcctattacgtcatcaactattccaaactccgtatatgggagtttgtggaatatagcaagatgatatacttggacggagatattcaggtatacgagaacatagaccacttatttgatcttcctgatgggaacttttacgctgtgatggactgcttctgcgagaagacatggagtcacaccccgcagtacaaggtggggtactgccagcagtgtccggagaaggtccagtggcccactaaattgggcccaccaccttctctttacttcaacgcgggcatgttcgtgttcgagcccagcttggacacctaccacgacctcttgaagacggtgcaagtcaccactcccacatcgttcgcggagcaggacttcttgaacatgtacttcaaggacatttacaagcccattcccttggcttataaccttgtcctcgctatgctgtggcgccaccccgagaatgttaaacttgaccaagtcaaggtcgttcactactgcgcagcggggtcgaagccgtggagatatacggggaaggaagagaatatgcagagggaggacataaagatgctggtgaagaaatggtgggatatctataacgactcttcccttgattacaaggggttgagtggaagtgaagacatggagccattcgtgcaggctctatcagaggttggtcatgttcaatatgtgacagcaccctcagctgcttaagatgagtttgtggacattcattgttgtgatgaaaaataaaaagttagagaaggaggagaagtaggtgggaagtgcaaggaagactttgcggtgaaaacaagggaggtttctttctttgtttttgttgtagatagagggaacggtcgtggattgctttggaaaggagctctccaccttttatatttgtttctctttttgagaatttcttagcgtctggtaattaattaaggttggagggtctcttcataagagtctggatctggtctttggcttcacgtatgtgttaatatatgtatttctgtgttccttgttttttcttttctttttgttgggactttgccattgtaataattctaaggcaatgcttaatgattaagggaattgttgaacgaaactatatgtctactttgatggtaaaaggattccttgtctgtt

SEQ ID NO: 11279 - DNA, 1397 bp, Prunus mume
tctctgcctctctcgccatctccagctagctctctctctctctctagctttgcaagggtcaaggccttcttcctctatcaacctcgttcccttctcccttggacacgtcactaccacacaatggctccagtactcgtccccaccagcgtcgctaagtcgggtttcaccatacccgccaccctgccgagccgagcatacgtaacctttttggccggcaacggcgactacgtgaaaggcgtcgtcggattggccaagggattgaggaaggtcaaaacggcgtacccattggtcgttgcggtcttgcccgacgtccctcaagagcaccgtcgtattctggagtcgcagggttgcatagtcggagagatcgaacccgtttgcccgcccgagaaccagacccggttcgccatggcctattacgtaatcaactattccaagctccgaatttgggagtttgtggagtatagcaagatgatatacttggacggggacattcaggtgtacgacaatatagaccacctgtttgatctgccagacggccacttctacgcagtgatggattgcttttgcgagaaaacatggagtcacacgccgcagtacaagatcgggtactgccagcagtgcccggagaaggtgcagtggcccacatcggagctgggaccaccaccctcactttacttcaacgccggcatgtttgtgttcgagcccgacctcgaaacctaccatgacctcttgaacactctcaaagtgactcctcccaccccatttgcggagcaggactatctgaacatgttctttaggaaaatctacaagccaattcctttggcttacaatttggtcctcgcaatgttgtggcgacacccggagaatgtggagcttgacaaagtgaaagtggtgcattattgtgcagcaggatcaaagccgtggaggtacacaggcaaggaggagaacatggagagggaggacataaagatgttggtgaagaaatggtgggacatatacaacgacacgtcgttggattacaagaaaccatcggcaccaggagcaagagcagctgttgtgggcggtgctgaaggtgaaggggtgaacatgcagcccttcattgaggctctgtcggaagctggtgtggtgcaatatgtgactgccccatcagccgcttaagaagggtagacgtggagtgagtgaaaatatttagattcctttgttatgtttctttttccatggctgttaatgaactggatggaatcaaatgcttggggtcggggaaaagcaggttttgatgtttttgctttgtttcatcttcttttgtttctggttggacctgcgaggagatgcgggttgctgtgttctgttgatatatcttgtaccatatacataataatgtaatttttatgaagcga

SEQ ID NO: 11280 - DNA, 1441 bp, Arachis hypogaea
gaatcaccaacatagcattcagtaaaacaatcacgctaccaaacaaagcctaattcccttcctttctttttcttcaccatcaactatggcacctcctgagcttgttccaaccgccgctgctgcttccgccttcaccgcgaaaactgccaccacactccccaggcgagcctacgtcactttcctcgccggaaatggtgactacgtcaaaggtgttgttggactggccaaaggcctccgcaaggtcaagtcagcttaccctctggtggtggcgatcctccccgacgtgccggaggagcaccgtcagatacttgagtcacaaggttgtatagttcgcgagatcgaaccggtttaccctcctgagaaccagactcagttcgccatggcctattatgtcatcaactactccaagctccgtatctgggagtttgtggagtacagtaagatgatatacttggatggagacattgaggtatatgagaacatagatcacttgtttgatcttccagatggaaagttctacgctgtaatggattgcttctgcgagaagacatggagtcacagccctcaatacaagatcggttactgccagcagtgccctgacaaggtgcaatggcctgaagagttgggtcaaccaccgtccctgtacttcaacgctggcatgttcgtgtttgagccatccatggaaacttaccacgaccttctcagaaaactccagatcacacctcctactccctttgcggagcaggatttcctcaacatgtatttcaaggacatttaccagcccattcccttggtttataaccttgttctcgccatgctctggcgccaccctgaaaatgttgaccttgataaagtcaaagttgttcactactgtgcagcgggatccaaaccatggaggtatacgggaaaggaagaaaatatgcagagggaggacataaagatgttggtgaagaaatggtgggatgtctattatgatgcatcccttgattacaagaaaccgccgctatccagtgacgaagctgatccattcgtgcatgtactttctgaggctgccgaagttcactatgtcgcttcggcctcagctgcttagattcaacctcaacaaaatactcaaaatttcagaaaaaagaaaaaaaagagtggattagagttatagacagaagagtaggtgcaacaagtaattttattgctatactttgcggtcaaaagaagggaggttccttttctcaacatggacaagttgaaccgtcgctatgctgattgcaatcatggttattacttgattagttgattaagaggaagccctcaaccagtttatatttttgcggttattttccccttttttgtgtgggtttgttgggttggttatctaggatcaagggtctgtttatattggcgtggctttaatttggtcgttattttcatccaatattattaacta

SEQ ID NO: 11281 - DNA, 1332 bp, Eutrema halophilum
cacaaagaacgaacagaaaaaaaaattacttctctcaccacatttctctagatccttcgaaatcacgtgcttctcacatggctccggagcttacacaaaccaacactgctaaatccgccgttacgataactaaaccgccaccgcaaatctacggcggtgatcgagcttacgtgacatttctggccgggaacggtgattacgtgaaaggagtcgttggtttagccaaaggattaagaaaagtcaaatccgcgcatccactcgttgtggcggtattaccagatgttccggaggaacaccgtcgattacttgtggaacaaggttgcattgtccgtgaaatcgaacccgtttacccaccggagaaccaaactcaatttgctatggcttattacgtcatcaattactccaaactccgtatctggaagtttgtggagtacagtaaattgatatatctagatggagacattcaagtttatgataacatcgaccacttgttcgatcttgacgatggctatttctacgcggtgatggactgtttttgcgagaaaacatggagtcacacgccgcaatacaagatcggatactgccaacagtgccctgaaaaggttcagtggccaaaggcagagcttggagagccaccggctctctacttcaacgccggaatgtttgttttcgaacctgatctcaatacttacgaggatcttttaaggacccttaaaatcactcccccaactcctttcgctgaacaggactttctgaacatgtatttcaagaaaatctacaagccaattcctttagtttacaatcttgtcctagcgatgctatggcgtcaccctgaaaatgtggaactcgataaagtcaaggtggttcactactgtgcagcgggttcgaagccatggagatacactgggaaagaaacaaatatggagagagaagacatcaaaatgttagtgaacaaatggtgggacatttacaacgatgattccttggattacacgaaatctgtggccgacctcgagagagactcagatatggtgaacctgaagccgtttatcaccgctcttactgaagctgggcgggtcaagtacgtgactgcaccgtcagctgcttgaatgtcaaaattgtttactagttgaattgggggttgtagtgtgttgcgtcgacaaccacacattctgcctcttgtttcatgtgcctttgcggttgacatgtgaatttgtatcgtctttgctttttagtctatgatgcaagctttcttgaattttttttttttatatggtatagtgttctgatgttcaaatttaaataacgagattaatatcttaaaagtaaaga

SEQ ID NO: 11282 - DNA, 1936 bp, Cicer arietinum
caactttgcatgatcaaatgtagccacaatttcatcacatcacaatcacaacttcttctcctaccagcaccttcatccctttattatatatatagcaacagcaactcctaccttccacaaatcacctaaccaatatcaaacaaacaaacttcctcttcaccattttctcaaacactttccctacatctctctcaaatttcattcactcacaaaaacacttcaaactcttttttttgcaacgatatggctccagaacttgttccaaccgcagcaaaatcagttaccgggttcacgaagcccgcgactataccaaaacgtgcattcgtaacatttcttgccggtaacggtgattacgtgaaaggcgtaattggtcttgccaaaggtttacggaaggtgaaaacggcgtatccgctggtggtagccgtgcttccagatgtaccggaggaacaccgtgagatgttggagtctcagggatgtattgtccgtgagattgaacccgtttacccacccgaaaatcaaacccagtttgctatggcttattacgtcatcaattattccaaactccgtatatgggagtttgtggaatacagcaagatgatatacttggacggagacattcaagtttatgaaaacatagatcatctctttgatctacaagatggttacctatacggtgtgatggattgtttctgcgagaaaacatggagtcacacgccacaatacaaaattggttactgtcaacagtgtccaaataaggtacaatggccaaaggaaatgggtcaacctccttcactttacttcaatgctggcatgtttgtgtttgaaccaagcattgaaacttaccatgatcttttgaacacacttcaagtcactcctcctactccatttgcagaacaagatttcttgaacatgtatttcaaggatatttataaaccaattcctttggattataacctagttcttgctatgttgtggcgtcaccctcaaaatgttgagcttcggaaagtcaaggttgttcactattgtgcagcgggatcaaagccttggagatatacagggaaggaagagaatatgcagagggaggacataaaaatgttggtgcagaaatggtgggatgtttacaatgactcttcacttgactatagcaagagcttgaatggaagtagtgaaacacaaaggaatgatgttgaaaatgagccattcgtacatgcgttgtcggaggttggtcatgttcaatacgtcactgccccttcagcagcttagactgagctgtttttttggtgtgtaacattcgtggaatgggagcaataaaataaagtaaggaatggatatgaaaataaaataaaaaaagaggatgagtgagtaggtgcaagactttgcggttaaaagaaggaaggattttattttttaagacaaggggtcggtgccaatagtagtagtcagatagtatatagctcatctgcttttgtgtgttctattttattttatttttcaagttttggaattttgacctttggttctgtttatatgtgtatgggatctggtttgtattttcatgtatatatataatattgtatttttattgtctttaatttttggtacatttttacttttgttttttgttattgtttttgcactatatgtatcaagggaaaatgttgtagcggatgaaatattcaattgtatggtgttaaccgtaaagggtctgttgtctatttcttgttaaattgtgggttgttttctatatttatagaattaatccacggtcaatttagtaggttggatttttgcttagtaaagcaatgtcttttgaattagttgcacaatgtttaaatatgtaaaatgtctatatgtaaacgtattcatgggattgggatttttatatgagaattaaagctacccatgtctgttattaggaaatgaacattaattttcg

SEQ ID NO: 11283 - DNA, 1466 bp, Nicotiana benthamiana
attcacccctacttcttcacctcttctccattttacttcacctctatatattacaccatatccccttgatcattttcttcaggccacgcagcttagagaaaataaacaattccattttcttgtttatgtacatacaatttcatcaccttccttgatcttattgtatggctccagagatcgttaaagtaagtgagaaaatggtgaaaccaagaattataacgagtggggatcgggcctatgtgacgtttttggctggtaatggtgactacgtgaagggtgtagttgggttagctaaggggctaagaaaggtcaaatcggcgtacccgctggtggtggcggttctgccggatgtaccggcggagcatcgccgtatactggaggagcaaggttgtatcgtcagggagattgagccagtttacccacctgagaatcaaactcaatttgccatggcttattacgtcataaattattccaagcttcgtatctgggagtttgtggagtacaagaagatgatatacctagacggtgacattcaggtgtatgacaacatagatcacctctttgatttgccagatggttatgtctacgcagtaatggactgtttctgtgagaaaacatggagtcacactcctcaatacaggattggctactgccagcagtgtccggacaaggtcaaatggcctactgaggaattgggtcagcctccttccctttatttcaacgctggaatgtttgtgtttgagcccagcctccatatttatgacgacctattaaagactctgcagatcaccccttctactccttttgcagagcaggacttcttgaatatgtatttcaacgacatttacagaccaatacctttagtttacaatcttgttctagcaatgttatggcgccatcccgagaatgttgaattggataaagtgaaagttgtacactattgtgcagcgggatcaaagccatggagatacacagggaaagaagaaaatatgcaaagggaagacataaaattactggtgaagaagtggtgggacatttacaaggacgaatcattggactacaagaatgcggttgctgttaataaccaggtgatagctggtgcagctgaagcagtgaaccagctgcaaccgctgattgctgctgctatcgcccaggctggtgcggtcaaatacgtgactgctccctctgctgcttagttttggactattccgccaaatggctcttagattagcttgatctcccttgcatttccattcctctatctcaaatttgcaagcggacctgtcctggattttccaatagaatagacggcagaggaagttgtcaatgtttttgcagcttctctcctcaagtgaagttttggatgatctttgtatttttaaagtgaaatatgtggcacaacgtagtgtatggtgtatatttgtgtttggtgtaatgcatgaatttggcttgtgttgacgatgcag

SEQ ID NO: 11284 - DNA, 1422 bp, Ricinus communis
gaacttcatttatcaagcaaacaaaacaagcattccttcaattaaacattctgacatacccttttcacattcatactcacttctcatttcttttcttttatagcgctcgaacctattcgttatatttccctgcttttgcatcttattcaagaaaactagttactatggcccctcatcttgccagtgctaatcttgcagccaataccaactctttggttaagcaagccagcatatctagttgtgcatatgttactttcttggccggcgatggagactatgtgaaaggtgttgttggtttagccaaagggttaagaaaagtcaagagtaagtacccactagtggtggctatcttgcctgatgtcccagaggatcaccgtaaaatcttggtctctcagggttgcatagttaaagaaattgagcctgtttatccacctgagaaccagactcaattcgccatggcttattatgttatcaattactccaagcttcgtatatgggagtttgtggagtatagcaagatgatatatttggatggtgatattcaagtttttgagaacatagaccatctgtttgacttgcaaaatggttacttttatgctgtgatggattgtttttgtgagaagacatggagccactctccacagtacaagatcggatactgccaacagtgtcctgatagagtgaagtggcctgctgaaatgggtcctaagcctccactttactttaatgctggcatgtttgtttttgagcccagtctttccacatatgatgacctcttgaacacagtcaaactcacccctcctaccccatttgctgagcaggatttcttgaacatgttcttcaaggacatttacaggccaattcctccaatttacaacctggtcttggccttgctctggcgccatccagagaacatcgagtttgaaaaggtcaaggttgttcactactgtgcagccggatctaagccatggaggtatactggaaaagaagacaacatggacagagaagatataaagatgctggtgaagaaatggtgggacatatacgaggatgagtcgttagactacaagaatactgttgctgctactggtggtgcaactgaaggtgaactgcagccgttcttagcagctttatcggaggccggcgttgttcattacgttaccgccccatctgctgcttaatggttgtggattctatcaagctactatatagtattacgaatactttgtataggaaaatataattaaggggtttgttttagacagcgattttcttctttcttttttgggtaatcctccatatattattaaatgggggaagttttctttttgtgtgcgaggaccttttaaccctcctcaatatttgttggttttctgaattattttgcaatttaaatgtaaacttaaaacatagtgtttttat

SEQ ID NO: 11285 - DNA, 1180 bp, Thalictrum flavum
aagacagttggatttacaaaacaaacaagtatacctagcaaagcttttgtaacgtttttggctggtaatggagactacgtgaaaggtgtagttggtttagccaaagggctaagaaaagtgaagtctgcttacccacttgttgtcgcaatcttgcctgacgttccacaagaacatcgccggattcttgaatctcagggatgtattgttcgtgaaatcgaacctgtttatccaccagagaaccagactcagtttgctatggcttattacgtcattaactactccaaattacgtatttgggagtttgtggagtatagcaagatgatatacttggatggtgatattcaagtgtttgaaaacattgaccatctttttgatcttcctgatgggtacttttatgctgttatggattgtttttgtgagaaaacatggagtcatactcctcaatataagcttgggtattgccaacagtgcccaaacaaagtgcagtggcctgctgagatgggtcaaccaccagcactctatttcaatgcaggcatgtttgtgtatgagccaaatttatctacttatgatgatctattgaagcaagtcaaaatcacccctcctacaccatttgctgaacaggactttttgaattcgttcttcaaggatatttacaaacctatccctttggtgtacaacctcgtactggctatgttatggcgccatccagaaaatgtagaactggagaaagtgaaagtagtccactattgtgctgcgggatcaaagccatggaggtatacagggaaggaagataacatggacagagaagatataaagttgttagtgaagaaatggtgggatatctatgatgatgcttcactcgattacaagaggagtgttgttccttcaagtcaagaatctggcgagaaacttcaacagattctggctgctttatctgaagctggagtagttcactttgttactgctccttcggctgcataattcatcatggatcatctcatcatctgctgtgcggactactagagtgtgtgtgaattgaatataacttgtgcaatatcaatgtaaaagatactatatatacatccgtacaggcagatagtctcaattttcatgttttggttcgatagatttgggtttttttgggcctggaacttgccttttattgttggctgtttcaggg

SEQ ID NO: 11286 - DNA, 1509 bp, Malus domestica
agacagataacgacgacgtcctaatctccgccgtgtctttctctctctctttcgtcgcattcagctagtttttctctctatatttccaagggtcaaggccttcctctgtaaaccctagttcccttctcccttggacacgtaatttctcatggctcccgaactcgtccccaccagcgtccccaaatcgggtttcaccactcccgccaccatgcctagtcgggcgtacgtgaccttcttggccggaaacggcgactacgtgaagggcgtcgtcgggctggccaaggggttgagaaaggtaaaaacggcgtacccgttggtcgttgcagtcttgcccgacgtcccggaggatcaccgtcgcattcttgaatctcagggttgcatcgtccgtgagatcgaacccgtttacccgcccgagaaccagacccagttcgccatggcctattacgtcatcaactactcgaagctgcgcatttgggagtttgtggagtacgagaaaatgatatacttggacggggacattgaggtgtacgacaatatagaccacctctttgacttgccagatggacatttctacgcagtcatggactgtttctgcgagaaaacctggagccacacgccgcaataccaaatcgggtactgccagcagtgcccggagaaggtccagtggcccacatcggagctgggcccgcctccgtcgttgtacttcaacgccggcatgttcgtgttcgagcccggcctcgagacctaccatgacctgttgaggactctcagagtgacccctccgaccccgtttgcagaacaggacttcttaaacatgtatttccggaaaatatacaagccaattccattggtatacaatttggtcctcgccatgctttggcgtcacccggagaatgtggagctagacaaagtcaaagtcgttcattattgtgcagcaggatcgaagccgtggaggtatacagggaaggaggagaacatgcagagggaggacattaagatgctggtgaagaaatggtgggacatatacaacgacgagtcgttggattacaagaaggcagcgggaggagcctgggcaggaggagttgtgggtccagaagcagcttcaggtggtgaaggggtgaacatgcagccgttcattgacgcactgtcggaagctgcggtccagtacgtgacagccccgtcagcggcttaggcgatttagagcattcactcatctacggggtagacaagagagagtggaagtacttagatgaatgaaattccaatgcttgttttggactgcgtcgagggaagggggaatgagttaagcaacaagcagcttttgattttttatttgtattttcttttggtttggtagatgaacctgcttagatgacaaggtttgacgtgtgttggtggtgtaatgtgttgtatgaaagagagaaaaaaacgccatttatgtaatcatcctcttatggagagggagcaaatggttaattaatgaaaaatatatgtttattagtaggatta

SEQ ID NO: 11287 - DNA, 1139 bp, Prunus persica
tctctctctctagctttgcaagagtcaaggccttcttcctctatcaacctcgttcccttctcccttggacacgtcactaccacacaatggctcctgaactcgtccccaccggcgtcgctaagtcgggtttcactatacccgccaccgtgccgagccgggcatacgtaacctttttggccggcaacggcgactacgtgaaaggcgtcgtcggattggccaagggattgaggaaggtcaaaacggcctacccattggtcgttgcggtcttgcccgacgtccctcaagagcaccgtcgtattctggagtcgcagggttgcatagtccgagagatcgaacccgtttgcccgcccgagaaccagacccagttcgccatggcctattacgtaatcaactattccaaactccgaatttgggagtttgtggagtatagcaagatgatatacttggacggggacattcaggtgtacgacaacatagatcacctgtttgatctgccagacggccacttctacgcagtgatggattgcttttgcgagaaaacatggagtcacacgccgcagtacaagatcgggtactgccagcagtgcccggagaaggtgcagtggcccgcatcggagctgggcccaccaccctcactttacttcaacgccggcatgtttgtgttcgagcccgacctcgaaacctaccatgacctcttgaacactctcaaagtgactccgcccaccccatttgcggagcaggactatctgaacatgttcttcaggaaaatctacaagccaattcctttggcttacaatttggtcctcgcaatgttgtggcgacacccggagaatgtggagcttgacaaagtgaaagtggtgcattattgtgcagcaggatcaaagccgtggaggtacacagggaaggaggagaacatggagagggaggacataaagatgttggtgaagaaatggtgggacatatacaacgacaagtcgttggattacaagaaaccatcggcaccaggagcaagagcaggaacaagagcagctgttgtgggcggtgctgaaggtgaaggggtgaacatgcagcccttcattgaggctctgtcggaagctggtgtggtgcaatatgtgactgccccatcagccgcttaagaa

SEQ ID NO: 11288 - DNA, 1017 bp, Zea mays
accaataaaaaggtagagaatacaagaaaccgtcacgaccgcctccgcggtgctctaccatccgttccatggcgccgccgctcgccctgtttcttctcgccgccatcgtgctctcgcgggccgtctcccacgcccacggcggcggcggcggcttctacgacccggcgagcgtcactcagctctcctcgcgccccagggcgttcctgtacagcggcttcctctcggacaccgagtgcgaccacctcgtcagcctggcgaaaggcagcatggagaagtcgatggtggcggataacgactccgggaagagtgtggcgagccaggcgcgcaccagctccggcaccttcttggccaagcgcgaggatgagatcgtgtctgcgattgagaaacgcgtagctgcttggacatttctcccggaagaaaacgccgaatcactccaggtcctgcgctacgaaaccggccagaagtatgacgcccacttcgactatttccacgacagaaacaacctgaagctcggcggccagcgagttgcgaccgtccttatgtacctcacagatgtcaagaaaggtggagagactgtatttccaaacgctgagggaagccatttacagtacaaggacgaaacttggtcggagtgttcaagatctggcctggcagtgaagccaaagaaaggagacgcgctactgttcttcaacctccacgtcaacgccacagccgatacaggcagtctccacgggagctgcccggtgatcgagggcgagaaatggtcggcgacgaaatggatccacgtcaggtcgttcgacaaccccccagacgtgaggacggacgcgccgtgctccgacgacaaggagctctgccctagatgggctgctatcggggagtgccacaggaacccgacgtacatggttgggaccaaagacactctcgggttttgccgcaagagctgcgggatctgtgatgcttgaacgtgttttgggggtagattttgatcccatcatgttttcaataacagatgaatca

SEQ ID NO: 11289 - DNA, 1595 bp, Panicum virgatum
gggcgcagcagcggttgaattccactccactctcggcccaggcccccgcgcgcgtccacgccattcccgtgggcgccgcgggcgtcccggcgccgcccgaatcccgcgcagaccgtgcccgctgtcgccggctgttaaaatactaccgggaaactgacaacgcggccgcgtccgccgtgctcctcccgctcccgtccccatggcgccgccgcccgccctgctcctgctccttgtcgccctcgcgctctgcccgagcccggccctctccgacgcccacggcatcggcggcggcggcttctacgacccggcgcgcgtcacccagctctcctggcggcccagggcgttcctctacagcggcttcctctccgacggcgagtgcgaccacctcgtcaatctggcgaaggggaacatggagaagtcgatggtggcggacaacgactccgggaagagcgtcatgagccaggtgcgcaccagctccggcaccttcttggtcaagcacgaggatgaaattgtatctgcaattgagaagcgtgtagctgcttggacatttcttcctgaagaaaatgctgaatcaattcaagttctgcgttacgaaattggccaaaagtatgatgcccacttcgattattttcatgacaaaaacaacctgaagcgtggtggtcatcgaattgccactgtacttatgtacctgacagatgtcaagaagggtggagagactgtatttccaaatgctgagggaggccatttacagtacaaggatgaaacttggtcagattgtgcaagatctggtctggcagtgaagccgaaaaaaggagacgcgctactgttcttcagtcttcatgtcaatgcaacaactgatacaagtagtcttcatgggagctgtccagtaattgagggtgagaaatggtctgccacgaaatggattcacgtccgatcattcgataatcctccagatgtaaggacagatgtgccatgttccgatgacaacgagctctgccgtaaatgggctgctattggggagtgttacaagaacccaacatacatggtgggcaccaaggatactctcggattttgccgcaaaagctgtggactctgtgatgcttgaaccgccaacaatctgaacgtgctgtggggtgttagatcggccgctattgtttgcatccctactcggttttttctggtactgacttgtaaataacaagtgaagcaggtcggttgagtagtataagagttacgtttacacctttgcatggtacctgcaaattgacctcacaaatcacaacatcttgacatagaagcaacggaattttttgtttttgtcaggtttaaggctgcgtgatctcgttgtgctacttagtaagtgttgtgttaacggtattactggccatatggcctgatggatcctccaaatgctacttgatcaatgttctgtatgagttggtctgaattcttcttctacttcttcttcttttgaactaggcgtatggcgatgcgcgggttagtattgaaaattcaaaaatttgcatgtcgttgtatccttacttaaaggttatactattttgtttaccatacatcatcctattcattatcgtaaa

SEQ ID NO: 11290 - DNA, 1253 bp, Pennisetum glaucum
gacgcgccctcctccgttcccgccgcctgccgccgccggttatcaaaacaaaataaccgagggaaaccgacgcgcccgcctccgccccgtgctccgcctgaccgaccgcctccgcctcggcgcctcccgtccgctccccatggcgccgccgccgctcgccatgctcctcctgctcgcgctctgcctggccacggccctctcccgcgccaacggcggcggcggcttctacgacccggcgcgcgtcacccagctgtcctggcgtcccagggcgttcctgtacagcggcttcctctccgacagcgagtgcgaccacctcgtcaacctggcgaaagggagcatggagaagtcgatggtggcggacagcgactccgggaagagcgtcatgagccaggtgcgcaccagctccggcaccttcttggacaagcaccaggatgaaatcgtctctgggattgagaagcgtgtagctgcttggacatttcttcccgaagaaaacgctgaatcaatgcaagtcctacactatgaaattggtgaaaagtatgacgcccacttcgattattttcatgacaaaaacaacctgaagcttggtggtcatcgaattgccactgtacttatgtacctgtcggatgtcaagaagggtggagagactgtctttccaattgctgagggtggccatttgcagtacaaggacgacacttggtcagattgtgcaagatctggtctggcagtgaaaccgaaaaaaggagatgcactactgttcttcagtcttcatgtcaacgcaacaactgatacaagtagtcttcatgggagctgcccggtaattgagggtgagaagtggtctgccacgaaatggattcatgttcgatcattcgataatcctccaaatgtgaggacggacgcgccttgttcagacgacaacgagctctgtgctaaatgggctgctattggggagtgttacaagaacccaacatacatggtgggcaccaaggataccctcgggttttgccgcaaaagctgcgggctctgtgatgcttgaacaccaatcccaacgtgctgtgctgtggggtgttgggccgctattgtttgcatccccaatgggttttctgttactggattgtaaataacagctgacgcaggtccttgagtagtgacagagtaatgtttactctgttgtactacatgaaaattgaccttgcaaattacaacatctgaacatcttgatataagagtaatgaaatttttgtcgcggggttagg

SEQ ID NO: 11291 - DNA, 1259 bp, Brachypodium distachyon
cccaccaggccaccgccgccgcctcccgccgtcgtccccgtcatggctccgctcctcttccttctcctcgccgccctcgcgttgtctccgaccttcgatgccgccgccggaggcttctacgaccaggcgcgcgtcacccagctctcctggcgccccagggcgttcctgtacagcggcttcctctcgcacgccgagtgcgaccacctcgtcaagctggccaaggggaggctgcagaagtcgatggttgcggacaatgactccgggaagagtgtcatgagccaggtgcgcacaagctccggcacgttcttgaacaagcatgaggatgaaattatctctggaattgaaaagcgcgtagctgcttggacatttctacctgaagaaaatgccgagtcaattcaggttctgcactatgaagttggtcagaagtatgatgcccacttcgattattttcatgacaaaaataaccagaagcttggtggtcatcgagttgccactgtccttatgtacctgacagatgtgaagaagggtggggaaactgtctttccgaatgcagagggaagacatttacaacacaaggatgaaacgtggtccgagtgcgcaagatctggcctggcagtgaagccaagaaaaggtgatgcactactgttcttcagtctccacattaacgcgacaacagatccaagcagtcttcatggaagctgcccagtaattgagggtgagaagtggtctgccacaaaatggatccacgtccggtcatttgacaatcctccaattgttaggatggacgtgcggtgttctgatgacaatgagctttgctctaaatgggctgctgttggagagtgttacaggaacccaaaatacatgataggcacgaaagatacgctcggattttgccgcaaaagttgcgggatttgcgatgcttgaaactctcacctatctgaactgtatatgtgaagtgcagtgttagcctgttgtctgtttccactcccctttctgttttacctgggatgtacgttacaaaaccaagtagacttactcctcttaacatgtagtttgaccgcagagcatcttgacataaagctatttttttaatccaacctgctgatatcaaagaatttctccagcattaaattgcattcagctctcatgtcttcggagcctgggccatatgaaaatgttcttgatccatcctaccaattgtactctgcacaatttgatagttcctactacagggctcaaggtagtcctccatagaccat

SEQ ID NO: 11292 - DNA, 1165 bp, Oryza sativa
gctcacccaagcggccatgaacccgctcccatggcgcccctccgaacactcgttatcttcctcctcctcctcctcgcgctcgtcccggcactctcgcgcccggatggcggcggcggcggcttctatgacccggcgcgcgtcacccagctatcctggcgccccagggcgttcctgtacagcggcttcctctcgcacgacgagtgcgaccacctcgtcaatctggcgaaggggaggatggagaagtcgatggttgcagacaatgattccggcaagagtatcatgagccaggtgcgcaccagctccggcaccttcttatcgaagcacgaggacgacattgtttctggaattgaaaagcgtgtagctgcttggacatttcttcctgaagaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcgggaaggcatttacaactcaaggatgaaacttggtctgattgtgcaagatctggcctggcagtgaagccaaagaaaggcgatgcgctactgttcttcagtctccatgttaacgcgacaacggatccagccagtcttcatggaagctgtccggtgatcgaaggcgagaaatggtctgcaacgaaatggatccatgtcagatcatttgataatcctccggatgtaagcctggatttgccgtgttccgatgaaaacgagcgctgcacgagatgggctgctgttggagagtgttacaggaacccaaaatacatggttggcaccaaggattcgctcggattctgccgcaagagctgcggggtttgcgatgcttaaaccctgcacccgccaaactgaagatctgaaaatcaaagtgtcatgttaggctgttagctattttcgcccactttacttacacagttacactacttgagaagttgagatgtacataacagacaaagcaggtttattagtatgtgtttctgtgtagtttaaccttgaacgatattgattgaaagtaattggaactttttttcaggtctaaagtgctactgaaatttttcgcaaaaaa

SEQ ID NO: 11293 - DNA, 1125 bp, Oryza sativa
gctcacccaagcggccatgaacccgctcccatggcgcccctccgaacactcgttatcttcctcctcctcctcctcgcgctcgtcccggcactctcgcgcccggatggcggcggcggcggcttctatgacccggcgcgcgtcacccagctatcctggcgccccagggcgttcctgtacagcggcttcctctcgcacgacgagtgcgaccacctcgtcaatctggcgaaggggaggatggagaagtcgatggttgcagacaatgattccggcaagagtatcatgagccaggtgcgcaccagctccggcaccttcttatcgaagcacgaggacgacattgtttctggaattgaaaagcgtgtagctgcttggacatttcttcctgaagaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcgggaaggcatttacaactcaaggatgaaacttggtctgattgtgcaagatctggcctggcagtgaagccaaagaaaggcgatgcgctactgttcttcagtctccatgttaacgcgacaacggatccagccagtcttcatggaagctgtccggtgatcgaaggcgagaaatggtctgcaacgaaatggatccatgtcagatcatttgataatcctccggatgtaagcctggatttgccgtgttccgatgaaaacgagcgctgcacgagatgggctgctgttggagagtgttacaggaacccaaaatacatggttggcaccaaggattcgctcggattctgccgcaagagctgcggggtttgcgatgcttaaaccctgcacccgccaaactgaagatctgaaaatcaaagtgtcatgttaggctgttagctattttcgcccactttacttacacagttacactacttgagaagttgagatgtacataacagacaaagcaggtttattagtatgtgtttctgtgtagtttaaccttgaacgatattgattgaaagtaattggaacttt

SEQ ID NO: 11294 - DNA, 1201 bp, Secale cereale
tcagcggccggaatcccagcccagcgcagacctcccctccgtcgcgtccactataagcaacgcaccgacgcccccacaacgagccatgtccccaccgtcgcccccatcatgccgccgctcctcctcgccgccctcgcgctcgcgctcgccccggccctctcccacgccgccgccggagggggcgccgggttctacgacccggcgcgcgtcacccagatctcctggcgccccagggcgttcctgtacagcggcttcctctcgcacgccgagtgcgaccacctcatcaagctggccaaggggaggctggagaagtcgatggtggcggacaccgactcggggaagagtgtcatgagccaggtgcgcacaagctccggcaccttcttgtccaagcgcgaggatgaaattatctctggaattgaaaagcgtgtagctgcttggacgtttctccctgaagaaaatgccgagtcaatgcaggttctgcattatgaagttggtcagaagtatgatgcccacttcgattattttagtgacaaaaagaacgtgaagcgtggtggtcatcgagttgccactgttcttatgtacctgacagatgtgaagaagggtggagagaccgtgttcccaattgctgagggaggagatttacagcataaggatgaaacgtggtcggagtgcgcgagacatggcctggcagtgaagccaaggaaaggcgatgcgctactgttcttcagtctccatgttaacgcgacaacagatccgagcagtcttcacgcgagctgcccagtagtcgagggcgagaagtggtctgccacaaaatggatccatgtccggtcattcgacaaccctccagctgttatgacggacgcaccgtgttctgatgacaatgagcaatgccctagatgggctgctcttggggagtgttataagaacgtaaaatacatggtgggcacgaaggacaccctcgggtcttgccgcaaaagttgcggggtctgcgatgcttgaaccccacaccaatcttaactgaatttgcatggttactgagatggagtatattacaaaaccaaatagattcttagtagcatggcattagatgtttactcttgtcatgtagtttgacctcagagcatcttgatataaagcaaaaagggaactgactttgtttcagaagaatttggacataacctgatggtatcaagtacgtatt

SEQ ID NO: 11295 - DNA, 1059 bp, Sorghum bicolor
ctccaaccactctcccgtcttcaaccctctggcaaatactactagtactgctccactacttgattgccgcctcactggcaccccgctcccaattccagtgacactgcaccacccggctccagcgagatccagacccaaaaccccagccaacctctgcctggggaggggaagagaagggaagggaagcaatggctgccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacccgcagtctccaggtcgacggcaaggtcatcaaggcccagatttgggacaccgccggccaggagaggtaccgcgctattacaagtgcctattaccgaggagctgtaggggcattacttgtctacgatgtcacccgccgtgctacattcgacaacgtgggccgttggctaagggagctcagagaccacactgatcagagcatcgttgtgatgctgattggcaacaagtccgatctccgccacttggtggccgtctcaaccgatgacgcgaaggagtatgctgaggccgagtccatgtacttcatggaaacgtctgccctcgacgccaccaatgtggacaacgcgttctcagaggtgctgacccagatataccagatcgtgagcaagaagacagtggaagccccggaggaaggcgcggctggcccaggcaaaggggagaagataaacgtgaaggatgacgtgtctgcgatgaagagagttgggtgctgctcaaactgaggcgagtagccgaatacaaacggtttgttcattttttttcatgtaggtatggcacggtcggcttttgcgtgaaaacaaatctgttcgattgtctttctggtggtggtactgagggttagaggttcagtcaaaccgttgagagatgagtctatcagtttaaattactcctatttattatttatcagctctgaatttgtcttctgtcaaa

SEQ ID NO: 11296 - DNA, 1028 bp, Saccharum officinarum
ggcaaacaaatactagaactgctccactacttgattgccgactcactggcaccgctcccaattccagtgacactgcaccacccggctccagcgagatccagacccaaaaccccacctcgcctacgctagcaggctagcagcagccaacctttgcctggggagaggaagggaagggaagggaagcaatggctgccaacggaggcgggtaccgggcggaggacgattacgactacctcttcaaggtggtgctcatcggcgactccggcgtcggcaagtccaacctcctctcccgcttcaccaagaacgagttcagcctcgagtccaagtccaccatcggcgtcgagttcgccacccgcagtctccaggtcgacggcaaggtcatcaaggcccagatttgggacaccgccggccaggagaggtaccgtgctatcacaagtgcctattaccgaggagctgtaggggcattacttgtctatgatgtcacccgccgtgctacattcgacaatgtaggccgttggctaagggagctcagagaccacactgaccaaagcatcgttgtcatgctgattggcaacaagtctgatctccgccacttggtggccgtctcaactgaggacgcgaaggagtttgccgaggccgagtccatgtacttcatggaaacgtctgccctcgacgccaccaacgtggacaacgcgttctcagaggttctgacccagatataccagatcgtgagcaagaagacggtggaggcaccagaggaaggcgcggctggcccgggcaaaggggagaagataaacgtgaaggatgacgtgtctgctatgaagagaggtgggtgctgctcaaactgaggcgaatagccgaatacaaacggtttgttcatttttcatgtaggtatggcacggtcggctttcgttaaaacaaatctgttcgattgtctttctggtggtggtactgggggtttagggtcagtcaaaccgttgagactatcagttcaaattatttatcagctctgaatttgtgcctctgtc

SEQ ID NO: 11297 - DNA, 1060 bp, Setaria italica
aaacccaatactagtagtgctcaaccacttgattgcctcctcactggcaccgcccctcccaattccagtgacactgcaccaccacccggctccagcgagatccagacccaaaacctcccaccacctcgcccgcgctagcagcagccgacctctgctcggaggggagcaatggctgccaacggaggcgggtaccgggccgaggacgactacgactacctcttcaaggtggtgctcatcggcgactccggcgtcggcaagtccaacctcctctcccgcttcaccaagaatgagttcagcctcgagtccaagtccaccatcggcgtcgagttcgccacccgcagcctccaggtcgacggcaaggtcatcaaggcccagatttgggacaccgccggccaggagaggtaccgtgctattacaagtgcctattaccgaggagctgtaggagcactacttgtctatgatgtcacccgccgtgctacattcgacaatgtgggccgttggctgagggagctcagagaccacacagaccaaagcatcgttgttatgctgattggcaacaaatccgatctccgccacttggtgactatctcgactgaagacgcaaaagagtttgcggaggctgagtccatgtacttcatggaaacgtctgcgcttgacgccaccaacgtggacaacgcgttctcggaggtcctgacccagatataccagatcgtgagcaagaagacggtggaggcaccggaggaaggcgcggctgccccgggcaaaggggagaaaataaacgtgaaggatgatgtgtccgcgatgaagagagttggttgctgctcatcaaactaaggcggatacaaacggtttgttcatttttcatgtaggtaaggtaccgttgcgcttgcagtacaagaaatatgttggattctgtttctggtggtgttactgaggattagggtcactcaagaaccactcaaactatcaatttaaattatcgactattaatttgtgcttctgtaagattcatatggtgttcttgtctatcactgcaatatcatctttttattgacgggag

SEQ ID NO: 11298 - DNA, 895 bp, Cynodon dactylon
ggtatggcgtaccagtagtaatcccgctccactgctccgttgcctcctcgtccagttgctcccaattccacagtgacactgcaccacccgcggctgcagcgagatccagactcaaaagccgctccgctcctctcctacgcgcccacgctagcagcagcagcagcccgtttccgcgcggagggggagcaatggctggcgcggggggcgggtaccgggcagaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacccgcagcctccaggtcgacggcaaggtcatcaaggcccagatttgggacaccgcaggccaggagaggtaccgtgctattacaagtgcctattacagaggagctgtaggagcattacttgtttatgatgtgactcgccgtgctacattcgacaatgtggggcgttggctgagggagctcagggaccatacagatcaaagcattgttgtcatgctgattggcaacaaatccgacctccgccacttagtgactgtctcaactgaggatgggaaggaatttgctgaggctgaatccatgtacttcatggaaacttcagcactcgatgccaccaatgtcgacaatgcattttcagaggtcctgacccagatataccaaattgtgagcaagaagacggtggaggctccagaagaaggctccgccttgccaggcaaaggggagaaaataaatgtgaaagatgatgtgtctgcactgaagagagctggctgctgctcaagttaaggagaaatggagaatacagatggtttattcattttttttcctct

SEQ ID NO: 11299 - DNA, 1021 bp, Oryza sativa
caaacacacaaactccagtgtctccccactccatagtgacactgcgcctgcctgcgagatccaaaatccgaccagccagcgttagctcggagaggcgaggcgagaatggcggccgcggcgggcgggtacagggcggaggacgactacgactacctgttcaaggtggtgctcatcggcgactccggcgtcggcaagtccaacctcctctcccgcttcaccaagaacgagttcagcctcgagtccaagtccaccatcggcgtcgagttcgccacccgcagcctccaggtcgacggcaaggtcatcaaggcccagatttgggacaccgccggccaggagaggtatcgtgctatcactagtgcctattaccggggagctgtgggagcattgctcgtctacgatgtcacccgtcgtgctacattcgacaacgtgggacgctggctaagggagcttagagaccacactgatcctagcattgtctgcatgctgattggcaacaaatccgatctccgccacttggtggctgtctcaaccgaggacggcaaagagtttgctgaagccgaatcaatgtacttcatggaaacttctgcgctcgacgctaccaacgtcgacaatgcgttcgcggaggtcctgactcagatataccagattgtgaacaagaagccggtggaggcacctgaggatgggtcggctggcccaggaaaaggagagaagataaacgtgaaagatgatgtctcggcgatgaagagagttggatgttgctcaaactaaagacaagagggacacaatttattcatttttccaagtagggatgctcagggtatactgtaatagatctattcaattgtctcatttctggtgttgttattgagggttagggtgatccaactatcattcaaactatcagttcttgatttgctctttgtatcaaactgatcatggtgttgttatctatcactgcaatgcaagtattatgttgacagaagaagcatatatccattgtttgagagtgtctgctctgatt

SEQ ID NO: 11300 - DNA, 991 bp, Oryza sativa
ctgtcaaacacacaaactccagtgtctccccactccatagtgacactgcgcctgcctgcgagatccaaaatccgaccagccagcgttagctcggagaggcgaggcgagaatgtcggccgcggcgggcgggtacagggcggaggacgactacgactacctgttcaaggtggtgctcatcggcgactccggcgtcggcaagtccaacctcctctcccgcttcaccaagaacgagttcagcctcgagtccaagtccaccatcggcgtcgagttcgccacccgcagcctccaggtcgacggcaaggtcatcaaggcccagatttgggacaccgccggccaggagaggtatcgtgctatcactagtgcctattaccggggagctgtgggagcattgctcgtctacgatgtcacccgtcgtgctacattcgacaacgtgggacgctggctaagggagcttagagaccacactgatcctagcattgtctgcatgctgattggcaacaaatccgatctccgccacttggtggctgtctcaaccgaggacggcaaagagtttgctgaagccgaatcaatgtacttcatggaaacttctgcgctcgacgctaccaacgtcgacaatgcgttcgcggaggtcctgactcagatataccagattgtgaacaagaagccggtggaggcacctgaggatgggtcggctggcccaggaaaaggagagaagataaacgtgaaagatgatgtctcggcgatgaagagagttggatgttgctcaaactaaagacaagagggacacaatttattcatttttccaagtagggatgctcagggtatactgtaatagatctattcaattgtctcatttctggtgttgttattgagggttagggtgatccaactatcattcaaactatcagttcttgatttgctctttgtatcaaactgatcatggtgttgttatctatcactgcaatgcaagtattatgttgacagaagaagc

SEQ ID NO: 11301 - DNA, 804 bp, Pennisetum glaucum
acgactacgactacctcttcaaggtggtgctcatcggcgactccggcgtcggcaagtccaacctcctctcccgcttcaccaagaacgagttcagcctcgagtccaaatccaccattggcgtcgagttcgccacccgcagcctgcaggtcgacggcaaggtcatcaaggcccagatttgggacaccgccggccaggagaggtaccgtgctattacaagtgcctattaccgtggagctgtaggagcactacttgtctatgatgtcacccgccgtgctacattcgacaatgtgggccgttggctaagggaactcaaagaccacacagaccaaagcatcgttgttatgctgatcggcaacaaatctgatctccgtcacttggtgacggtctcaactgaagatgcgaaagagtttgcagaggctgagtccatgtacttcatggaaacgtctgcgctggatgccaccaacgtggacaacgcgttctcagaggtcctgacccagatataccagatcgtgagcaagaagacggtggaggcaccggagcaaggcgcagctgccccgggcaaaggagagaaaataaatgtgaaggatgatgtgtctgcgatgaagagagctgggtgctgctcaaactaaggcgaatacaaactgtttgttcatttttcatgtaggtaaaggtacggttccgcttgcagtacaagaaatgtcttggattctgtttctggtggtgttactgaggcttagggtcactcaagaaccattcaaactattgatttaaattatcgactatgaatttgtgcttctgtcaaaa

SEQ ID NO: 11302 - DNA, 1088 bp, Brachypodium distachyon
ggcgtagcagctcagctcacttcacactgtcgtcacctactgctccgtcccccacaccgcgacgctgcacccccccaaactcccgcgagatccagagcctaaaacgccacaagcagcccgggacccgcgaagcaaggaagggggaaatggcgggcggcggaggcagcggcgcgtacagggcggaggacgactacgactacctgttcaaggcggtgatcatcggcgactccggcgtcggcaagtccaacttgctgtcgcggttcaccaagaacgagttctgcctcgagtccaagtccaccatcggggtcgagttcgccacccgcagcctccaggtcgacggcaaggtcgtcaaggcccagatttgggacaccgccggtcaggagagataccgtgctatcacgagtgcctattatagaggagcagtaggcgcattacttgtctatgatgtcactcgccgttcgacattcgacaatgtggcgcgctggctaaaagagctgagggatcacactgatcctagcattgttgtcatgctagttggcaacaaatctgatctccgccacttggtggctgtttcaactgaagatggccaggagtatgccgaggctgagtcactgtacttcatggaaacgtctgcattagacgcgacaaatgtagacaacgcttttgcagaagttttgactcagatataccaaattgcaagcaggaagacggttgatgcaggagaggatggctcagctgcccctagcaaaggggagaagataaatgtgaaagacgacgtgtctgcattgaagagagtcggctgttgctcaaattagggtactatatagatgcattgtctgttgagtctgcaactagttggtgctgcttctgctgcaacagatttatgcatcctctctttttgctgcggtgattatgagggttagattgatgcagttttctcctgaaaccattatgtaagattgattgtgatattcgatttgaactaaatacccagactttaccgagaaatacttgtctccgaaacaggtttatgcttctattttattttttctcatcctgtcatctcatgacaggttcatgcagcatat

SEQ ID NO: 11303 - DNA, 804 bp, Cenchrus ciliaris
ggcgtcggcaagtccaacctcctctcccgcttcaccaagaacgagttcagcctcgagtccaagtccaccatcggcgtcgagttcgccacccgcagcctccaggtcgacggcaaggtcatcaaggcccagatttgggacaccgccggccaggagaggtaccgtgctattacaagtgcctattaccgtggagctgtaggagcactacttgtctatgatgtcacccgccgtgctacatttgacaatgtgggccgttggctaagggagctcagagaccacacagaccaaagcatcgttgttatgcttattggcaacaaatccgatctccgccacttggtgaccgtgtcgactgaagatgcgaaagagtttgcggaggctgagtccatgtacttcatggaaacgtctgcgctggacgccaccaacgtggacaacgcgttctcagaggtcctgactcagatataccagatcgtgagcaagaagacggtggaggcaccggaggaaggcgcggctgccccgggcaaaggagagaaaataaacgtgaaggatgatgtgtccgcgatgaagagagctgggtgctgctcaaactaaggcgaatacaaactgtttgttcatttttcatgtaggtaaaggtacggttccgcttgcagtacaagaaatgtcttggattctgtttctggtggtgttactgaggcttagggtcactcaagaaccattcaaactattgatttaaattatcgactatgaatttgtttgttatgcaatctttattatcagaataagttgccaagcagtcatttgatgtggagc

SEQ ID NO: 11304 - DNA, 919 bp, Persea americana
gagaaccaaaaggttacagaagagacgatggctgcctacaaagctgaggacgattacgactaccttttcaaagttgttctgataggcgattcaggagtcgggaagtcgaatttgctctccagattcacaaagaacgagttcagcctcgaatccaagtccacgatcggagtagagtttgccacgcggagcttgaacgtagaagggaaggtgataaaagcccagatttgggacactgcagggcaggagaggtatcgtgctattactagtgcttactaccggggagccattggtgcattacttgtatatgatgtcacccgacacactacatttgagaatgttgagcggtggttgaaggaactgagggaccatacagacccaaacatagttgtgatgctaattggcaacaaatcggacctccgccaccttgttgcagtttcaactgaagatgggaagtcatttgcccagagggagaatctctatttcatggagacctctgcattggaagcaacaaatgttgaaaatgcatttgcagaagttctaactcacatctaccatatcgtgagcaagaaggctgttgaggcaggtgatggggcagctgcaacagtccccagcaaaggggagaagataaatgtgaaagacgatgtttctgccatgaaaagagttggatgctgctcaaactagagttggtttaaggtacttagtacatgtcatgcacatctgtttacaccaggttttctgctttttatttatttatttagagagtgagagttttagttctgttttgtggaacaacacaggtttgcataggatcagggcgtttgatattcttcagataatttcttaagtttgtaagatctttcatttgaagcggatagtcattgcgggctttaataccaaaaaaaaaaaaaaaggccgcctc

SEQ ID NO: 11305 - DNA, 1019 bp, Platanus occidentalis
aatcaggcacaaacccatctcgtctgtgtgaaatcccagactgttccaagatcaaacaagttttgtttttgattttttggttctctgcaacgtcttgtggaatttgcagagaagaagaagaagaacggtgatggctggttatagagctgaagatgactatgattatctgttcaaggtggtactgataggagattcgggagttgggaagtcgaatttgctttcgaggttcacgaagaacgagttcagtctcgaatctaagtctacgattggtgtggagttcgctactcggagcttgaacgtcgatgggaaggtcatcaaagctcagatttgggatacggctggccaagaaaggtaccgtgccattactagtgcatactaccgaggagcagtgggtgcattgcttgtgtacgatgtcacccgtcattccacttttgagaatgttgagaggtggttgaaggaactgagggaccacacagaccccaacattgttgtgatgctcattgggaacaagtctgacctccgtcaccttgtggctgtttctactgaggatggtaaatcctttgcggagagggagtccctctatttcatggagacgtctgctttggaagcaaccaatgttgacaatgccttcgctgaggtcctgacccagatctaccgcattgtgagcaagaaagctgtagagacgggtgatgatggagctgcttctggtgttcccagcaaaggggagaaaataaatgtcgatgatgtgtctacgctgaagagagttgggtgctgctcaaactagggtttgggaaagtgaatgtatgtgttgaagaatgtggctgggtcttttgctgcatctgttgcttctgtgtacaccatggttttgtgttaagactttctcaggggcaccaaccaggaaaagagagcagggaaggagtccttttaatacttttattttctgtgttgaacaagaggagcttgaatagggggtagatgtcacgtttattgcttttattagattatggattggggatacg

SEQ ID NO: 11306 - DNA, 1264 bp, Triticum aestivum
gcggacgcgatcaccacgcgccgctccccgtgggcgctgccgtgcccgtgcccccttcctttcctttccttccttcttttctttcccctctccgtccgcccccgcttttacaccacctcccccccacctttccctccccctctcgctctcctccttcgccacccccgcaaacaaccagatcgccgacgcgacgggagcaatggcggcggggtaccgggcggaggacgactacgactacctcttcaaggtcgtgctcatcggcgactccggcgtcggcaagtccaacctgctctcccgcttcacccgcaacgagttcagcctcgagtccaagtccaccatcggggtcgagttcgccacccgcagcctccaggtcgacggcaaggtcgtcaaggcccagatttgggacaccgccggccaggagagataccgtgctattactagcgcatactaccgtggtgctgtaggagcgttgcttgtctacgacgtcactcggcacgcaaccttcgagaatgcagagcgctggctgaaggaattgagggaccatacggacccgaacatagttgtcatgcttgttggcaacaagtctgatctccgccatctcgtggccgtcccaactgacgaagggaaggcgtttgcagagagggagtcactctatttcatggagacctctgcgctcgagtcgaccaatgtggaggacgcgtttgcggaggtcttgaaacagatttaccgcatcgtgagcaagagggcggtcgaggcaggcgaagactcggccgccggccctggcaagggtgagaagatcaacatgaaggacgatgtctcggcggtaaagaagggcgggtgctgctctagctgaggcgccatgatgcattctttttgctgagcttttgtgatgtggcatttccagcgaccgggaattattagtagcagtagtagcaagtattattattatgaatgttacctagagaagttgaagtttgttgctgaaccgggaagtttgtctagatgaggtgagaccttccttcatattgttgtatggtctttgaggcaatcggcatggagtattgtttttcaggtcatttcgttgcaaccatgcttgaacttttcaacttgatttaaatttgcttcacgtttgccaatagcagattcttctcagacgctaggaactgttcactcactattataagctgaacagttgaacgagttctgtcggaatataatttagtgaaatctaagagcatctgcaatcgaattgggctattttggt

SEQ ID NO: 11307 - DNA, 1054 bp, Secale cereale
gactgccttcgccaccctccccttccccccctcgctctcctccttcgccaaccagatcgccgacgcgacgagagcaatggcggcggggtaccgggcggaggacgactacgactacctcttcaaggtcgtcctcatcggcgactccggcgtcggcaagtccaacctgctctcccgcttcacccgcaacgagttcagcctcgagtccaagtccaccatcggggtcgagttcgccacccgctccctccaggtcgacggcaaggtcgtcaaggcccagatttgggacaccgccggccaggaacgataccgtgctattactagcgcatactaccgtggtgctgtaggagcgttgcttgtctacgacgtcactcggcatgcaaccttcgagaatgctgagcgctggctgaaggagttgagggaccatacggatccgaacatagttgtcatgcttgttggcaacaagtctgatctccgccatctcgtggcggtcccaaccgacgaagggaaggcgtttgcagagagggagtcactctatttcatggagacctctgcgctcgagtcgaccaatgtggaggacgcgtttgcggaggtcttgaaacagatttaccgcatcgtgagcaagagggcggtcgaggcaggcgaagactcggccgccggccctggcaagggtgagaagatcaacatgaaggacgatgtctcggcggtgaagaagggcgggtgctgctctagctgaggccccatgctgtattttttgttgctgagcttttgtgatgtggcctttccagcgacgggaattattagtagcagtagtagcaagtattattattattatgaatgttacctagagaagttgaagtttgttgctgaactgagaagtttgtctagatgaggtgagaccttccttcatattgttgtatggtctttgcggcaatcggcatagtggggtattattatctttcaggtcattacattgcaaccatgcttgaacttttcgacttgattgaaatttgtcttctacgtttgtgtagttgtcttattctaccacaaaactgagtac

SEQ ID NO: 11308 - DNA, 1096 bp, Aquilegia formosa
ttaattaataaagttgaaaactttaaaaaccttcattacttcttcaacacatcttctctttctctttctctttctctttctcttctaacaaaaaaaaacccacaaagaagaagagaaacagttgttgttgttgttaagtatggctgcatatagagctgatgatgattatgattatctatttaaagtagttttaattggagattcaggtgttgggaaatcaaatttattatcaagatttactaaaaatgaatttagtcttgaatctaaatctacaattggtgttgaatttgctactagaagtttaaatgttgatactaaagttattaaagctcagatttgggatactgctggacaagaaaggtaccgtgccattactagtgcttactacagaggagctgtaggagcactacttgtttatgacgtcactcgacatgcgacgtttgagaacacagagaggtggctgaaagaactaagggaccatactgaccccaacatcgtcgttatgctcattggaaacaagtctgacctccgtcatcttgtggcagtctcaactgaggatggaaaatcttttgcagagagggagtccctctacttcatggagacttctgcactagaagcaaccaatgtggaaaacgctttcgcagaagtcctgacccaaatctaccgtatagtaagcaagaagtcaatggagactggagatgacggagctgcagcaaacgtccccaccaaaggagaaaaactaaacgtcaaagatgacgtgtctgcactaaaacgagttggatgttgctcaagttagggtttgagatttcaaatatcactttttaaggatgtaactttggtattttagctagctgcaactgttgtttctttgatgtacaccatatttttgtataagattctctcagggatttgtagcaggagttgaagcggagggaatagtccttcaaataacttctatttttttgtggtttagcagttgagatttttattagttgcacttagtgttaaacttgcaggggttttatgatgttgaagacgattattagctttcgatgttagtagtaggtacccaatgttgtaatctccatttatcaaa

SEQ ID NO: 11309 - DNA, 1444 bp, Ricinus communis
aaagatcactcccacttttctctaattgttttctctttcactggagtgcagacagcggtctcgcccatttccagctcactcccctagcaaaagggtcaaaagaacacattactatattaaagcttttggattcgaacttctcttactttgtttgaaagcaagaaataagagaagtgaaaaatggcagggtatagagcagaagatgactacgattacctattcaaggtggtcctgatcggtgattcaggtgtaggcaagtctaatctgctttctaggtttactcgtaatgagtttagcttggagtctaagtccactattggagttgagttcgctactcgtagcttaaacgtcgatggcaaggttatcaaggcccagatttgggatactgctggtcaagaaaggtaccgtgccattactagtgcatactaccgaggagcagtaggtgccctgcttgtctacgatgtcacccgccactcaacatttgaaaacgtcgaaaggtggttaagggaattgagggaccacacagatcccaacattgtggtcatgctcataggcaacaaatcagatcttcgccaccttgtggctgtctcaactgaggatggcaagtcatttgccgagagggagtctctctacttcatggaaacttctgctctggaagctactaatgtagacaatgcatttgctgaagtgcttacacagatctaccgaattgtaagcaagaaggctatggagactggcgatgaaggtgctgcctcggctgttccttccaagggagagaaaattgatgtcagtaaagatgtttctgcaatgaagagagtaggatgctgctctagctaggagtttagtcagaattgacgcagaggatggagccagtttgttttgctgcatctatctttatgtacaccattattgtgtaaaattttcttaaagatgccaacagtaggagaggtggggattgatttttaaagttttcttttccatcgactgctattttagccgacagagagcttaattaggaacaaggtattacactattgcttttaaaatggttctgggtgaagtccaagtgtccatcaagttatatctattcagttgtattcatgtttgggattatatgtcctgcatcagattgataggtaattcaactctctttcgaaaaaagaaaaaaatcaatttatctcatgcactggagctatctatcattttgaggtagatgatgtgggcttctcattttttcagctgttagcatggtgtttgtttcattgggagactaaaataagatcggaagtttagatttttgagcagaatatttggcatccacatatatatttaaagcaaatgaaaatctagtgattctgataccacaaggtcgtttcttctgcttgctttggtatctactttctgtaaattagaagaaacaaataagaatggtccagatcttatg

SEQ ID NO: 11310 - DNA, 1176 bp, Populus trichocarpa
ataggcattctctccaactttcacttgggagtccagcccagcaaaagcacaggagacagagagacagcagtctcccccatttccaactcacaacaataccaaaagattcatagaaaagcaaaagaaaacaccaccatttctctccctctctccctctctctctccgtagcttcctttctttgaagcaaagcaagaagagtaaaggtagcgtgtgacaactagtaatggctggatacagagctgaagatgactatgattacctgtttaaggtagttcttattggtgactcaggtgtgggcaagtccaatctgctttcaagattcactcgtaatgaattcagtttggagtctaagtctactattggtgttgagttcgctactcgcagcttgaatgttgatggcaaggtcattaaggcccagatttgggacactgctggccaagaaaggtaccgtgccataactagtgcttactaccggggagcggtgggtgcacttcttgtgtatgatgttacccggcactcaacatttgaaaatgttgaaaggtggctaagggagttgagggatcatacagatcctaacattgtcgtgatgctcattggcaataaatcagatcttcgccaccttgtggctgtctcaactgaggatggaaaatcctttgctgagagggagtcgctctacttcatggaaacatctgctttggaagctactaatgttgacagtgcatttgctgaagtgcttactcagatctatcgcattgtgagcaagaaagctatggagaccggtgatgaggcagctgcttcagctgttccatccaaaggtgagaaaatcgatgttagtaaagatgtttctgctatgaagagagtagggtgctgctcaagctaggattctaatctgatcattacattgttgagatgtggctggtttgatttgctgcgtctgtttctatgtacaccattattgtgtaaaattttctcaaagatgccaacttaggaggtcggtggattgattttattatgatcttaaaaagtttttcctcctctgttttagctgacgaacagcttaactaggaatgaagtgttacacttatggctttcaaaatggtatttaatggagctcatatttgcattaaattatctgtttagttgtctgttaataaatatttgctcgagcctcccat

SEQ ID NO: 11311 - DNA, 791 bp, Chelidonium majus
cttttctttttttgttcctacaaatctcactcggtttcagaggaaaataggaaaccaaataaatacttttttgtttttctctctaaaaaacagtagattttgtagagagagagagaagtagaaggaaagtgagatggctgcatatagagctgaagatgactatgattatctttttaaagtagttttgatcggtgattcaggagtgggtaagtcgaatttgttgtctaggtttacaagaaatgagttcagtcttgaatctaagtcgacgatcggagttgagtttgctactagaagcttaaatgtcgatgggaaagttattaaagctcagatttgggacacagcaggtcaagaaaggtaccgtgcaattactagtgcatactatcgaggagctgttggtgcactacttgtttatgatgtcactagacatgctacatttgagaatgtcgagaggtggttgaaggaattgagagaacacactgaccccaacattgttgtgatgcttataggaaacaaagctgatctccgtcaccttgtggccgtctcaaccgaggatgggaagtccttcgccgagagagagtccctctacttcatggaaacctctgcattggaggcaacaaatgtggaaaatgcatttgctgaagtcctcgcacagatctatcatattgtgagcaagaagtcagttgaaacaggagatgaaggagctacttcggctgttcccgtcaaaggggagagaataaatgtcaaagatgacgtgtctgcactgaagagagtcgggtgctgttcatcttaag

SEQ ID NO: 11312 - DNA, 1052 bp, Vitis vinifera
cttgttaagcagccaaacaaaggttctaatcataattattagtattcattctcacttccctcttccttctccttcacaaatctccactctactttactctctctgcatatttttctagggttttttcggagggaagaggaagcatcaaacatggctgggtacagagctgaagatgactatgactacctcttcaaggttgtcttgattggagactctggtgtgggcaagtccaacttgctctctaggttcaccaagaacgagttcaatctcgagtccaagtccactattggtgtagagttcgctaccaggaccttgaacgtcgatggcaaggtcatcaaggctcagatttgggacactgcgggtcaagaaaggtaccgagccatcaccagtgcttactaccgaggagctgtaggtgcactccttgtatacgatgtcacccgacatgcaacctttgagaatgttgacagatggctgaaggaattgaggaatcacactgaccccaacatcgttgtgatgcttgtgggcaacaaatccgatcttcgccaccttgtggctgtctcaacagaagatgggaagacatatgcagagagggagtcactctacttcatggagacttctgcactggaagcgaccaatgtagagaatgcatttgcagaggttctgacccagatataccgcattgtgagcaagaagtcggtggaaggaggagatgaaggagccgcttcatctgtacctgccaaaggggagagaataaatgtgaaagacgacgcgtctgctctgaaaagagtggggtgttgctcagggtaaggtttgggggattgaattgtgtttgggtagatttggcttctttgtttggtgtaatattttctcagggatagacatcagaaggaaactggaaaaagtgatgttcttcataagacattgatttgctgtattggaccgtgatatatgggagcagaataggcacttccattgcttctttgtcttttttttttccttttcttttcaagtgaatctgtttgacaaatttcataatcaagagtttttgtgaa

SEQ ID NO: 11313 - DNA, 1215 bp, Gossypium hirsutum
gcattgaagtcattccagaaaaagccccaacgttcaaggacatttccccacattttctggagtccaacggagcagacaattagtcttttacatttccaactcataccaaaaccaaacaactagatttttttcttaggcagatctcaaaagaaaaggcttttaatatacatagaagccgcgggccatcccctcgttcacacactcgtttatttacttgacgcaaagaaagagggtaacagctgtggttctgagaaagagtaaagatggctggttacagagctgaggatgactatgactatcttttcaaggtggttttgatcggtgattccggtgtcggaaagtcaaatctgctctcgaggttcaccaggaacgagtttagcctcgagtccaagtccactattggtgttgagttcgctacacgtagcttgaatgttgatggaaaggtcatcaaggctcagatttgggacactgctggtcaagaaaggtatcgtgccataacaagtgcctattatcgaggagctgttggtgcacttcttgtgtatgatgttacacgacactccacattcgaaaatgtcgagaggtggttaagagagttgagggatcacacagatcccaacattgtagtcatgctcattggtaataaatccgatcttcgtcaccttgtggctgtctcaaccgaagatgggaaatccttcgcggagaaagaatccctctacttcatggaaacttctgccctggaagctactaatgttgaaaatgcatttgccgaagttctgacacagatctaccatatcgtgagcaagaaagctatggagaccagcgaggaagggaatgcttcagctgtcccatcaaagggagagaaaatcgatgtgggtaaagacgtgtcagctatgaagaagggaggttgctgctcaagctaggatgatcacactaatctgaagtcagattgtttaaatgatgcggccggggtttcgatttcatcataaacctggttttgtaaatttcttaaaaggtgcctaaagtagatctgagcagagattgatttaatttttcattcatttttttccctggatgactgttattgttagtagacaagaggattacgaagaagagggtcttacactattgcatttaaatatgtgcttagaacatctgtttacttacaacaatttgtgcccaactcttttgttggaaataccatatgccatttgtttc

SEQ ID NO: 11314 - DNA, 883 bp, Manihot esculenta
ggagtctctcccatttccaactcacctccagagcaaaaagggtcaaaaaaacacacactggcttttagatttcaagggttgatttttccctttttttcttcgaagaaatataagacccagtctctatcttgctcttccttttattttcttttctttgaagcaaagcaagagaagaggtgatggcagggtacagagctgaagatgattatgattacctcttcaaggtggtgctgatcggtgattctggtgtgggcaagtccaatctgctctctaggttcactcgaaatgagttcagcttggaatctaagtccactattggcgtggagtttgctactcgcagcttgaacgtcgatggaaaggtcatcaaggcccagatttgggacactgctggccaagagaggtaccgtgccataactagtgcttactacagaggagcagtgggtgcattacttgtgtatgatgtgacacgacattcgacatttgaaaatgttgaaaggtggctaagggagttgagggaccatactgatcccaacattgtggtcatgcttatcggtaataaatcagatcttcgccaccttgttgccgtctccacagaggatgggaaatcctttgcagagagagagtccctctacttcatggaaacttctgcactggaagcaactaatgtggaaaatgcatttgctgaagttcttactcagatctaccgcatcgtaagcaagaaggctatggagactggtgatgaaggtgctgcttcagctgttccatcgcaaggagagaaaatcgacgtcagtaaagatgtttctgctatgaagagagtaggatgctgctcaagctaggagttttattggagctggtttgtttttgctgctatctgtttctatta

SEQ ID NO: 11315 - DNA, 1173 bp, Euonymus alatus
gaggtcattatggtcatcccagaaaatcccccgtgaaatcgaacggcgtgctttcgtaaagcgaagccgacagcagtctcttccgttcccacttgatccgagtcaaaatatttcctgaaaaattaaaaagaaaaggaaagtgagatcttcttgtagaccttgaaagctccatctctctcagacgcattcgttctgttgtttgttcggaagtaggaggtgacgatggcagggtatagagcggaggatgactacgattacctcttcaaggtggtcctaatcggtgattccggtgttggcaagtccaaccttctttccaggttcactcgcaacgagttcagcctcgagtctaagtctacaatcggtgttgagttcgctactcgcagcttgaacgttgatggcaaggttatcaaggcccagatttgggacactgctggtcaagaaaggtaccgtgccataactagtgcctattatcgaggagctgttggcgcactgcttgtctatgatgtcactcggcactccacatttgagaatattgagagatggttaagggagctgagggatcatacagatcccaacattgtggtcatgctcattggtaataaatcagatcttcgtcacttagttgccgtttcaaccgaggatggaaagtcttttgctgagagagagtctctctacttcatggaaacttctgctctggaagccactaatgtggacagtgcatttgctgaagtgcttactcagatataccgtattgtaagcaagaaggcgatggagagtggtgaagatggagctgctgcagctgttccatcaaaaggagagaaaattgacgttagtaaagatgtttctgctgtgaagaaaggaggttgctgctcgagctagatttctagactaaattttattcttcatgagatgatgttttttttttttttgggtgttacttcatcccttcctatgtaccccattgttgtgtaaaatcttctcaaatatggctactgtaggagataggccatgatcggtcactattttacttccatttttttttttgcgaaaactgttgatttagacagacattgagattgatcaggaatgcgatgttacactctgtgcattaggttttcaccaattctctggtgtttatatatatacagcaactggaatattctgtttctacat

SEQ ID NO: 11316 - DNA, 867 bp, Olea europaea
gaagagagatgtcagggtacagagcagaagatgactatgattacctcttcaaggtggttcttataggggattcgggtgttggcaagtccaacttgctttcaagattcactagggatgagttcagtcttgagtccaaatccaccattggtgttgagtttgccaccagaagcttgaatgttgatggaaaggtcatcaaggctcagatttgggacactgctggccaagaaaggtatcgtgccattaccagtgcatactaccgtggtgcagttggtgctttgcttgtttacgatgtaacgaggaaccccacatttgaaaatgttggaaggtggttaagagagttgagggatcacactgatcccaatatagttgtcatgctcgttgggaacaagtctgatctccgacatctggtggcagtctcgactgaggatggaaagtcatttgctgagaaggagtcactctacttcatggaaacttctgcactggaagcaactaatgtggaaaatgcttttgctgaggttcttactcagatataccgtattgtgagcaagaagacaatggaaacaggcgagaatggagctgcatcgaacattccttcaaagggtgagaaaatcgacgtcagtaaagatttatccgctatgaagagcggcggttgctgttcgacataaatcatgtcttcatgtacaccaaaattttcttgcagaagaagatgactggaagaaatgttttcttctatatcaagagtcctgggaaatgttacttttgcaggcaaagagttgttagaaaccgcaggttttatttctattgctttcaatatagatggaattctggttcagaagttgtggaattcttcaatattattaacctttt

SEQ ID NO: 11317 - DNA, 1267 bp, Sesamum indicum
agaaagaactcaaaagagaaaagaaacggaaatactttcacagtcacacagtagtaaaatagagaatagccatcatcttacagattgctttacttttaccatcctcattgtgctctttgaagtatcacccccattgttcgtttttcagaagagggtttcataagctggatcctcataccctgtgataagtctaaaagagagagagatggcaggctacagagcagaagatgactatgactacctcttcaaggtggttttgataggggactcaggggtgggcaagtccaacttgctttcaagattcaccaggaatgagttcagccttgagtccaaatcaactattggtgttgagtttgccaccagaagcttgactgttgatggaaaagtcatcaaggctcagatttgggacactgctggccaagaaagataccgagccatcaccagtgcgtactaccgtggtgctgttggtgctttgcttgtctatgatgtcactaggcactccacatttgaaaacgtcgaaaggtggctaagggagctgagagaccataccgatcccaacattgtcgtcatgcttattggcaacaaatctgaccttcgacatctggtggcagtctcaaccgaagacggaacttcttttgctgagagggagtcactttactttatggagacttccgcacttgatgctactaacgtggataatgcgttcacagaggttcttactcagatatatcggatcgtgagcaagaagaccatggagacgggtgatgatggggctgcagcaaacgtcccttccaagggtgagaaaatcgacgttagtaaagatgtatctgctgtgaagaaagccggctgctgctcctcgtaggtttaaaaagacggttcgcggaaattgacacaacgcattgtgtttgtttcgctgcacctgttcgggtttgtggtgtaaaattttatccaatcgatgccactgctgcagatattagccgcaaagagaagaataactattattaacatgctttactctaccgctttcacgttagatggaatgtcaattcattagatgtctagggaacaatgttctgaaccaaacaccatatttctgccgctgcttcagttcaatttgcttccaatttctaagaattacacattcttttcctatgtatttcctgccaccattcaccaagtacatctgtctgtctgaagaatctcttttcaaacagcattttgagctgatggtaatattcttacaagttacagcaatattgagaaaccg

SEQ ID NO: 11318 - DNA, 901 bp, Tripterygium wilfordii
caacttttggtaaagcgaagccgacagcagtctcttccgtttccacctcgctccgaaacaaaagaaaggtcaagatattttctgaaatcaaaggataaataaaaagaaaaggaaagtgagatcttctggtaaatcttgaaagctccatctctccccaacgaactcctactgttgttgttgttgtttgttcggaagtaggaggcgacaatggccgggtatagggcggatgatgactacgattacctcttcaaggtggtcctaatcggcgattccggtgttggcaagtccaacctgctttcgaggtttactcgcaacgagttcagcctcgagtccaagtccacaatcggtgttgagttcgctactcgcagcttgaacgttgatggcaaggttatcaaggcccagatttgggacactgctggtcaagaaaggtaccgtgccataaccagtgcttattatcgaggagcagttggtgcactgcttgtctatgatgtcactcggcactccacatttgagaatgttgagagatggttaagggagctgagggatcacacagatcccaacattgtggtcatgctcattggtaataaatcagatcttcgtcacctagttgccgtctcaaccgaggatggaaaatcttttgctgagagagagtctctctacttcatggaaacttctgctttggaagcaactaatgtagacagtgcatttgctgaactgcttactcagatataccgtatcgtaagcaagaaggcgatggagagtggtgaagatggagctgctgcagctgttccatcgaaaggagagaaaatagacgttagtaaagatgtttctgctatgaagaaaggagggtgctgctcgagctagaattctagtctaaatttgattcttcatgagatgttgg

SEQ ID NO: 11319 - DNA, 949 bp, Valeriana officinalis
acacatggcttttcgctatctgtatgtgtttgcagtttatgtaccaaaccccaccatttcaattttatacaccaaatcctccattgatatactgagagattgaggtagtggagttatggctggttacagagctgaagatgactatgattatctcttcaaagttgttttgattggagactctggtgttggaaaatccaacttgctttccagatttactagaaatgagttcagtctcgagtctaaatctactatcggcgtcgaattcgctactagaagcctcactgttgatactaaggttattaaagctcagatttgggacactgctggtcaagaaaggtaccgggcgataacaagcgcatactaccgaggagcagtgggcgctttactagtctacgacgtgacccgccactcaacgttcgaaaatgtcgaaaggtggctaagggagctgagagaccacactgaccccaacatcgtagtcatgctcatcggaaacaaatccgatctccgccaccttgtcgcagtccccacagacgacgccaaatccttcgccgaacgagagtctctctacttcatggaaacttccgccctcgaagctaccaacgtcgagaacgcgttcagcgaggtcctcactcaaatctaccgcatcgtcagcaagaaagccatggacacggcaaacgatgcagacggttcggccgtaccgtccaaaggcgagaaaatcgacgtcggtaaagacgtctccgctatgaagagagtcggatgttgttccaattagggttttgaagtgaaattcgggtgtgtaaaattagaaagcaagccatgcatgatcggttttttgtttgaggttctttcgatatatattgttgttgttttcggttttattatcattaacactagtttctctttatacgttgcgtttttcatgacattgttttcaaagaatgataatttt

SEQ ID NO: 11320 - DNA, 1015 bp, Nuphar advena
agagctgagagaggttttgagtctctcctcctgcttaatcttttttgtggtcatctttccttttgttgtccttagtctctcagagagagagagagagagagagagagagagatggctatctatagagctgaggatgactatgactacctcttcaaggtggtgttgatcggggactcgggtgttggcaagtccaacttgctctcaaggttcacaaaaaacgagttcagcttagaatccaagtccaccatcggcgtggagttcgcaaccaggagtctcaatgttgatgggaaggtcatcaaggctcagatttgggacactgctggtcaagaaaggtaccgcgctattaccagtgcatactacaggggagcagttggcgcactgcttgtgtatgatgtcacccgtcatgctacatttgaaaatgttgagagatggctcaaggagttgagagaccacactgaccccaatatagttgtgatgctcattgggaacaagtctgaccttcgtcaccttgtcactgtttctactcaagatggaaaatcttttgccgagcgtgagtctctctatttcatggagacatctgcactggaagccacaaatgtggagaatgcatttgctgaagttttaacgcagatttaccatattgtgagcaagaaagctgttggggctggtgaagatggagcagcaaccacgttgcctagcaaaggagagaggataaatatcgcgaataaagatgatgtttctgcattgaagaaaattgggtgctgctcaagctagagggatcgttgttgttgcttcaaagggatatgtttggtttactttagttgctctaccgccattgtttcttgtataccaatcttcagcttcaaatgtagacttgtctttgtctggcctttggacatagaagcatgagttgtaggggcaggttttttatcctattgtttgaaatccagcggtcaagggttatatttaatctgttctcagatgacatttcagtgtttgaagactttaaagaatc

SEQ ID NO: 11321 - DNA, 950 bp, Gossypium hirsutum
tctctctcatattcatcactcgaagcaaagtaaagggaagtaaaaggagggttttgaggagagtgaaagatggctggttacagggcagaggatgactacgacttccttttcaaggtggtgctgatcggtgattcgggagtaggcaagtctaaccttctctcaaggttcaccaggaacgagtttagcctcgagtccaagtccactattggcgttgagttcgctactcgtagcttgaatgttgatggtaaggtcatcaaggctcagatttgggacactgctggtcaagaaaggtaccgtgccatcacaagtgcctattaccgaggagctgttggtgcgctacttgtgtatgatgtgacccgacactccacgtttgaaaatgtggagaggtggttaagagagttgagggatcacacggatcccaacatcgtggtcatgctcataggcaacaaatcagatctccgacaccttgtggctgtcccaactgaggatgcaaaatcctttgcggagaaagaatccctctacttcatggaaacttcagccctggaagcaacaaacgtggaaaacgcattcgcagaagtgctgacacagatctatcacatagtaagcaagaaggcaatggagacaagtgatgaaggggctgcttcagctgttccatccaagggggagaaaattgatgtcagtaaagacgtgtctgcaatgaagaaagggggttgctgctcgagctaagggatgaagaagatgttaaaacctgcagtctctgattgttttaagggatgcaggcatggatggggatttcattgtaaaccttgggttctgtaaaatttttctcaaaaaggtaccctatagtaggatatgggtggactggagattgatttaatttacataaaaaaaattcataatggctgttaatttgagtagacaaaaggcatgtgaggaacagggttttacat

SEQ ID NO: 11322 - DNA, 866 bp, Vaccinium corymbosum
cagtagtggtagtgctggtagatattgatggcagggtacagagctgaagatgactatgactacctcttcaaggttgttctgatcggagattcaggcgttggcaagtccaatttgctttcaagattcactaggaacgagttcagcctcgagtccaagtccacaatcggtgttgagtttgctactagaagcttgaatgttgatggaaaggtcatcaaagctcagatttgggacactgctggccaagaaaggtatcgcgccatcactagtgcctactatcgaggtgctgtgggcgctcttcttgtatacgacgttacccgccactccacttttgaaaacgttgagaggtggcttagggagttgagggaccacacggatcccaacattgtagtcatgctcatcggaaacaaatccgatctccgacacctcgtggcagtttcaaccgaggatggaaagtcatttgccgagagggagtcactcttctttatggaaacctccgctttagaagccactaatgtggaaaatgcattttctgaagttctgactcagatctatcgcattgtgagcaagaaggctatggagtctgccgatgatggagctgcttctgctgtcccttccaaaggagagagaatcgatgttggtaaagatgtgtcggcgatgaagagggttgggtgttgttcgtcttagggcttaaatcatatttgatttgcttcaattcagatgtggctggtttgctcgcggcatctattatgtagactctgactatcgtgtaaaattctctctcaaagatgcttacattaggagaaaatgtgggattagtaatttttgcaatgttttttgacaatgatttattatcgtttatgcgaaaa

SEQ ID NO: 11323 - DNA, 971 bp, Chelidonium majus
ccaaaattataaaggaaaagatacaaagagaagaaccgaaaactccactcagcttcttctcttctttctcttttgcaaatctcatactatatttgcagagaagaagagaagaaaaaacaacaatgggtgcgtataaagctgaagacgattacgattacctcttcaaggtggttttaatcggagattcaggtgtgggtaagtcgaatttgctttcgagattcacgagaaatgagttcagtctcgagtccaagtctaccattggagtagagtttgctactaggagtctgaatgtcgatggtaaagtcatcaaagctcagatttgggatacagcagggcaagaaaggtatcgtgccattactagtgcttactaccgaggagctgttggcgcactactagtatatgacgtcactcgacatgccacgtttgagagtgtagagcggtggttgaaggagttaaggaaccacacagacccaaacattgttgttatgctcattggaaacaagtctgatctacgtcacctagtggctgtctcaaccgaagatgggaaatcctttgctgaacaggaatccctctatttcatggaaacttctgcattggaagcaacaaatgtagaaaatgcattcgctgaagtcctgactcagatctaccgtatcgtgagcaagaaagcagtggaggcaggggatgatggatctgcttcggctgtccctgccaaaggtgagaaaattaatatcaaagatgatgtttcagcgatgaaaaaagttgggtgctgctcaagctaggtttcttgaggtcgaatactggtggtaaaggacgtggttgtttaatttttgctgcatctggtattttattttctgtataagctttttcaggatatcaaaactagggagagagtagggaaattattagtctttcttttaagacacttgacttgttatttttgcccgtgcaagcacgggccctttttatgattt

SEQ ID NO: 11324 - DNA, 1143 bp, Gossypium hirsutum
agaaaaagcatgataaacttgaaactctcccctgtttcacactctctttctcatattgttactccacacaaagcaaaagggaaagtaatatagtatcaacatcagtggttttgagaggaaaaaaggaagggtgaaatatggctggttacagagcagaggatgactatgactaccttttcaaggtagttttgatcggtgattcaggtgtggggaagtctaatttactctccaggttcaccaggaacgagttcagcctcgagtccaagtctactattggcgttgagttcgctactcgtagtttgaatgtggatggcaaggtcattaaagctcagatttgggacactgctggtcaagaaaggtaccgtgcaataacaagtgcctattaccgaggagctgtgggagcactccttgtgtacgacgttacacgccactccacattcgaaaatgtagagaggtggctaagagagttgagggatcatacagatcccaacatcgtagtcatgcttgtcggaaacaaatcagatcttcgtcaccttgtggctgtctcaaccgaggacgggaaatcctttgctgagaaagaatccctttacttcatggaaacttctgctctggaagctactaacgtggaaatttcatttgctgaagttcttacgcagatatacaacgtcattagcaagaaagctatggagacaagcgatgatggggctgcttcagctgtgccctccaagggagagaaaatcgatgtcggtaaagatgtctcggcaatgaagaaagggggttgctgttcaagctgatatcgatctgaaagtctggggtttgttcagctgcattgatttctttgtaaaccattgtttcgtcacattttcgtaaaaagtgtgcattgtggaggcccgaacccgacttgtgaagtattgtccgcttttaacataggtccgagtttaagtctacatataatatcgtggtagatgcttcgaatttcttgatataggattggggtgttacatccataagctaaagtgctaaagtaggggattagcagtaatggagattgagttacttgttggaaaatactattttctatcctcttccattttcaggcagatctaaaatgaatgaatggttttaaagtccttactttttgag

SEQ ID NO: 11325 - DNA, 733 bp, Euphorbia peplus
gaggagaggagaggagaggaaaaaaactcatggcaggttacaaagctgaagatgactacgattaccttttcaaagttgtgctcatcggcgattctggtgtaggcaagtctaatcttctctctagattcactcgtaatgagttcagcttggagtctaaatccactattggagtcgagttcgctactcgcagcttaaccgtcgatggcaaggttattaaggctcagatttgggatactgctggccaagagaggtaccgagcaattacaagtgcttactacagaggagcagtaggagcattactagtctatgacgtgacccgacactcaacatttgagaacgtggagaggtggctaagggaactgagggaccacacggatcccaacatagttgtgatgctaataggtaataaatccgatcttcgccacctggtagctgtccaaaccgaggacgggaaatcctttgcagagagagaatccctctacttcatggaaacttctgctctcgaatcaactaatgtagacaatgcatttgctgaagtgcttactcagatatatcgtatcgttagcaagaaagccatggaggccggggatgagagcgccacgtcagctgtcccctccaaaggagagaaaatcaatgtgaataaagatgtttctgccatgaaaagagtcccgtgctgctcaagctaggagttttattggagctggtttgtttttgctgctatctgtttctatta

SEQ ID NO: 11326 - DNA, 1149 bp, Gossypium raimondii
tcctctaattttcactctcgagtccctcttctcagagacagcagtcttttacattggaaaatatttaaaaagaaatttacgtttttttctttttctttttttgtagtgagagatcttaaagttgaaacgaaaccctcttttgcacgctctttctctctctcatattcatcactcgaagcaaaagtaaaagggaaagtaaaaggagggttttgaggagggtgaaagatggctggttacagggcagaggatgactacgacttccttttcaaggtggtgctgatcggtgattcgggagtaggcaagtctaaccttctctcaaggttcaccaggaacgagtttagcctcgagtccaagtccactattggcgttgagttcgctactcgtagcttgaatgttgatggtaaggtcatcaaggctcagatttgggacactgctggtcaagaaaggtaccgtgccatcacaagtgcctattaccgaggagctgttggtgcgctacttgtgtatgatgtgacccgacactccacgtttgaaaatgtggagaggtggttaagagagttgagggatcacacggatcccaacatcgtggtcatgctcataggcaacaaatcagatctccgacaccttgtggctgtcccaactgaggatgcaaaatcctttgcggagaaagaatccctctacttcatggaaacttcagccctggaagcaacaaacgtggaaaacgcattcgcagaagtgctgacacagatctatcacatagtaagcaagaaggcaatggagacaagtgatgaaggggctgcttcagctgttccatccaagggggagaaaattgatgtcagtaaagacgtgtctgcaatgaagaaagggggttgctgctcgagctaagggatgaagaagatgttaaaacctgcagtctctgattgttttaagggatgcaggcatggatggggatttcattgtaaaccttgggttctgtaaaatttttctcaaaaaggtaccctatagtaggatatgggtggactggagattgatttaatttacataaaaaaaaaattcataatggctgttaatttgagtagacaagaggcatgtgaggaacagggttttacattatttgtgatctggttggtgaaatttgaaaacacccccacg

SEQ ID NO: 11327 - DNA, 910 bp, Euphorbia esula
aaagcagacagcggtctcgcccatttccactattcaatacacacaacaaaaagggtcaaaaagaaagaacacacaaaaaaagctttcaaattattcacagagacagagagagagagactcaattttgaaattctctcgcacaaatctctcttcatttctctcaaagcaaaaaagctcgaggagaggagaggagaggaaaaaaactcatggcaggttacaaagctgaagatgactacgattaccttttcaaagttgtgctcatcggcgattctggtgtaggcaagtccaatcttctctctagattcactcgtaatgagttcagcttggagtctaaatccactattggagtcgagttcgctactcgcagcttaaccgtcgatggcaaggttattaaggctcagatttgggatactgctggccaagagaggtaccgagcaattacaagtgcttactacagaggagcagtaggagcattactagtctatgacgtgacccgacactcaacatttgagaacgtggagaggtggctaagggaactgagggaccatacggatcccaacatagttgtgatgctaataggtaataaatccgatcttcgccacctggtagctgtccaaaccgaggatgggaaatcctttgcagagagagaatccctctacttcatggaaacttctgctctcgaatcaactaatgtagacaatgcatttgctgaagtgcttactcagatatatcgtatcgttagcaagaaagccatggaggccggggatgagagcgccacgtcagctgtcccctccaaaggagagaaaatccatgtgaataaagatgtttctgccatgaaaagagtagggtgctgctcaagctaggagttttattggagctggtttgtttttgctgctatctgtttctatta

SEQ ID NO: 11328 - DNA, 904 bp, Rosa hybrid cultivar
aaaacccacttatattttcttagagggaaaaacaaaaacagagagatctaagaaagaacgtacctgttgtcttgtgttacagtgagaaacaaaaagaagaagaagaaaccaatggccgggtacagagctgaggacgactacgactacctcttcaaggtggtgttgatcggcgactcgggtgtgggcaagtccaacttgctctccagattcacccggaacgagttcagcctcgagtccaagtccacaattggggtcgagttcgccacccggagcttggatgtggacggaaaagtcatcaaggcccagatttgggacactgccggccaagaaaggtacagagcaataactagcgcttattatcgaggggctgtgggtgcactgcttgtgtatgatgtcactcggaattcaacatttgaaagtgtggaaagatggctaagggagttaagagaccatactgatcccaacattgttgtcatgctggttggtaacaaatcagatctacgccaccttgtggcagtctcaactgaggatggaaaatcctttgccgagagagagtccctctacttcatggaaacttctgcactcgaagcaactaatgtggacaatgcatttgctgaagtccttacccagatctttcacatagtaagcaagaagaccatggaggctaacaatgatgcagctgctgttccttcccaaggagagaaaattgatgtcagtaaagatgtttcagctgtgaagaaaggcgggtgctgttcaagctagattttgaatctgcatcagatttgtctggtttatgttgccacatctgtttctctgtataccggggtgttgtgtaaaatttttcatccaaagacattaggtgctaagcggggttcaatttcttacttccagtgtcattatctac

SEQ ID NO: 11329 - DNA, 1031 bp, Arachis hypogaea
agttcttcagttcccactgctttcactctctcactcgctctctctctctctcttcatccccaacaccaacaccactatcttcctactttattctctcttcaatggcgggttatagagccgacgacgactacgactacctcttcaaggtggtcctgatcggcgactccggcgtcggaaagtccaacctcctctcgcggttcaccaagaacgagttcaaccttgagtccaagtccaccattggcgtcgagttcgctactcgcaccttgaacgtcgattccaaagtcatcaaggctcagatctgggacaccgccggtcaagaaaggtatcgcgccataaccagcgcttactaccgtggggctgtaggtgcacttcttgtgtatgatgtcacccgccatgcaacattcgagaatgttgacagatggcttaaagaattgcgaaaccacacggatgccaacatagttgtgatgcttgtcggtaacaaatcagatctccgccaccttgtagccgtgtcaaccgaagacggcaagtcttatgccgagaaggaatcactgtacttcatggaaacctcagctctggaggccaccaatgtagagaatgcatttgccgaagttctaactcaaatctaccgaattgtgagcaagaaagcggtagaggctgcagagaatggaactgctgccgttcccgcgaaaggggagaaaatagatcttaaaaatgatgtttctgcattgaaaagagttggttgctgctcaagctaaggttggaacaacataattcaattggttcttaccggctatattgtacttgtaatattctgagatacaaatttagtagcaaaaaaacaaagaaaagaatttaatttttcatagcatgttagacctttatgtgtaaccttaaaattaaaaccatgttttttcatgtccagtaggagctgctggtgaagcaaattgattgctgagcagcgtagtcttatttattgtagtgtattgttttgaaatgttttcacttgcaaaggttcaagcttgagattaatt

SEQ ID NO: 11330 - DNA, 1169 bp, Populus trichocarpa
aaaaaactggacttggagtccagcccagcaaagcaccgagacagagagcgggagagagacagcagtcccctccatttccaactcccaataccccacaagaggcaagagaactcacaaaaaaaaacagcattttcatcctctctttctgtctctacagggctttacttctttgaagcaaagcaagcataatactattggtgtgacaactactaatggcagggtacagagccgaagatgactatgattacctgttcaaggttgtacttattggcgactcaggtgtgggcaagtccaatcttctttcaagattcactcgtaatgagttcagtttggagtcgaagtctactattggcgttgagttcgctactcgcagcttgaatgttgattccaaggtcattaaggcccagatttgggacactgctggccaagaaaggtaccgtgccataactagtgcttattaccggggagcagtgggtgcattgcttgtgtatgatgttacccggcactcaacatttgaaaatgttgaaaggtggctaagggagttgagggatcatacagatcctaacattgttgtcatgctcatcggcaataaatcagatcttcgccacctggtggctgtctcaactgaggatggaaaatcctttgccgagagggagtccctctacttcatggaaacatctgctttggaagctactaatgttgacaatgcatttgctgaagttcttaatcagatctatagtattgtgagcaagaaagctatggagacaggtgacaatgcagcagcttcagctgttccatccaaaggtgagaaaatcgatgtcaataaagatgtttccgctatgaagagggtggggtgctgttcaagctaggattttgatctgactattatattgtttaggagatgtagctggtttgatatgctgcgtctgtttcaatgctcaccattattgtgtaaaattttctcaaagatgccaaccataggagatcggcggattgcttttattttgatcttaagccttttcttctactgttctagttgacaaagagcttgattagcaatgaagtattacactagtcgttttcaaacctgtatgtatattttataaaaaatataaaatatttactggcaagaattggataagactatttaggagttatgacaacaacca

SEQ ID NO: 11331 - DNA, 1227 bp, Gossypium hirsutum
acattttctggagtccaacggagcagacattctagtcttttacatttccaactcataccaaaaccaaaacaacttagattttttttcttaggcagatctcaaaagaagaggcttttaatatacttagaagccgcgtgccatctcctctttcacacactcgtttatttacttgacgcaaagaaagagggtaacagctgtggttctgtgaaagagtaaagatgtctggttacagagctgaggatgactatgactatcttttcaaggtggttttgatcggtgattccggagtcggaaagtcaaatctgctctcgaggttcaccaggaacgagtttagcctcgagtccaagtccactattggtgttgagttcgctactcgtagcttgaatgttgatggaaaggtcatcaaggctcagatttgggacactgctggtcaagaaaggtatcgtgccataacaagtgcctattatcgaggagctgttggtgcacttcttgtgtatgatgttacacgacactccacattcgaaaatgtagagaggtggttaagagagttgagggatcacacagatcccaacattgtagtcatgctcattggtaataaatccgatcttcgtcaccttgtggctgtctcaaccgaagatgggaaatccttcgcggagaaagaattcctctacttcatggaaacttctgccctggaagctactaatgtcgaaaatgcatttgccgaagttctgacacagatctaccatatcatgagcaagaaagctatggagaccagcgaggaagggaatgcttcagctgtcccatcgaagggagagaaaatcgatgtcagtaaagacgtgtcagctatgaagaagggaggttgctgctcaagctaggatgatcacactaatctgaagtcagattgtttaaatgatgcggccggggtttcgatttcatcataaaccttggttttgtataattttcttaaaagggtgccctaaagtaggagatctgagcagagattgatttaatttttcattcatttttttccctgatgactgttattgttagtagacaagaggattacgaagaacagggtcttacactattgcatttaaatatgtgcttagaacgtctgtttacttagaacaaattgtgcccaactcttttgttggaaataccatatgccatttgtttcttcatttctctaacagatcccaaaaaatccccgtaacccatcataaatta

SEQ ID NO: 11332 - DNA, 1225 bp, Gossypium raimondii
attccagaaaaggccccaactttcaaggatatttccccacattttctggagtccaacggagcagacattcagtcttttacatttccaactcataccaaaaccaaaacaactagatttttttttcttaggcagatctcaaaaaaagaggcttttaatatacttagaagccgcgtgccatctcctctttcacacactcgtttatttacttgacgcaaagaaagagggtaacagctgtggttctgagaaagagtaaagatggctggttacagagctgaggatgactatgactatcttttcaaggtggttttgatcggtgattccggtgtcggaaagtcaaatctgctctcgaggttcaccaggaacgagtttagcctcgagtccaagtccactattggtgttgagttcgctacacgtagcttgaatgttgatggaaaggtcatcaaggctcagatttgggacactgctggtcaagaaaggtatcgtgccataacaagtgcctattatcgaggagctgttggtgcacttcttgtgtatgatgttacacgacactccacattcgaaaatgtcgagaggtggttaagagagttgagggatcacacagatcccaacattgtagtcatgctcattggtaataaatccgatcttcgtcaccttgtggctgtctcaaccgaagatgggaaatccttcgcggagaaagaattcctctacttcatggaaacttctgccctggaagctactaatgtcgaaaatgcatttgccgaagttctgacacagatctaccatatcatgagcaagaaagctatggagaccagcgaggaagggaatgcttcagctgtcccatcaaagggagagaaaatcgatgtcagtaaagacgtgtcagctatgaagaagggaggttgctgctcaagctaggatgatcacactaatctgaagtcagattgtttaaatgatgcggccggggtttcgatttcatcataaaccttggttttgtaaaattttcttaaaagggtgcctaaagtaggagatctgagcagagattgatttaatttttcattcatttttttccctgatgactgttattgttagtagacaagaggattacgaagaacagggtcttacactattgcatttttaaatatgtgcttagaacatctgtttacttagaacaatttgtgcccaactcttttgttggaaatgccatatgccatttgtttcttcatttctc

SEQ ID NO: 11333 - DNA, 1150 bp, Populus trichocarpa
gagagacagcagtcccctccatttccaactcccaataccccacaagaggcaagaaaagtcacaaaaaaaacagcattttcatcctctctttctgtctctccagggctttacttctttgaagcaaagcgagcataatactattggtgtgacaactactaatggcagggtacagagccgaagatgactatgattacctgttcaaggttgtacttattggcgactcaggtgtgggcaagtccaatcttctttcaagattcactcgtaatgagttcagtttggagtcgaagtctactattggtgttgagttcgctactcgcagcttgaatgttgattccaaggtcattaaggcccagatttgggacactgctggccaagaaaggtaccgtgccataactagtgcttattaccggggagcagtgggtgcattgcttgtgtatgatgttacccggcactcaacatttgaaaatgttgaaaggtggctaagggagttgagggatcatacagatcctaacattgttgtcatgctcatcggcaataaatcagatcttcgccacctggtggctgtctcaactgaggatggaaaatcctttgccgagagggagtccctctacttcatggaaacatctgctttggaagctactaatgttgacaatgcatttgctgaagttcttaatcagatctatagtattgtgagcaagaaagctatggagacaggtgacaatgcagcagcttcagctgttccatccaaaggtgagaaaatcgatgtcaataaagatgtttccgctatgaagagggtggggtgctgttcaagctaggattttgatctgactattatattgtttaggagatgtagctggtttgatatgctgcgtctgtttcaatgctcaccattattgtgtaaaatgttctcaaagatgccaaccataggagatcggcggattgcttttattttgatcttaagccttttcttctactgttctagttgacaaagagcttgattagcaatgaagtattacactagtcgttttcaaacctgtatgtatattttataaaaaatataaaatatttactggcaagaattggataagactatttaggagttatgacaacaaccaattagctaataatcgttctttgcaaattgtggtgt

SEQ ID NO: 11334 - DNA, 1114 bp, Papaver somniferum
ctatacccttcttttattcttctcttcttcatctctttagcaaaaatctcattttgtaaatttttgcaaagaagaagagaagaaaacaaaactaacaaaaatgggtgcgtataaagctgaagatgactatgattacctatttaaggtagttttaatcggagattcaggtgttggtaagtcaaatttactctctagatttactaggaatgagttcagtctcgaatccaagtctaccattggtgttgagtttgctactaggagtctgaatgttgatggtaaagtcatcaaagctcagatttgggacactgctggtcaagaaaggtaccgtgccattactagtgcttactatcgaggagctgttggcgcactcctagtgtatgatgtcactcgacatgccacatttgagagtgtcgagaggtggttgaaggagttgaggaaccacacagaccctaacattgtcgtaatgctcatcggaaacaagtctgacctgcgtcaccttgttgctgtctcaaccgaagatgggacatcctttgcggaaagagaatcactttatttcatggagacttctgcattggaagcaactaatgtagaaaatgcatttgctgaagtgctgactcaaatttaccgtatcgtaagcaagaaggcagtggaggcgggcgatgatggatcagcttcagctgtacctgccaaaggtgaaaaaataaacatcaaagatgatgtctcagcacttaaaagagttgggtgttgctctacctagggtgtatcaaggatctactgaatatttctgcttgaaaaggatatggtttgtttatttagcttcatctgtaatttcatttctgtgtatgattccttaggatatcaaaactggggagctgatggaaagagagatagtaccaaagtagtagtcttgttttcaatagacttatttgctataatgaagaccgagtggaaaagagagtttaggtacggaaaacatcttccctcgactgtttcttcgtttagtatttatattttagatataacttcagtttgtgacgactagattgcaatcagaatgtggtgttgcgagaacagggtttatatggctttgaatgtatgtggataggtcttctaa

SEQ ID NO: 11335 - DNA, 989 bp, Scabiosa columbaria
aaaacgacaagaaagctaaagtttagagagagaaacatctttaccttttacattctctcccctctcaaaactccaaaccccaccatttcagcacgcaagaagaaaaaagcaacaattttttcctctaaatcaattgctatactcatatacaacagctagcatagtaatggctggttacagagctgaagatgactatgattacctcttcaaggtagttcttattggagactctggtgttggcaaatccaacttactttccagatttaccagaaacgagttcagcctcgagtccaaatctactattggtgtcgaattcgctactagaagcttgactgttgataccaaggtcattaaagctcagatttgggacactgctggacaagaaaggtatcgagccatcactagtgcttattacagaggcgctgtcggcgctttgctcgtgtatgatgtcacccgccactccacatttgaaagtgtggagaggtggctaagagagctaagggaccatactgacccaaacatcgtagtcatgctcattggtaacaaatccgatcttcgccaccttgtcgcagtctcaacagaggatggaaaatcctttgccgagaaagaatctctctacttcatggaaacctctgcccttgaatctactaacgtagaaaatgcattcagtgaagttctcactcaaatttatcgtattgtgagcaagaaggcaatggagacaactaatgaaggacccggttctgctgtgccttctaaaggagagaaaatcgacgttagtaaagacgtatcggctatgaaaagagttgggtgctgttcaacttagggtattttcaatgaatttcatgttgtttcagtgtaaaattttcttaaagaaagccggttgaggatttgagcgtgggctgggttttcgaatttgagtatgatgatgatttgcagggattgaggttaattagagaatgttgaaatatatggtattttgtgtaaggtgt

SEQ ID NO: 11336 - DNA, 1133 bp, Fragaria vesca
tggataaaccgaggagcctcatggtatttacattacgctttccctcaccgttcaacttttaaaaacactttcacgcttcccacttctctctctctctctctctctctctctgcaaatctctctctcactttctctctcttccccaaaatatcaaagcaagctcggaagcgatggccgggtacagagcggacgatgactatgactacctcttcaaggtggtcctgatcggcgactccggcgtcggcaagtccaatctcctctccaggttcaccaagaacgagttcaacctcgagtccaagtccaccattggcgtcgagttcgccacacggaccttgaacgtcgacagcaaagtcatcaaggcccagatttgggacaccgctggccaagaacggtaccgtgccattacaagcgcttactatcggggggcagtgggtgcactccttgtgtatgatgtcactcgtcatgcaacttttgagaatgttgacagatggctgaaagaattgaggaaccacactgattccaacattgttgtgatgctggttggaaacaaatcagatctccgccaccttgtagctgtctcgactgaagatggaaagtcctatgctgagaaggagtcactctacttcatggaaacatctgcactggaagcagtcaatgtggaaaacgcatttgctgaagttctgactcaaatctaccatattgtgagcaagaaggcagtcgaagcgggagaaaatggaacagcttcatccgtcccagccaaaggagagaaaataaatataaaagatgatgtgtctgctctgaagagagttgggtgctgctcgagctaggccaggtaacaaaacttatgaatgaatattgcttatctttaacttgtgtaatatttttccgacggatacaaactagaggatatgaaacatgaggttttccttgagtggttaagctagttatagtatccaaatttagtgacaattcctgtgaatgctgattagcccatttaaatcgcctttcagcaccaactctgctttctatgtttgttttccccaaggatatatttggtgaatttaaatatcaaaattgtatcaacatctttatttttgtttacaccaaagtgcccccacctttatttggatgca

SEQ ID NO: 11337 - DNA, 1226 bp, Gossypium hirsutum
agcagacagcagtcttttacatttccaacttggtaaataaaggtttaattttatttttatttctagagaaatctttttaagaattttttttaaaagctcaataaactcgaaaccaatcctccatttgaaaaaaagagaaagtgaaaaatggctggttacagagcagaagatgactatgattaccttttcaaagtagtattaatcggtgattcaggtgtgggaaaatctaatttactctcaagattcacaaggaacgagttcagcttagaatccaaatccaccattggtgttgagttcgcaactcgaagcttaaatgttgatggcaaagtcatcaaagctcagatttgggatactgctggtcaagaaaggtaccgagccataacaagtgcttattaccgaggagccgttggtgcactcctcgtgtacgacgttacccgtcattccacattcgagaacgttgagaggtggttaagagagttaagggatcacacagatcccaacatcatagtcatgctcatcggtaacaaatcagatcttcgtcacctcgtggctgtcccaactgaagacgggaagtctttcgccgagaaagagtctctctacttcatggaaacttctgcactcgaagctacaaatgtcgagaatgcattcgccgaagttcttactcaaatctaccatatcgtaagcaaaaaagccatggagacagccgacgaagggactgcatcaaccgttccttccaaaggcgagaaaatcgatgttggtaaagacatctccgcaatgaagaaagggggttgttgctcaagctaagaaaatgacataaacccgaacatccagttgtttaacaacgcggctggggatcgttccgctgtgtcggttttgtagaatcttctcggaaaggcacctaagagtaggaatatcgggtgagaacggttcggtttacatccaaaattttttttccagggtattatattgttgaatttgaaaaggtgaattgggctatcaatgatgtttgtagtgtttatgttagtttaggaaatgcttttaccttttattgaatattacaaaggacagttgtggtgtttaaaacttaaaatcattcaagcaatgaacaccttttgattgttgtggccatgccataagtccctgtattatgtcgtaagtccttgactttttgtaaattatttgtaaattactttataccgtaaattctgatttttataaaaaaaaaa

SEQ ID NO: 11338 - DNA, 1069 bp, Fagus grandifolia
aagcttagcattcaaaaaaagagacacatccttctctacttctctgtctttgcttggagtccagcccaaccagctgactctggtctggtctctcacatttccaacccacaaaacaaaacaaaagaagtaaaaacacacacaaaatactcaaatttttagagagagaaagtagagcgagagggatctataaaaaactacataaaatctctctttcctctctgtctttttttctgaagtgaaagttgtttttggttttgtttggaggagtatggctgggtacagagctgaagatgattatgactacctcttcaaggtggtgctgatcggtgactcgggtgtgggcaagtccaacttgctctccaggttcactcgcaacgagttcagcctcgagtccaagtccaccatcggggttgagttcgccacccggagcttgaatgtggatagcaaggtcatcaaggctcagatttgggacactgctggacaagaaaggtaccgagccataactagtgcttactaccgtggggccgtaggcgcactgcttgtgtatgatgtcactcggcattccacatttgaaaatgtcgaaaggtggttaagggagttgagggatcacacagacccaaacattgtggtcatgctcattggtaacaaatcagatcttcgtcaccttgtggcagtctcaactgaggatgggaaatcctttgcggagagggagtccctttttttcatggaaacttctgctctggaggcgactaacgtggacaatgcttttgccgaagttcttactcagatctaccgtattgtgagcaagaaggccatggaggctggagatgatgcagctgcttcagccgttccttccaaaggagagaaaattgatgtcggtaaagaggtttctgctgtgaagagagttgggtgctgttcctcctagggttttaatctgcttgggatgtggctagtttgttttgctgcatctgtttctatgtacactatgattgtgtaaaattttttcagagatgcctacagtaggagataggccagatctgttttccttgtactttcaatttttttggtg

SEQ ID NO: 11339 - DNA, 1085 bp, Citrus sinensis
tgaggcagtcacgcagatctattaaatttaaaactctctctcaaagactcaaaacaagaagagaatagtccaagagagtgtgaagatataaaattgcaatagctatggctggatacagagctgaagatgactatgattatctttttaaggtggttttgatcggtgactccggtgtcggcaagtccaatttgctttctaggttcactaggaacgagtttagtctcgagtctaagtccacaataggtgttgagttcgctactcgtagcttgaatgtcgatggcaaagtcatcaaagctcagatttgggacaccgccggccaagaaaggtaccgtgccataaccagtgcatactaccgaggagctgtcggggcacttctagtgtatgacgtcactcggcattccacatttgaaaatgtggaaaggtggttaagggagttgagggatcacacagatcccaacattgtggttatgctcattggtaataaatcggatctccgtcacctggtggctgtctcaacggaggacgggaaatcatttgctgagaaggaatctctcttcttcatggaaacttctgctctggaggctactaatgtggacaatgcatttgctgaagtgctgactcaaatctaccgtattgtgagcaagaaggccatggagacaggtgaggatggaggaaattctgctgtaccttccaaaggagagaaaattgatgtcagtaaagatgtgtctgctgtgaagaaaggtggctgctgctcaacatagtgggttgatatatttttaacggaacgaagcggctatgttaggctctgtctgttttctcttctccgttattgtgtaaaattttctgaaaagtggcctacagtaggagataggcggtgattaatttctctttcagattcaaaatttttcccggtgactcttgtttttggctggctgactaggagtttatgtaggaacaatgaattacatacttaggtattgagtgggaacaaatttgcactgagaaattgtttatcgagagattcttgttcgcatctagaatcctatttcagtattgtgcatcctatttttcattaagaacatgat

SEQ ID NO: 11340 - DNA, 1092 bp, Plantago ovata
agagatctaatctaacctctcatccatcttacactgcaaacaattccatttagattgaataatggctggctacagagctgaagatgactacgattaccttttcaaactggtcctcattggtgattctggcgttggcaagtccaacttgctctccagattcactcgcaatgagttcagtctcgagtccaaatccaccattggcgttgagtttgctaccagaagcttgactgttgatggcaaggttattaaagctcagatttgggacactgctggccaggaaaggtaccgtgccatcacaagcgcatactatcgaggagctgttggcgctttactcgtctatgatgtcaccaggcactccacattcgaaagtgtcgaaagatggctaaaagagctgagggaccacactgacccaaacattgttgtcatgctcatcggcaacaagtccgatctccgacatctcgtggccgtctcaaccgaagacgggacctcatttgccgagagggaatcactctacttcatggaaacttctgcactcgagtctactaatgttgaaaatgctttcacagaggttcttacgcagatttatcatatcgtgagtaagaagaccatggaggccagtgaaaacggagctgcagcgaacctcccgtccaagggtgagaaaatcgatgttagtaaagatgtgtctgctatgaaaaagcccagttgctgctcttcttaagtgtcgatcctgagcgaatccaccattcttacgattttactcacgttgatatgatgcagctggcttgtttctgcagatattaacctgctaagagagagggagagagagatactattaacatgcttaaaatgcttatgttcattgttcaccaaaatatcatcatgttcatgtgattttactaagttttcttcttctatctatattggatattatggaacttttaaagtttcttcagttgaccgattgaaatgcatttcagaaagaaagctctgattcattcttactagttactagtagtagctattttacttctaccgtgtaaatgtaacccttcagttgaaaataattttgtcttgatcaaatagcgtcatgtt

SEQ ID NO: 11341 - DNA, 1072 bp, Papaver somniferum
ctttagcaaaaatctcaattttgtaaatttttgacaagaagaagagaagaaacaaaactaacaaaaatgggtgcgtataaagctgaagatgactatgattacctatttaaggtagttttaatcggagattcaggtgttggtaagtcaaatttactctctagatttactaggaatgagttcagtctcgaatccaagtctaccattggtgttgagtttgctactaggagtttgaatgttgatggtaaagtcatcaaagctcagatttgggacactgctggtcaagaaaggtaccgtgccattactagtgcttactaccgaggagctgttggcgcactgctagtgtatgatgtcactcgacatgccacatttgagagtgtcgagaggtggttgaaggagttgaggaaccacacagaccctaacattgtcgtaatgctcattggaaacaagtctgacctgcgtcaccttgttgctgtctcaactgaagatgggacatcctttgcggaaagagaatcactttatttcatggagacttctgcattggaagcaactaatgtagaaaatgcatttgctgaagtgctgactcaaatttaccgaattgtaagcaagaaggcagtggagacgggcgatgatggatcagcttcagctgtacctgccaaaggtgaaaaaataaacatcaaagatgatgtctcagcacttaaaagagttgggtgttgctctacttagggcgtaacaaggatctactgaatatttctgcttgatatggtttgtttatttagcttcatctgtaatttcatttctgtgaatgattccttaagatatcaaaactggggagatgatgaaaagagagatagtagcgaagtagtagccttgtttttagtagacttatttgctgtaatgaaaaccgagtgttaaagagagtttaagtacggaacacatcttccctatgtttcttggtttagtatttatatttatatgtaacttcagtttgtgacgattaagattacaatcagaatgtgatgtggcgaggacagggtttatttggctttgcatctatgtggatagtgttggtatt

SEQ ID NO: 11342 - DNA, 1241 bp, Gossypium hirsutum
gcgagtcttcggtttttttattaatatcatccctactgtgtggagtccaaccaagcagacagcagtcttttacatttccaacttggcaaaataaaggtttgtatttttattttttatttctagagaaatctttttaagaattttttttaaaaagctcaataaactcgaaaccaatcctccatttgaaaaaaaaagaaagtgaaaaatggctggttacagagcagaagatgactatgattaccttttcaaagtagtattaatcggtgattcaggtgtgggaaaatccaatttactctcaagattcactaggaacgagttcagcttagaatccaaatccaccattggtgttgagttcgcaactcgtagcttaaatgttgatggcaaagtcatcaaagctcagatttgggatactgctggtcaagaaaggtaccgagccataacaagtgcttattaccgaggagccgttggtgcactcctcgtgtacgacgttacccgtcattccacattcgagaacgttgagaggtggttaagagagttaagggatcacacagatcccaacatcgtagtcatgctcatcggtaacaaatcagatcttcgtcacctcgtggccgtcccaactgaagacgggaagtctttcgctgagaaagagtctctctacttcatggaaacttccgctctcgaagctacaaatgtagagaacgcatttgccgaagttcttactcaaatctaccatatcgtaagcaaaaaagccatggagacagctgacgaagggactgcatcaaccgttccttccaaaggcgagaaaatcgatgttggtaaagacatctccgcaatgaagaaagggggttgttgctcaagctaagaaaatgacataaacccgaacatccaattgtttaacgacgcagctgggggtcgttctgctgtgtcggttttgtagaatcttctcgaaaaggcgcctaacagtaggaatttcgggtgagatcggttcggtttacatccaaatttttttccagggaattatattgttgaatttaaataggtgaattgggctatcaatgatgtttgtagtgtttatgttagtttaggacatgcttttacctttttatgaatgttacaaaggacaattgtggtgtttaaaacttaaaatctttcaagcaatgaacaccttttgattgttgtgggcatgccataagtccctgtacctttttgtaaatttatcattatgtcataagtccttgtac

SEQ ID NO: 11343 - DNA, 963 bp, Castanea mollissima
tggttacagagctgaagatgactatgactacctgttcaaggtggtgctgatcggtgactcgggtgtgggcaagtccaacttgctgtccaggttcactcgcaacgagttcagcctagagtccaagtccaccatcggggtcgagttcgccactcggagcttgaatgtcgatagcaaggtcatcaaggcccagatttgggacaccgctggccaagaaaggtaccgggccataactagtgcttactaccgtggggccgttggtgcactgcttgtttatgatgtcactcggcattccacatttgaaaatgttgaaaggtggttaagggagttgagggatcacacagatccaaacatcgtggtcatgctcattggtaacaaatcggatcttcgtcaccttgtggcagtctcaactgaggatgggaaatcctttgccgagagggagtcccttttcttcatggaaacttctgctctggaagcaactaatgtggacaatgcttttgcagaagttcttactcagatctaccatatagtgagcaagaaggccatggagactggagatgatgcagctgcttcggctgttccttccaaaggagagaaaatagatgtcagtaaagatgtttctgctgtgaagagagctggatgctgttccacctagggttttaatctgcgtgggatgcggttggtttgttttgctgcatctgtttctatgtacactatgatttgtgtaaaattttttcagatgcctacagtaggagataggccagatgtgtttcgtttttacttttttttttggttgaagtctgaaatttgtagctaagaacttgtttaggaatcgggatttatcgctttcaaaggtgctcaattggcccaaaatttgcacccaatgtttgtatgttgacattcttgctcagagttaagagttaagacccataatcaaaatttctctatctggcaagccatgccctt

SEQ ID NO: 11344 - DNA, 1094 bp, Citrus clementina
tgaggcagtcacgcagatctattaaatttaaaactctctctcaaagactcaaaacaagaagagaatactcccaagagaggagagtgtgaagatataaagttgcaatagctatggctggatacagagctgaagatgactatgattatctttttaaggtggttttgatcggtgactccggtgtcggcaagtccaatttgctttcgaggttcactaggaacgagtttagtctcgagtctaagtccacaataggtgttgagttcgctactcgtagcttgaatgtcgatggcaaagtcatcaaagctcagatttgggacaccgccggccaagaaaggtaccgtgccataaccagtgcatactaccgaggagctgtcggggcacttctagtgtatgacgtcactcggcattccacatttgaaaatgtggaaaggtggttaagggagttgagggatcacacagatcccaacattgtggttatgctcattggtaataaatcggatctccgtcacctggtggctgtctcaacagaggacgggaaatcatttgctgagaaggaatctctcttcttcatggaaacttctgctctggaggctactaatgtggacaatgcatttgctgaagtgctgactcaaatctaccgtattgtgagcaagaaggccatggagacaggtgaggatgtaggaaattctgctgtaccttccaaaggagagaaaattgatgtcagtaaagatgtgtctgctgtgaagaaaggtggctgctgctcaacttagcgggttgatatatttttaacggacgaagcggctatgttaggctctgtctgttttctcttctccgttattgtgtaaaattttctgaaaagtggcctacagtaggagataggcggtgattaatttctctttcagattcaaaatttttcccggtgactcttgtttttggctggctgactaggagtttatgtaggaacaatgaattacatacttaggtattgagtgggaacaaatttgcactgagaaattgtttatcgagagattcttgttcgcatctagaatcctatttcagtattgtgcattctatttttcactaagaacatgattaag

SEQ ID NO: 11345 - DNA, 1196 bp, Eschscholzia californica
ccatccctctgtgctcctccccgacatctcaacacgcaacataacagtctctgaactcaatcaaacagacaaaacctacttgaacgaaaaaagaagattcagaatacccataaacaaatccacaacccatttcttctcttctctttcttttgtccaaatctcataccctttttgcagaacaagaagaagaagaagagaagctaaacattaacactaataatatgggtgcatataaagctgaagatgactatgattatctctttaaacttgttttgattggagattcaggtgtgggtaagtccaatttgttgtctagatttactagaaatgagttcagtcttgaatccaaatctactattggtgttgagtttgctactaggagtttgaatgttgatggtaaagttatcaaagctcagatttgggatacagctggccaggaaaggtaccgtgcaattacgagtgcatactaccgaggagccgttggtgcactattggtgtatgatgtcactcgccacgccacatttgagagcgtggagagatggttgaaggagttgaggaaccacacggaccctaacattgttgttatgttaatcggtaacaagtccgatttacgtcaccttgtggctgtctctacagaagatggaaaatcctttgctgagaccgaatctctctatttcatggagacttctgcattggaagcttcaaacgtggaaaacgcatttgccgaagtcctaactcaaatctaccgtattgtgagcaagaaggcagtcgaaactggtgacgatggatctgcttcagctgtcccagccaaaggtgagaaaataaacatcaaagatgatgtttcggctctgaaaagagtcgggtgttgctcgacttagggtttcggtgttggagaactaaaatgtcttatgcagcttgtactttgttttgtgttatatttatgagggtatcagaaatggaactaggagaaatgaatagtattagcttgtttaatggattcatttgttgtgatgaactagaagattagagttgagtgggggaactaggaaagcactgttttttccatatttatttcagacatggcctgaaaattttatcattcgatagaccagatcgaaatctcatgtgtgggtgtttgttttggtttgtattattcttgtttgggctttcaaaattgcaatctccagaataatttt

SEQ ID NO: 11346 - DNA, 1418 bp, Quercus alba
tgccattccatttattcctcatcgaaccgaaccaaacaaacaaagctcagcattcaaaaacagacacatccctctgtcttgctttggactccagcccaaccagactctctgcctctggtctctggaacatttccaactcacaaacccaaaaggtcccccaaaaaaaaaaaaagaggcaacaaaggtactaaatttagagagagagagagagagtagagtgagagagatctcaaaaaaagtaaaaacacacacacaattctctctctctccaaaccaaactgaaaactccctctgcttattttgggagcgaaagttttggtattttttgttttggaaaaaaatggctggttacagagctgaagatgactatgactacctgttcaaggtggtgctgatcggtgactcgggtgtgggcaagtccaacttgctgtccaggttcactcgcaacgagttcagcctcgagtccaagtccaccatcggggtcgagttcgccactcggagcttgaatgtcgatagcaaggtcatcaaggcccagatttgggataccgctggccaagaaaggtaccgggccataactagtgcttactaccgtggggccgttggtgcactgcttgtgtatgatgtcactcggcattccacatttgaaaatgttgaaaggtggttaagggagttgagggatcacacagatccaaacattgtggtcatgctcattggtaacaaatcagatcttcgtcaccttgtggcagtctcaactgaggatgggaaatcctttgccgagagggagtcccttttcttcatggaaacttctgctctggaagcaactaatgtggacaatgcttttgcagaagttcttactcagatctaccatatagtgagcaagaaggccatggagactggagatgatgcagctgcatcagctgttccttccaaaggagagaaaatagatgtcagtaaagatgtttctgctgtgaagagagctggatgctgttccacctagggttttaatctgcgtgggatgcggctggtttgtttcgctgcatctgtttttatgtacactatgatttatgtaaaattttttcagatgcctacagtaggagataggccagatgtgtttcgtttttacttccgattttttttttttggtttagtctgaaatttttagctaagaacttgtttaggaatcgggatttattgctttcaaaggtgctcaattggcccaaaatttgcacccaatgtttgtatgttgacattcttgctcagagttaagggttaagacccataatcaaaatttctctatctggcaagccatgcacttggtcagttcctgtgaagtaaataggaaatggcttcaactcaatttacttgctcactcaatgctagtgtctttttcatccttctctcaactgtggaggttaacc

SEQ ID NO: 11347 - DNA, 962 bp, Lippia dulcis
ctttcacagcgataccaacggcagtaaaatactacagattgcccgaagatctctactgttaaacgccctcattttacactttttgaaatcctaatttctcgaaagagggtttcttaagctgggatcctcgtgcccctgcaagaactcgaatcgcttggattaatggcgggttacagagcagaggacgattatgactaccttttcaaggtggttttgataggggattctggggttggtaagtctaacttgctttcgagatttacgaggaatgagttcagcctcgagtccaaatcaactatcggtgttgagttcgctacgagaagcttgactgtggatgggaaagtaatcaaagctcaaatttgggacactgctggccaagaaagatatcgtgccatcactagtgcatactaccgcggtgcagtgggtgctctactagtgttcgacgtcacccgtcactccaccttcgaaagcgttgaaaggtggcttagggagttgagggaccacactgaccccaacatcgttgttatgctcataggcaacaaatccgacctcagacatttggtggccgtctcaaaagaagatgggacctcatttgctgagagagaatcgctctactttatggaaacttctgcattagattccactaacgtggataatgccttcacggaggttcttacacagatataccggattgtgagcaagaaggctatggaggcgggagatgacagcgccgcagccaatgtgccttccaaaggtgagaaaattgatgtgagcaaagatgtatcggctatgaagaaagggggttgctgctcttcatgatttgatgcggctatagaggttgtgctgtaaagttctatcagatatttgttggaggggaaggggtgttgagttaatttattgtcattaacatgagtttaagtttttaattggtttcgtgttatatcggcaattaaccaaatgtg

SEQ ID NO: 11348 - DNA, 1143 bp, Malus domestica
gaaagatcgaagggaaaggaagcaaaatccaccgaaacaaacataaaaaacaaagatctcagagagcgaaagcaaatcagcgggagagatccgaaggacaagatcgccaccttcttcttagaagcgaaagaaacttcaaacttttttctttggggtcacagtagtaatggctgggtacagagctgaggacgactacgactaccttttcaaggtggtgctgatcggcgactccggcgttggcaagtccaacttgctgtcgaggttcaccaggaacgagttcagcctcgagtctaagtccaccatcggcgtcgagttcgccacccgcagcttggatgtcgacggcaaagtcatcaaggctcagatttgggacactgccggccaagaaaggtaccgggcaataacaagtgcttactatcgaggggctgtgggtgcactgcttgtgtatgatgtcactcggaattcaacttttgaaagtgtggaaaggtggttaaaggagttaagagaccacactgatcccaacattgtcgtcatgcttgttggtaacaaatcagatcttcgtcatcttgtggcagtctcaactgaggacggaaaatcctttgccgagagggagtctctctacttcatggaaacttctgcactcgaagcgaccaacgtggataacgcattttctgaagtcctcactcagatctttcgagtcgtgagcaggaaggccatggagtctggcaatgaaggagctgcttcagctgttcctcaaggggagaaaatcgatgttggtaaagatgtttcagctgtgaagaaaggtgggtgttgctcaacctagagtccgaatctgcaccggatgtagctggtttgtgtttgccacatctgtttttccctataccggggttgtgtaaaaaaaaatcttggaaattctgccggctttaggagataggaaggcggggttcggtgtttacttccattgtcattatcattaattaccctaaggcagatatgtttagctgatcaagaggagcttgtttagtaacaagatattacatgttcttacttttcataggtgttgaatggggggtttactttcacccgaattttttcggtattccgaggttattcttgagactaattaattgaaattgtttattcaac

SEQ ID NO: 11349 - DNA, 1145 bp, Fragaria vesca
agtctttctcagtccacactgttcagacacgcttccgaaaggccgaaaggtccaaacacaccgaaagcaaacctcttttcattttccttaaagagtgaaaaagaaaaacacaaacatagagaagtgagagatctaagatcaccaccaccagtttcttcgaagaaacaaaaagaacataacaatggcagggtacagagctgaggacgactacgactacctgttcaaagtggtcctgatcggcgactccggcgtcggcaagtccaacttgctctcccgattcacccgcaacgagttcagcctcgagtccaagtccaccattggcgtcgagttcgccactcgcagcttgaacgtcgactccaaagtcatcaaggcccagatttgggacactgccggccaagaaaggtatagagcaataactagtgcctattatcgaggggctgtaggcgcactgcttgtatatgatgttactcggaattcaacatttcaaagtgtggaaagatggttaaaggaattaagagatcatactgatcccaacattgttgtcatgctggttggtaacaaatcagacttacgtcaccttgtggcagtctcaactgaggatggaaaatcctttgccgaaagagagtccctctacttcatggaaacttctgcactcgaagcaactaatgtggacaatgcatttgctgaagtccttacccagatctttcacatagtgagcaagaagtccatggaggctaacaatgatgcagctgctgttccatcccaaggagaaaaaatcgatgtcagtgatgtttcagccgtaaagaaaggtgggtgttgttcgagctagatattgaatctgtatcagatatgtctggtttgtgttgctacatctgtttctttgtataccagggtgttgtgtaaaatttttcatccaaagacattaggtgctgagcggggttccgtttctttcttccagtgtcgttatcattcattactcgagacagattatgtttagctgttggaagaagagcttctgtaggaacttttacatgattttactctctagtctctacatagatgttgaatggggcaatttgcaccaaaattctgtattttgaaattgtttatcagtcccattaatttaaatcttttattcaactcaa

SEQ ID NO: 11350 - DNA, 680 bp, Conyza canadensis
aatcaagatgcagatatttgtgaaaaccttgacagggaagaccatcacacttgaggttgaaagcagtgacaccatcgacaatgtcaaggctaagattcaagacaaggaaggtattccaccagaccagcagcgtttgatctttgccggaaagcaacttgaagatggccgtactcttgctgattacaatatccagaaagaatcgactcttcatttggtgttgaggctaagaggaggaattattgaaccttctttgatggctttggccaggaagtataaccaagacaagaccatttgccgcaagtgctatgctcgtctccacccaagggccgtgaactgcaggaagaagaagtgtggccacagcaaccaactgaggccaaagaagaagatcaagtgaagactttgtcggaagaactggtgcatctaagaccatgtgtatcttatggtttaaccatttatgttgttgtttagccatttctgttgtcatttagccatttatgttgttaagtacctatttaagtgaacttactgtattgtatctttacttctcaacaattttctgaacaaactgcagatgtttctgtaaaatcattttggaatgtgcttataccattgtaatgttagtgtgtggttgatcacctttacttgtatgttaaaagagtaatgctagaacccctgcactg

SEQ ID NO: 11351 - DNA, 830 bp, Conyza canadensis
tacatacaaactttagatacaacataaaaaaaagctctaggaaagatgcagatttttgtgaaaactttaactgggaagacaataacgcttgaagttgaaagcagcgacactattgacaatgtcaaagccaagattcaagacaaagaaggaatcccaccggatcagcagaggttgatatttgctggaaagcagcttgaagatggccgtacacttgctgattataacatccagaaagaatccactcttcatttggtgttgaggcttagaggaggaatcattgagccttctctgatggctttggctagaaaatacaatcaagacaagactatttgccgcaaatgctatgctcgccttcaccccagggcagttaactgcaggaagaagaagtgtggtcacagcaaccagttgaggccaaagaagaagatcaagtaagcggttacagattgtttctttttgttggatgttggatctgtcgtcgtagtgccagcctgcatcttatcttctagttttattgttttcctataataagtgaactggattatttttggttttcgtactttggatttcaagatgttatgaaattactttatggttatcttgcttctaagttggaagtttggtcttttcgtgtcttttatcctagtcatgatatgtaagaggggagggagtggttgcggtaaagggcttccccaatatagcggccccgcgcggccgccggtggtttgccgagggagagagagtgaaaatcggggttgttcacccatgaggggaaggagagagaggagcgtgtaattggttgagtgaggactcacaatgatcaaaatctgttt

SEQ ID NO: 11352 - DNA, 444 bp, Ambrosia trifida
aagaaaatgcagatcttcgtgaagacattgaccgggaagaccatcacactcgaggttgaatcaagtgatacgatcgacaatgtcaaggctaagatccaggacaaggaaggaattcctccggaccagcagcgtttgatctttgctggaaaacagcttgaggatggaaggactctcgctgattataatattcagaaagagtctacacttcatttggtgctgaggcttcgtggaggtattattgagccgtcgttgatggctttagccaggaagtataaccaggataagactatctgccgcaagtgttatgctcgtctccatcctcgcgctgtcaactgtaggaagaagaaatgtggtcacagcaaccagttgaggccgaagaagaagatcaagtagacgaagatgtttttggactttcttttgaaatatgtttaattggtgaccatt

SEQ ID NO: 11353 - DNA, 496 bp, Ambrosia trifida
caaagatgcagatcttcgtgaaaaccctaacagggaagaccataacccttgaggttgagagcagcgacaccattgacaatgtcaaggccaagattcaggacaaggaaggtattccaccggaccagcagcggttgatctttgctggaaagcagcttgaagatggtcgcactcttgctgattacaacatccagaaagagtcgactcttcatttggttttgaggttaaggggaggaatcattgaaccttctttgatggcattggctaggaaatacaatcaagacaagaccatttgccgcaagtgttatgctcgtttgcacccaagagctgtgaactgcaggaagaagaagtgtggccacagcaaccaactaaggccgaagaagaagattaagtgaagacttagaaaagcaacttatctggttaattttagaacttctgcatgcatctatttttgtcatattttgttgttaagcacctatggatgaattgtttgtttatg

SEQ ID NO: 11354 - DNA, 705 bp, Ambrosia trifida
agggtttctaaagtcggcggcagcaaagaaaatgcagatcttcgtgaagacattgaccgggaagaccatcacactcgaggttgaatcgagtgatacgatcgacaatgtcaaggctaagatccaggacaaggaaggaattcctccggaccagcagcgtttgatctttgctggaaaacagcttgaggatggaaggactctcgctgattataatattcagaaagagtctacgcttcatttggtgttgaggcttcgtggaggtattattgagccgtcgttgatggctttagccaggaagtataatcaggataagactatctgccgcaaatgttatgctcgtctccatcctcgcgctgtcaactgtaggaagaagaaatgtggccacagcaaccagttgaggccgaagaagaagatcaagtagacgaagatgtttttggtactttcttttgaaatatgttttaattggtgaccattttagaatgatgttagataccggtttgtcgtggatgttatcggtagcaatcttgaaagcgagtaagcaacgttgattttgttggaaagatgaaatacaaagatacggagacaaaagcttttatcttaaattcgtttgtcaaacgagtgtgacaaatgctactataagttttcttttgtgttgatgtaaccttaagagtataagaacctagctagtggacgatgcattatatacaa

SEQ ID NO: 11355 - DNA, 563 bp, Arnica chamissonis
acgaaaagcggcggcagagaaaatgcagatcttcgtgaagacattgaccgggaagacgatcacgctcgaggttgaatcgagcgatacgatcgacaatgttaaggctaagatccaggacaaagaaggaattccaccggatcagcagcgtttgattttcgctggaaagcaacttgaggatggaaggactctcgccgattacaacatccagaaagagtctacgcttcatttggtgctgaggctccgtggaggtatcattgagccttctttgatggcgttagcaaggaaatataaccaggataaaaccatctgccgcaaatgctatgctcgtctccatcctcgtgctgttaactgcaggaagaagaaatgcgggcacagcaatcagttgaggccaaagaagaagatcaagtagacaaggatgttaagggacccccgttttaaagatattataaagctgtaaggttgatgtttctgttttgacaccaattttagacttttttggacaatgtttgttgattttgatttggctttcaactatccctttgatggtctactagtggcctgtt

SEQ ID NO: 11356 - DNA, 668 bp, Artemisia annua
cagtactccgacggggatagttggtattctcataagtttgtagcagacacacaagcggcggaagcggaggcggtggtatagatcgttaaaaaaagaaagaaagatgcagatctttgtgaaaacattgactggtaagaccatcacacttgaggttgagtccagtgataccatcgacaatgttaaggccaagattcaagacaaggaagggattccaccagaccagcaacgtttgatctttgctggaaagcaattggaagatggaaggactcttgctgattacaacatccaaaaggagtcaacgctgcatttggtgttgaggctacgtggagggattattgagccttctttgatggctttggctaggaagtacaaccaggacaaaactatctgccgcaaatgttatgctcgcctccatcctcgtgctgttaactgcagaaagaagaaatgtggtcacagcaaccagttgaggccaaagaagaagatcaagtagatgagaatgtcatggtactggcttttgaaggatatgttgtaattgtaagtgtgtgctttgtttgtacaccagttatgaatgtttatggagtatgttttaaaccctgaattttatgttcgcacattgagatctttataagctcttgcagtgttattttaatgtttctattagcggtcaa

SEQ ID NO: 11357 - DNA, 693 bp, Artemisia annua
acgcagtactccgacggggattagaacggcgagacaaaatgcagatctttgtgaaaactttgacagggaagaccataacacttgaggttgaatcctcagacaccattgacaatgtcaaggccaagattcaggacaaggaaggtatcccaccagaccagcagaggttgatctttgctggaaagcaacttgaagatggccgtactcttgctgactacaacatccagaaagagtcaactcttcatttggtgttgaggctgagaggaggaatcattgagccctctttgatggctttggctaggaagtacaaccaggacaagaccatctgccgcaagtgttatgcgcgtctccatccaagggctgttaactgcaggaagaagaagtgtggtcacagcaaccaactaaggccaaagaagaagatcaagtagacttgtgagcgctttctgtgttggagagcagcttgtctggctatgtttaaaacttctttttcagtcatttctattttctgctgttaagtacctatggaattaaacctatgaattctagtttaatttaagaagcacattatttggtttgaattttttaagtctttttatgattgggcgtttttggtattataggcaggcagccatgaatcttacatttcaatgatttggaaaaccaaacattagtacctctcatctgatacacaatttg

SEQ ID NO: 11358 - DNA, 698 bp, Centaurea maculosa
gaatcggcggttgaagagaaggaaagatgcagatcttcgtgaaaaccctaactggcaagaccatcactctcgaggttgagagcagcgatactatcgacaatgtcaaagctaagattcaagataaggaaggtattccaccggatcagcagcgattgatctttgccggaaagcagcttgaagatggccgaactctggctgattataacatccagaaagaatcaactcttcatttggttttgaggctaagaggaggaatcattgagccttcgttgatggccttggctaggaaatacaaccaagacaagaccatttgccgcaagtgctatgctcgtctgcacccgagggcagttaactgcaggaagaagaagtgtggccacagcaatcagctgaggccaaagaagaagatcaagtgaagggttggcgattgttttgcgtgttggtttggaagtatctgcgtctttactagtcgttttgtttctgttttcttataaaaaatgtaaactgatggaattttgctgtgttgaaatggtgttattactttagatttttgagatattctgcaagtgatggttgttttgcgtagtttaagctttgcaaatatccgttcttgtttttgggcatcggttgttgtggttcaggtttattaggttgtgattccttggtcatcaaaataagtttttgaaaatattatcttgcat

SEQ ID NO: 11359 - DNA, 535 bp, Centaurea maculosa
atgcagatcttcgtgaaaaccctaaccgggaagaccatcacccttgaggtcgagagcagcgacaccatcgacaatgtcaaggccaagattcaggacaaggaaggtattcctccggatcagcagcgattgatcttcgccggaaagcagctcgaggatggccgaactcttgccgattataacatccagaaagaatcgactcttcatttggtgttgaggctcaggggaggaatcattgaaccttctttgatggcattggctaggaaatacaaccaagacaagaccatttgccgcaagtgttatgctcgcctgcacccaagggctgtaaactgcaggaagaagaagtgtggccacagcaaccagctaaggccaaagaagaagatcaagtgaagagttacaagtggtttgtgcttgaaaaaagtagaactgatattgttaagttttggaacatctgcatctgttttgattagtctttttgtttgtaaggaccaatgaaagtaaacctgatgaattgttcatctaattcagtattggtttt

SEQ ID NO: 11360 - DNA, 648 bp, Centaurea maculosa
aaagatgcagatcttcgtgaaaaccctaaccggaaagaccatcactctcgaggttgagagcagcgatactatcgataatgtcaaagctaagattcaagataaggaaggtattccaccggatcagcagcgattgatctttgccggaaagcagcttgaagatggacgaactttggctgattataacatccagaaagaatcaactctccatttggttttgaggctaagaggaggaatcattgagccttcgttgatggccttggctaggaaatacaaccaagacaagaccatttgccgcaagtgctatgctcgtctgcacccgagggctgttaactgcaggaagaagaagtgtggccacagcaatcagctgaggccaaagaagaagatcaagtgaagggttggcgattgtttcgtgtgttggtttggaagtatctgcgtctttactagtcgttttgtttctgttttcttataaaatgtaaactgatggaattttgctgtgttgagatggtgttattactttagatttttgagatattctgcaggtaatggttgttttgcgtagtttaagctttgcaaatatccgttcttgtttttgggcataggttgttatggttcaggtttattaggctgtttggtcatcaaaatatgttg

SEQ ID NO: 11361 - DNA, 1151 bp, Cicer arietinum
ctttatgatattacttattagcgcaacttttttagtctgataaattaatgtgtcatctaagataaaataattataacaataataataataataatgtgtaatcatttcattcaggtattaaacatgataatacagataacaacaattgaaaagatataacatgaagatagtttggccgagtggtctaaggcgccagatttaggctctggtccgaaagggcgtgggttcaaatcccacagctgtcatttttatttttatttttgttttccttcattcaacgttaattgggctgggtaacaaatccattaaaccctagcaaaaacgaagtgtataaaaaaccaattcatttttctgattcacttttcacaatttcagttgattttttattttttttgcattagcagagatgcagatattcgtgaaaaccctaactggaaaaacgataaccctcgaagtcgagagtagcgacaccatcgacaatgtcaaagccaaaattcaagacaaagaaggcatcccacccgatcaacagcgtttgatattcgccgggaaacagcttgaagatggaagaaccctagctgattataacattcaaaaggaatctacactgcatctcgtcctcaggcttcgtggaggtattattgagccttctttgatggctttggctcgcaaatacaatcaagacaaaaccatttgccgcaaatgctatgctcgtctgcatccaagggctgtaaactgccggaaaaagaaatgtggtcacagtaatcagttgaggccaaagaaaaagattaagtaaattatggctctgatgctgtgcgtcgtttgtggtgagctgacagacaattgtttgattaatagatgataatgtgcttagtatggtgtttgtcaatgtttgatgattttggatttatttatgtggtattcaacttatatacttttatgacattttgatctctttcatgtttcagttataagtttttgaagattaatttcttcttttcttatactaatacactagcaacagtttttgttaaaaagttatttactttcctgtttcatgttgctgttgctttgatatttaattaaacttaaccataaatcttgttattatgttattgattataatgataattagcaaacctcatcattattca

SEQ ID NO: 11362 - DNA, 1211 bp, Cicer arietinum
aaacggaccggcacattttgaaggcaatagcagcccaacaagcagaaagcccatttatgaagtaaattttgttggatcctaaaccctagaaacgctgaatataaaaacagtgaccatatcatctagacaactgagaatcgagagaggttgtaaaagcggcaaagatgcagatcttcgtcaaaaccctaactgggaagaccatcaccctcgaagtcgagagcagtgacacaatcgacaatgtcaaagccaagattcaagacaaggaaggtattcccccggatcagcagcgtttgattttcgccggtaagcagcttgaagatggacgcaccttggccgattacaacatccagaaggagtcaacacttcatcttgttctcaggcttcgtggtggtatcatcgaaccttctttgatggctttggctcgcaaatacaatcaagacaaaaccatatgccgcaaatgctatgctcgtctacaccctagggctgtaaactgccgcaaaaagaagtgtggacatagcaatcagttgaggccaaagaagaagatcaagtaaactctggttttgatattgtttttctcttattggtgtttgttttgtgagacctttatttataaatttcgttgttactcccgactcaactcaatcttctgttttgaatgatgttaaatgtagttggagtttattttggtataagtggattatatttttccgattacttatattctgtttcaagcttactggcatcattatctgtaatatggattgcctatagtatgttagttgtcttgcacttcatttagggtaatagtaacccatacgagttttttgggagcttactggtctcgtttttgatttgcataatatttcttttcccttgttggaataattttagaattattagcttggtttagtcaaagaactgcgctattgatttttcaattttaggaataccatgatgttgtcagataacatgaaggtcaacactgttacttgtgttgtttctagtcccttctatcagagttttatctgataaacattttgcgtaaccccttgcttgttttggctggtccgttctgtttttcttctaggttttatgctacttgttatttcccttgtttgatttttcacgatataatgtattgaacaaaatcaaagtaaacttgcattttgacaataacaccctcgacactatatatggtgtctaataccaaa

SEQ ID NO: 11363 - DNA, 1138 bp, Cicer arietinum
ctttagtgtgggaatatagtaaacgtgggctacgaaaaaccctaatctaaaagttttgaggtcgtatatatacgtaaaatagaagaacggcagaaaatttgatagcagattgggagcagacaaaatgcagatattcgtgaaaaccctaaccggcaagaccatcacccttgaggtggagtcaagtgacactatcgataatgtcaaagctaagattcaggacaaagaaggaattcctccggaccagcagaggttgatcttcgccggaaaacagttggaagatggacgcaccctcgccgactataacatccagaaagagtcaacattgcatcttgttttgaggcttcgtggtggtattattgagccatctttgatggcattggccaggaagtataaccaggacaagacaatctgccgcaagtgttatgcacgtttacaccctcgtgctgtcaactgcaggaagaagaagtgtggacacagcaaccagttgaggccaaagaagaagatcaagtaaactgttgtaattgcaggaaggaagaatttttttgttgtcatggactactggatgatttcttgtgataattagcttcttagtattgtaggaaatctgctggaaattgaacttacagtttttgtctatgtttttgttttggtttgagacaaattgatatcaattatgctactgttctatgtgatgatataattttgttgctttttggataataacggcttaaaccaaacttagatgcagtttttatgccctgccaatactgttctttcataataatttattcagaacaagttatgaatccactagtaagaacagccattttgaatttgatgtcaaggggcatgataaatagcataataaattacttatagaacaatttcttagttgtcttaatttgtttaatgtcattgcgtggatgaaaaggctctatctttatgttctattttcgttttgacgcaattgtcttcggttggatctttagtaaattgctttaaagaaagatttgaaggcctcttaatcatttgtttcgtgccattcactggttgaaagggttctagctaataataatatcttgatttggggcacaaagatctcctttggcctcttcagcagtgttttgtatgcttctga

SEQ ID NO: 11364 - DNA, 690 bp, Chrysanthemum coronarium
aacagatttttgacaacaacaatatccaagcccgcccaaacatttattgaagcaacaaccaaccctaataaaataatgaatgagaccatttgcttccttcccaagaaaacaatcataaccgccggccgtttagagagagaaagaagcaaaacaaaatgcagatcttcgtgaaaactttgaccgggaagaccataacccttgaagttgaatcatcagacaccatcgataatgttaaggcaaagattcaggacaaagaaggtatcccaccagatcagcagaggttgatatttgctggaaaacaacttgaagatggccgtactcttgctgactacaacatccagaaagagtcaactcttcatttggtgttgaggctaagaggaggaatcattgagccctctttgatggctttggctaggaagtacaaccaggacaagaccatctgccgcaagtgttatgcgcgtctccatccaagggctgttaactgcaggaagaagaagtgtggtcacagcaaccaactaaggccaaagaagaagatcaagtagacttgtgagcgttttctgtgttggagagcagcttgtctggctatgtttagaacttctttttcagtcatttctatattctgctgttaagtacacctctggaattaaacctatgaattctagtttaatttatgcacattattggtttgca

SEQ ID NO: 11365 - DNA, 744 bp, Chrysanthemum coronarium
atcccaaatatttagcaaaaccatatatcatttccatttcaaactgggcctcctaacacatcaatgggccaaaaagtccaaagattatcaaaaccctaatcagagcatataaaaccagtgacctaccaacgttctaaaccattagaacggcgagacaaaatgcagatctttgtgaaaactttgacagggaagaccataacacttgaggttgaatcctcagacaccattgacaatgtcaaggccaagattcaggacaaggaaggtatcccaccagaccagcagaggttgatatttgctggaaaacaacttgaagatggccgtactcttgctgactacaacatccagaaagagtcaactcttcatttggtgttgaggctaagaggaggaatcattgagccctctttgatggctttggctaggaagtacaaccaggacaagaccatctgccgcaagtgttatgcgcgtctccatccaagggctgttaactgcaggaagaagaagtgtggtcacagcaaccaactaaggccaaagaagaagatcaagtagacttgtgagcgttttctgtgttggagagcagcttgtctggctatgtttagaacttctttttcagtcatttctattttctgctgttaagtacctatggaattaaacctatgaattctagtttaattgaagaagcacattattggtttgcattttctatgcctttttataattgggcgtttttggttattcccgtggaat

SEQ ID NO: 11366 - DNA, 686 bp, Chrysanthemum coronarium
gctgctattctcacaagtttgttaaccaaaaatagcggcggaggcggtggaacagatcgttaggaaaagatgcagatctttgtgaaaactttgactggcaagaccatcacacttgaagttgagtcaagtgacaccatcgacaatgttaaggccaagattcaagataaggaagggattccaccagaccagcaacgtttgatatttgctggaaaacagttggaagatggaaggactcttgctgattacaacatccaaaaggagtcaacgcttcatttggtgttgaggctacgtggagggattatcgagccttctttgatggctttggctaggaagtacaaccaagacaaaactatctgccgcaaatgttatgctcgtctccatcctcgtgctgttaactgcagaaagaagaaatgtggtcacagcaaccagttgaggccaaagaagaagatcaagtagatgagaatgtcatggtactgtcttttgaaggatgctgtaactgttagggcgttctttgttatgaagtatgttgtaattgtaagggtgtgttttgtttttacatcagttctgaatgttttatggtgtattttctaaaacctggaattttatgttagcatattaagacctttatttaagctcttgcagagttgcagtgttgttctagtctttctattagcggtctaatattg

SEQ ID NO: 11367 - DNA, 721 bp, Chrysanthemum coronarium
atcccaaatatttagcaaaaccatatatcatttccatttcaaactgggcctcctaacacatcaatgggccaaaaagtccaaagattatcaaaaccctaatcagagcatataaaaccactgacctaccaacgttctaaaccattagaacggcgagacaaaatgcagatcttcgtgaaaactttgacagggaagaccataacacttgaggttgaatcctcagacaccattgacaatgtcaaggccaagatccaggacaaggaaggaatcccacctgatcagcagaggttgatctttgctggaaagcagctggaagatggtcgtactcttgctgactacaacatccagaaagagtcaactcttcatttggtgttgaggttgagaggaggaatcattgagccttccttgatggctttggcaaggaagtacaaccaagacaagaccatttgtcgcaagtgttatgcgcgtctccatccaagggctgttaactgcaggaagaagaaatgtggtcacagcaaccagctaaggccaaagaagaagatcaagtaggcttgtgagcgttttctgtgttggagagcagcttgtctagctatgtttagagctttatttccagtcttttttattttctgctgttaagtacctatggaaaacttatgaattctactttttaatttaagaagcacaatcttggtttcacgagtggtgtggtcggcgtctctcaagg

SEQ ID NO: 11368 - DNA, 625 bp, Chrysanthemum coronarium
cacatcaatgggccaaaaagtccaaagattatcaaaaccctaatcagagcatataaaaccagtgacctaccaacgttctaaaccattagaacggcgagacaaaatgcagatctttgtgaaaactttgacagggaagaccataacacttgaggttgaatcctcagacaccattgacaatgtcaaggccaagatccaggacaaggaaggaatcccacctgatcagcagaggttgatctttgctggaaagcagctggaagatggtcgtactctcgctgactacaacatccagaaagagtcaactcttcatttggtgttgaggttgagaggaggaatcattgagccttccttgatggctttggcaaggaagtacaaccaagacaagaccatttgtcgcaagtgttatgcgcgtctccatccaagggctgttaactgcaggaagaagaaatgtggtcacagcaaccagctaaggccaaagaagaagatcaagtagacttgtgagcgttttctgtgttggagagcagcttgtctagctatgtttagagctttatttccagtcgtttttattttctgctgttaagtacctatggaaaacttatgaattctactttttaatttaagaagcaca

SEQ ID NO: 11369 - DNA, 592 bp, Chrysanthemum coronarium
gataaaacacacagcaaaaatgcagatctttgtgaaaacactaacagggaagaccataacccttgaagttgaaagcagtgatactattgacaatgtgaaagctaagatccaagacaaggaagggattcctccagatcagcagaggttgatttttgctggtaaacagcttgaagatggaaggactcttgctgattacaacatccagaaagaatcaactctgcatttggtgttaaggctaaggggagggatcattgaaccttcgttgatggcgttggctaggaagtacaaccaagacaagactatttgccgcaagtgctatgctcgccttcacccaagggcagttaactgcaggaagaagaagtgtggccacagcaaccagttgaggcccaagaagaagatcaagtgagcgcttgttgagtgctttgggagctggattcagaagtatctgcatttatttctagtttgtgttgaactcgtattaaagtaaaccaaatcacttttgctttgttgcaggaatgattattttactttaaatcttcctagacattttatctaatggatttttcgtgactttattaaatctctgttttta

SEQ ID NO: 11370 - DNA, 816 bp, Cichorium intybus
cttgaaccgttgatacatctatggacccaaagatcaaactccaaaccctaattacgaaccagagtataaaaccctaaaataacaaagaattttcattctcggcaaggtgtgagatagagaaaggcaaagatgcagattttcgtcaaaaccctaaccgggaaaaccattactctcgaggttgagagcagcgacaccatcgacaatgtcaaggctaagatccaagataaggaaggcattccaccggatcagcagcgattgatctttgccggcaagcagcttgaagatggccgaactctcgctgattacaacatccagaaagaatcaactcttcatttggtgttgaggctaagaggaggaatcattgagccctctttgatggctttggctagaaaatacaatcaagacaaaaccatttgccgcaagtgctatgctcgcctgcacccaagggctgtgaactgcaggaagaagaagtgtggccacagtaaccagttgaggccaaagaagaagatcaagtaaatgtttgcagaatgttttctgtgttggatttggaagttttgtttttatcttttctagtcgttttgttgttgaacttttataaaaagtaaactaaaggcattgttgcttagtggaagttgtgtttttacttttagatctccaagacatatggaatatggtgtaatctgatgtgcattcttatttttggtcatggattacttttatctctgggttgatgattgaattgtctttccaaatcctttgctcatattgggtaatatgtctgttaaacatgccatcaaagttccattttcttttccc

SEQ ID NO: 11371 - DNA, 583 bp, Cichorium intybus
ccgagggagacaaagatgcagatcttcgtgaaaaccctaaccgggaaaactataaccctcgaggttgagagcagtgacaccatcgacaatgtcaaggccaagattcaggacaaggaaggtattccaccggatcagcagaggttgatctttgccggaaagcaacttgaagatggccgaactcttgctgattacaacatccagaaagaatcgacccttcatttggtgttgaggctaaggggaggaatcattgaaccctctttgatggcattggctaggaagtacaatcaagataagaccatttgccgcaagtgttatgctcgcttgcacccaagggcagtgaactgcaggaagaagaagtgtggccacagcaaccagctaaggcctaagaagaagattaagtagacttgtgtgtttggaaaaggagcattttggttaaatttagaaggctggattttgttaggtgatttttgttaacattttgaagtaaacttgatggattgtttgtttaatttaaagaagcattacttgtttgaaatctctagtccttgcttttttagttctttttgtcaacaaccttttaaag

SEQ ID NO: 11372 - DNA, 628 bp, Cichorium intybus
ggggattctcggcaaggtgtgagatagagaaaggcaaagatgcagattttcgtcaaaaccctaaccgggaaaactattactctcgaggttgagagcagcgataccattgacaatgtcaaggctaagattcaagataaggaaggtatcccaccggatcagcagcgattgatctttgccgggaagcagcttgaagatggccgaactctcgctgattataacatccagaaagaatccactcttcatttggtgttgaggctaagaggaggaatcatcgagccctctttgatggctttggctagaaaatacaatcaagacaaaaccatttgccgcaagtgctatgctcgcctccacccaagggctgtgaactgcaggaagaagaagtgtggccacagtaaccagttgaggccaaagaagaagatcaagtagatgcttgcagaatgttttctgtgttggatttggacgttttgtttttatcttttctagtcgttttgttgaacttttataaaaagtaaactaaaggcattgttgcttagtggaagtggtgtttttacttttagatctccaagacgtatggaatatggtgtaatctgatgtgcattctcatttttggtcatggattacttttatc

SEQ ID NO: 11373 - DNA, 605 bp, Cichorium intybus
aatataaagtacgccatttactctgagccttcatcagccgctgcgccgagggagacaaagatgcagatcttcgtgaaaaccctaaccgggaaaaccataaccctcgaggttgagagcagtgacaccatcgacaatgtcaaggccaagattcaggataaggaaggtattccaccggatcagcagaggttgatcttcgctggaaagcaacttgaagatggccgaactcttgctgattacaacatccagaaagaatcgacccttcatttggtgttgaggctaaggggaggaatcattgaaccatctttgatggcattggctaggaagtacaatcaagataagaccatttgccgcaagtgttatgctcgcttgcacccaagggcagtgaactgcaggaagaagaagtgtggccacagcaaccagctaaggcctaagaagaagattaagtagacttgtgtgtgtgtggaaaaggagcattttggttaattctagaatgctggattttgttaagtgatttatgctaacaatttaaagtaaacttgatggattgtttgtttaatttaaagaagcattacttgtttgaaatctctggtcctttcttttttagt

SEQ ID NO: 11374 - DNA, 618 bp, Cichorium intybus
aaagatgcagattttcgtcaaaaccctaaccgggaaaactattactctcgaggttgagagcagcgacaccattgacaatgtcaaggctaagattcaagataaggaaggcattccaccggatcagcagcgattgatatttgccggcaagcagcttgaagatggccgaaccctcgctgattacaacatccagaaagaatcaactcttcatttggtgttgaggctgagaggaggaatcattgagccctctttgatggctttggctagaaaatacaatcaagacaaaaccatttgccgcaagtgctatgctcgcctccacccaagggctgtgaactgcaggaagaagaagtgtggccacagtaaccagttgaggccaaagaagaagatcaagtaaacgcttgcagaatgttttctgtgttggatttggaagttttgtttttatcttttctagtcgttttgttgaacttttataaaaagtatactaaaggcattgttgcttagtggaagtggtgtttttacttttagaatatggtgtaatctgatgtgcattcttattttttgtcatggatgacttttatcttttggttgatgattgaattgtctttccaaattctttgctca

SEQ ID NO: 11375 - DNA, 622 bp, Cichorium intybus
tacaacatccagaaggagtcaactctgcatctggttctccgattgcgtggtgggatgcagatctttgtgaaaacgttgaccggaaagacgataacattggaggttgagagctctgacaccattgataacgtgaaagcgaagattcaggataaggaagggatcccgccggatcagcagaggttgatcttcgctggaaagcaacttgaagatggccgaactcttgctgattacaacatccagaaagaatcgacccttcatttggtgttgaggctaaggggaggaatcattgaaccatctttgatggcattggctaggaagtacaatcaagataagaccatttgccgcaagtgttatgctcgcttgcacccaagggcagtgaactgcaggaagaagaagtgtggccacagcaaccagctaaggcctaagaagaagattaagtagacttgtgtgtgtgtaaaaggagcattttggttaattctagaaggctggattttgttagtgatttttgttgacattttaaagtaaacttgatggattgtttgtttaattcaaagaagcattacttgtttgaaatctcttgtccttgcttttttagttctttttgtcaacaaccttttaaagc

SEQ ID NO: 11376 - DNA, 657 bp, Cichorium intybus
aatataaagtacgccatttactctgagccttcatcagccgctgcgccgagggagacaaagatgcagatcttcgtgaaaaccctaaccgggaaaactataaccctcgaggttgagagcagtgacaccatcgacaatgtcaaggccaagattcaggacaaggaaggtattccaccggatcagcagaggttgatctttgccggaaagcaacttgaagatggccgaactcttgctgattacaacatccagaaagaatcgacccttcatttggtgttgaggctaaggggaggaatcattgaaccctctttgatggcattggctaggaagtacaatcaagataagaccatttgccgcaagtgttatgctcgcttgcacccaagggcagtgaactgcaggaagaagaagtgtggccacagcaaccagctaaggccgaagaagaagattaagtagacttgtgtgtgtggaaaaggagcattttggttaattctagaaggctggattttgttagtgatttttgttaacattttaaagtaaacttgatggattgtttgtttaattcaaagaagcattacttgtttgaaatctttacttctttttgtcaacaaccttttaaagtaaaccttgtctacccctggatacatataaagctccatcgtttcg

SEQ ID NO: 11377 - DNA, 696 bp, Cichorium intybus
gtgagatagagaaaggcaaagatgcagattttcgtcaaaaccctaaccgggaaaaccattactctcgaggttgagagcagcgacaccatcgacaatgtcaaggctaagatccaagataaggaaggcattccaccggatcagcagcgattgatctttgccggcaagcaacttgaagatggccgaactctcgctgattacaacatccagaaagaatcaactcttcatttggtgttgaggctaagaggaggaatcattgagccctctttgatggctttggctagaaaatacaatcaagacaaaaccatttgccgcaagtgctatgctcgcctgcacccaagggctgtgaactgcaggaagaagaagtgtggccacagtaaccagttgaggccaaagaagaagatcaagtagatgcttgcagaatgctttctgtgttggatttggaagtttgtttttattttttctagtcgttttgttgttgaactcttataaaaagtaaaccaaatgcattgttgcttagtggaagtggtgttttacttttagatctccaagacgtatggaatgtggtgtaatctgatgtgcattctcatttttggtcatggttacttttatcttttggttgatgattgaattgtctttccaaatcctttgctcattttgggtaatgtctgttaaacatgccatcaaagttccattttc

SEQ ID NO: 11378 - DNA, 598 bp, Cirsium arvense
gtaaccgactgcgactctgcggttgaagagatagagaagaaaagatgcagatcttcgtgaaaaccctaactggtaaaaccatcactctcgaggttgagagcagtgatactatcgataatgtcaaagctaagattcaagataaggaaggtattccaccggatcagcagcgattgatctttgccggaaagcagcttgaagatggacgaactttggctgattataacatccagaaagaatcaactctccatttggttttgaggctaagaggaggaatcattgagccttcgttgatggccttggctaggaaatacaaccaagacaagaccatttgccgcaagtgctatgctcgtctgcacccgagggctgttaactgcaggaagaagaagtgtggccacagcaatcagctgaggccaaagaagaagatcaagtgaagggttggcgattgtttcgtgtgttggtttggaagtatctgcgtctttactagtcgttttgtttctgttttcttataaaatgtaaactgatggaattttgctgtgttgagatggtgttattactttagatttttgagatattctgcaggtaatggttgttttgcgta

SEQ ID NO: 11379 - DNA, 710 bp, Cirsium arvense
cgacaaacctacctaggttaggtttgtttttggaaaagaaagcggcggaactgaaaatgcagatcttcgtgaaaacattgacggggaaaacaatcacgctggaggttgaatccagtgatacaatcgacaatgtgaaggctaagatccaggataaggaaggaattccacccgaccagcagcgtctcatatttgccggaaaacaactagaggatgggaggactctggccgattacaacatccagaaagagtctacgcttcatttggtgttgaggcttcgtggagggataattgaaccatctttgatggcgttagcaaggaaatacaaccaggataagaccatctgccgcaagtgttatgcacgcctccatcctcgtgctgtcaactgtaggaagaagaagtgtgggcacagcaaccagttgaggccaaagaagaagatcaagtagacgaggacgttgttatggtgcactatttctcaactcaactatgatgtttatgtagcctgagagatatctctttcattttctaattacatacattatcttgttttcgaaccatctttatatttgccatttaatcaacatcagttatgctcatggtgacatttttcaactctgaccagtttaaggtaatattcttcttctctttctagaataattacaatgaaagtttttaactaaaaaagaaaaaagtaaaccgactgcgactatgcg

SEQ ID NO: 11380 - DNA, 757 bp, Trifolium pratense
gggacgttttttcagttgaaagaatcagtatcaggatgcagatattcgtgaaaaccctaacagggaaaacgataactcttgaagtagagagtagcgacacaatcgacaatgtcaaagccaagattcaagacaaggaaggaatcccaccggatcagcaacgtttgatcttcgccggaaaacagcttgaagatggaagaaccctagctgattacaacattcagaaagaatccacgcttcatcttgtgctaaggcttcgtggaggtatcatagagccttctttgatggctttggctcgcaaatacaatcaggacaaaaccatttgccgcaaatgttatgctcgtctgcatccaagggctgtaaattgccggaaaaagaagtgtggtcacagtaatcagttgaggccaaagaagaagattaagtagattatggctccgatgatcatcttgtatggtgagctgatgaccaattgcagtttaatactgttgatcatgtgcttagtatggtgtttatcaatgtttcaatgattttggatttatttgtggcattcaactataatacatgtatgacattttctactctttcatgtctcaagtttgaggattcattgctttttatcttataatatgctagcaagagtttttgttaaaagttaatacattcttgttttcttcttgttttgatttttaattcagcttgtaagtaataactagaaatcttgttataacaatgttattattgaggaaagttaatttgccca

SEQ ID NO: 11381 - DNA, 704 bp, Trifolium pratense
agttgagaattgagaaaggtgaagccgcagccgcaaacatgcagatcttcgtcaaaaccctaaccgggaaaaccatcaccctcgaggttgagagcagcgacacaatcgacaatgtcaaagctaagattcaagacaaggaaggtattcccccggatcagcagcgattgattttcgccggaaagcaacttgaagatggacgcactttggctgattacaatatccagaaggaatcaactcttcatcttgttctcaggcttcgtggtggaatcattgaaccttctttgatggctttggctcgcaaatacaatcaagacaaaaccatttgccgcaaatgctatgctcgtcttcatcctagggctgtgaactgccgcaagaagaaatgtggacacagcaatcaattgaggccaaagaagaagatcaagtaaactgtggttgatattgtttctctcttgttgttagttttgagatactttgttttttggtttttgcatctctattgactaaatcctttgttttaatttatgttgaatgtagtcggaatttattttggtacaagtggattatattcttgtgattgcattatattctcgttcatgttagtgttttgtttttgctaatagcattattaattccctatacaaatcaaagacatttaacttttattgcattattacattagcaatacgaagatgttgtctcttttt

SEQ ID NO: 11382 - DNA, 662 bp, Trifolium pratense
agaattgagaaaggtgaagaagccgcaaatatgcagatcttcgtcaaaaccctaaccgggaaaaccatcaccctcgaggtcgagagcagtgacacaatcgacaatgtcaaagctaagattcaagacaaggaaggaattcccccggatcagcagcgattgattttcgccggtaagcaacttgaagatggacgcactttggctgattacaatatccagaaggaatcaactcttcatcttgttctcaggcttcgtggtggaatcattgaaccttctttgatggctttggctcgcaaatacaaccaagacaaaaccatttgccgcaaatgctatgctcgtcttcaccctagggctgtgaattgccgcaagaagaaatgtggacacagcaatcaattgaggccaaagaagaagatcaagtaaactgtggttgacattgtttctctcttgttgttagttctgagatatgtctttggtttttacttcaaacttgactaaatcctttgttttaatttatgttcaattcggagtttattttggtacaagtggattatattcttgtgtttgcattatatcctctttcatgctctttttaatgtttgtttaaatcattattaattgcctttacaaatcaatgtgatttaaattttattgcactattacattag

SEQ ID NO: 11383 - DNA, 656 bp, Conyza canadensis
gaagagtgataagaaaagaagaatcaagatgcagatatttgtgaaaaccttgacagggaagaccatcacccttgaggttgaaagcagtgataccatcgataatgtcaaggctaagattcaagacaaggaaggtattccaccagaccagcagcgtttgatctttgccggaaagcaacttgaagatggccgtactcttgctgattacaatatccagaaagaatcgactcttcatttggtgttgaggctaagaggaggaattattgaaccttctttgatggctttggccaggaagtataaccaagacaagaccatttgccgcaagtgctatgctcgtctccacccaagggccgtgaactgcaggaagaagaagtgtggccacagcaaccaactgaggccaaagaagaagatcaagtgaagactttgtcggaagaactggtgcatctaagaccatgtgtatcttatggtttaaccatttatgttgttgtttagccatttctgttgtcatttagccatttatgttgttaagtacctatttaagtgaacttactgtattgtatctttacttctcaacaattttctgaacaaactgcagatgtttctgtaaaatcattttggaatgtgcttataccattgtaatgttagtgtgtggttgatac

SEQ ID NO: 11384 - DNA, 651 bp, Cynara scolymus
cgggacaacctctatagaatcggcgcgattgagagagagcaacggaagatgcagatcttcgtgaaaaccctaacgggtaagaccattactctcgaggttgagagcagtgacaccatcgacaatgtgaaggctaagatccaagataaggaaggtattccaccggatcagcagagattgatctttgccggcaagcagcttgaagatggccgaactctcgctgattataacatccagaaagaatcaactctccatctggttttgaggctaagaggaggaattattgagccctctttgatggcattggcaaggaaatacaatcaagacaagaccatttgccgcaagtgctatgctcgtttgcacccgagggctgtaaactgccgaaagaagaagtgtggccacagcaatcagctgaggccaaagaagaagatcaagtgaaggtcttacgagtgttttatgtgttggatcagaactatttacgtcttttctagttgtttcgttgctggttttttatctaatatgaactgattgaatttttgctgtgttaaaatgatgttattacattagatattctggaaatgctggttgcttttgcttgcaaatttccgttttcgttcttgatagttgattattatggttaagatccgtttgatc

SEQ ID NO: 11385 - DNA, 584 bp, Taraxacum officinale
gcctcggcaggtgaagagctagagaaacggaaagatgcagatcttcgtcaaaaccctaaccgggaagaccatcaccctcgaggttgagagcagtgacaccatcgacaatgtcaaggccaagattcaagacaaggagggtattcctccggatcagcagcgattgatcttcgccggcaagcagcttgaagacggccgaaccctcgctgattataacatccagaaagagtcaactcttcatttggtgttgaggctaagaggaggaatcattgagccttctttgatggcattggctaggaaatacaaccaagacaagaccatttgccgcaagtgctatgctcgtctacaccctagggctgtaaactgcaggaagaagaagtgtggtcacagcaaccagttgaggccaaagaagaagatcaagtagatgctagtttggttttgctgtgttggatttggatctttctgcatctttttagtcattctgtttaagcttttggaagtgggttttaatactctagatctataagacatctttaatttggtgtaatttcacatttttggtcatttaattcttattatctttacct

SEQ ID NO: 11386 - DNA, 750 bp, Echinacea purpurea
cagaacaacaaaatctagtacaaagtacaaaccctaggttttcttcacttaacaacgttagggttacgaaaatcggcggcagcagagaaaatgcagatcttcgtgaagacattgaccgggaagacgatcacgctcgaggttgaatcgagcgatacgatcgacaatgttaaggctaagatccaggacaaagaagggattccaccggaccagcagcggttgatctttgccggaaaacaactcgaggacggaaggactcttgctgattataacattcagaaagaatctacgcttcatttggtgttgaggcttcgtggagggattattgaaccgtctttgatggctttagcgaggaagtataaccaggataaaactatctgtcgcaaatgttatgctcgcctccatcctcgtgctgttaactgcaggaagaagaaatgtggacacagcaaccagttgaggccaaagaagaagatcaagtagatgatggcgatgtcgtggtacttgtttttgaaggttgtttaaaattcgtaaggatgttgctttgttgttgcaacttttttgaatgcttttcgactatgttttagacctgaagatttatgatctgtgattttgataagctactgtggtttttctttgatgttttagactttcagtgatctgtatgtgttagtttgctatgtgttggtttgtgttagtgtcactctagatgcatcaactgttcgacttagttattgaagcaatatcaatactaga

SEQ ID NO: 11387 - DNA, 719 bp, Echinacea purpurea
aaaccctaggttttcttcacttaacaacgttagggttacgaaaatcggcggcagcagagaaaatgcagatcttcgtgaagacactgacggggaaaaccataaccctcgaggttgaatcgagcgacacgatcgacaatgtcaaggccaagatccaggataaggaaggaatcccaccggaccagcagcggttgatctttgccggaaaacaactcgaggacggaaggactcttgctgattataacattcagaaagaatctacgcttcatttggtgttgaggcttcgtggagggattattgaaccgtctttgatggctttagcgagaaagtataaccaggataaaactatctgtcgcaaatgttatgctcgcctccatcctcgtgctgttaactgcaggaagaagaaatgtggacacagcaaccagttgaggccaaagaagaagatcaagtagatgatgacgatgtcgtggtacttgtttttgaaggtttaaaatttgtaaggatgttgctttgttgttgcaacttttttgaatgcttttcgactatgttttagacctgaagatttatgatctgtgattttgataagctactgtgatttttctttgatgtttcagactttcagcgatctttatgtgttagtttgctatgtgttggtttgtgttagtgtcactctagatgcatcaactgttcgacttagttattgaagcaatatcaatactaga

SEQ ID NO: 11388 - DNA, 609 bp, Fagopyrum esculentum
cgggagtagtgaatctctgatcggcggcaagatgcagattttcgtcaaaaccctaactggtaagaccatcactctcgaggtcgagagcagcgacaccatcgacaatgtcaaggctaaaattcaagacaaggaaggcattcccccggaccagcagcgtctcatcttcgccggcaagcagctcgaagatggccgaacccttgccgattacaatatccaaaaagaatcgactcttcatcttgttctgagactcagaggtggtatcattgaaccatctcttatggctttggctcgcaaatacaaccaggacaagaccatttgccgcaaatgctatgctcgtctgcatcccagggcagtgaactgcaggaagaagaaatgtggtcacagcaaccagttgaggccaaagaagaagatcaagtagatgtctcttttgacattgtctcctgccattctatttccatttggtttgagttcaaggacccaatcggtttggagtggagttctcttttacaatcgtttgtagccaaataccctgaacccttttttgacttcgcttgtctaaaatactagtatcatgggatttatctcccaaatgttatggatgaatgttac

SEQ ID NO: 11389 - DNA, 610 bp, Fagopyrum esculentum
tacgctgttctagagggagaatcgaagaaatcttcgtttgggaagatgcagatattcgtgaaaaccctaacggggaagaccatcacccttgaggttgagagcagcgatacaatcgacaatgttaaggccaagatccaagacaaggagggcattcccccggaccagcagcgtctgatcttcgccggaaagcagctagaagatggccgaactcttgccgattacaacatccagaaagaatctacccttcaccttgttctgaggctgagaggaggaatcatcgagccttcactcatggctttggcacgaaaatacaaccaggacaagaccatctgccgcaagtgctatgctcgtcttcatcccagagctgttaactgcaggaagaagaagtgtggccacagcaaccagttgaggccgaagaagaagatcaagtagattcatttgctgtggcatcagccattcagttcctatgtggtttgggttgaatgccaaaactagtttgtttgattttctggaagtcatttgtagcaaatacttgaaacttaaaattttgaagtcttctgtacttgttattaaagatttattctcttgaggattatggaaagacttgttg

SEQ ID NO: 11390 - DNA, 631 bp, Fagopyrum esculentum
gggagcagtgaatctctgatcggcggcaagatgcagattttcgtcaaaaccctaactggtaagaccatcactctcgaggtcgagagcagcgacaccatcgacaatgtcaaggctaaaattcaagacaaagaaggcattcccccggaccagcagcgtctgatcttcgccggcaagcagctcgaagatggccgaaccctagccgattacaatatccaaaaagaatcgactcttcatcttgttctgaggctcagaggtggtatcattgaaccctctctcatggctttggctcggaaatacaatcaggacaagaccatttgccgcaagtgctatgcacgtctgcatccaagggcagtgaactgcaggaagaagaaatgtggtcacagcaaccagttgaggccgaagaagaagattaagtagatgtgccttttgacaatggctcaagcgattctatttccatgtggtttggtttcaaggacccaatcagtttggagttctcttttacaatcgtttggagccaatacctgagaacctttttgccttttcttgtctaaaatactagtttcatggtgtttatctcccaaatattatggatgaatgttacgatatgcttgctaacactcattatctttag

SEQ ID NO: 11391 - DNA, 601 bp, Flaveria ramosissima
ccctacgttagttttacccaaagcggcggtagacaaaatgcagattttcgtgaagacattaacggggaagacgatcaccctagaggttgaatcgagcgatacaatcgacaatgttaaagctaagattcaagacaaagaaggaattcctccggatcagcagcgtttgatcttcgctggaaaacaactcgaagatggaaggactctcgccgattacaacatccagaaagaatctacgcttcatttggtgttgaggcttcgtggagggattattgaaccctcgttgatggctttagcgaggaagtataatcaggataaaaccatctgtcgcaaatgttatgctcgtctccatcctcgtgctgttaattgcaggaagaagaaatgtgggcacagcaaccagttgaggccaaagaagaagatcaagtagatgattaaggtgatgttatggttcttgcttttgaaggttgtttgaatctttaagaggtggtactttctttttagaatatttttgatatttcttaagtatgttttggacctaaaggtttatgttgtgactttgacaagctattggaatgtctctttaatgtttgatgaaaaaaatatt

SEQ ID NO: 11392 - DNA, 545 bp, Flaveria ramosissima
acacacaagcaaaattagggttctgaaaatcggctgaagagaaaatgcagatcttcgtgaagacattgacggggaagacaatcacgctcgaggtcgaatcgagcgatacgatcgacaatgttaaggctaagattcaggacaaagaagggattccaccggatcagcagcgtttgatcttcgccggaaaacaactcgaggatggaaggactctcgccgattacaacatccagaaagaatctacgcttcatttggtgttgaggctccgaggaggtattattgaaccctctttgatggctttagctaggaagtataaccaagataaaaccatctgccgcaaatgttatgctcgtctccatcctcgtgctgtcaactgcaggaagaagaaatgtgggcacagcaaccagttgaggccaaagaagaagatcaagtagacgattttactatgcattttctttaaaaaagatgttttacatgtacgggtggtgcttttgttttacaccatttttgaatgtttctggatgatttttagaccctttaaatttaag

SEQ ID NO: 11393 - DNA, 618 bp, Flaveria ramosissima
gcggcggtagagaaaatgcagatcttcgtgaagacattaacggggaaaacaatcaccctagaggttgaatcgagcgatacaatcgacaatgttaaggcgaagattcaggacaaagaaggaattccaccggatcagcagcgtttgatcttcgccggaaagcaactggaagatggaaggactctcgccgattacaacatccagaaagaatcgacgcttcatttggtgttgaggcttcgtggagggattattgaaccctcgttgatggctttagcgaggaagtataatcaggataaaaccatctgccgcaaatgttatgctcgtctccatcctcgtgctgttaattgcaggaagaagaagtgtgggcacagcaatcagttgaggccaaagaagaagatcaagtagatgatgatggtgatgatgttatggcacttgcttttgaatgttgtttgaatctgtaagaattggtgctttctttttagaatctttttgaagttgtttttatgtttgctttgaatcttaagatttatgttgtgattttgataagccattgcattgtctctttaatgtttgatgaaattgttactgttctgtttgcttaggaatgaaacaagttggtta

SEQ ID NO: 11394 - DNA, 612 bp, Flaveria ramosissima
aacctcctcatttgagctacagacacaaaaagatgcagatcttcgtgaaaaccctaactggaaaaaccataaccctagaggttgaaagcagcgataccatcgataatgtgaaagcgaagatccaggataaggaaggtatcccaccggatcagcagcggttgatctttgccggaaagcagcttgaagatggccgaactcttgctgattacaacattcagaaagaatctactcttcatttggttttgaggctgaggggaggaatcattgaaccttcattgatggcattggctaggaaatacaatcaagacaagaccatctgccgcaagtgctacgctcgcttgcacccaagggctgtaaactgcaggaagaagaagtgcggtcacagcaaccaattaaggccgaaaaagaagattaagtgaagaggtgcgcatgcttttactgctggaagaagattatgtgttgtcatttttagaacatttgcatctgttttagacatattcttttgaagcatgaagtaaacttttactgatattgctgtttagtttaagatgcaccatttgtctgaaatctttttaacctatttgaacccgtcacataaacacttgtcttaat

SEQ ID NO: 11395 - DNA, 693 bp, Flaveria ramosissima
ataaacacacaccacgttagttttacgcaaagcggcggtagacaaaatgcagatcttcgtgaagacattaacggggaagacgatcaccctcgaggttgaatcgagcgatacaatcgacaatgtcaaagctaagatccaagacaaagaaggaattcctccggatcagcagcgtttgatcttcgctggaaaacaacttgaagatggaaggactctcgccgattacaacatccaaaaagaatctacgcttcatttggtgttgaggcttcgtggagggattattgaaccctcgttgatggctttagcgaggaagtataatcaggataaaactatttgccgcaaatgttatgctcgtctccatcctcgtgctgttaattgcaggaagaagaagtgtgggcacagcaatcagttgaggccaaagaagaagatcaagtagatgatgatggtgatgatgttaatggcacttgcttttgaaggttgtttgaatctgtaagagttgttgctttctttttagaatctttttgaagttttttaagtatgttttggatcttaacatttatgtggtgattttgataagctattgcattgtctcttcaatgtttgatgaagttactactgatctgtttgcctatgaataacaaaaaaaaaaaaaaaaagaaaaaagtactctgtcgttagactaccactgtacttact

SEQ ID NO: 11396 - DNA, 526 bp, Flaveria ramosissima
cctacaaacacaaaaagatgcagatcttcgtgaaaaccctaactggaaaaacaataaccctagaggttgaaagcagcgacaccatcgataatgtgaaagcgaagatccaggataaggaaggtatcccaccggatcagcagcggttgatctttgccggaaagcagcttgaagatggccgaactcttgctgattacaacattcagaaagaatctactcttcatttggttttgaggctgaggggaggaatcattgaaccttctttgatggcattggctaggaaatacaatcaagacaagaccatctgtcgcaagtgctacgctcgcttgcacccaagggctgtaaactgcaggaagaagaagtgtggtcacagcaaccaattaaggccgaaaaagaagatcaagtgaagaggtgtgcatgcttttactgctggaagaagattatgtgttgttattttcagaacatttgcatctgttttagacatattcctttgaagtatgaagtaaacttttactgaaaaaaaaatatt

SEQ ID NO: 11397 - DNA, 580 bp, Flaveria ramosissima
gcctcaagtcatccaatcaaatcacaaagatgcagatcttcgtgaaaaccctaacggggaagaccataaccctcgaggttgagagcagtgacacgattgacaacgtcaaggccaagattcaagacaaggaaggtatcccaccggatcagcagcggttgatcttcgccggaaagcagcttgaagatggccgaacactcgctgattacaacatccaaaaagaatcgactcttcatttggttttgaggttgaggggaggaatcatcgaaccctctttgatggcattggctaggaagtacaatcaagataagaccatttgccgcaagtgttatgctcgtttgcacccaagggctgtaaactgcaggaagaagaagtgtggccacagcaatcaactaaggccaaagaagaagatcaagtgaagacttagaagagcaacatatcttattaatttagggtcttcatctttttcagtcattttatgttgttagttacctatggatgaattgtttgtttgattcaagaagcaatactggttttaagtttctttgtgccatcttatgtgaagctttctattttgctttac

SEQ ID NO: 11398 - DNA, 479 bp, Flaveria ramosissima
tatagacacaaagagatgcagatcttcgtgaaaaccctaaccggaaaaacaataaccctagaggttgaaagcagcgacaccatcgataatgtgaaagcgaagatccaggataaagaaggtatcccaccggatcagcagcggttgatctttgccggaaaacagcttgaagatggccgaactcttgctgattacaacattcagaaagaatctactcttcatttggttttgaggctgaggggaggaatcattgaaccttctttgatggcattggctaggaaatacaatcaagacaagaccatctgccgcaagtgctatgctcgcttgcacccaagggctgtaaactgcaggaagaagaagtgtggtcacagcaaccaattaaggccgaaaaagaagatcaagtgaagagatgtgcatgcttttactgccggaagaagattatgtgttgttatttttagaacatttgcatctgttttagacat

SEQ ID NO: 11399 - DNA, 463 bp, Flaveria ramosissima
cggtagacaaaatgcagatcttcgtgaagacattaacggggaagacgatcaccctcgaggttgaatcgagcgatacaatcgacaatgttaaagctaagatccaagacaaagaaggaattccaccggatcagcagcgtttgatcttcgccggaaagcaactggaggatggaaggactctcgccgattacaacatccagaaagaatctacgcttcatttggtgttgaggcttcgtggagggattattgaaccctcgttgatggctttagcgaggaagtataatcaggataaaaccatttgccgcaaatgttatgctcgtctccatcctcgtgctgttaattgcaggaagaagaaatgtgggcacagcaaccagttgaggccaaagaagaagatcaagtagatgatgatgatggtgatgttatggtacttgattttgaaggttgtttgaatctttaagaggtggtg

SEQ ID NO: 11400 - DNA, 584 bp, Flaveria ramosissima
tactgaacatatacaagctaaattagggttctgaaaatcggcggaagagaaaatgcagatcttcgtgaagacattgacggggaagacaatcaccctcgaggttgaatcgagcgatacgatcgacaatgtcaaggctaagatccaggacaaagaaggaattccaccggatcagcagcgtctgatttttgccggaaaacaactcgaagatggaaggactctcgccgattacaacatccagaaagagtctacgcttcatttggtgttgaggctccgtggaggtattattgaaccttctttgatggctttagcaaggaagtataaccaggataaaaccatctgccgcaaatgctacgctcgtctccatcctcgtgctgttaactgcaggaagaagaaatgtgggcacagcaaccagttgaggccaaagaagaagatcaagtagacgaggatgttactatgcgtgtttttgaacgaaagttattttacattaagggtggtgcttttgttttacaccatttttgaatgtttctggaggatctttagaccctctaaatttatgtttggtgattcttataagctattgcaat

SEQ ID NO: 11401 - DNA, 588 bp, Flaveria ramosissima
ttcacaagcaaaattaggggttctgatttctgaaaatcggcggaagagaaaatgcagatcttcgtgaagacattgacggggaagacaatcacgctcgaggtcgaatcgagcgatacgatcgacaatgtcaaggctaagattcaggacaaagaaggaattccaccggatcagcagcgtctgatctttgctggaaaacaactcgaggatggaaggactctcgccgattacaacatccaaaaagagtctacgcttcatttggtgttgaggctccgtggtggtattattgaaccttcgttgatggctttagctaggaagtataaccaggataaaaccatctgccgcaaatgttacgctcgtctccatcctcgtgctgtcaactgcaggaagaagaaatgtgggcacagcaaccagttgaggccaaagaagaagatcaagtagacgacgatgttactatgcatgtttttgaaagaaagatattttacatgtaagggtggtgcttttgttttacatcacttttgaatgtttctggaagatctttagacccttaaatattaagtctggtgatttttataagctattgtaatgact

SEQ ID NO: 11402 - DNA, 490 bp, Flaveria ramosissima
atttgggagcctcaggtcatccaaatcagatcacaaagatgcagatcttcgtgaaaaccctaacggggaagacgataaccctcgaggttgagagcagtgacactattgacaacgtcaaagccaagattcaagacaaggaaggtatcccaccggatcagcagcgattgatctttgctggaaaacagcttgaagatggccgaactcttgctgattacaacattcaaaaagaatcgactcttcatttggttttgaggttgaggggaggaatcatcgaaccctctttgatggcattggctaggaagtacaatcaagataagaccatttgccgcaagtgttatgctcgtttgcacccaagggctgtaaactgcaggaagaagaagtgtggccacagcaatcaactaaggccaaagaagaagatcaagtgaagacttagaacaacatatcttattaattttgggtctttatcttttcagtctattttatgttgtta

SEQ ID NO: 11403 - DNA, 407 bp, Flaveria ramosissima
aaagcggcggtagagaaaatgcagatcttcgtgaagacattaacggggaaaacaatcaccctagaggttgaatcgagcgatacaatcgacaatgttaaagctaagatccaagacaaagaaggaattccaccggatcagcagcgtttgatcttcgccggaaagcaactggaagatggaaggactcttgccgattacaatatccagaaagaatcgacgcttcatttggtgttgaggcttcgtggagggattattgaaccctcgttgatggctttagcgaggaagtataatcaggataaaaccatctgccgcaaatgttatgctcgtctccatcctcgtgctgttaattgcaggaagaagaagtgtgggcacagcaatcagttgaggccaaagaagaagatcaagtagat

SEQ ID NO: 11404 - DNA, 511 bp, Flaveria ramosissima
atggggagcctcaggtcatccaaatcagatcacaaagatgcagatcttcgtgaaaaccctaacggggaagacgataaccctcgaggttgagagcagtgacaccattgacaacgtcaaagccaagattcaagacaaggaaggtatcccaccggatcagcagcgattgatcttcgccggaaagcagcttgaagatggccgaacactcgctgattacaacatccaaaaagaatcgactcttcatttggttttgaggttgaggggaggaatcatcgaaccctctttgatggcattggctaggaagtacaatcaagataagaccatttgccgcaagtgttatgctcgtttgcacccaagggctgtaaactgcaggaagaagaagtgtggccacagcaatcaactaaggccaaagaagaagatcaagtgaagacttagaacaacatatcttattaattttgggtctttatctttttcagtcattttatgttgttagttacctatggatgaattgttt

SEQ ID NO: 11405 - DNA, 564 bp, Flaveria ramosissima
tttacgcaaagcggcggtagagaaaatgcagatcttcgtgaagacattaacggggaagacgatcaccctagaggttgaatccagcgatacaatcgacaatgttaaggccaagatccaagacaaagaaggaattccaccggatcagcagcggttgatcttcgccggaaagcaactggaggacggaaggactctcgccgattacaacatccagaaagaatctacgcttcatttggtgttgaggcttcgtggagggattattgaaccgtcgttgatggctttagcgaggaagtataatcaggataaaaccatctgccgcaaatgttatgctcgcctccatcctcgtgctgttaattgcaggaagaagaagtgtgggcacagcaaccagttgaggccaaagaagaagatcaagtagatgatgatggtgttgttatggtacttgcttttgaaggttgtttgaatctgtaagaggtggtgctttctttttagaatctttttgaagtttttgaagtatgttttggacctaaagatttatgttgtgattctgataagttattccattgtctc

SEQ ID NO: 11406 - DNA, 597 bp, Gerbera hybrid cultivar
gaggcagaacctcgttagcctcggcaactgaagaagagatacagggacgaaacgatgcagatctttgtgaaaaccctaaccgggaagacgataactctcgaggttgagagcagcgacaccattgacaatgtcaaagctaagattcaagacaaggaaggtattccaccggatcagcagcgattgatatttgccggaaagcagcttgaagatggccgaactctcgccgattataatatccagaaagaatcaactcttcatttggttttgaggctaaggggaggaatcattgagccctcattgatggcattggctaggaaatacaatcaggacaagaccatatgccgcaagtgctatgctcgcctgcacccaagggctgtaaactgcaggaagaagaagtgtggccacagcaaccagctgaggccaaagaagaagatcaagtgaagaaatttgagtgttttatttgttggaattggagttatttgtgtcttttctagtgattttgttgtgcgactttatatttaaagtataactaaaggaatggtggtattactttagatcaccacgacattatcaaaatggtgctatcttatttggtga

SEQ ID NO: 11407 - DNA, 582 bp, Gerbera hybrid cultivar
cacagggaaagatgcagattttcgtgaaaaccctaaccgggaagacgatcactctcgaggttgagagcagcgacacgatcgacaatgtcaaagctaagattcaagacaaggaaggtattcccccggatcagcagcggttgatctttgccgggaaacagcttgaagatggtcggactcttgcagattacaacattcagaaagaatctactcttcatttggtgttaaggctaaggggaggaatcattgagccctctttgatggcattggctaggaaatacaatcaagacaagaccatttgccgcaagtgctatgctcgcttgcaccctagggctgtcaactgcaggaagaagaagtgtggccacagcaaccagttgaggccaaagaagaagatcaagtgaagatttgtaagtgttttgttgtgtcgaaagtgtttgaattcggtagtcggtttggttttgaaccatcttctctctttttctaggcgttttgctaaatctacttgagttattttaatttatccgaaagtactattaataacttttagtttcttttaaactttccaaaatggaacattatcaaata

SEQ ID NO: 11408 - DNA, 607 bp, Carpinus betulus
accgcgtagagcgaaacagagtgcgagagagcgaaggcaaaatgcagatcttcgtgaaaaccctaaccggcaagaccatcaccctcgaggtcgagtccagtgacaccatcgataatgtcaaggcaaagattcaagataaggaaggtattccaccggaccagcagaggctgatcttcgcagggaagcagctcgaggatggccgtactcttgcggattacaacatccagaaagagtcaactcttcaccttgttctgaggcttcgtggtggaattattgagccatctcttatggcattggccaggaaatacaaccaggacaaaacaatctgccgcaaatgctatgcacgcctgcacccacgtgctgtcaactgcaggaaaaagaagtgtggacacagcaaccagctgaggccaaagaagaagatcaagtagattactgattgtgaggaagaagtgccatggattctagtgggtctctgtctgttttgtttgaaccatggtagtatcaaaaaagcttgcagtagacttttagaaattcggccgacttgtagctttaaaacttttgagatggttgcaatgttactttgttctaatatgctttgaattttttt

SEQ ID NO: 11409 - DNA, 580 bp, Carpinus betulus
gaaaggaagagagagagaagagaatgcagatattcgtgaaaaccctaaccgggaagaccattactctcgaggtcgagagcagtgacaccatcgacaatgtcaaggccaagatccaagacaaggaaggaattcctccggatcagcagcgcttgatcttcgccggaaagcagctcgaagatggccgaaccctagccgactataacattcagaaagagtcgacgttgcatctggtgctgaggcttcgtggagggatcatagagccttctctgatggctttggcccgcaaatacaatcaagacaagacgatttgccgcaaatgttacgctcgtctgcacccaagggctgtaaactgccggaagaagaagtgtggtcacagcaatcagttgaggccaaagaagaagattaagtagactctgtaccgctattttgtttagtgtcgtcgattataatttgaaagttgatataataggaccaagatattcagtatgtggtttccatcataatggattttctattgttagtcaacatttatgaatgtgttccaatcctgatatcaaaatattgtgatgggtcttcttct

SEQ ID NO: 11410 - DNA, 667 bp, Carpinus betulus
cctcaccatccaatttttatctaaatcatgcaagccggatcgcaattgacctaaacccttaccgcttagagcgaaacagagtgcgagagagcgaaggcaaaatgcagatattcgtgaaaaccctaaccggcaagactatcactctcgaggtcgagtccagtgacaccatcgataatgtcaaggcaaagattcaagataaggaaggtattccaccggaccagcagaggctgatcttcgcagggaagcagctcgaggatggccgtactcttgcggactacaacatccagaaagagtcaactcttcaccttgttctgaggcttcgtggtggaattattgagccatctcttatggcattggccaggaaatacaaccaggacaaaacaatctgccgcaaatgttatgcacgcttgcacccacgtgctgtcaactgcaggaaaaagaagtgtggacacagcaaccagctgaggccaaagaagaagatcaagtagactactgattgtgaggaagaagtgccatggattctattgggtcactgtctgttttgtctgaaccatggtagcatcaaaaagtttgccagtagacttatagaaatccgacatagctttgaacttttgagatggttgcaatgttacttgttctaatatgctttgaattttttcgggcatta

SEQ ID NO: 11411 - DNA, 1022 bp, Lactuca sativa
caagaattgaaaaagatgggcttgaaactttcatggacaaaaaggtactactccaaaccctaattacaaaccagagtataaaatcctcataacaaacaattatcagcctcggcaaagtgaaagagatagagaaacggaaagatgcagattttcgtcaaaaccctaaccgggaagaccattactctcgaggttgagagcagtgacaccattgacaatgtcaaggctaaaattcaagacaaggaaggtattccaccggatcagcagcgattgatctttgccggaaagcaacttgaagatggccgaactcttgctgactataacatccagaaagaatcaactcttcatttggtgttgaggctaagaggaggaatcattgagccctcattgatggctttggctaggaaatacaaccaagacaagaccatttgccgcaagtgctatgcacgtttgcaccctagggcagtaaactgcaggaagaagaagtgtggccacagcaaccagttgaggccaaagaagaagatcaagtaggcgctagcccagttgttctatgtgtttggtttggaagtttctgcatcatttctagttattctgtttctaaactattgtaagaagtaaaaccaaaggctttgttgcttagtggagtggttttaatactttagatttctaaagacattttagtgtggtgtaatctggatgtgcattcgcatttttggtcatggatttttattattgttatgtttgctatctgtttactacattcagaattaaatggttctcttttgccagagattcaatggtacaatggtagctggttttaaatttcatgttgttcttttttgttatctttatgttgtttaaagtatggaaaaccttgtatgaaatataaaatttcaaaatgtaaaatgctctgatgaatatgttgggattgaattagttttgctttaataggtttacaatatagtgtgtttctttttcccaattaggtgaaatgtgctttctacctaccatatgtagtacctctt

SEQ ID NO: 11412 - DNA, 675 bp, Glycyrrhiza uralensis
ttgaacagcagattgggaagaaagagaaaatcagggggagagaaagatgcagatcttcgtgaaaaccctaaccgggaagactatcacccttgaggtggagtcaagtgacaccatcgataacgtgaaagctaagattcaggacaaagaagggattccaccggaccagcaaagactcatcttcgccggaaaacagttggaggatggccgtacccttgccgattacaacatccagaaagaatcaacattgcatcttgttttgaggcttcgtggtggcattattgagccgtctttgatggcattggccaggaaatataaccaggataagacgatctgccgcaagtgttatgcacgtcttcaccctcgtgcagtcaactgcaggaaaaagaagtgtggacacagcaaccagttgaggccaaagaagaagatcaagtaaactgttctgattgcaggaaggaattttgtgttgtcatggattactggatgtcttgtgatcttgatgacttaattagcttcttggtattgtaggaaatctgttggaaattgaactggcagagttactctatttttttgtttcagtttgagaaggattgatatcaattatgctacagttccatgtgatgacataattttgttgctttgataataatgcgtgtgatgtctttgttttccctccct

SEQ ID NO: 11413 - DNA, 522 bp, Glycyrrhiza uralensis
gatggcatgtatgtagacttgagagagctgaagcagcagcggcaaagatgcagatattcgtgaaaaccctaacggggaagaccataactctcgaggtcgagagcagcgacaccatcgacaatgtcaaagctaagattcaagacaaggaaggaattcccccggatcagcagcgtttgatattcgcggggaagcagctggaagatggaaggaccttagcggattacaacattcagaaggaatcaacacttcaccttgtcctcaggcttcgcggtggcatcattgagccttccttaatggctttggctcgcaaatacaaccaagacaagacaatttgccgcaagtgttatgctcgtctacacccgagggctgtgaactgccgcaaaaagaagtgtggtcatagtaatcagttgaggccaaagaagaagatcaagtaaattctggctaatgttgtttgtatcttcttaatgttggatctgggaggtttatgatttatttccatttactgctctgactatatctctt

SEQ ID NO: 11414 - DNA, 586 bp, Lupinus angustifolius
attggattgagaagggggagaggaagaagaaaagatgcagatcttcgtgaaaaccttaacagggaagaccatcaccctggaggtggagtcaagcgacaccatcgacaacgttaaggctaagattcaagacaaagaaggaattccaccggatcagcagaggttgatcttcgccgggaagcaactcgaagatggacgcactctcgctgattataatatccagaaagagtcaactttgcatcttgttttgaggcttcgtggtggcattattgagccatctttgatggcattggccaggaaatacaatcaggataagacaatctgccgcaagtgttatgcacgtctacacccccgtgctgtcaactgcaggaaaaagaagtgtggacacagcaaccagctgaggccaaagaagaagatcaagtagaatattctgattgcaatatggatttgtggatttgccagatgtcttcgtaatcctgataactttagcctcttgctctgttaagatttttagtaataagtttgagacggattgatatcaattttcatttattcaatgttaagacataaatttgttgcttttttatga

SEQ ID NO: 11415 - DNA, 486 bp, Lupinus angustifolius
tcgattcagaggcagcacaaaatgcagatcttcgtcaaaaccctaacgggcaagaccatcacccttgaggtcgagagcagcgacaccatcgacaatgtcaaggctaagattcaagacaaggaaggaattccaccggatcagcagcgattgatattcgctggaaagcagttggaggatggaagaacattggctgattacaatatccaaaaggaatccactcttcatcttgtactcaggcttcgcggtggcattatcgaaccttcgttgatggctttggctcgcaagtataaccaagacaagaccatttgccgcaagtgctatgctcgtcttcatccaagggctgtgaactgccgtaagaagaagtgtggccatagcaaccagttgaggccaaagaagaagatcaagtagactcttgcagatactgttcttatctttatttatgttgccaagaatactggcttttgatgtacttctgattagaactct

SEQ ID NO: 11416 - DNA, 637 bp, Lupinus angustifolius
aaaccctaaaaccagattcagataaggggcagaggaagaagaagaaaagatgcagatctttgtgaagaccctaacagggaagaccattacccttgaggttgagtccagcgacaccatcgataacgttaaggctaagattcaagacaaagaaggtatccctccggatcagcagaggttgatcttcgccggaaaacaactcgaagatggccgtactctcgctgattacaatatccagaaagagtcaacattgcatcttgtgttgaggcttcgcggtggtattattgagccatctttgatggcacttgccaggaaatacaatcaggacaagacaatctgccgcaagtgctatgcacgtttacaccctcgtgctgtcaactgcaggaaaaagaagtgtggacacagcaaccagctgaggccaaagaagaagatcaagtagactattctgactgccagatggattttgcggatttgcttgatgtctagtcttgtaatcctgataactttagcctcatgttattggggaaatctgttggaattgcactagctatgactgttaagatttttagtaatgagtttgagacgacttgatatcaatttttatttgcgtcaatgttaagacataattttgttgcatttt

SEQ ID NO: 11417 - DNA, 858 bp, Mimulus guttatus
agaattagcggctatctccgattgaatcaagtgaaaatgcagatcttcgtgaaaaccctaaccgggaaaacgataacgctcgaggtcgaatcgagcgacactattgacaatgtcaaggctaaaattcaagacaaggaagggattccaccggatcagcagcgtctgatttttgctgggaagcagcttgaagatggccggacactcgcagattacaatattcagaaagagtcgacattgcatctggttttgaggcttcgtggagggattatcgagccttctttgatggctttggctaggaagtacaaccaagataagaccatctgccgcaaatgttatgcacgcctgcatccacgtgctgtcaactgtagaaagaagaaatgtggccacagcaaccagttgaggccaaagaagaagatcaagtagacattttatattacgtttttcaagttgagaaattttgcttgtagaagcctcgatgaaaaaaattcctccccattttctacttattgcattggcctataatggtatatggaccaattattgtgtttttattggtaatgccagaatgtcttccggatttttatgattttgaaatatgtgcgttatttttagtgatttcattgttatgtgtatgaattgtttctagtcttgttggtgatgctctctggttattgttgaaacagaatgctttaatgtgcctgttcgaattaggatgtctgaattccaggattgtcaagtcagttatattctttaaccaagtgaaaatttgtagagtggacatgtgattgatctacccaagttccagctctaatctttgttggttgtctaatgtagtaatctctgtgatgggcagtgggt

SEQ ID NO: 11418 - DNA, 1251 bp, Mimulus guttatus
gttttgcaagtggaagaattgtagcttaagttggcggagttccgacggggaaagatgcagatcttcgtgaaaaccctcaccggaaaaaccatcacgctcgaggtcgaatcgagcgacaccattgacaatgtcaaagctaagattcaggataaggaaggaatcccaccggatcagcagcgtttgattttcgccggaaagcagcttgaagatggccgaacccttgctgattacaacatccagaaagagtcgactttgcatttggttttgaggcttaggggtggaatcatcgagccttcgctaatggctttggctaggaaatacaaccaagataagaccatttgccgaaaatgttatgctcgtctgcatcctcgtgccgttaactgcaggaagaagaagtgtggacacagcaatcagttgaggccaaagaagaagatcaagtagacttgctggctgtactatttatctttatttttctatttcagttgttgacaactaaacacacatagtttggcttttcttatgatagacattattacctccttataattgatgtaacgaaaatggttttgttttattctcgactttttgaattgtgattcagttttgtccatcggtttcttcatttatcgagttttgatgataaacttagtttaggcgcacccatacaaccattgcaacacgttcgatattgcattcaaaatgaaccactctttttcgataaacatttaaagctcgggcaaatataattttgttcgacatgaatcatgtgggcatataagccgccagagtaagagcttctcttctctgtttatctgttgtaacacgaaacaaaattgttgtcaatttccaatgaataattatataagtacagtggaacgcgagggcaaatcatattacaattaccttgtctgaaatatgttttgaaccatcttacgtggagattcagcagccgcatattccaactgcagcaactcatctgaactgagttgccagccaagggcacctaagttttcctcagcttgtttcattgacttcactcctggaattggaatcgtacctttgctaatgcaccagtttatagcaacctgtgtacaagtttggattcatctcatccgtttattttccacatagcttgtcacaaaaggagaaaaccgaagtacctgagatacggtttttcgccttctttgcgcagtttctttgagagaattgagcagtggctcaagtcctggtaaaatttgtcgaaatagaaga

SEQ ID NO: 11419 - DNA, 790 bp, Mimulus guttatus
taaagctggaactcggcggaggcggagaagtgtagttgctttttcaccgccaaaggaaaaatgcagatcttcgtgaaaaccctaaccgggaaaaccataacgctcgaggtagagtcgagcgacaccatcgacaatgtcaaggcaaagattcaggacaaggaaggaatcccacctgatcaacagcgtctgattttcgccggaaaacagcttgaagatggccgaacacttgctgattacaacattcagaaagagtctactcttcatttggttctgaggcttaggggtggaattatcgagccatctctcatggcattggccaggaaatacaaccaggacaagacaatttgccgcaaatgttacgctcgtctgcacccacgtgctgtcaactgcaggaaaaagaagtgtggacacagcaatcagttgaggccaaagaagaagatcaagtagagtgccaaaattggtggagaaatatcaccgcttgtttttttgttagatgtctttgaactgcttactgtcgttcattccgatatttgtcgtctactactattattatgttggatttccttttagtttatttgatgagagattttcaaacaaataatttacatgttggttgcttttctgttactgttatctagttatttgaaagatttgagattgaatttgcatgagctttgttatatctatattttcgcgtgattagtcatcgatcggagataagtatatacatacatgatacatatatatttcaggagcatttatgtaagttatatttttttgttgcaaaacg

SEQ ID NO: 11420 - DNA, 584 bp, Allium cepa
cgcaacaatgcagatctttgttaaaaccttgaccgggaagacaatcaccctagaggtcgagagcagtgacacaatcgacaatgttaaagctaaaatccaagacaaagaaggaattcctccggatcagcaaaggctgatttttgcaggaaagcagctcgaagacgggagaacactagctgattacaacatccagaaagagtctactttgcatttggtgttgaggttaagaggtggaattattgagccttctctgatggcacttgccaggaagtacaaccaggataagacaatttgccgcaaatgctatgcaaggttgcatcctagggctgttaactgcagaaagaagaagtgtggccacagcaatcagctaaggcccaagaagaagatcaagtaggcacttcatttggttgctaataggatatggagtacagctctgttattctctttttatttattgaacgaatatttttgtgtacattgcaattgcatcttgcactagatgtgagaatttcggcattatttccttgcactatgcttgtttccttttaaattgcctatttatgtcgaaacaagcatagtgcaag

SEQ ID NO: 11421 - DNA, 500 bp, Allium cepa
ccttcgccaagaaatgcagatcttcgtcaaaactctaaccggaaaaactatcactcttgaagtcgagagctccgatacaatcgacaatgtcaaagccaaaatccaagacaaagaaggaattcctccggatcaacagaggttgattttcgctggaaagcagctcgaggacggccgtactttagctgattacaacattcaaaaggaatcaactttgcatttggtactgaggttgagaggtggaattatcgagccttctctaatggctcttgctaggaagtataatcaggacaagactatttgccgcaagtgctatgcaagacttcatccaagggctgtcaattgcaggaagaagaagtgcggtcacagcaaccagttgaggcccaagaagaagatcaagtagatgctttctgttgctgctggatgccttttagacctttattttcagagaacttttgtttaatttcccttagttgagttgttaacttaatttttcattttag

SEQ ID NO: 11422 - DNA, 543 bp, Parthenium argentatum
tagggttacaacagtcggcggcgacagagaaaatgcagatcttcgtgaaaaccttgaccgggaagacaataactctcgaggttgaatcgagtgatacgatcgacaatgttaaggctaagatccaggacaaggaaggaatcccaccggaccagcagcgattaatattcgctggaaaacagctcgaggatggaaggactctcgctgattataatatccagaaagagtctacgcttcatttagtgttgaggctccgtggaggtattattgaaccatcgttgatggcgttagcaaggaagtataaccaggataaaactatctgccgcaaatgttatgctcgtctccatcctcgtgctgtcaactgtaggaagaagaaatgtggacacagcaaccagttgaggccgaagaagaagatcaagtagacgaagatgctgtggtactttcttttgaaatatgttttaatttgtgaccattttggaatgtttttgagtactttgaccctgttcggtgatttttatatgctattgcgacgtgtctttgatgttt

SEQ ID NO: 11423 - DNA, 574 bp, Carthamus tinctorius
ctccatcgagaagagagagagagagagaccaagaagatgcagatcttcgtgaaaaccctaaccgggaagaccatcacccttgaggtcgagagcagcgacaccatcgacaatgtcaaggccaagattcaggacaaggaaggtatccctccggatcagcagcgattgatcttcgccggaaagcagcttgaggatggccgaactcttgccgattacaacattcagaaagaatcgactcttcatttggtgttgaggctcaggggaggaatcattgagccttctttgatggcattggctaggaaatacaaccaagacaagaccatttgccgcaagtgttatgctcgcctgcacccaagggctgtaaactgcaggaagaagaagtgtggccacagcaaccagctaaggccaaagaagaagatcaagtgaagagttacaagtggtttgtgcttgagaaaagtagaagtgatattgttaaattttggaacatctgcatctattttgattagtcattttgtttgtaaggaccaatgaaagtaaacttgatgaattgttcatctaattcaggattggttttcaa

SEQ ID NO: 11424 - DNA, 612 bp, Carthamus tinctorius
tggcggggagttatcagaatcggcgatcgaagagaagatgcagatcttcgtgaaaaccctaaccgggaagaccatcactctcgaggttgagagcagcgataccatcgacaatgtcaaagctaagattcaagataaggaaggtattccaccggatcagcagcgattgatctttgccggcaagcagcttgaagatggccgaactctggctgattacaacatccagaaagaatcaaccctccatttggttttgaggctaagaggaggaatcattgagccttctttgatggccttggctaggaaatacaaccaagacaagaccatttgccgcaagtgctatgctcgtctgcacccgagggctgtaaactgcaggaagaagaagtgtggtcacagcaatcagttgaggccaaagaagaagatcaagtgaagggttggcgattgcttcgtgtgttgggttggaagtgtccgcgtcttttctagtcgttttgtttctgttttcttataaaatgtaaactgatggaatttttgatgtgttgaaaacggtattattactctagatcttcgagatattctgaaaatgatggtggttttgcgtagtttaagcttttgcaaaaa

SEQ ID NO: 11425 - DNA, 588 bp, Helianthus annuus
aaatcggcggtagcagaagaagaagagaaaatgcagatcttcgtgaaaacattgaccgggaagacaatcacgctcgaggttgaatcgagcgatacgatcgacaatgtcaaagctaagatccaggacaaagaaggaattccaccggaccagcagcggttgatctttgccggaaaacaactggaagatggcaggactcttgccgattacaacatccagaaagagtctacgcttcatttggtgttgaggcttcgtggtggtattattgaaccgtcgttgatggctttagccaggaagtataatcaggataaaactatctgccgcaaatgctatgctcgtcttcatcctcgtgctgtcaactgtaggaagaagaaatgtggtcacagcaaccagttgaggccgaagaagaagatcaagtagatgaaaatgctatggtactttctattgaaatatgttttaattgtgaaccatttttgaatgtttgttgagtactttgaccctgtttggtgattttgatcaactatttcgacatctttgatgttttattgttgatttgctttataatactcgtacgaatggaagtggttgata

SEQ ID NO: 11426 - DNA, 596 bp, Helianthus annuus
gagagaaaatgcagatcttcgtgaaaacattgaccgggaagacgatcacgctcgaggttgaatcgagcgatacgatcgacaatgtcaaggctaagatccaggacaaagaaggaattccaccggaccagcagcggctgatctttgccggaaaacaactggaagatggcaggactcttgccgattacaacatccagaaagagtctacgcttcatttggtgttgaggcttcgtggtggtattattgaaccgtcgttgatggctttagccaggaagtataatcaggataaaactatctgccgcaaatgctatgctcgtcttcatcctcgtgctgtcaactgtaggaagaagaaatgtggtcacagcaaccagttgaggccgaagaagaagatcaagtagatgaaaatgctatggtactttctattgaaatatgttttaattgtgaaccatttttgaatgtttgttgagtactttgaccctgtttggtgattttgatcaactatttcgacatctttgatgttttattgttgatttgctttataatactcgtacgaatggaagtggttgataccaatctgtttatcctggtttcatgattag

SEQ ID NO: 11427 - DNA, 573 bp, Helianthus annuus
tacacaacagatcagttctacaacaagcggcggcggcggctgagaaaatgcagatcttcgtgaagacattgaccgggaaaaccatcacgctcgaggttgaatcgagcgataccatcgacaatgtcaaggctaagatccaagacaaagaaggaattcccccggaccagcagcggttgatcttcgccggaaaacaactcgaggatggaaggactcttgcggattataatattcagaaagagtctacacttcatttggtgttgaggcttcgtggtgggattattgaaccgtctttgatggctttggcgagaaagtataaccaggataaaactatctgccgcaaatgttacgctcgtctccatccacgtgctgttaactgcaggaagaagaagtgtgggcacagcaaccagttgaggccaaagaagaagatcaagtagatgatgatgatgatgttatggtactttgttttgaaggttgtttaaggttgtaaggatggtgcttacatttttgaatttgaatgttatgttttagacttaaaatttatgatttatgattttgatgaggtattgcggtttt

SEQ ID NO: 11428 - DNA, 534 bp, Helianthus annuus
aatgcagatcttcgtgaagacattgaccgggaaaaccatcacgctcgaggttgaatcgagcgataccatcgacaatgtcaaggctaagatccaagacaaagaaggaattcccccggaccagcagcggttgatcttcgccggaaaacaactcgaagatggaaggactcttgcggattataatattcagaaagagtctacacttcatttggtgttgaggcttcgtggtgggattattgaaccgtctttgatggctttggcgagaaagtataaccaggataaaactatctgccgcaaatgttatgctcgtctccatccacgtgctgttaactgcaggaagaagaagtgtgggcacagcaaccagttgaggccaaagaagaagatcaagtagatgatgatgatgatgttgttatggtactttgttttgaaggttgttttaggttgtaaggatggtgattacatgctacaccatttttgaatttgaatgttatgttttagacttaaaatttatgatttgtgattttgataaggtattgc

SEQ ID NO: 11429 - DNA, 562 bp, Helianthus annuus
aatgcagatcttcgtgaaaacattgaccgggaagacaatcacgctcgaggttgaatcgagcgatacgatcgacaatgtcaaagctaagatccaggacaaagaaggaattccaccggaccagcagcggctgatctttgccggaaaacaactggaagatggcaggactcttgccgattacaacatccagaaagagtctacgcttcatttggtgttgaggcttcgtggtggtattattgaaccatcgttgatggctttagccaggaagtataatcaggataaaactatctgccgcaaatgctatgctcgtcttcatcctcgtgctgtcaactgtaggaagaagaaatgtggtcacagcaaccagttgaggccgaagaagaagatcaagtagatgaaaatgctatggttctttctattgaatatgttttaattatgaaccatttttgaatgtttgtcgagtactttgaccctgtttggtgattttgatcagctatcgcgaaatatctttgatgttttattgttgatttgctttataatactcgtacgaatggatttagtcgatacc

SEQ ID NO: 11430 - DNA, 607 bp, Helianthus annuus
gtacgcggggacaacagatcagttctacaacaagcggcggcggctgagaaaatgcagatcttcgtgaagacattgacggggaaaaccatcacgctcgaggttgaatcgagcgataccatcgacaatgtcaaggctaagatccaagacaaagaaggaattccgccggaccagcagcggttgatcttcgccggaaaacaactcgaggatggaaggactcttgcggattataatattcagaaagagtctacacttcatttggtgttgaggcttcgtggtgggattattgaaccgtctttgatggctttggcgagaaagtataaccaggataaaactatctgccgcaaatgttatgctcgtctccatccacgtgctgttaactgcaggaagaagaagtgtgggcacagcaaccagttgaggccaaagaagaagatcaagtagatgatgatgatgatgttgttatggtactttgttttcaaggttatttaaggttgtaaggatggtgcttacattttacaccatttttgaatttgaatgttatgttttagacttaaaatttatgatttgtgattttgataaggtattgcggttttcttatatgttttagtga

SEQ ID NO: 11431 - DNA, 545 bp, Helianthus annuus
cattttgagacaagaaacaaagatgcagattttcgtgaaaaccctaaccggaaagaccataactctcgaggttgagagcagtgacaccattgataatgtcaaagctaagattcaagacaaagaaggtattccaccggatcagcagcgcttgatctttgccggaaagcagcttgaagatggccggacccttgctgattacaacatccagaaagaatcaactcttcatttggtgttgaggctaagaggaggaatcattgaaccttctttgatggcattggctaggaaatacaaccaagacaagactatttgccgcaagtgctatgctcgtttgcacccaagagccgtaaactgcaggaagaagaagtgtggtcacagcaaccagctgaggccaaaaaagaagatcaagtaaactgtaggcgagtttgcataatgggtttggaagtatgtgcatcttttattgtttttctcttttttgaagaaaagtaactctaatacattgtttaagaaatgttgttattaaccgagacactttgaaaagtaatgga

SEQ ID NO: 11432 - DNA, 548 bp, Helianthus annuus
aatgcagatcttcgtgaaaacattgaccgggaagacaatcacgctcgaggttgaatcgagcgatacgatcgacaatgtcaaagctaagatccaggacaaagaaggaattccaccggaccagcagcggttgatctttgccggaaaacaacttgaagatggcaggactcttgccgattacaacatccagaaagagtctacgcttcatttggtgttgaggcttcgtggtggtattattgaaccatcgttgatggctttagccaggaagtataatcaggataaaactatctgccgcaagtgctatgctcgtcttcatcctcgtgctgtcaactgtaggaagaagaaatgtggtcacagcaaccagttgaggccgaagaagaagatcaagtagatgaaaatgctatggtactttcatttgaaatatgttttaattgtgaaccatttttgaatgtttgttgagtactttgaccctgtttgatgattttgatcagctattgcgacttatctttgatgttttattgttgatttgctttataatactcgtacgaatg

SEQ ID NO: 11433 - DNA, 517 bp, Helianthus annuus
aatgcagatcttcgtgaagacattgacggggaaaaccatcacgctcgaggttgaatcgagcgataccatcgacaatgtcaaggctaagatccaagacaaagaaggaattcccccggaccagcagcggttgatcttcgccggaaaacaactcgaggatggaaggactcttgcggattataacattcagaaagagtctacacttcatttggtgttgaggcttcgtggtgggattattgaaccgtctttgatggctttggcgagaaagtataaccaggataaaactatctgccgcaaatgttacgctcgtctccatccacgtgctgttaactgcaggaagaagaagtgtgggcacagcaaccagttgaggccaaagaagaagatcaagtagatgatgatgatgttgttatggtactttgttttgaaggttgtaaggatggtgcttacattttacaccatttttgaatttgaatgttatgttttagacttaaaatttatgatttgtgattttgataaggta

SEQ ID NO: 11434 - DNA, 597 bp, Helianthus annuus
agagaaaatgcagatcttcgtgaaaacattgaccgggaagacaatcacgctcgaggttgaatcgagcgatacgatcgacaatgtcaaagctaagatccaggacaaagaaggaattccaccggaccagcagcggttgatctttgccggaaaacaactggaagatggcaggactcttgccgattacaacatccagaaagagtctacgcttcatttggtgttgaggcttcgtggtggtattattgaaccgtcgttgatggctttagccaggaagtataatcaggataaaactatctgccgcaaatgctatgctcgtcttcatcctcgtgctgtcaactgtaggaagaagaaatgtggtcacagcaaccagttgaggccgaagaagaagatcaagtagatgatgatgatgatgttgttatggtactttgttttcaaggttatttaaggttgtaaggatggtgcttacattttacaccatttttgaatttgaatgttatgttttagacttaaaatttatgatttgtgattttgataaggtattgcggttttttatatgttttagtgatcttatgtttgctatgtgttgtgttggtttgtgtt

SEQ ID NO: 11435 - DNA, 765 bp, Helianthus annuus
ctcagccagaaacaaagatgcagatcttcgtgaaaaccctaaccggtaagaccataaccctcgaggttgagagcagcgacaccattgacaatgtcaaggccaagattcaggacaaggaaggtattccaccggatcagcagcggttgatcttcgccggaaagcagcttgaagatggcagaactcttgctgattacaatatccagaaagaatctactcttcatttggttttgaggttaaggggaggaatcattgaaccctctttgatggcattggctaggaagtacaatcaagacaagaccatttgccgcaagtgttatgctcgtctgcacccaagggcagtaaactgcaggaagaagaaatgtggccacagcaaccaactaaggccaaagaagaagattaagtgaagacttagacaagcaacttgtttggttaattttagaagttctgcatgcatctatttctgtcctattttgttgttaagtacctatggataaattgttcgttttttttcaagaagcaatactggtttttatgtgttttttgtgctatctgatgtggaggtgtcgagttttctattttgttttaatgttttgagctagttctgaaacgtggacgtcatttaacatctaaaattaagctgtgattcgaaggttttcaacatatagagcgacaacacatagttttgacacagatggcgtttggtggcggatagttcaaaatagattgggtgatacggtgtaatgaagcccctgacagatgtgatgc

SEQ ID NO: 11436 - DNA, 520 bp, Helianthus annuus
aatgcagatcttcgtgaagacattgacggggaaaaccatcacgctcgaggttgaatcgagcgataccatcgacaatgtcaaggctaagatccaagacaaagaaggaattccaccggaccagcagcggttgatcttcgccggaaaacaactcgaggatggaaggactcttgcggattataatattcagaaagagtctacacttcatttggtgttgaggcttcgtggtgggattattgaaccgtctttgatggctttggcgagaaagtataaccaggataaaactatctgccgcaaatgttatgctcgtctccatccacgtgctgttaactgcaggaagaagaagtgtgggcacagcaaccagttgaggccaaagaagaagatcaagtagatgatgatgatgttgttatggtactttgttttgaaggttgtttaaggttgtaaggatggtgcttacattttacaccatttttgaatttgaatgttatgttttagacttaaaatttatgatttgtgattttga

SEQ ID NO: 11437 - DNA, 574 bp, Helianthus annuus
aatgcagatcttcgtgaaaacattgaccgggaagacaatcacgctcgaggttgaatcgagcgatacgatcgacaatgtcaaggctaagatccaggacaaagaaggaattccaccggaccagcagcggttgatctttgccggaaaacaactggaagatggcaggactcttgccgattacaacatccagaaagagtctacgcttcatttggtgttgaggcttcgtggtggtattattgaaccgtcgttgatggctttagccaggaagtataatcaggataaaactatctgccgcaaatgctatgctcgtcttcatcctcgtgctgtcaactgtaggaagaagaaatgtggtcacagcaaccagttgaggccgaagaagaagatcaagtagatgaaaatgctatggtactttctattgaaatatgttttaattgtgaaccatttttgaatgtttgttgagtactttgaccctctttgatgattttgatcagctattgcgacatatctttgatgttttattgatgattggctttataatactcgtacgaatggaattagtcgataccaatctgtttat

SEQ ID NO: 11438 - DNA, 662 bp, Helianthus annuus
aatgcagatcttcgtgaaaacattgaccggtaagacaatcacgctcgaggttgaatcgagcgatacgatcgacaatgtcaaagctaagatccaggacaaagaaggaattccaccggaccagcagcggttgatctttgccggaaaacaactggaagatggcaggactcttgccgattacaacatccagaaagagtctacgcttcatttggtgttgaggcttcgtggtggtattattgaaccgtcattgatggctttagccaggaagtataatcaggataaaactatctgccgcaaatgctatgctcgtcttcatcctcgtgctgtcaactgtaggaagaagaaatgtggtcacagcaaccagttgaggccgaagaagaagatcaagtagatgaaaatgctatggtactttctattgaaatatgttttaattgtgaaccatttttgaatgtttgttgagtactttgaccctgtttggtgattttgatcagctattgcgacatatctttgatgttttattgttgatttgcatactcgtacaaatggagtcagtcgataccaatctgtttatcatggtttcatgattgatggttgctgcttctagattgattttcccaggcaactccttacggaaaaaaaacaccaaaaccacaaccaataaactt

SEQ ID NO: 11439 - DNA, 534 bp, Helianthus annuus
aatgcagatcttcgtgaagacattgacggggaaaaccatcacgctcgaggttgaatcgagcgataccatcgacaatgtcaaggctaagatccaagacaaagaaggaattccaccggaccagcagcggttgatcttcgccggaaaacaactcgaggatggaaggactcttgcggattataatattcagaaagagtctacacttcatttggtgttgaggcttcgtggtgggattattgaaccgtctttaatggctttggcgagaaagtataaccaggataaaactatctgccgcaaatgttatgctcgtctccatccacgtgctgttaactgcaggaagaagaagtgtgggcacagcaaccagttgaggccaaagaagaagatcaagtagatgatgatgatgatgatgttatggtactttgttttgaaggttgtttaaggttgtaaggatggttccaacattttacgccgtttttgaatttgaatgttatgttttagacttaaaatttatgatttgtgattttgaaatgctattgc

SEQ ID NO: 11440 - DNA, 519 bp, Helianthus annuus
aatgcagatcttcgtgaaaacattgacggggaaaaccatcacgctcgaggttgaatcgagcgataccatcgacaatgtcaaggctaagatccaagacaaagaaggaattccgccggaccagcagcggttgatcttcgccggaaaacaactcgaggatggaaggactcttgcggattataatattcagaaagagtctacacttcatttggtgttgaggctacgtggtgggattattgagccgtctttgatggctttggcgagaaagtataaccaggataaaactatctgccgcaaatgttatgctcgtctccatccacgtgctgtgaactgcaggaagaagaagtgtgggcacagcaaccagttgaggccaaagaagaagatcaagtagatgatgatgatgttgttatggtactttgttttgacggttgtttaaggttgtaaggatggtgcttacattttacaccatttttgatttgaatgttatgttttagacttaaaatttatgatttgtgattttga

SEQ ID NO: 11441 - DNA, 512 bp, Helianthus annuus
aatgcagatcttcgtgaagacattgacgggaaagaccatcacgctcgaggttgaatcgagcgataccatcgacaatgtcaaggctaagatccaagacaaagaaggaattccaccggaccagcagcggttgatcttcgccggaaaacaactcgaggatggaaggactcttgcggattataatattcagaaagagtctacacttcatttggtgttgaggcttcgtggtgggattattgaaccgtctttgatggctttggcgagaaagtataaccaggataaaactatctgccgcaaatgttatgctcgtctccatccacgtgctgttaactgcaggaagaagaagtgtgggcacagcaaccagttgaggccaaagaagaagatcaagtagatgatgatgatgatgatgatgatgttgttatggtactttgttttgaaggttgtaaggatggtgcttacattttacaccattttttaatttgaatgttatgttttagacttaaaatttgtgattt

SEQ ID NO: 11442 - DNA, 560 bp, Tragopogon dubius
tcggcaagctgaagagatagagaaagggaaagatgcagattttcgtcaaaaccctaaccgggaagaccataaccctcgaggttgagagcagcgataccattgacaatgtcaaggctaagattcaagacaaggaaggtattccaccggatcagcagcgattgatctttgccggcaagcagcttgaagatggacgaactctcgctgattacaacatccagaaagaatccactcttcatttggtgttgaggctaagaggaggaatcattgagccctctttgatggcattggccaggaagtacaatcaagacaagaccatttgccgcaagtgctatgctcgtttgcatccaagggctgtaaactgcaggaagaagaagtgtggccacagcaatcagttgaggccaaagaagaagatcaagtgagtgtttttttgtgttgggatttggaagtatttgcatcttttttagacattttgttgctaaactcttataaaaaaagtaaaacttggaagtggtattattactttagatctttgagacattttgactattgtgtaatctgaa

SEQ ID NO: 11443 - DNA, 557 bp, Tragopogon dubius
tcgggggacaagcggccgagccttcaacagcctcaccgccgagagagacaaagatgcagatcttcgtgaaaaccctaaccgggaaaaccataaccctcgaggttgagagcagcgataccatcgataatgtgaaggccaagattcaggataaggaaggtattccaccggatcagcagaggttgatctttgccggaaagcagctagaagatggccgaactcttgccgattataacatccagaaagaatcgactctccatttggtgttgaggctaaggggaggaatcattgaaccttcattgatggcattggctaggaaatacaaccaagataagacgatttgccgcaagtgttatgctcgtttgcacccaagggctgtgaactgcaggaagaagaagtgtggccacagcaaccagctaaggcccaagaagaaaatcaagtagacttttgtgtggaagaagaactttttggttatttctagaagactgcatctttttgattcatttttgttgttaaaaaccttctaaagattgtttgtttaaatttaagaatctttattg

SEQ ID NO: 11444 - DNA, 709 bp, Trigonella foenum-graecum
ctgttatcacctcgtatatatacgtctattagaaaaacaacacaaactttggcagcagctttggaagagagaaattcagcggcggaagagaagatgcagatcttcgtgaaaaccctaaccggcaagactatcacccttgaggtggagtcaagcgacactatcgacaacgtcaaagccaagatccaggacaaagaaggaattccaccggaccagcagaggttgatcttcgccggaaagcagttggaggatggccgtaccctcgccgactacaacatccagaaagagtcaacattgcatcttgttttgaggcttcgtggtggtattattgagccatctttgatggcgttggccaggaagtataatcaggacaagacaatctgccgcaagtgctatgcacgtttacaccctcgtgctgttaactgcaggaaaaagaagtgcggacacagcaaccagttgaggccaaagaagaagatcaagtagactgttctgattgctggaaggaattttttgttgtcgttgattactggaaaatgtcttttgataattagcttcttaagtattgtatgaattctgttggaagttgaacttgcagttttgtctatgattttgtttcggtttgagacatgttatatcaattatgctactcttatatgcaatgacataattttgttgcttttacttttggtagtaatgcatggtacgaaatgta

SEQ ID NO: 11445 - DNA, 841 bp, Trigonella foenum-graecum
cggccgggggagaaaggtgaagtaagtccgcaaatatgcagatcttcgtcaaaaccctaaccgggaaaaccatcacccttgaggttgagagcagcgacacaatcgacaatgttaaggcaaagattcaagacaaggaaggtattccaccagatcagcagcgtttgattttcgccggtaagcagcttgaagatggacgcaccttggctgattacaatatccagaaggaatcaactcttcatcttgttctcaggcttcgtggtggtatcattgaaccttctttgatggctttggctaggaaatataaccaggacaaaaccatttgccgcaaatgctatgcacgtcttcatcctagggctgtcaactgccgcaagaagaagtgtggacatagcaatcaattgaggccaaagaagaagataaagtagactctggttgttattgttttttcttgtggtttgttttgagatacttttgatggttttggttgttacttatcttttgactggatctattgtttaattgatgttgaatttagttggaacttattttggtataagtggattatattttggtataagccaatgttgttaagatcttttacgttatttgtcccttttttgtttccacccacaactttaacatacgaattgcgaacacatttgaatattaggcaatttattgcaatatatgatactaacataaatagatcattgtttatctagagagacctatgtagttttactatatttattgattcttacatgacagaaattcgatcagttggttattgcactcttgataaataactgatattttattctatttttttaagggtaaatgtctc

SEQ ID NO: 11446 - DNA, 656 bp, Trigonella foenum-graecum
agcagctatgcagatattcgtgaaaaccctaacagggaagacgattactctcgaagtcgagagtagcgacaccatcgacaatgtcaaagccaagattcaagacaaagaaggtatcccaccggatcagcagcgtttgatttttgccggaaaacagcttgaagatggaagaaccctagctgattacaacattcaaaaggagtctactctacatcttgtgctgaggcttcgtggtggtattattgagccttctttgatggctttggctaggaaatacaatcaggacaaaaccatctgccgcaagtgttatgctcgtctgcatccaagggccgtgaactgcaggaaaaagaaatgtggtcacagtaatcagttgaggccaaagaagaagattaagtagattatggctttgatcttgttcttctcgtgtggtgagctggtgaccaattgttgattaatgtagttgatcacatgcttagtatggtgttaaacaatgtttgaatgattttggttttgtttctgtagcaatcaactatatacttttatgacatttttatctctttcatgtcccagtcttgagtttttgaggattcttgacgttagcaacaatttttgttacaagtttgttttaactacattataatttcatgttgttttgattt

SEQ ID NO: 11447 - DNA, 709 bp, Vicia sativa
agcaaaaactttgacagcagcagcttggaaagagcaacaggcggaggaagatgcagatctttgtgaaaacccttaccggcaagactatcaccctcgaggtggagtcaagcgacaccatcgataatgtcaaagctaagattcaggacaaagaaggaatacctccggaccagcagaggttgatcttcgccggaaagcagttggaggatggccgtacccttgctgactataacatccagaaagagtcaacattgcatcttgttttgaggcttcgtggtggtattattgagccatctttgatggcattggccaggaaatacaaccaggataagactatctgccgcaagtgctacgcacgtctgcaccctcgtgctgtcaactgcaggaaaaagaagtgtggacacagcaaccagttgaggcccaagaagaagatcaagtagactgttctgatcgcaggaaggatttttttgatgtcatggattactggagaatgtctttcgataattagcttcttagttttgttggaagttgaactgaccgtttttgttcatgattttgttttggtttgagacactttgatatcagttatgctattgtttgttatatgcgatgacataattttgattttttaaatgtgtgaaacttgaatgctatgctctgtttttacttttctttgacaattcaatgttctttaataaaaagttaatttccc

SEQ ID NO: 11448 - DNA, 787 bp, Vicia sativa
atgcagatcttcgtgaaaaccctaaccgggaaaaccatcaccctcgaggtcgagagcagcgacaccatcgacaatgtcaaggccaagatccaagacaaggaaggtatccctcctgatcagcagcgtttgatcttcgccggtaagcagcttgaagatggacgcactttggcggattacaatatccagaaggaatctactcttcatcttgttctcaggcttcgcggtggaatcattgagccctctttgatggctttggctaggaagtataaccaagacaaaaccatttgccgcaaatgctatgctcgtcttcatcctagggctgttaactgccgcaagaagaagtgtggacacagcaatcaattgaggccaaagaagaagatcaagtagattctggttgatattgtttctcttttgttgtttgttctgagatactttttgttattttggttattaattctctcctcactaaagatttagtttactcaatgttgaatgttgttggggtttattatggtataatcattttgtgttatatttcctccctcatgatttttttcctttaattaatgtcatgtccattgcttttagttgttttaaaaaatggttacagatgcgctgctgtttatgtaaatgtttagtgatttcgttctgttgtgtggccattaatgtcgtcacatttgttatttgaattctatatgatttgattatgatctgtgtgccagtaacagttttgataaaaatgtaacaacatttatatgatctttcaaaaattttataggcttgatgt

SEQ ID NO: 11449 - DNA, 448 bp, Zinnia violacea
acgcgggaacggcggcagtaggaaaagtcgaaaatgcagatcttcgtgaagacattgacgggaaaaaccatcacgctcgaggttgaatcgagcgatacgatcgacaatgtgaaggctaagatccaggataaggaaggaattccaccggatcagcagcggttgatctttgccggaaaacaacttgaggatggaagaactcttgctgattataacatccagaaagagtctacgcttcatttggtgttgaggcttcgtggaggtataattgaaccatctttgatggctctagccagaaagtataaccaggataaaactatctgtcgcaaatgttatgctcgtctgcatcctcgtgctgttaactgcaggaagaagaaatgtggacacagcaaccagttgaggccaaagaagaagatcaagtagatgatgatgatgattttgatgttatggt

SEQ ID NO: 11450 - DNA, 713 bp, Cycas rumphii
aaaggtctcttcagaatcttgaaggcaaaacctagcgaccaactagaaatactctaaacacgttactattttgccaatatagaagccttgcagagctggttaccccgagtgttaaagatgcagatattcgtgaaaaccctgacgggaaagaccataactttggaggtcgagagcagcgacaccatcgataatgtcaaggctaaaatccaggacaaggaagggattccccccgatcaacaacggttgatatttgcgggcaaacagttggaagacggtcgcactttggctgactataatattcagaaagagtcaacgctgcaccttgtattgaggctccgtggagggattattgaaccttcgttgatggcattggctagaaagtataaccaagacaagatgatttgcagaaagtgctatgctcggttgcatcctagggcagtaaactgcaggaaaaagaagtgtggccatagtaaccagttgcggccaaagaagaagatcaagtaaatctgacatctgaagtgatcatatcgctggcttatattcacattattcatatttcagcttatatattttttattagtacgtgcaaaaggtacaattttgaaagtacattgctcttaagtaagcaaacttcagttttttgatccctcatctgttatggattcactagaatctttaaggagtcatgttttttattcttttggtttgttaat

SEQ ID NO: 11451 - DNA, 817 bp, Cycas rumphii
ttacaaacccgagatcaacgaaccctggttttctgaaaccctagcaacccagaatggatgcgataaaagcacaagcagacctttaaacctaaaattgttttgatagaacgctttcaaccagagaggcagtgcttgaacaagatgcagatattcgttaaaaccctcacgggtaagaccataaccctagaggtcgagagcagcgataccatcgacaatgtgaaggccaaaatccaggacaaggaaggcattccacccgaccagcaacgattgatttttgctggaaagcagctggaagatgggcgaactcttgctgactataatattcagaaagagtccacattgcaccttgttctgaggcttcgtggaggaataattgagccgtcattgatggctttggcaaggaaatacaatcaggacaagatgatctgcagaaagtgttacgcccgtttgcatcccagggcagtgaactgcaggaaaaagaaatgcgggcatagcaaccagctgaggccaaagaaaaagatcaagtaaaatatgacgagttggaaattagttttcagcatgcgtgtttcctttcctttttgtatttgcttttgagaacttttagcaaacatgttttttcagcatttaatctccaattaggaattgatgtatttgcatgccttgtatggattcccctatgaataattagggatgtcttattgatatttccatgtagtattattagtcaatgaatttggaggtgatttaaatctgacgaggagtaaatggttgtgtgtgcatcagcttgttttctgaatgtgtcaacatttaactgcca

SEQ ID NO: 11452 - DNA, 610 bp, Pinus taeda
aagtccactattgttggggagaaattgttggcagcgagcaagatgcagatcttcgtaaagaccctgacgggcaagaccataaccttagaagttgaaagcagcgatacaatcgacaatgtgaaggccaaaatccaggacaaagaagggatcccgcccgaccagcaacgtctgatatttgcgggcaagcagttggaagatggacgcactctggcggattacaacattcagaaagagtcaaccttgcaccttgtgctgaggcttcgtgggggtattatagagccttctttgatggcattggccaggaagtacaaccaagacaagatgatttgcagaaaatgctatgctcgtctgcaccctcgagcagtcaactgcaggaaaaagaagtgtgggcatagtaaccagctgcggccaaagaagaaaatcaagtaaatgtgatgccgcattgagattttatatctctaaagtcattcatgttctatgattccccatcattttaggtggttgtgccttgtcaaaagcatcacttttaaaccatgcttggcttataagtaaagccttcacgtttttgatatcatatattaaattaaactgggaatctgactcataacaa

SEQ ID NO: 11453 - DNA, 834 bp, Rosmarinus officinalis
cggccgggggagataaattttggtaggaggccacagcatacagtgaaaaagccttggcccaacccaatttcggaaaccctaattcttgaagctacatactagtaagcaaacaaactgccacttgattatcggcgactgcagaattaggggaaaatgcaaatattcgtgaaaaccctgaccgggaaaacaattacgctcgaggtcgaatcgagcgacaccatcgacaatgtcaaggccaaaatccaagacaaagaaggaattccgccggatcagcagcgtctgatttttgctggcaagcagctggaagatggccggacgctggccgattacaatattcagaaagagtcgacgttgcatttggttttgaggcttcgtggaggaattatcgagccttccttgatggctttggctaggaagtacaaccaggacaagatgatctgccgcaaatgttatgctcgcctgcatccccgtgctgttaactgtagaaagaagaagtgtgggcacagtaaccagttgaggcccaagaagaagatcaagtagacatgcgctgaatttcactccattttcaacttctttcgttggccttatattgagtttcttttgccttggtgatgtcagaatattaagatgttttggatacttgataattatcgcactgtgtttaatgtcagatgtcaaagctacctgttaccttttctacttccttttgttgattatcatgtcacaagtaacctatatatgcaagtattttgttgatatattataatgttgtatcttgaattctatcataataaaagcatgcataatagatctaagtgcatgtatataagatat

SEQ ID NO: 11454 - DNA, 591 bp, Glycine max
cctaatagcagttttggaagagagggaaagatgcagatattcgtgaaaaccctaaccgggaagaccatcacccttgaggtggagtcaagcgacaccattgacaatgtcaaagccaagattcaggacaaagaagggattcctccggatcagcagaggttgatcttcgccggtaaacagctggaagatggccgtaccctcgctgattataacatccaaaaagagtcaacattgcatcttgttttaaggcttcgtggtggtattattgagccatctttgatggcactggcgaggaaatataaccaggataagatgatctgccgcaagtgttatgcccgtttacatccccgtgctgtgaactgcaggaaaaagaagtgtggtcacagcaaccagttgaggccaaagaagaagatcaagtaaactcttctgattgcaagatggaattttgtgttgtcatggattattggatgtcttgtaatcctgataactccattagcttcttagtactctagtaaatctttcggaaatttgacagtcagttactcttatgatttttgttttcagtttgagacggattgatattgattatgctac

SEQ ID NO: 11455 - DNA, 536 bp, Glycine max
agtagttttgaaagggaaggaaagatgcagatattcgtgaaaaccctaaccgggaagacaatcacccttgaggtggagtcaagcgacaccattgacaatgtcaaagccaagattcaggacaaagaagggattcctccggatcagcagaggttgatcttcgccgggaaacagctggaggatggccgtaccctcgccgattacaacatccaaaaagagtcaacattgcatcttgttttgaggcttcgtggtggtattattgagccatctttgatggcactggcgaggaaatataaccaggataagatgatctgccgcaagtgctatgcccgtttacacccccgtgctgtgaactgcaggaaaaagaagtgtggtcacagcaaccagttgaggccaaagaagaagatcaagtaaactgttctgattgcaagatggaattgtgttgtcatggattactgggatgtcttgtaatcctgataactccattagcttcttagtattatagtaaatctttcggaaatttgacagccaaagttact

SEQ ID NO: 11456 - DNA, 592 bp, Glycine max
gagtgaagaagcagagggagtagcggcattaaaaatgcagatcttcgtgaaaactctgacagggaagactataaccctcgaggtcgagagcagcgacaccatcgacaatgtcaaggccaagattcaagacaaggaaggcattcctccggatcagcagcgtttgattttcgccggaaagcagcttgaagatggaaggaccctggccgattacaacatccagaaggaatcaacccttcatctcgtcctcaggcttcgtggtggcatcattgagccttccctcatggctttggctcgcaaatacaaccaggacaagatgatttgccgcaagtgctatgcccgtctgcatcctagggctgtgaactgccgcaagaaaaagtgcggtcatagtaaccagttgaggcctaagaagaagatcaagtgaattctgtgtgatattgttggtctcatccttcgtgttgttggatttggaacagggactggtttgatatttatagttctggttttgattaatgttaattgttttgagacaatagttttgaagtagccaattatattgttatgacgacattttgatctctcgtaagttgtattt

SEQ ID NO: 11457 - DNA, 1634 bp, Amborella trichopoda
tatattttaaacattttcggacagcatatgtagaaatgcggttaagcgaaacaattttcctatgtagttttccattttaaggttgcaaccttgtttaaactttcgctttcacgtaaaaggaaagcatattcttggaattcaatttgtgtaggatatgatgtcattagggaaatgtcaaggtcgtttagcgtctttagtaggcattgcaaagcaaaaccctccactataaaatcttatcatcctcggcgcctctctctctagcgaattggagagagagagagaagatgcagatctttgtgaaaaccctaacgggtaagaccataaccctagaggtcgagagcagcgacaccattgacaatgtcaaggccaagatccaggacaaggaagggattcctccggaccagcagcgcttgatctttgctggaaaacagcttgaggatggtcgtacgctcgcagattataacatccagaaagagtctactctgcaccttgttctaaggcttcgtgggggtatcattgagccatcattgatggccttggcgaggaagtacaaccaggacaagatgatttgccggaagtgttatgctcgtttacatccaagggctgttaattgcaggaagaagaaatgtggtcacagcaatcagttgaggcctaagaagaagatcaagtgagctggagctgctaagttgtggctggtttacattcaaaatttctcccagaacttaccaattcccttctgttttaggattatgaactggctagtagttttgtaatttgctgagcacttgcagacttgatggttgatatggttgatgtcaatcaagcagcagatgacattgaaagacgccttacggccttttttttgtttttttggatcagtatgacattattcctagaattttttgtttaagcaatgactgttttcttgaattttccttggaaatgtgatgaagcttggggggtcattgggattaggattggagaatttaaatctgaaatctagaatgcagaaaattgagtatctggtaacaaaaatactgtgttttgttaaccactatagagttggggggattttggaaaactatgtttggatcaagttcaaaacagaaatactgtgagctatggggattttggaaaactatgtttggatttaagttcaaatttttatattaaatatgaaaattagcaaatttaaccttcttgaaagtttttgttagatgatatggtactgtttgttggatgagacaccaaaattgcacgtcgatgataggtccactaaagtttaatactaccaggaaataaattggttaagttgagggcaagtttaaggattttaatattgttttattttttctattcttcatattgagctaacatctttggcttttatattttcaccaagtacccgtcatgaaattatagaaaaataatttgaaaaaagtgtaataattgtaatgtctttatggatggttaggacatgtcacgagtattacaattttattttgatttcttaacgttgtattgaattaaaattttgggagtgtgcgattcttatgtttacaaatttgtacaatctacttgaattatttttggagttcaaaattttataattagagataaaaatagattctcaa

SEQ ID NO: 11458 - DNA, 590 bp, Amorphophallus konjac
cggccggggcttcggaagcccgacagagggtgaggagcgcggcggcggggcacgatgcagatcttcgtgaagaccctgacggggaagaccatcaccctcgaggtggagagcagcgacaccatcgacaatgtcaaggccaagatccaggacaaggaagggatcccgccggaccagcagcgcctgatcttcgccgggaagcagctcgaggatggtcgcacactcgcagattacaacatccagaaagagtcgaccttgcatctggtgttgaggctgaggggaggtattatcgaaccttcgctcatggcactggcgaggaagtacaaccaagacaagatgatctgccggaagtgctatgctaggcttcacccaagggctgtgaactgtaggaagaagaaatgtggccacagcaaccagttgaggcccaagaagaagattaagtaagctgttccgggacgaaacacttgccatgtgaatgagagtagcataagggttgtgcaagcgtctattcgtggacattttattttgtgttctaaaattttgttctttccatgtgctcatgactgcaagttgtagtgtttgaaactatttgc

SEQ ID NO: 11459 - DNA, 791 bp, Amorphophallus konjac
ctaaactccactcacggtctggctaacgagtccgactcggaaagttggcgacgttggcatccgtcgagcggacctggggccaattcgaaaccctagggaagggactcgcgcatgaggagataaaatagcggcggagacaaagaagaaggcgcgggtgaaggggaacgaaggagggaggagggactccgctggtctgcaatcatgcagatcttcgtgaagaccctgactgggaagacgatcaccctcgaggtcgagagcagcgacaccatcgacaacgtcaaggccaagatccaggacaaggaagggattcccccggaccagcagcgcctcatcttcgccgggaagcagcttgaggatgggcgcaccctcgccgactacaacatccagaaagagtcgacgttgcacctggtgttaaggctgaggggagggataatcgagccttcgctcatggccctggccaggaagtacaaccaggacaagatgatctgccgcaagtgctatgctcgtcttcacccaagggctgtcaattgcaggaagaagaaatgtggtcacagcaatcagctgaggccgaagaagaagattaagtaaactgctactgtgcttttgggtcgctaatttctggactaaagaacttgtgaccttcgcaatttggatgtgtagagtgaaggttttggtaaaatcgtagacatgttattgttattttttgtttggtattttgttctgttgctagagagggtatttgcaagttaatggaatttcactatttcggcttcaatatcaaatcgatatcc

SEQ ID NO: 11460 - DNA, 754 bp, Aquilegia formosa
agaaaagaaagatgcagatcttcgtgaaaaccctaactgggaagacgattacccttgaggttgaaagcagtgataccatcgataatgtcaaagccaagattcaagacaaggaaggtattcctccagatcagcaacgattgatctttgctggaaagcaacttgaagatggcagaactcttgctgattataacattcaaaaagaatctactttgcatttggttctgaggcttagaggtggaattattgaaccttctttgatggctttggctaggaagtacaatcaggacaagatgatttgcaggaagtgttatgctcggctgcatcccagggcagtgaattgcaggaagaagaaatgtggtcatagcaatcagttgaggcctaaaaagaaaatcaagtgagctcaggtgttttatgttggacccactgatgggagttttttttccgctgtcttgcctccacctctctgcttcacctccaccaccacctccacctccacctccacctccacctccacctctctttcttcttttgctctttgcaccttctttcacggctggttcccatggtctcaccttattgcaattttctatttattttttattggtagaacagacatatgtcttgcaccatgagtgcttttgtttgtgcttaaatgcttactttagtattcctaatatacttgtttaagcaatttgaattccaatgagtaggtttatcatcatatgaatgccttaataatgaggactcctgcatg

SEQ ID NO: 11461 - DNA, 760 bp, Aristolochia fimbriata
ttggcgaagaaagtaacgaggcagatagagggggaggagaggtaggcagaggaagcagaggcgaaaatgcagatattcgtcaaaaccctaaccgggaagaccatcaccctcgaggtcgaatcgagcgacaccatcgacaatgtcaaggcgaagatccaggacaaagaagggatccccccggatcagcagcgtctgatcttcgctggaaagcagcttgaggatggccgtacccttgcagattacaacatccagaaagagtcgacgctccatctggttctcaggcttcgtggtgggattattgagccatctttgatggcattggcaaggaagtacaaccaggataagatgatctgccgcaagtgttatgctcgtctccacccccgtgctgtgaactgcaggaagaagaagtgtggacacagcaaccagttgaggccaaagaagaagatcaagtagactaatcatgtattcaggaggaatagttgtagttttcttggatgcgatttttgtttctttagccccattgtggaacatgttttattcagaattaatgtgtttttgactgcttttgtttctaagtgagacaatagttaaggtgtcatattatttacccttccccgatctctgtgatgtgaaaacttatatggaacgcagcctggtagtctttctaatgaaatatcgttgtcaacactatgcaaatcgtgttcattccgaaattgcagtgttaattattttatttgtggtaaagggaatcagctatccc

SEQ ID NO: 11462 - DNA, 421 bp, Artemisia annua
acgcagtactccgacggggattagaacggcgagacaaaatgcagatctttgtgaagactttgacagggaagaccataacacttgaggttgaatcctcagacaccattgacaatgtcaaggccaagattcaagacaaggaaggtatcccaccagatcagcagaggttgatatttgctggaaagcaacttgaagatggccgtactcttgctgactacaacatccagaaagagtcaactcttcatttggtgttgaggctgagaggaggaatcattgagccctctttgatggctttggctaggaagtacaaccaggacaagaccatctgccgcaagtgttatgcgcgtctccatccaagggctgttaactgcaggaagaagaagtgtggtcacagcaaccaactaaggccaaagaagaagatcaa

SEQ ID NO: 11463 - DNA, 678 bp, Persea americana
agagagagagaagaggtgcgaatacgaagaagaagaatatgcagatcttcgtaaaaaccctaacggggaagaccataaccctcgaggtcgaatccagcgacaccatcgataatgtaaaagccaagatccaggacaaggaaggaatccctcccgatcagcagcgtctgatcttcgctggtaaacagctcgaagatggtcgtactctcgctgactacaacatccagaaagagtcgacgctgcatcttgttctgaggctccgtggtggaatcatcgagccatctctgatggcgctggccagaaagtataaccaggacaagatgatctgccgaaagtgctatgctcgcttacacccccgggctgttaattgtaggaagaagaaatgtggccacagcaatcagttgaggcctaagaagaagattaaataaatctgatcgtggtagctgggcaggtagtgatagggcaactgatttacgctttcgctttctgaaaaatgtggatcttatggtgatttagtctcagttgtgagcattcagcccttgactgttttcttattatgagcattcagcccttgactgttttcttattttgttttcttgttggacttgcgattggtggcagttttattttaatgtaaaagccatgtaacttttttaaaaattctgattgagttcttttttt

SEQ ID NO: 11464 - DNA, 639 bp, Persea americana
aggcacaatccctgccctaaaaacgcagtggagaagagaaggaagaagaagaagaagaatcggaagagagaaagatgcagatcttcgtaaaaaccctaactgggaagaccattaccctagaggtcgaatccagcgacaccattgacaacgtcaaggcgaaaatccaagacaaagaaggaattccaccggatcagcagcgcctcatctttgcaggaaagcagctcgaagatggccgcactctggccgactacaatatccagaaagagtcgacgctgcatctcgttctgaggcttcgcggtggaattatcgagccttctctgatggcattggccagaaagtataaccaagataagatgatctgcagaaaatgctatgcccgtctccatcctcgagctgtgaactgcaggaaaaagaagtgtggccacagcaatcagttgaggccaaagaagaagatcaagtaaattcaattatggagaggatggtacctgcagcagaagctcttctactgatgatacccttttatttagaagcagaaattactattttgacgttttgattgttggttgtcaattttactttttctattttgctgctaaacttggagttcagatcttagttgttatccttaatttaaggctt

SEQ ID NO: 11465 - DNA, 691 bp, Brassica juncea
aaagatgcagatcttcgtgaaaaccctaaccgggaagaccatcaccctcgaggtcgagtcctccgacaccatcgacaatgtcaaggccaagatccaagacaaagaaggaatccctccggatcagcagagattgatcttcgccggaaaacagctcgaagatggacgtactttggctgactacaacatccagaaagagtcaacgcttcatcttgtgttgaggcttagaggaggtatcatcgagccttctttgatggctttggctcgtaagtacaatcaggacaagatgatttgccgcaagtgctatgctcgtcttcacccaagagctgtgaactgcaggaagaagaagtgtggccatagcaaccagttgaggcctaagaagaagatcaagtagactcgtttcaagaacctgatcttgcttgcctctttctttttgtttgttttatctctgccctttgataaggttgtttttgcttcagtgaattttgatgttcaaagattatatcagtaaaaggattttgttttctattcatgcttattcacttatttgtttttattattccattctgcatatgcttcttccgatttatttgtgcatcctagacgatgctaacgaaatttaagtgtaatattttaaaactgctagtaaaattgttcaactgcaagagagcattcttttataatccccacttca

SEQ ID NO: 11466 - DNA, 500 bp, Brassica juncea
aagatgcagattttcgtgaagacgctgacgggcaagaccatcaccctcgaggtggagagcagtgacaccatcgacaatgtcaaggccaagatccaggacaaagaaggaatccctccggaccagcagaggttgatcttcgccggaaaacagcttgaggatggtcgcactttagctgactacaacatccagaaagagtcgactctgcatcttgttttgaggctaaggggaggtatcattgagccgtctttgatggctttggctcgtaagtacaatcaagacaagatgatctgccgcaagtgttacgctcgtctgcacccaagggctgtcaactgcaggaagaagaagtgtggccacagcaatcagttgaggcccaagaagaagatcaagtgatctgtttttcactacgaacttatttatctatgttttttttccttgaacagacatctctagtgttatgacacaaacttgtttcattgaattttaatcctaaaagattgttg

SEQ ID NO: 11467 - DNA, 744 bp, Brassica juncea
agaactctcgctgactacaacatccagaaggagtcgactcttcatctcgtcctcaggctccgtggtggtatgcagatctttgtcaagaccttgaccggaaagactattactttggaggtggagagctcggacaccattgacaacgtgaaagccaagatacaagacaaggagggtattcctccggaccagcagcggttgatctttgccggaaagcagctcgaggatgggagaactctcgctgactacaacatccagaaggagtcgactcttcatcttgtgttgaggcttagaggaggtatcattgagccttctttgatggctttggctcgtaagtacaaccaagacaagatgatttgtcgcaagtgctatgctcgtcttcatccaagagctgtgaactgcaggaagaagaagtgtggccatagcaaccagttgaggcctaagaagaagatcaagtagactcgtctcaacaacccatcttgtctgtctcttatttttgtcttcctcttgttaaggttgttttgtttcagtgaattttttatgttgtgttcaaagattatatcagtaaaatgatttggttttctttatgctgaatcattattggtttcctttattccttgatctatatgttcgtttctgaattttatttctgcaccctagactttgagatgatttctatcgaaatgttctggatttgatacttacgtaccaattacttgttggatgaatatagtcatttccttaaaa

SEQ ID NO: 11468 - DNA, 519 bp, Brassica juncea
cttttgcggcggagaagaagaagaagatgcagatattcgtgaagacgctgacgggcaagaccatcaccctcgaggtggagagcagcgacaccatcgacaatgtcaaggccaagatccaggacaaagaagggatccctccggatcagcagaggttgatcttcgccggaaaacagcttgaagatggtcgtaccttggctgactacaacatccagaaagagtcgactctgcatcttgtcctgaggcttaggggaggtatcatcgagccgtctctgatggctttggctcgtaagtataatcaagacaagatgatctgccgcaagtgttacgctcgtcttcatccaagggctgtcaactgcaggaagaagaagtgtggccacagcaaccagttgaggcccaagaagaagatcaagtgatctgttttgtttatttatctatgtgtttttttccttgaaagacatctctagtgttttgacacaaactcgtttcagtgaattttaatcctaaatgattttcgttagt

SEQ ID NO: 11469 - DNA, 509 bp, Brassica juncea
aaagatgcagatcttcgtgaaaaccctaaccggcaagaccatcactctcgaggttgagtcctccgacaccatcgacaatgtcaaggccaagatccaagacaaagaaggtatccctccggatcagcagagattgatcttcgccggaaaacagctcgaagatggccgtactttggctgactacaacatccagaaagaatcaacacttcatcttgtgttgaggcttaggggaggtatcatcgagccttctttgatggctttggctcgtaagtacaaccaagacaagatgatttgccgcaagtgctatgctcgtcttcacccaagagctgtgaactgcagaaagaagaagtgtggtcatagcaaccagttgaggcctaagaaaaagatcaagtagactctctttcaagaacctgatcttgcttgcctcctcgtttttgtttgtttgcttgcttttccctttgataaggttgttttttattcagtgaaatttgatgttcaaagattatatcagt

SEQ ID NO: 11470 - DNA, 420 bp, Brassica juncea
ctggaacttgcggcggagaagaagatgcagattttcgtgaaaacgctgacgggcaagaccatcaccctcgaggtggagagcagtgacaccatcgacaatgtcaaggccaagatccaggacaaggaagggatccctccggatcagcagaggttgatcttcgccggaaaacagctcgaagatggtcgcaccttggctgactacaacatccagaaagagtcaactctgcatcttgttctgaggctaaggggaggtatcattgagccttctctgatggctctggctcgtaaatacaatcaagacaagatgatctgccgcaagtgttacgctcgtctgcacccaagggctgtcaactgcaggaagaagaagtgtggccacagcaaccagttgaggcccaagaagaagatcaagtgatctgttttt

SEQ ID NO: 11471 - DNA, 484 bp, Brassica juncea
gatgcagatcttcgtgaaaaccctaaccggcaagaccatcacactcgaggtggagtcctccgacaccatcgacaatgtcaaagccaagatccaagacaaggaaggcatccctccggatcagcagcgtttgatcttcgccggtaaacagctcgaagatggtcgtaccttggctgactacaacatccagaaagagtctacgcttcatcttgtgttgaggcttagaggaggaatcattgagccttctttgatggctttggctcgtaagtacaatcaggataagatgatttgccgcaagtgctatgcacgtcttcacccaagggctgtgaactgcaggaagaagaagtgtggccacagcaaccagttgaggcccaagaagaagatcaagtagactctgtttaagattctatcttgcttgcttggttcttttttccttgccttctctttgatatagttgttctgtttcagtgaatttttatgttatgtt

SEQ ID NO: 11472 - DNA, 687 bp, Brassica juncea
cggctgagaacaccaagaagccaacaaagatgcagatcttcgtgaaaactcttaccgggaagaccatcaccctcgaggtcgagtcctccgacaccatcgacaatgtcaaggccaagatccaagacaaagaaggaatccctccggaccagcagagactgatcttcgccggaaaacagctcgaggatggccgtactttggctgactacaacatccagaaagagtccacgcttcatcttgtgttgaggcttagaggaggaatcattgagccttctttaatggctttggctcgtaagtacaaccaagacaagatgatttgccgcaagtgctatgcacgtcttcacccaagggctgttaactgcaggaagaagaagtgtggccacagcaaccagttgaggcccaagaagaagatcaagtagactcagcttaagattctatcttggttactgcttcttttcttccttgccttctctttgatagagttgttttgtttcagtgaatttttatgttatgttcagagattatgtcagtaaaaggagttggttctgtttatgctgaatcatttatttgcttcctttattgtgttttgcatatgatatgcatgttccgatccatttcagcacacaagatatgttgacgaaatgaaacgagaaattacttgagaaaacaataatgttgattttgggatgc

SEQ ID NO: 11473 - DNA, 589 bp, Brassica juncea
gaggctcttgcggcggagaagatgcagattttcgtgaaaacgctaacgggcaagaccatcaccctcgaggtggagagcagcgacaccatcgacaatgtcaaggccaagatccaggacaaagaaggaatccctccggatcagcagaggttgatattcgccggaaaacagcttgaagatggtcgtaccttggctgactacaacatccagaaagaatcgactctgcatcttgtcctgaggctaaggggaggtatcattgagccgtctttgatggctttggctcgtaagtacaatcaagataagatgatttgccgcaagtgttacgctcgtctgcacccaagggctgtgaactgcaggaagaagaagtgtggccacagcaaccagttgaggcccaagaagaagatcaagtgatttgttttttttcaccggaggctcgtttatctatgttatgttttgtgtgtttcatctcttttgttttgacacaaacccgtttatgtggatttttcactagtaattctgattttctttggcattttatataaaattcgaaactgtgtcacaaacttgttttagtggattttaatcctagtgg

SEQ ID NO: 11474 - DNA, 548 bp, Brassica oleracea
gcggaaggaaggaaagaagagacgaacagaaagatgcagatcttcgtgaaaaccctaaccggaaagacaatcaccctcgaggtcgagtcctccgacaccatcgacaatgtcaaggccaagatccaagacaaagaaggaatccctccggatcagcagaggttgatcttcgccggaaagcagctcgaagatggccgtactttggctgactacaacatccagaaagagtcaacgcttcatcttgtgttgaggcttaggggaggtatcatcgagccttctttgatggccttggcgcgtaagtacaaccaggacaagatgatttgccgcaagtgctatgctcgtcttcacccaagggctgtgaactgcaggaagaagaagtgtggccatagcaaccagttgaggcctaagaagaagatcaagtagactcgtatcaagaacctgttcttgcttcttttttttgttgtttcgtcttgcccttgataaggttgtttttgcttcagtaaaatttgatgttcaaagattatatcagtaaaaggatttggttttctaat

SEQ ID NO: 11475 - DNA, 516 bp, Brassica oleracea
ccgcggcggagaagatgcagattttcgtgaaaacgctgacgggcaagaccatcaccctcgaggtggagagcagcgacaccatcgacaatgtcaaggccaagatccaggacaaagaaggaatccctccggatcagcagaggttgatattcgccggaaaacagcttgaagatggtcgtaccttggctgactacaacatccagaaagaatcgactctgcatcttgttctgaggctaaggggaggtatcattgagccctctttgatggctttggctcgtaagtacaatcaagacaagatgatctgccgcaagtgttacgctcgtctgcacccaagagctgtcaactgcaggaagaagaagtgtggccacagcaaccagctgaggccgaagaagaagatcaagtgatttgttttttttcaccggaggctcgtttatctatgttatgttttgtgtgtttcatctcttttgttttgacacaaacccgtttatgtggatttttcactagtaattctgattttct

SEQ ID NO: 11476 - DNA, 424 bp, Brassica oleracea
gagacttgcggcgaaggagaagatgcagatattcgtaaaaacattgactggcaagaccattaccctcgaggttgagagcagtgacaccattgacaatgtcaaggcaaagatccaggacaaagaaggaatccctccggatcagcagaggttgatcttcgccggaaaacagcttgaagatggtcgtaccttggctgactacaacatccagaaagaatcgactctgcatcttgtcctgaggctaaggggaggtatcattgagccgtctttgatggctttggctcgtaagtacaatcaagacaagatgatctgccgcaagtgttacgctcgtctgcacccaagggctgtcaactgcaggaagaagaagtgtggccacagcaaccagttgaggcccaagaagaagatcaagtgatttgttttttttcac

SEQ ID NO: 11477 - DNA, 639 bp, Brassica rapa
gtaaccttttctgagacttttgcggcggagaagaagaagaagatgcagatattcgtgaagacgctgacgggcaagaccatcaccctcgaggtggagagcagtgacaccatcgacaatgtcaaggccaagatccaggacaaagaagggatccctccggatcagcagaggttgatctttgccggtaaacagcttgaagacggtcgcaccttggctgactacaacatccagaaagagtcgactctgcatcttgtcctgaggcttaggggaggtatcatcgagccgtctttgatggctttggctcgcaagtacaatcaagacaaaatgatctgccgcaagtgctacgctcgtctgcaccctagggctgtcaactgcaggaagaagaagtgtggccacagcaaccagttgaggccgaagaagaagatcaagtgatctgttttgtttgttcacaacaacttatttatctgtgttttttttccttgaaagacatctcgctagtgttttccttgaaagacatctcgcgcgtccttcagtagtaaatctgaattgtcttttgcttttcttttttctttacagattccaactttttgtcatcttatttaatttgccaatagttgatattccattataggagaatttgac

SEQ ID NO: 11478 - DNA, 658 bp, Brassica rapa
aaactataaacattactcttcaaagcaaactctgttttttagaggctcttgcggcggagaagatgcagattttcgtgaaaacgctaacgggcaagaccatcaccctcgaggtggagagcagcgacaccatcgacaatgtcaaggccaagatccaggacaaagaaggaatccctccggatcagcagaggttgatattcgccggaaaacagcttgaagatggtcgtaccttggctgactacaacatccagaaagaatcgactctgcatcttgtcctgaggctaaggggaggtatcattgagccgtctttgatggctttggctcgtaagtacaatcaagacaagatgatctgccgcaagtgttacgctcgtctgcacccaagggctgtgaactgcaggaagaagaagtgtggccacagcaaccagttgaggcccaagaagaagatcaagtgatttgttttttttcaccggaggctcgtttatctatgttatgttttgtgtgtttcatctcttttgttttgacacaaacacgtttatgtggatttttcactagtaattctgattttctttggcattttatataaaattcgaaactgtgtcacaaacttgttttagtggattttaatcctagtggatcaaagtcatgccttaattttcttaga

SEQ ID NO: 11479 - DNA, 777 bp, Brassica rapa
tacataagtttgtgggcttaaaaagcccattgtaagagcccacttcaaaaaccctagaaatgaaggagaggactttaaatactcttcttctctccttcttgtaagcttttctgatacttgcggcggagaagaagaagaagatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggaaaacagcttgaagacggtcgtaccttggccgactacaacatccagaaagagtcgactctgcatcttgtcctgaggcttaggggaggtatcatcgagccgtctctgatggctttggctcgtaagtacaatcaagacaaaatgatctgccgcaagtgttacgctcgtcttcatccaagggctgtcaactgcaggaagaagaagtgcggccacagcaaccagttgaggcccaagaagaagatcaagtgatctgttttgtttattcacaacagacttatttatctatgtgtttttttttccttgaaagacatctctagtgttttgacacaaactcgtttcagtgaattttaatcctaaaagattttcgttagtaaatctgaattgtctttggcttttttttttctttacaaattccaactttttatcatcttatttaatttgctaatagttgatgtagaacatattccattataggagaatttgacataacaataataag

SEQ ID NO: 11480 - DNA, 784 bp, Brassica rapa
caaaaccctagaaatgaaagggtataagaaccccttcctgtatctgtatggttacgcggccagaacaagaagaagccaacaaagatgcagatcttcgtgaaaaccctgaccgggaagaccatcaccctcgaggtcgagtcctccgacaccatcgacaatgtcaaggccaagatccaagacaaagaaggtatccctccggatcagcagcgattgatcttcgctggaaaacagctcgaagatggccgtactctggctgactacaacatccagaaagagtccacgcttcatcttgtgttgaggcttagaggaggtatcatcgagccctctttgatggcgttggctcgcaagtacaaccaagacaagatgatctgccgcaagtgctacgctcgacttcacccgagggctgtgaactgcaggaagaagaagtgtggccatagcaaccagttgaggcccaagaagaagatcaagtagactctgttcaagaaactatcttgctcgcttgcttgcctctttttttttctttgcgttctggacttgttttgtttcactgaatttttatgttatgttcaaagattatatcagggaaaggatttggtgatctgtttatgctgaatcagttatttgctttctttattctgttatgcgcatatgcctgttcctatttatcactgcatcctagatgttgatgaaaatgactttttaacgggagatgattacttgagaaaacaatgttgattttgaatatgttatgcatggaatttgaaaagcaatgataaatactttg

SEQ ID NO: 11481 - DNA, 565 bp, Ocimum basilicum
taacgagcggtcgggtaggttaatctgcgaagccgaaatgcagatcttcgtcaaaaccttaactgggaaaaccatcaccctcgaggttgaatccagcgatacaattgacaatgtcaaagccaagattcaagataaggaaggaatccctccggaccaacagcgtctgattttcgccggaaagcagctagaagatggtcgaacacttgcggattataacattcagaaagaatcgaccctgcatttggttctgaggcttaggggtggaattatcgagccttctctcatggctttggctaggaaatataaccaggataagatgatttgccgcaaatgctatgctcgtttgcaccctcgtgctgtcaactgcaggaagaagaaatgtggacacagcaaccagttgaggccaaagaagaagatcaagtagattagcaggtggatcaatttctttgttcggttttgttggatgtatgtctttgaactcataatgcagcttttgctgataaatttaagaatcttgatgatgtagctttggttcatttgacccaaacttcagttattggttgac

SEQ ID NO: 11482 - DNA, 670 bp, Phaseolus vulgaris
aagatagtgaaacagcagcagaagagcagggtagcagcaaaaatgcagattttcgtgaaaaccctaacggggaagaccataaccctcgaggttgagagcagtgacaccatcgacaatgtcaaggcaaagattcaagacaaggaaggtattccaccggatcagcagcgtttgattttcgctgggaagcagctggaagatggaaggaccttggccgattacaacattcagaaggaatccacccttcaccttgtcctcaggcttcgcggtggcatcattgagccttcgcttatggctttggcgcgcaagtacaaccaagacaagatgatttgccgcaaatgttatgctcgtcttcacccaagggctgtgaactgccgcaagaagaagtgtggccatagtaatcagttgaggccaaagaagaagatcaagtaaatcttggttgaggttgttggtctcttgttcgttttggatttgggacagggactggtttgttgatttatatacttatccttaattgtttttgcttattgttaattttaaatgttttgatggatatttttgtagtggccagttatattgctatgatgatgacattaaattagctccgtttccattttacattgtttttctagttctttttacattaaatgtttgcatgatcaaccaaactgaa

SEQ ID NO: 11483 - DNA, 702 bp, Fagus grandifolia
ctggaccttggctgtcactcagttgacagcaaaacacagagggagagagcgagagagagagcaaaaaaatgcagatcttcgtgaaaaccctaactggcaagaccatcacactcgaggtcgagtccagcgacaccatcgacaatgtcaaggccaagatccaggacaaagaaggtattccaccggaccagcagaggctgatcttcgctgggaagcagcttgaggatggccgtactctcgccgattacaacatccagaaagagtcaactcttcatcttgttctgaggcttcgtggtggcattatcgagccatctctgatggcattggccaggaaatacaaccaagataaaatgatctgccgcaagtgttatgcacgcttgcacccacgtgctgtcaactgcaggaagaagaaatgtggacacagcaaccagctgaggccaaagaagaagatcaaatagagcgctgattgtgaggaacaagtgctatccattgttgtaggtcatttgatgtcctttctgaaccatggtagtagctttgaagagtttgctagtagactagaaatcagacatgtagcactgaactttacaccttttgagatgttgcattgttactttgttctaatatgctttgaaccttgtttgggtgttggatattccttgatgttgagctcttcatttttgatactttgaaatcaaagttgttaat

SEQ ID NO: 11484 - DNA, 796 bp, Vaccinium corymbosum
aacggggacaggcccatcttagaaaacccacagagcccatatttaggctaaaccctaattttgaactgtataaaaatcgataggttgggaaagcaggcgccgcccgcgaggagagacagagagtgaaaatgcagattttcgtgaaaactctaactgggaagacgatcacactcgaggtcgagtcaagtgacacaatcgacaatgtcaaagctaagattcaggacaaggaaggtattccacctgaccagcagcgattgatctttgctggaaaacagctcgaagatggccgtactcttgccgactacaatatccagaaagagtcaacactgcatctggttctgaggcttcggggtgggattattgagccttcattgatggctttggcacggaagtataaccaggacaagatgatttgccgcaagtgttacgctcgcttgcatccacgtgctgttaactgcaggaagaaaaagtgtggacacagcaaccagttgaggccgaagaagaagatcaagtagatgcgattcatcagccggctagttttagtttgattttcagtacagcagcctcgactgctgcttggttacagtttgaagctttgaaacccactgcttgtagtggctgtaatggaccacctgcttgtttttcgtttcgttaagatgttactgttcactgaatttttcgtaatttgctaatttgatactagtagtatttttgtggcggctcaatgataagaaatactggtaatgtatacgaaggtgtcattttcaagtgtgaattgaaaatacaaattgagtgt

SEQ ID NO: 11485 - DNA, 626 bp, Vaccinium corymbosum
cagggcgaaaatgcagatcttcgtgaaaaccctgactgggaagacgatcaccctcgaggtggaatcgagtgacacaattgacaatgtcaaggctaaaattcaagacaaagaaggtatcccaccggaccagcagcggctgatttttgccggaaaacagcttgaagatggccgcaccctcgccgactacaacattcagaaagagtcgactctgcatctggttctgaggcttcgaggtggcattattgagccgtcattgatggccctggctcgaaagtacaaccaggataagatgatttgccgcaagtgttatgctcgcctgcatccgcgtgctgttaattgcaggaagaaaaagtgtggccacagtaaccagttgaggccgaagaagaagatcaagtagatgtaccatttagctgtgacggtccagtcgtccagagtgcctgtatggattttggatatcatgtctggttgttagaggctatggacccttcattatttttggtttcttaagacgtttgttttaacttggaggaccataaagaattgctgttttgttacttgttatgcaattatcgtatttcagtttggttcttgatttactaataaaacagtttcagccaatgaaactg

SEQ ID NO: 11486 - DNA, 699 bp, Vaccinium corymbosum
ttgctccttctgctagctaaccttcaccaaacaggagagagagagagagatagagagagagggagaaaatgcagatcttcgtgaaaaccctgactgggaagacgatcaccctcgaggtggaatcgagtgacacaattgacaatgtcaaggctaaaattcaagacaaagaaggtatcccaccggaccagcagcggctgatttttgccggaaaacagcttgaagatggccgcaccctcgccgactacaacattcagaaagagtcgactctgcatctggttctgaggcttcgaggtggcattattgagccgtcattgatggccttggctcgaaagtacaaccaggataagatgatttgccgcaagtgttatgctcgcctgcatccgcgtgctgttaattgcaggaagaaaaagtgtggccacagtaaccagttgaggccgaagaagaagatcaagtagaattaatttggagcttgcaccatttagctgtgacggtcaagagtgcctgtatggattttggatatcatgtctggttgttgaggctatggacccttcattatttttggtttgttaagacgtttgttttaacttggagaaccataacgaattgctgatttgttacttgttatgcaattatcgtatttcagtttggttcttgatttactaataaaacagtttcagccaatgaaactgaacgtttcaa

SEQ ID NO: 11487 - DNA, 577 bp, Theobroma cacao
gagagagagagagagagagagacagaagcaggagcagggttaggaaaatgcagatcttcgtgaaaaccctaacggggaagaccataaccctagaggtcgaatccagtgacactatcgacaacgttaaggctaagatccaggacaaggaaggtatcccaccggaccagcagagattgatcttcgccggaaagcagcttgaggatggccgtactcttgccgactacaacattcagaaagagtcaaccttgcatctggttctgaggcttcgtggtggcattattgagccttctttgatggcattggctaggaagtacaaccaggacaagatgatctgccgcaagtgttatgctcgtctgcacccccgtgctgtgaactgcaggaaaaagaagtgtggacatagcaatcagttgaggccaaagaagaagatcaagtagattgcaaaatttgagggaggaattctacatttagtattattagatttctggatgttatttttggacaatatagttctaaataacagacatcttgactatcccaaagatagctttaatttcattaagttgaacctcttttggtg

SEQ ID NO: 11488 - DNA, 539 bp, Theobroma cacao
acagagccaggaaacgatgcagatattcgtgaaaaccctcaccggcaagaccataactctcgaggtcgagagcagcgacactattgataatgtcaaagccaagatccaagacaaagaaggaataccaccggaccaacagcgtctcatcttcgccggaaaacagctcgaagatggccggaccttggctgactacaacatccagaaagaatcaacgcttcatctagtattgaggttgagaggtggaatcattgagccttctttgatggctttggctcgcaaatacaaccaagacaaaatgatttgccgcaagtgttatgctcgcttgcatcccagagctgtgaactgtcgaaagaagaagtgcggtcatagcaatcagttgaggcccaagaagaagatcaagtaaactacgagtggggttataatacctgctttaaaagaatttgaatatcagacttggaaaatttttccatttagttctttgctgatctgttttgttgacatgtgatatctggatttgcaattgatgaagattttgagtt

SEQ ID NO: 11489 - DNA, 612 bp, Brassica napus
aggaccgtcaatacttaggttttccgttaaattagtacatcggacgttaactaaatacatcggcagcaatcaaggtgtggtcgccgtcagagagggaggagctttcttgatacttgcggcggagaagaagaaaaagatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggtaaacagcttgaagacggtcgtaccttggctgactacaacatccagaaagagtcgactctgcatcttgtcctgaggcttaggggaggtatcatcgagccgtctttgatggctttggctcgtaagtacaatcaagacaagatgatctgccgcaagtgttacgctcgtctgcacccaagggctgtcaactgcaggaagaagaagtgtggccacagcaaccagttgaggccgaagaagaagatcaagtgatctgttttgtttgttcacaacaagcttatttatctgtgtttttttttccttgaaagacatctcgctagtgttttgacacaaactcgttt

SEQ ID NO: 11490 - DNA, 658 bp, Brassica napus
ggaaggaaggaaagaagagacgaacagaaagatgcagatcttcgtgaaaaccctaaccggcaagacaatcaccctcgaggtcgagtcctccgacaccatcgacaatgtcaaggccaagatccaagacaaagaaggaatccctccggatcagcagaggttgatcttcgccggaaagcagctcgaagatggccgtactttggctgactacaacatccagaaagagtcaacgcttcatcttgtgttgaggcttaggggaggtatcatcgagccttctttgatggccttggcgcgtaagtacaaccaggacaagatgatttgccgcaagtgctatgctcgtcttcacccaagggctgtgaactgcaggaagaagaagtgtggccatagcaaccagttgaggcctaagaagaagatcaagtagactcgtatcaagaacctgttcttgcttctttttttttgttgtttcgtcttgcccttgataaggttgtttttgcttcagtaaaatttgatgttcaaagattatatcagtaaaaggatttggttttctaatcatgcttactcagttatttgttcttattattcgattctacatatgcttcttccgttttatttgtgcatgcatcctagacgatgagatattgactgttaacgaaatcttatt

SEQ ID NO: 11491 - DNA, 776 bp, Brassica napus
acttggtacgcacgcaggtaccggttcgcgattcccgggtcgacccacgcgtccgcggacgcgtggagaagaagatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggaaaacagcttgaagacggtcgtaccttggccgactacaacatccagaaagagtcgactctgcatcttgtcctgaggcttaggggaggtatcatcgagccgtctctgatggctttggctcgtaagtacaatcaagacaaaatgatctgccgcaagtgttacgctcgtcttcatccaagggctgtcaactgcaggaagaagaagtgcggccacagcaaccagttgaggcccaagaagaagatcaagtgatctgttttgtttatgcacaacagacttatttatctatgtgttttttttccttgaaagacatctctagtgttttgacacaaactcgtttcagtgaattttaatcctaaaagattttcgttagtaaaaaaaaaaaaaaaaaaaaaaaactcgagccgacgcgaaaatggtgaagggacgccaaggagaacgtgtcagactctacgttaggggaaccatcttgggatacaaaaggtccaagtctaaccagtacccaaacacatcccttatccagattgaaggagtcaacacgacggaggaggtgacatggtacaaggg

SEQ ID NO: 11492 - DNA, 607 bp, Brassica napus
ctgggaattgaatcgcgtttgcttatgttgtaaggacaggagagaagaagatatgcagatattcgtgaagacgctgacgggcaagaccatcaccctcgaggtggagagcagtgacaccatcgacaatgtcaaggccaagatccaggacaaagaagggatccctccggatcagcagaggttgatcttcgctggaaaacagcttgaagacggccgcaccttggctgactacaacatccagaaagagtcgactctgcatcttgtcctgaggcttaggggaggtatcatcgagccgtctttaatggctttggctcgcaagtataatcaagacaagatgatctgccgcaagtgttacgctcgtctgcacccaagggctgtcaactgcaggaagaagaagtgtggccacagcaaccagttgaggccgaagaagaagatcaagtgatctgttttgttttatcacaacaaacttatttatctgtgtgtgtttttttctttcaaagacatctcaagtgttttgacacaaactcgtttcagtggattttaatcctacaagattttcgttagtcaaacacaccatcccataccattccttccatcctcaataccaaag

SEQ ID NO: 11493 - DNA, 627 bp, Brassica napus
agaagaagaagatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggaaaacagcttgaagacggtcgtaccttggccgactacaacatccagaaagagtcgactctgcatcttgtcctgaggcttaggggaggtatcatcgagccgtctctgatggctttggctcgtaagtacaatcaagacaaaatgatctgccgcaagtgttacgctcgtcttcatccaagggctgtcaactgcaggaagaagaagtgcggccacagcaaccagttgaggcccaagaagaagatcaagtgatctgttttgtttatgcacaacagacttatttatctatgtgttttttttccttgtaaagacatctctagtgttttgacacaaactcgtttcagtgaattttaatcctaaaagattttcgttagtaaatctgaattgtctttggtcttttttttctttactaattcctaacttttttatcctaattctttatttaatttgtacttaatagttgatgtagaactatattacc

SEQ ID NO: 11494 - DNA, 734 bp, Brassica napus
ggttgaaagaagtctcggccactatcctcgccaacatagtcaacattggatacgactttgacaaagccacacttgtgtcagagaacacaagaagccacacaaagatgcagatcttcgtgaaaaccctgaccgggaagaccatcaccctcgaggtcgagtcctccgacaccatcgacaatgtcaaggccaagatccaagacaaagaaggtatccctccggatcagcagcgattgatcttcgctggaaaacagctcgaagatggccgtactctggctgactacaacatccagaaagaatccacccttcatcttgtgttgaggcttaggggaggaatcatcgagccttctttgatggcgttggctcgcaagtacaaccaagacaagatgatctgccgcaagtgctatgcacgtcttcacccgagggctgtgaactgcaggaagaagaagtgtggccatagcaaccagttgaggcccaagaagaagatcaagtagactctgttcaaggaactatctgctggcttgcttgactcttttttttctttgccttcccgagttgttttgtttcactgaatttttatgttatcttcaaagattatatcagtaaaaggatttgttgatctgcttatgctgaattaattatttgctttctttatcctgttatgcatatggctgttcttatttattagttattactgcctgaatcctagatgttgatgaaaatgacttcttaacgat

SEQ ID NO: 11495 - DNA, 594 bp, Brassica napus
gagacttgccgcggcggagaagatgcagattttcgtgaaaacgctgacgggcaagaccatcaccctcgaggtggagagcagcgacaccatcgacaatgtcaaggccaagatccaggacaaagaaggaatccctccggatcagcagaggttgatattcgccggaaaacagcttgaagatggtcgtaccttggctgactacaacatccagaaagaatcgactctgcatcttgttctgaggctaaggggaggtatcattgagccctctttgatggctttggctcgcaagtataatcaagacaagatgatctgccgcaagtgttacgctcgtctgcacccaagagctgtcaactgcaggaagaagaagtgtggccacagcaaccagctgaggccgaagaagaagatcaagtgattttttttttcaccggaggctcatttatctatgttattttttgtgtgtttcatctcttttgttttgtcacaaacacgtttctgtggatttttcactagtaattctgattttctttggcttttatataaaattcgaaactgtgacacaaacttgtttatgtgtatttcaatcctaggcatgcctta

SEQ ID NO: 11496 - DNA, 581 bp, Brassica napus
gcggcggagaagatgcagatattcgtgaaaacgctaacgggcaagaccatcaccctcgaggtggagagcagcgacaccatcgacaatgtcaaggccaagatccaggacaaagaaggaatccctccggatcagcagaggttgatattcgccggaaagcagcttgaagatggtcgtaccctggctgactacaacatccagaaagagtcgactctgcatcttgtcctgaggctgaggggaggtatcattgagccgtctttgatggctttggctcgtaagtacaatcaagacaagatgatctgccgcaagtgttacgctcgtctgcacccaagggctgtgaactgcaggaagaagaagtgtggtcacagcaaccagttgaggcccaagaagaagatcaagtgatttgtttttttcaccggaggctcgtttatctgtgttatgttttatgtgtttcatctcttttgttttgacacaaacacgtttctgtggatttttcactagtgattctgattctctttggcttttatataatattcgaaactgtgatgtattttaatcctagaggaaacaaaggcatgccttaa

SEQ ID NO: 11497 - DNA, 708 bp, Brassica napus
ttattagggggggggacgcggccagaacacaagaagaagccaacaaagatgcagatcttcgtgaaaaccctgaccgggaagaccatcaccctcgaggtcgagtcctccgacaccatcgacaatgtcaaggccaagatccaagacaaagaaggtattcctccggatcagcagcgattgatcttcgctggaaaacagctcgaagatggccgtactttggctgactacaacatccagaaagagtccacgcttcatcttgtgttgaggcttagaggaggtatcatcgagccttctttgatggcgttggctcgcaagtacaaccaagacaagatgatctgccgcaagtgctatgcacgtcttcacccgagggctgtgaactgcaggaagaagaagtgtggccatagcaaccagttgaggcccaagaagaagatcaagtagactctgttcaagaaactatcttgctcgcttgcttcttgcctctctttttttctttgccttctcgagttgttttgtttcagtgaatttttatgttattttcaaagattatatcagagaaaggatttggtgatctgtttatgctgaatcagttatttgctttctttattctgttatgcgcatcctagatgttgatgaagatgactttttaacgggagatgattacttgagaaaacaacaatgttgattttgaatatattatgcatggaatttgaa

SEQ ID NO: 11498 - DNA, 515 bp, Brassica napus
gaagaagaagatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggcaaacagcttgaagatggtcgcaccttggctgactacaacatccagaaagagtcgactctgcatcttgtcctgaggcttaggggaggtatcatcgagccgtctctgatggctttggctcgtaagtacaatcaagacaaaatgatctgccgcaagtgttacgctcgtcttcatccaagggctgtcaactgcaggaagaagaagtgcggccacagcaaccagttgaggcccaagaagaagatcaagtgatctgttttgtttatgcacaacagacttatttatctatgtgttttttttccttgaaagacatctctagtgttttgacacaaactcgtttcagtgaattttaatcctaaaagattttcgt

SEQ ID NO: 11499 - DNA, 590 bp, Brassica napus
gaggctcttgcggcggagaagatgcagattttcgtgaaaacgctaacgggcaagactatcaccctcgaggtggagagcagcgacaccatcgacaatgtcaaggccaagatccaggacaaagaaggaatccctccggatcagcagaggttgatattcgctggaaaacagcttgaagatggtcgtaccttggctgactacaacatccagaaagagtcgactctgcatcttgttctgaggctaaggggaggtatcattgagccctctttgatggctttggctcgtaagtacaatcaagacaagatgatttgccgcaagtgttacgctcgtctgcacccaagggctgtcaactgcaggaagaagaagtgtggccacagcaaccagttgaggcccaagaagaagatcaagtgatctgtttttttcaccggaggctcatttatctatgttatgttttatgtgtttcatctcttttgttttgacacaaacacgtttctgtggatttttcactagtaattctgattttctttggcatttatataaaattcgaaactgtgtcacaaacttgttttagtggattttaatcctagtggatc

SEQ ID NO: 11500 - DNA, 541 bp, Brassica napus
cgggtctcttcttcttgtatgcttttctgatacttgcggcggagaagaagaagaagatgcagatattcgtgaagacgctgacgggcaagaccatcaccctcgaggtggagagcagtgacaccatcgacaatgtcaaggccaagatccaggacaaagaaggtatccctccggatcagcagaggttgatcttcgccggaaaacagcttgaagatggtcgcaccttggccgactacaacatccagaaagagtcgactctgcatcttgtcctgaggcttaggggaggtatcatcgagccgtctttgatggctttggctcgcaagtacaatcaagacaagatgatctgccgcaagtgttacgctcgtctgcacccaagggctgtcaactgcaggaagaagaagtgtggccacagcaaccagttgaggccgaagaagaagatcaagtgatctgttttgtttgttcacaacaagcttatttatctgtgtgtgttgtttttccttgaaagacatctctttagtgttttgacacaaactcgtttcattgg

SEQ ID NO: 11501 - DNA, 440 bp, Brassica napus
gagaagaagaaaaagatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggtaaacagcttgaagacggtcgtaccttggctgactacaacatccagaaagagtcgactctgcatcttgtcctgaggcttaggggaggtatcatcgagccgtctttgatggctttggctcgtaagtacaatcaagacaagatgatctgccgcaagtgttacgctcgtctgcacccaagggctgtcaactgcaggaagaagaagtgtgggcacagcaaccagttgaggccgaagaagaagatcaagtgatctgttttgtttgttcacaacaagcttatttatcttgt

SEQ ID NO: 11502 - DNA, 636 bp, Manihot esculenta
atctttgctattgagagggagacgccggagaggaaagatgcagatttttgtcaaaaccctgactgggaagaccataactctcgaggtagagagcagcgataccatcgataatgtcaaggccaaaattcaggacaaggaaggaatcccaccggaccagcagcgtttgatctttgctgggaagcagcttgaagatggtcgaaccttagctgattacaatattcagaaagaatcaaccctacatcttgtgctgaggcttaggggaggaattatagagccttctcttatggcattggctcgcaaatacaatcaagacaagatgatctgccgcaagtgttacgctcgtctccatccaagggctgttaactgccggaagaagaaatgtggccacagcaatcagttgaggcccaagaagaagatcaagtaaactctgatgcagaggtgtgcttttatggcgttcaaagattaaaatgttagatttgcaatattttcttgcatttcagttttggctttaacaggcacactattttaagattttttatcgaattaaatgaagcagatactttatttttgaagttgtgattcgacattgtgttgtgtagcaaccacccactagtcgagcatgattcctttggatgg

SEQ ID NO: 11503 - DNA, 653 bp, Manihot esculenta
atgcagattttcgtgaaaaccctaaccgggaaaaccatcactctcgaggtagagagcagcgatacaatcgacaatgtcaaggctaagatccaagacaaggaaggaatcccaccagaccagcagcgattgatcttcgctggaaagcagcttgaagatggccgaactttggccgattacaacatccagaaagaatcaaccctccatcttgttttgaggcttaggggaggaattatagagccttctcttatggctttggctcgcaagtacaatcaagacaagatgatctgccgcaagtgttatgctcgtctgcatccaagggcggtaaactgccggaaaaagaaatgtggtcacagcaatcagttgaggcctaagaagaagatcaagtaaattaagatgcagagtgcatttcgggtcttcaaacattcaagtgttagatttgttattttagctcatggttgctttaaatgtcagtttttggttctagcaaacactgtaagaagttttatccagacctgttaaatttaggacttgcattgtttttgaaatgttgttgactttatttcagttgaacttgctacatttcagagcgaataccttctagcacttctttaattctcgatattctctagtgatccttttgagtttttccttct

SEQ ID NO: 11504 - DNA, 639 bp, Manihot esculenta
gcctttctctgctattgcgagtgagggagagagagtcggaggagggcaaagatgcagatattcgtgaaaaccctgaccggaaagaccattactctcgaggttgagagcagcgataccatcgacaatgtcaaggccaagatccaggacaaggaaggaatcccaccggaccagcagagattgatcttcgctggaaagcagcttgaagatggccgaactttggctgattacaatatccagaaagaatcaaccctccatcttgtgctgaggcttaggggaggaattatagagccttctcttatggctttggctcgcaagtacaatcaagacaaaatgatttgccgcaagtgttatgctcgtctgcatccaagggctgtaaactgccggaagaagaaatgcggtcatagcaatcagttgaggcctaagaagaagatcaagtaaacgccggtgaagattagtgctttttgggtgtttgaggatgtgagtgttaagtttgttattttacccgtgggttggcttaaacatgatgattctggatttagctagctactatgtgaccatcttttatcaatgctgttaaattggagcaaatatatatattttttaattgtgatgtgaaattttgtttcagtggaaaccacc

SEQ ID NO: 11505 - DNA, 387 bp, Manihot esculenta
atgcagatattcgtgaaaaccctaaccggaaagaccataactctcgaagtagagagcagcgatacaatcgacaatgtcaaggccaagatccaagacaaggaaggaatcccaccggaccagcagcggttgatcttcgctgggaagcagcttgaagatggccgaacattggctgattacaatatccagaaagaatcaacccttcatcttgttctgaggcttaggggaggaattatagagccttctctcatggctttggctcgtaagtacaatcaagacaagatgatctgccgcaagtgttatgctcgtctgcatccaagggctgtaaattgcaggaagaaaaaatgtggtcacagcaaccagttgaggcctaaaaagaagatcaagtag

SEQ ID NO: 11506 - DNA, 572 bp, Ricinus communis
gagagagaaagagaaggggagcaaagatgcagatattcgtgaaaaccctaaccggaaagaccataactctagaagtagagagcagcgacaccattgacaatgtcaaggccaagattcaagacaaggaaggaattccacctgaccagcagcgattgattttcgctggaaagcagcttgaagatggaagaaccttagctgattacaatatccagaaagagtcgacccttcatcttgtgttgagacttaggggagggattattgagccttctcttatggccttggctcgcaaatacaatcaggacaagatgatttgccgcaagtgttatgctcgtctgcacccaagggctgtaaactgtcggaagaagaaatgtggtcacagcaatcagttgaggcctaagaagaagatcaagtagacccgtatggagagtgcatgttggccagttaaagttttcagtattagattttggaccttattggacttttttgctatttcgaacatgtgaaatcttgatttggcaaggccattttgcaatcagattttatagaatgctattgaatggagcaagttttat

SEQ ID NO: 11507 - DNA, 448 bp, Ricinus communis
tcgaggaagcaaacggagcgagcaagatgcagatattcgtgaaaaccctaactgggaagacaataactctcgaggtagagagcagtgataccatcgacaatgtcaaggccaagatccaggacaaagaaggcattccacctgaccagcagcgcttgatcttcgctggaaagcaacttgaagatggtagaactttggctgattacaatatccagaaagaatctactctccatttggtgctaaggcttagaggagggattatagagccatctcttatggctttggctcgcaaatacaaccaagacaagatgatttgccgcaagtgttatgctcgtctgcatccaagggctgttaactgcaggaagaagaaatgtggccacagcaaccagttgaggcccaagaagaagatcaagtagactctgatggagagtgcttgctgggcatttgaaga

SEQ ID NO: 11508 - DNA, 766 bp, Catharanthus roseus
gatccaaagaattcggcacgaggggaaaaagacgcagtcgttggtcgagagagaagaagaagcagaaagatgcagatattcgtcaaaaccctaaccggcaagaccatcacgctcgaggttgaatcgagcgacaccatcgacaatgtcaaggccaaaatccaggacaaggaaggaatcccaccggaccagcagaggctaattttcgccggaaaacagttggaggatggccgaactcttgctgactataacatccagaaagaatcaactttgcatcttgttctgaggcttcgtggtggaatcatcgaaccttctttgatggctttggctaggaaatacaatcaggacaagatgatctgtcgcaagtgctatgctcgtcttcaccctcgtgctgttaactgcaggaaaaagaagtgtggacacagcaaccagttgaggccaaagaagaagatcaagtagactagtatctttaatatctgtggaacttttagtggaaggttttcagagacaatattcttgaatggtttatgtgagattttggttttacatttgtttcggaactcttcttattcctgctttgtcaacttatgggaaccaaaggtgtttggtgaagttatatccaaatgattattattgatagttatctttttttttcttttttttgtctgtttttcaagattattgttctgtagttgtggatgttcttgttgttttccagtccttggactcaatatgggttttctatcatgcataattattttttataccc

SEQ ID NO: 11509 - DNA, 634 bp, Cedrus atlantica
aattgttggcagcgaccaagatgcagatctttgtaaagaccctgacgggcaaaaccataactttggaagttgaaagcagcgacacgatcgacaatgtcaaggccaaaatccaggacaaggaagggatcccgcccgaccagcaacgtctgatctttgcgggcaagcagctggaagatggccgcactctggcggattacaatatccagaaagagtctaccttgcaccttgtgctcaggctccgtgggggtattatagaaccttctttgatggcactggccaggaagtacaaccaagacaagatgatttgcaggaaatgctatgcccgtttgcaccctagagcagtcaactgcaggaaaaagaagtgtgggcatagtaaccagctgcgaccaaaaaagaaaatcaagtaaattttatgctgcattggggttttatctctctaaatacgttcatgttgtattgttccccatcattttaggctgctatgccatgtcagaagcatcacttttaaaccgtgctttgcttttaagcaaaagcttcatgtgttttgatatcaaatatacattaaattgaatttgaaatctctcataaggattttgatttgcagtgcattattgctcggtgttagggttatgtc

SEQ ID NO: 11510 - DNA, 856 bp, Cephalotaxus harringtonia
ggctagcgaaaaaaccctaaaaacggaatgcaaaaccctctcgtgaaaccctaaaagcagaccgttaaattaccaaagcatagtttcagtattttgattcagcagttttgtgggaaggaggattcgttacaggctacaagatgcagatcttcgtgaagaccctgacgggcaagaccattactctagaagttgaaagcagcgataccatcgacaatgtcaaggcaaaaatccaggataaagaagggattccaccggaccaacagcgactgatatttgctggaaagcagttggaagatggccgcactcttgctgattacaatattcagaaagaatccacattgcaccttgtgctgaggctccgtggtggaattatcgagccctcgttgatggcattggctaggaaatataaccaggacaagatgatctgcagaaagtgctatgctcggctgcacccaagagctgttaactgcaggaaaaagaagtgtgggcacagtaaccagctacgacccaagaagaaaattaagtaaatctgaatttggagttaagtaaatctgaatttggagtgaaagttcgtgaagactaatcctatttatcttaggcttgaaaggcatgtcaaaagcgctccaaaactgtatttcttacaaggaaacttgcgttatttaccttaaatctgtgttgacgtaaattgagctttctatgcacaaaatttgttatttgaagttaaatggctttcttaccgtagagggatttcatgtattggcaaaataatctcagtatggatagtaatagacaatacagtttcttgagattctactcgacaatatgaatgccatttaccattgttggaaactggaag

SEQ ID NO: 11511 - DNA, 701 bp, Cephalotaxus harringtonia
cctagttcgaaatcctaaaaatgaaaccctagaaacggattataaaacatctgagcacaattttattgaaaacttttggggtaaagaattctgggagggagaataagatgcagatcttcgtgaagaccctgacgggcaagaccataactctagaagttgaaagcagtgataccatcgacaatgtcaaggcaaaaatccaggacaaagaagggatcccacctgaccaacagcgattgatatttgccggaaagcagttggaagatggccgcactctggctgattacaatattcagaaagaatccacattgcaccttgtgctgaggctccgcggtggaatcattgagccttcattgatggcattggccagaaagtataaccaggacaagatgatttgcagaaagtgctatgctcggcttcacccaagagcagttaactgcagaaaaaagaagtgtgggcatagtaaccagctgcgaccaaagaagaaaatcaagtaaatctgatgtttggagcaagattttgcatttccgagattaattccatttgttttaaattattttgatctcaaaagtaatactcaaaaacaaattattttgatctcaaaagtaatactcaaaaactatgtcgtttatatttgaacatcccttttggtcttaaattggtggacatgaattggggttaagcaaaacttgtctttatctttt

SEQ ID NO: 11512 - DNA, 899 bp, Chelidonium majus
aatattcctagcagatgcgatacgattttcgtctctaggttttattgtacactagtagctcgattcttttataacataaaataaaccagtttagattaactaaacatggattaatcatatcataaagatagagagcattattagctagctacttgatcagcaacgatcaaagtagcagaaacacatatgctttccacctcgtacgtgacaagctccatgcagagctttctcccagttgatgcattgacgatcgcagttttgagtattcccacagttgcctgaccatgtctggctagccttctcacataggtcagctaaataggcattccccgtctctaccttctccgcattcccagtttctaccttcttcgcattccccgaggtagagatgaggagaaagatgcagatctttgtgaaaaccctaacggggaagacaataaccctagaggttgagagcagtgacaccatcgacaatgttaaggcaaagatccaagacaaggaaggaattcctcctgatcagcagagattgatctttgctggaaagcagcttgaagatggccgaaccctagctgattacaacattcagaaggagtctactctgcatcttgttttgaggcttcgtggaggaattatcgagccttcattgatggctttggctaggaaatataatcaagataagatgatttgcaggaagtgctatgctcgtctgcatccaagagccgtgaactgcaggaagaagaagtgtggccacagcaatcagttgaggcctaagaagaagatcaagtgagctctagtcctgtcctatttgtttcagttggtagaactaaaggttgagagagactcaattttgcactttcagttggttctgtttagaacggttttcatgattctgttatttg

SEQ ID NO: 11513 - DNA, 634 bp, Chelidonium majus
gcagcagcagcagtcgaagtggaaaaaatgcagatctttgtgaaaacccttacagggaagacaatcaccctcgaggttgaatcgagtgataccatcgacaatgtcaaagccaagatccaggacaaggaagggattcctccagaccagcaacgtttgatcttcgccgggaaacagctcgaggatggccgcactctcgctgactacaatattcaaaaagaatcgactcttcatcttgttttgaggcttcgcggtgggattatcgagccatctttgatggcgttggccaggaagtataaccaggacaagatgatctgtcgcaaatgttacgcacgcctgcatcctcgtgccgtgaattgcaggaagaagaaatgtggacacagcaaccagttgaggccaaagaagaagatcaagtagacgttatcatcaacatttagtaggtgtagtgataatttttgtttgggtgatagtctgatactcggttcaaggatttgcactgtcatcatttgtttgatcactgtggtctattttgtttttggtaatacttgacaatggttagatgctttataattctgcttaaagagattttcgtatcttggttattgtgatctctttgcatatttaccacaacctttat

SEQ ID NO: 11514 - DNA, 520 bp, Castanea mollissima
gtagagaggcagagagagaaagatgcagatattcgtgaaaaccctaacagggaaaaccataactctcgaggtcgagagcagcgacacaatcgacaatgtcaaagctaaaatccaagacaaagaagggattccaccggatcagcagcgtttaatctttgctggaaagcagcttgaagatggccgaaccttagctgactataacattcagaaagagtcgacattgcatcttgtgctgagacttcgtggtgggatcatagagccttctttgatggctttggctcgcaaatacaatcaggacaagatgatttgccgcaaatgttatgcacgtctgcacccaagggctgtaaactgccggaaaaagaagtgtggccatagcaatcagttgaggccaaagaagaagattaagtagactctggaccattattgcgtttaatgcctcagattgtaattgaaattttgatattagaaccaagatatccatatgtggtttatatcattaatttcaattacaatctgaggc

SEQ ID NO: 11515 - DNA, 765 bp, Citrus clementina
aatctcgtaaccaaacaagagcaatacagcccactaaaaaccctaatcatgaacagagtccttcatatataaacaaatcccaaaatcggctagttgcaaacgagctagagagagagagagaaagcgagaggaaaaggagaaaagggggaaaaaaatgcagatcttcgtgaaaaccctaacggggaagaccattaccctcgaggtcgaatccagcgacaccatcgacaatgtcaaggccaagatccaagacaaggagggtattccgccggaccagcagagacttatcttcgctgggaagcaacttgaggatggccgtactctagccgattacaatatccaaaaggagtcaactctgcatctggttctgaggcttcgtggtggtattattgagccttctttgatggcattggcaaggaagtataaccaggacaagatgatctgccgaaaatgttatgcacgcctgcacccccgtgctgtgaactgcaggaagaagaaatgtgggcacagcaaccagctgaggccaaagaagaagatcaagtagatattctgcagagaaatgctacattttatactgaaacaggatgttttgcctagaatatgtagcatcaactattgcctagtaatagttgtcacttagtacgtgatttctgtttcaagatgtttccagggttgagagtatttgtagactgattactatcgcctctatgtgccgtgacattgagcactttattataacttgcctgaatctactattttcttacactg

SEQ ID NO: 11516 - DNA, 965 bp, Citrus clementina
tttatttttctcccttctctcaaagggcataaacagaacgtgttctagcctattggcaaaactgatttcatcccaagaaacttgcttcgggcctgtgtgttgggcccaatttaaggactcactacgacatcgtttagcaaagaaaaccctaaccaagttctataaaaccctaatgacttgccagtcagctgccgtccttggaaaatcatcagagcgtgaagatgcagatcttcgtgaaaaccctaaccggaaagaccataactctcgaagtcgagagcagcgacaccatcgacaatgtcaaagctaagattcaagacaaggaaggaattcccccggatcagcagcgtctcatcttcgccggaaagcagctcgaagatggccgtaccttggctgattacaatattcagaaagaatccactcttcatttggtgctgaggcttaggggaggtatcattgagccttcattgatggctttggctcgcaaatacaatcaggataagatgatttgccgcaaatgttatgctcgtctgcatcccagggctgtaaattgccggaagaagaaatgtggccacagcaatcagttgaggcctaagaagaagatcaagtagaccacttgccttagtcatgatatgtgccttcagagagacattccaattatgagatgtattttgtttgttttttaataggatttgggatttgaattaagcgatcatctaagttggattgtagttgattcagttcaagtgcaattctgttaaacttttaccgtatgaaattgggatatattttttagctaattttgtttcattgtcggtgtaatttttgggacggatttatatcaaattgggatacataatctgcatgtattacaaaactcaaagatagcatcttgaaatacttacaacggcgttcacattaaatcctcataattaacaaatttaaaatttgggtttgcaactcaagag

SEQ ID NO: 11517 - DNA, 577 bp, Cleome gynandra
gaccgactgccttcttctccagtgaaagaacgagcaatcgaagatgcagatctttgtgaaaacccttaccggaaagaccatcactctcgaggtcgagagcagtgacaccattgacaatgtcaaggccaagatccaagacaaagaaggaatcccaccggaccagcagcgtttgatcttcgccggaaagcagctcgaagatggtcgtaccttggctgattacaatatccagaaagaatctacacttcaccttgttctgaggcttagaggaggtatcattgagccatctttaatggctttggctcgtaaatacaatcaagataagatgatctgccgcaagtgctatgctcgtctccacccgagggccgtgaactgcagaaagaagaaatgtggtcacagcaaccagctgaggcctaagaagaagatcaagtgagctattatcctccaactgctgttttgcagcctctcggatttttgtggtgctttcggttcgaatttattaaccgaattaatttgagactttagtgtaatgtttcgactattctggttaagtgaaacttttcttaaatacatgactggt

SEQ ID NO: 11518 - DNA, 601 bp, Cleome gynandra
ccatctcctcgctgaaccagctgtgagaacaagaaaaatcgaagatgcaaatcttcgtgaaaaccctaactggcaagaccatcactctcgaggttgagagtagcgacaccatcgacaatgtcaaggccaagatccaagacaaggaaggaatccctccggatcagcagcgtttgatctttgccggaaagcagctcgaagatggccgtaccctggccgactacaacatccagaaagaatcgacacttcaccttgttctgaggcttaggggaggtatcatcgagccatctttgatggcattggctcgtaagtacaaccaagacaagatgatctgccgcaagtgctatgctcgtctccaccctagggctgtgaactgcagaaagaagaagtgtggtcacagcaaccagttgaggcctaagaagaagatcaagtgagctataatctttcaactgcgtttttgcatcaatggcacattctcttaccggttttctatcgtacttttcagtttgatctttgttagtggatttgatgtgagactttagtgtaatggtttaattttgatttcatgcaactttttcttaaaagtattgatggtctgatggat

SEQ ID NO: 11519 - DNA, 539 bp, Cleome gynandra
tcgggggtcagtctcctacattttcagacgacaagaaaccaaagatgcagatctttgtgaaaaccctaaccggcaaaaccatcactctcgaggtcgagagcagcgacaccatcgacaatgtcaaagctaagattcaagacaaagaaggaattcctcccgaccaacaacggttgatcttcgccggtaaacaactcgaggacggtcgcaccttggccgactacaacattcagaaagagtcgaccttacatcttgtgctgaggctaagaggaggtataatcgaaccttctctaatggcattggctagaaagtacaaccaagacaagatgatttgtcgcaagtgttatgctcgtctgcatccgagggctgtgaactgtaggaagaagaaatgtggccacagcaaccagttgaggccaaagaagaagatcaagtgagccattttgaagcctgtttatgttttgttttttctttcaatccttaaagtgaagaaccatcctttgttacttattttaaatggatctaatataatcacattcttcctc

SEQ ID NO: 11520 - DNA, 567 bp, Cleome spinosa
acccattttacgttcccagcggacgagaaaccaaagatgcagatcttcgtgaaaaccctcaccggcaaaaccatcactctcgaggtcgagagcagcgacaccatcgacaatgtcaaagctaagatccaagacaaagaaggaatccctccggaccagcaacggttgatcttcgccgggaaacagctcgaggacggtcgtaccttggcagactacaacattcagaaagagtcgacgttgcatctcgtgctgaggcttagaggaggtatcatcgaaccatctttgatggctttggctcgcaaatacaaccaagacaaaatgatttgccgcaagtgttatgcacgtctgcatccgagggctgtgaactgcaggaagaagaaatgtggccacagcaaccagctgaggccgaagaagaagatcaagtgagctatttattatgaagctgatgattgtcttttctcctttatcccttcaagtgaattaccctttgatatgaacctcgattttgagttttataacttttaagtgatcagaacatggttgtttgccatatcaattccaatgatattt

SEQ ID NO: 11521 - DNA, 602 bp, Cleome spinosa
ttttcctttttccttctcgctgaacggccagtggaagaacgcggaatagaagatgcagatcttcgtaaaaaccctaaccggcaagaccatcactctcgaggtcgagagcagcgacaccattgacaacgtcaaggccaagatccaagacaaggaaggaatcccaccggatcagcagcgtttgatcttcgccggaaagcagcttgaagatggtcgtaccttggccgattacaatatccagaaagaatctacgcttcaccttgttctgaggctgagaggaggtatcattgagccatctttgatggcattggctcgtaagtacaaccaagacaagatgatctgccgcaagtgctatgctcgtctccaccctagggcggtaaactgcagaaagaagaaatgcggtcacagcaaccagctgaggcctaagaagaagatcaagtgagctataatcctccactgccccctttttttttgcttcagcgtgtttcttcccgaatttgtaccaagctttcagtttgagtttgtgtttgtcgttttaattggagacattattgtaatgttacaatctttccagagtctggtttaatgcagtttcgcttacatag

SEQ ID NO: 11522 - DNA, 557 bp, Cleome spinosa
gcctatcttccttctcctccgaacgagctgcgaaagcaagagagccgaagatgcagatcttcgtgaaaaccctaaccggcaagacaattactctcgaggtcgagagcagcgacaccattgacaatgtcaaggccaagatccaggacaaggaagggatcccaccggatcaacagcgtttgatcttcgccggaaagcagctcgaagatggtcgtacattagccgactacaatatccagaaagaatctacacttcaccttgttctgaggcttagaggaggtatcattgagccatcattgatggcattggctcgtaagtacaatcaagacaagatgatctgccgcaagtgctatgctcgtctccacccgagggctgtgaactgcagaaagaagaagtgtggtcatagcaaccagctgaggcctaagaaaaagatcaagtgagcgaccgtctttttggggtttctaccttgcttttcagttggatattgttaggccaatctattctgagactttagtgtaatgtttgccattctggattctggtttaatgcaactactttgt

SEQ ID NO: 11523 - DNA, 574 bp, Trifolium pratense
cagatcttcgtgaaaaccctaaccggcaagaccatcacccttgaggtcgagtcaagtgacactatcgataatgtcaaagctaagattcaggacaaagaaggaattcctccggaccagcagaggttgatcttcgccggaaaacagttggaagatggtcgcactcttgctgactataacatccagaaagagtcaacgttgcatcttgttttgaggcttcgtggtggtattattgagccgtctttgatggcattggccaggaaatacaaccaggataagacaatttgccgcaagtgctatgcacgtctacaccctcgtgctgttaactgcaggaaaaagaagtgtggacacagcaaccagttgaggccaaagaagaagatcaagtaaactgttctgattgcaggaagaaaatttttgttgtcatggataatgtgttttgatgattagtttcttagtattatatgaagtctgttgcaacttgaactggcagtttttatctgagtttgttttgggtttgagacatgttgatatcaattatgttactgttatatgtgatgtgatgacatgattttgttac

SEQ ID NO: 11524 - DNA, 718 bp, Coffea canephora
tgacatctcgaaagtaaccctagctataaaaggcgagggagaaagaggggggagagcaaaggaggaagatagcggaggaagacagcagaggaagatgcagatattcgtgaagaccctaacagggaaaaccataactctagaggttgagtcgagtgataccatcgacaatgtgaaggccaaaatccaagacaaggaaggaatcccccccgaccagcagaggttgatctttgctggaaagcagttggaggacggccgcactcttgccgattacaatatccagaaagaatcaacgctgcatctggtgctgaggcttcgtggtggaatcattgaaccgtctttgatggctttggctaggaagtacaatcaggacaagatgatttgccgcaagtgttatgcacggctgcatcctcgtgctgtgaactgtaggaagaagaagtgcgggcacagcaaccagttgaggccaaagaagaagatcaagtagagggatatatatacctatgaatgtccatcaagcatgtttctaggaaggctctcagagctcaagaagtttttgaatgttctgttcaattttttttttttttaaatgttgtgacaattgttgtgaacaccttcattcatacttggagattgttgtgactcaaattatcgcttggtggatgaattttattttaatggtttaaggatttttaccatttcagcctgaaaaaaaaaaaaaaaa

SEQ ID NO: 11525 - DNA, 639 bp, Coffea canephora
gataataagtgtcctggctaggcgaaacggcgttctaaaagtagcgttaaacaaaaaaggggagaggaagaggaggagccgccggcggcagctgagaaaatatgcagatcttcgtcaaaaccctgaccggaaagaccataactctagaggtcgagtcctcggacaccatcgacaatgtcaaggccaaaattcaagacaaggaagggattcctccggaccagcagcggttgatttttgctggaaagcagctggaggatggccgtactcttgctgattacaatatccagaaagagtcgaccctccatttggttctgaggttgcggggagggatcattgagccctctctgatggctctagctagaaaatacaatcaggacaagatgatttgccgcaaatgctatgctcgtttgcatcctcgtgctgttaactgccggaagaagaaatgcgggcacagcaatcagttgagaccaaagaagaagatcaagtagacatgctgcagagttctgagccaacgagttatatttgtctggtgttacatcttttagtgcttgtttggatttacaaaaaattttgcggacagagccagatatggaccattttgtttgcttaaccgtaatcttgaggatttgaatattcaag

SEQ ID NO: 11526 - DNA, 710 bp, Gossypium hirsutum
ggcacgagtcacgtccaacaacaacaaaaaaaaaccctagaaaatgagtataaaatcgtctgaatgttttagccgctcattgtccttgtgaaggaagagagagagagggaggaaaagatgcagatattcgtgaaaacgctaaccggcaagaccataactctcgaggtcgagagcagcgataccattgacaacgtcaaagccaagatccaagacaaagaaggaatcccaccggaccaacaacgtctcatcttcgccggaaaacagctcgaagatggccgtaccttggctgactacaacatccagaaagaatcaacacttcatcttgttctgaggttgagaggtggaattattgagccttctttgatggctttggctcgcaaatacaaccaagacaagatgatttgccgcaagtgttatgctcgtctgcatccaagagccgtgaactgccgcaagaagaagtgtggtcacagcaatcagttgaggccgaagaagaagatcaagtagataccgactggtgttatcctgtctgctttaaaagaaattgaatgtcagactaggaaaatatttccattgagttcttttgctattattctattttgttgagattttgtttgtgggttctggatttgatgttccaatgtatgtttggacaatcttatgtcttttgtcttggaattttgataaggaggtggaaattttaagtaacgcta

SEQ ID NO: 11527 - DNA, 2054 bp, Gossypium hirsutum
cgctatttatgcaaacgccgtgaaagaaacgcaagcgcatgttacgcaatcactgtttgtgagaagccctagagataataacagtgatggaagtgctacattagaaggaggggagcagttgggtttaaataattattcttctgagtcaacttggacgaggcagattaatcagactggttaactcagccgagtcagattaaccagacaggatctgttggttcgagccaattagttggccggagccaacacggactacccccattaatcaacctgaggctgttggggaaaaccagattaatcagactgagctgactcggatgggtcagattaatcactcagcagctcctgctcctgctcctgcacctgctcctgctcctactcctactactactcctactaaggagcatagtcgggtagagccaactggtgcgagtcaggaaaccaattcggctcaggctagtcaagctaccgagttagagggatcaactttctggacagcttgtccgcactgttactctcgttttgagtatccgaagatgtacgagaattgtacactaaggtgtcagactaaggactgcaggaaagctttccatgcggttgtgataccttctccacctgctcagacagagccaactggtgtgactcgggccaatcaagctattgagtcagaggaaccgacattctggacggcttgtccatactgttacacactctgtgaatacctgaaggtgtacgaggactgtacgctaaggtgtcaaactaagaactgtaggagagctttccatgcagttgtgataccaccgccaccgatgaacggaaaggacacatatatctgctcctggggttttttccctataggattatctcgtaatggtaatttcccaaattggtcacctatttcgaccgtgtttgcttgccctgacaacaagaatgctggaaaacaaatgaataccaacaagtcttctccaaagctgttttatgatgaacaagatgtatatgtagagatctctgattcgagcatgagttccgagaatgaggatgatgatgatgattggcgaaatgaaaagagggagaaaaaggtgaacaattctaaagggaaaggatctagggggagatatgcaaagaaaccacagagtgagagagtgaagcaggggggtgatgaccaagttagtgcggatcatggtgggaattcgagtggtgcgtccatggtgccggacagtgtgtcaactgctgaatcaagcagaaggaagcagatgaaaagaggaacgaaggttttggggaagttggatttgaacgtagagtttcggaacgaggcagaagagccggtggcagggaggagtaaggggaatgatgctggaaacgaggaagaggataacagtgaaggaagagagagagagggaggaaaagatgcagatattcgtgaaaaccctaaccggcaagactataactctcgaggtcgagagcagcgataccattgacaacgtcaaagccaagatccaagacaaagaaggaatcccaccggaccaacaacgtctcatcttcgccggaaaacagctcgaagatggccgtaccttggctgactacaacatccagaaagaatcaacacttcatcttgttctgaggttgagaggtggaattattgagccttctttgatggctttggctcgcaaatacaaccaagacaagatgatttgccgcaagtgttatgctcgtctgcatccaagagccgtgaactgccgcaagaagaagtgtggtcacagcaatcagttgaggccgaagaagaagatcaagtagacactggctggtgttatcctgtctgctttaaaagaaattgaatgtcagaccaggaaaatatttccattgagttcttttgctattatattattttgttgagattttgtttgtgggttctggatttgatgttccaatgtatgtttggacaatcttatgtgttttgtcttggaattttgataaggaggtggaaattttaagtaatgctagttttagaaatattatttaaaaatgttagtgtgaaatcaaattttatagattca

SEQ ID NO: 11528 - DNA, 618 bp, Gossypium hirsutum
aagagagaaacataagcggcataagagttttaaggaaaatgcagatcttcgtgaaaaccctaactgggaagaccataaccctagaggttgaatccagcgacactatcgacaatgttaaggctaagatccaggacaaggaaggtatcccgccggaccagcagaggttgatcttcgccggaaagcagcttgaggatggtcgtacacttgccgactacaatatccagaaagaatcaacattgcatctggttctgaggcttcgtggtggcattatcgagccatctttgatggcattggctaggaaatacaaccaggacaagatgatctgccgcaagtgctatgctcgtctacacccccgtgctgtgaactgcaggaaaaagaagtgtgggcatagcaatcagctgaggccaaagaagaagatcaagtagattggatatcttgatggagttttaaagtcattcaatttcagatgttctgtttggaatttgaatggtgtagtgctaataacagatcttaattaccttctaagttggctttgatttctttaagcttgaacctctccttgttttatgtcattaattttgaattttatgatatgatattggagttctttatttatgg

SEQ ID NO: 11529 - DNA, 647 bp, Gossypium hirsutum
tgtggaggaagagagagagggaggaaaagatgcagatattcgtgaaaaccctaactggcaagaccataactctcgaggtcgagagcagcgataccattgacaacgtcaaagccaagatccaagacaaagaaggaatcccaccggaccaacaacgtctcatattcgccggaaaacagctcgaagatggccgtaccttggctgactacaacatccagaaagaatcaacacttcatcttgttctgaggttgagaggtggaattattgagccttctttgatggctttggctcgcaaatacaaccaagacaagatgatttgccgcaagtgttatgctcgtctgcatccaagagccgtgaactgccgcaagaagaagtgtggtcacagcaatcagttgaggccgaaaaagaagatcaagtagacactgactagtgttatactgtctgctttaaaagaaattgaatgtcagactaggaaaatatttccatttggttcttttgctattattctattttgttaagattttgtttgtgggttccggatttgatgttccaatgtatgtttggacaatcttatgtgttttgtcttggaaattttaagaacgctagttttagaagtatttttaaaaatgttagtgtgaaaatcaaatttt

SEQ ID NO: 11530 - DNA, 704 bp, Gossypium hirsutum
aaaccagtataaaaccctaacaatccgccactaaagcacagcttaaatgtaaagaaaaaaagatgcagatattcgtgaaaaccctaaccggcaagaccataactctcgaggtcgagagcagcgacaccatcgataatgtcaaagccaagatccaagacaaagaaggaattcccccggaccaacagcgtttaatttttgctggtaaacaacttgaagatggccgtacattggctgattacaacattcaaaaagaatcaacgcttcatcttgttttaaggttgagaggtggaattattgagccttctttaatggctttggctcgtaaatacaaccaagacaaaatgatttgccgcaagtgttatgctcggttgcatccgagagcggtgaactgtcgcaagaagaaatgtggtcatagcaatcagttgaggcccaagaagaagatcaagtaaactatgactgactatggtggtttatgtcatagctggatatggctgttgttgaggagttttgagttataattgaggttaaaaattatactttttgactatgtttgggctagttttcttcttttgggttgcaataatatgcacaaaatgttgttattatgctttcaatgtttttcttttataatgttagagctgtaatcccgatgaaacagttttatcatgcaatatatatggtgcatttataacatgcagttctta

SEQ ID NO: 11531 - DNA, 683 bp, Gossypium hirsutum
aaaaggccaaaacccaaggctaagaaagaattcactacaaaccctaatcaggctgtcagtatctttgttagatagattcagatacagaagcagaatcagaatcagggtttgaaaaaaatgcagatcttcgtgaaaaccctaacagggaagaccataaccctagaggtcgaatccagcgatactatcgacaatgttaaggccaagatccaggacaaggaaggtattccaccggaccagcagagattgatcttcgctggaaagcagctcgaagatggccgtactcttgctgactacaatattcagaaagaatcaaccttgcatctggttctgagacttcgtggtggcattatcgagccttctttgatggcattggctaggaaatacaaccaggataagatgatctgccgcaagtgttatgctcgtctgcacccccgtgccgtgaactgcaggaaaaagaagtgtggacacagcaatcagttgaggccaaagaagaagatcaagtagattacatatatcgacggaggaattctacttttattatcagatttctggttggaaactattgttctaataacagacatctttaatttcgtttatcttgaaactctcttgtagtttatgttcttccatttgtacttgaatgcaagttcttcgtttttgaaatgatgatggcaatatttaac

SEQ ID NO: 11532 - DNA, 635 bp, Vigna unguiculata
agagggagcagcaaagatgcagattttcgtgaaaaccctaacggggaagaccataaccctcgaggttgagagcagcgacaccatcgacaatgtcaaggccaagattcaagacaaggaaggtattcctccggatcaacagcgtttgattttcgctgggaagcagctcgaagatggaaggaccttggccgattacaacattcagaaggaatcgacccttcaccttgtcctcaggcttcgcggtggcatcattgagccctcgctcatggctttggctcgcaaatacaaccaagacaagatgatttgccgcaaatgctatgctcgtcttcacccaagggctgtgaactgccgcaagaagaagtgtggccacagtaatcagttgaggccgaagaagaagatcaagtaaatcttggttgatgttgttggtctcttgttctttatggatttgggactgggactggtttgttgattatatacttgtcgttaattgtttctggtttttattgatgttaaatgttttggtggatatttttgtagcggtcagttatattgctatgatgatgacattaaattatgtttcttttccgtatttcgttgcaatctttagtcgtttttacaattgcaaaaaaaaaaaaaaa

SEQ ID NO: 11533 - DNA, 648 bp, Cucumis sativus
atagagagagaggcagaaaaaagtcggaaacgtaaaaccctcaaactcatcaaggaggcgccgaggaaaactagaggatcaagaaaatgcagatcttcgtcaaaaccctaacggggaagaccattacgctggaagttgagtccagcgacaccattgacaatgtcaaggccaagattcaggataaggagggtattccccccgatcagcaacggcttatctttgccggaaagcagctcgaggatggccgcactctggccgactacaacatccagaaagagtcaacactgcatttggttctaaggcttcgtggtgggattattgagccatctttgatggcattggccaggaaatataaccaggacaagatgatctgccgcaaatgttatgcacgcctgcatccccgtgctgtcaactgccgtaagaagaaatgtggtcacagcaatcagctgaggccaaagaagaaaatcaagtagacggctgatcttaaggatgaaatgttgtggttccttatatatcacttcaatgcgctctgtagagtcttagattatgtgcccgtttgttaaggattcaattttgtagttcggacttcagaacttttgttgcattacattgattatgagatggtgttgttttctttttgaatctatt

SEQ ID NO: 11534 - DNA, 723 bp, Cucumis sativus
atgagcatataaaatgggctgatggaggtggagagtgtagccacgccgaattgtagagcagagatagcgttaacgccacaagatgcagattttcgtgaaaaccctaacggggaagacgattacgttggaagttgagtccagcgataccatcgacaatgtcaaagctaagatccaggataaggaaggtattccccctgaccagcagagacttatctttgccgggaagcagcttgaggatgggcgaacgctcgctgactacaatatccagaaagagtcaacactacacttggtgctcaggcttcgtggtggtattattgagccgtctttgatggcattggctaggaagtacaatcaggacaagatgatctgccgcaagtgctatgcccgtctgcaccctcgtgctgtcaactgcaggaaaaagaagtgtggacacagcaaccagttgaggccaaagaagaagatcaagtagactgttgattctgagagaggaaatctatgcaaaagtttatgcttcgatttattttctggattgcttatgcctagaaccatctgctttatactcattaggagtttgaattgttatgttttttactttttaacattctcgtgtaatggcattaaaaaataataacaagaatttaaaataaaaatttgacataactctttaaatatgtaataactactttatgaagaataacttgaaagatcatataaaatatactt

SEQ ID NO: 11535 - DNA, 586 bp, Cucurbita pepo
ggcaaaccggagagagcgttaacgaacgacgacagaatgcaaattttcgtgaaaaccctaactgggaagacgattacgttggaagttgagtccagcgacaccatcgacaatgtcaaagctaagatccaggacaaggaaggtattccaccggaccagcagagactgatcttcgccgggaagcagcttgaggatggacgaactcttgccgactacaacattcagaaagagtcaactctgcacttggtgctcaggcttcgtggtggaattattgagccctctttgatggcattggctaggaagtacaaccaggacaagatgatttgccgcaagtgctatgcccgcctgcatcctcgtgctgtcaactgcaggaaaaagaagtgtggacacagcaaccagttgaggcctaagaagaagatcaagtagactgttgattgcgagagaggaaacccatgccgaagtttatgcttttatttatttttttggatgcttagaactatttgctttcaaatactcggtataagtttgaattgttatgacttttgtttaacattctctgtaatgccatgttttgttctttagcttttga

SEQ ID NO: 11536 - DNA, 503 bp, Cucurbita pepo
cgacaagatgcagatcttcgtgaaaacccttactgggaagacgattacgttggaagttgagtccagcgataccatcgacaatgtcaaggctaagatccaggataaggaaggtattcccccggaccagcagagacttatctttgctgggaagcagcttgaggatgggcgaacgctcgctgactacaatatccagaaagagtcaactctgcacttggtgctcaggcttcgtggtggtattattgagccgtctctgatggcattggctaggaagtacaatcaggacaagatgatctgccgcaagtgctatgcccgcctgcaccctcgtgctgtcaactgcaggaaaaagaaatgtggacacagcaaccagttgaggccaaagaagaagatcaagtagactgttgattttgagaaaggaaacctatgcagtagtttatgttttggtttattttctggagcagttgtgcttagaactactaaactcattaggagtttgattgttatga

SEQ ID NO: 11537 - DNA, 705 bp, Cyamopsis tetragonoloba
gcgtcttgggaagaattacccgaggccatgttagtagctagttccagtcgcatgccgtgcagcaatggagatcggagatcaccttccgcgtgccgatcgccgccgttgggacgggttgtctccgctgggggaagagagggaaagatgcagatcttcgtgaaaaccctaaccgggaagaccatcacccttgaggtggaatcaagcgacaccatcgacaatgtgaagactaagattcaggacaaagaagggattccgccggaccagcaaaggctaatcttcgccgggaaacaacttgaggatggccgtaccctcgcggattacaacatccagaaagagtcaacattgcatcttgtcttgaggcttcgtggtggcattattgagccgtctttgatggcactggccaggaaatataatcaggataagactatctgccgcaagtgctatgcacgtttacacccccgtgctgtcaactgccggaaaaagaagtgtggacacagcaaccagttgaggccaaagaagaagatcaagtagactgttctgattgcaaggagttatgtgttgtcatggattactggttgtcttgtaattctgactacttcattagctttttaatattgtagggaatgttggaactggcaaacacaagtactattttttattttggctttccgtttgagatgcgttgaacagttatgcaatgacaat

SEQ ID NO: 11538 - DNA, 563 bp, Cyclamen graecum
cagcggcggtaagaaatgcagatattcgtgaagacactcacggggaagacgatcacgctcgaggtcgaatcgagcgacaccatcgacaatgtcaaggccaagatccaggacaaggaaggtattcccccggaccagcagagactgatcttcgccggaaagcagcttgaagatgggcgcactcttgccgactacaacatccagaaagagtcgactctgcatctggttctgaggcttaggggtgggatcattgagccatctttgatggctttggctaggaagtacaaccaggacaagatgatatgccgaaagtgttatgcccgtctgcatccccgtgctgtcaactgcaggaagaagaagtgcggacacagcaaccagctgaggcccaagaagaagatcaagtagacgatttatgatattttggagtattttacagtggtctttcgcaatagcgctgcccactcttagggtttttaagttttggtatttgctgtttcgataaacacatttttcttttccatttgttgagatgttacttgaccgtaattgcccaatttgtgttgcga

SEQ ID NO: 11539 - DNA, 647 bp, Cyclamen graecum
gagagagaggaaatgcagatattcgtgaagaccctgacggggaagacgataaccctcgaggtcgaatcgtccgacaccatcgacaatgtcaaagctaagatccaggataaggaagggattccgccggatcagcagaggctgatatttgccggaaagcagcttgaagatggccgcactcttgccgattacaacatccagaaagagtccacactgcatctggttctgaggcttaggggtggcatcattgagccatccttgatggctttggcaaggaagtacaaccaggacaaaatgatctgccgcaagtgctatgctcgtctgcacccacgagctgttaattgcaggaagaagaagtgtggtcacagcaaccagctaaggccgaaaaagaagattaagtagatgattaatcaaatcttcagtcttttcttattgtcttatattgccggcttgctcttgggacttctaaagttttgaaatcgctgttttggttggagactgttttccgtttcccccttattaagatgctgtaactgtttcgtaactcacatattcgtcatttgatgggagtattgcttggttctagttttgtgctgaaagtattagtattgcttggtcgggtctttcgatggtcgttttttgtgcaagtg

SEQ ID NO: 11540 - DNA, 393 bp, Cyclamen graecum
agaggaaatgcagatattcgtgaagaccctgacggggaagacgataaccctcgaggtcgaatcgtccgacaccatcgacaatgtcaaagctaagatccaggataaggaagggattccgccggatcagcagaggctgatatttgccggaaagcagcttgaagatggccgcactcttgccgactataacatccagaaagagtcaactctgcatctggttctgaggcttaggggtggcatcattgagccatccttgatggctttggcaaggaagtacaaccaggacaagatgatctgccgcaagtgttatgctcgtcttcatccacgtgctgttaactgcaggaagaagaaatgtggtcacagcaatcagctgaggcccaagaagaagatcaagta

SEQ ID NO: 11541 - DNA, 609 bp, Distylium racemosum
gattcgaaagttttgcaagggttttccagcaagcctaacaagatgcagatcttcgtgaagaccctcacggggaagaccattaccctcgaagttgagagcagtgataccatagacaatgtcaaagccaagatccaggacaaggaagggattccgcccgatcaacagcgtctgatatttgctggaaagcagctggaagatggccgcaccctcgctgattacaacattcaaaaagagtctactttacatcttgtgctgaggctccgcggtggaattattgagccttctttgatggcactggccaggaagtacaaccaggacaagatgatctgcagaaagtgctatgctcgactgcacccaagagcagttaactgcaggaaaaagaagtgtgggcacagtaaccagctgcgaccaaagaagaaaatcaagtagatctgatgtcgcaagggggattttacatgtttacaagattgttttgtttcattgacttaaacctccaaaactatgtcaaacgcatcactgagactatgttgctaattagtaaacatactttttgattttaaatctatgtaggcttaaattgggctttttatgtgtaatttggtgttttcg

SEQ ID NO: 11542 - DNA, 573 bp, Epimedium sagittatum
aactaaaaatgcagatcttcgtcaaaaccctaacagggaaaactatcaccctcgaggttgaatcaagcgacaccatcgacaatgtgaaagctaagattcaggacaaggaaggtattcccccggaccagcagaggttgatctttgcaggaaagcaacttgaagatggccgaacactggctgattacaatatacagaaagagtcgactctgcatcttgttttgaggcttcgcggtggcattattgaaccttctttgatggctttggctaggaaatacaaccaagacaagatgatctgccgaaaatgttatgcccgcttgcatccacgcgccgttaactgtaggaagaagaagtgtggacactccaaccagttgaggcccaagaagaagatcaagtaaacttacttgtggatcgtagacaagtctgttctgttggcattggccattttgttccgttttattcagaattgaactgttctgtgatacaaattctgttaactagacattttagacttgtcaaaaagctcggttatttattttatgttgggtaaaaatgatgcagtttgggagtttcaaa

SEQ ID NO: 11543 - DNA, 982 bp, Epimedium sagittatum
acgaacggaccgtaaccttagttttccgttaccggtagggtaagggaccgaaatttaaggtttaaggggtaaggttaaacgttaaccgtagtactccgtcgaggtccgaacccaaacaaattgtatgtcgctaaattaaattctgactacgtaactaatagtaaaagaaatcgttcgttgttggtttcgtttcgttcgtactaacttactttatttgtgttgttattagtaacttactaccgtaccgttcgtaacaagaggggtgtgacacgagtggcgctagtccgggcgggaggccgcggctgagacaggtgaagcgaaaaaatgcagatcttcgtgaaaaccctaacagggaagaccatcaccctcgaggtcgaatcaagtgacaccatcgacaatgtgaaagctaagattcaggacaaggaaggtattcccccggaccagcagaggttgatctttgcaggaaagcagcttgaagatgggcgaactctggccgattacaatatccagaaagagtcgactctgcatcttgttttgaggcttcgtggtgggattattgaaccttctttgatggctttggctaggaagtacaaccaagacaagatgatctgccgaaaatgttatgctcgcttgcatccacgtgctgtcaattgtaggaagaagaagtgtggacactccaaccagttgaggcccaagaagaagatcaagtaaacttacttgcggatcctagacaacagcctgttggtgttggcttttttgttctgttttattaggaattgtactgttccgtgatacaaattctgttaactagacattttagctttatcagaaactctgttatttatttttagttggataagtttgcaaacaaaaaaaaaaaaaaacaaaaaatgtcggccggccctccggccgtcctagaaatagttggtaaccggaaaacgggtttaggtaattactaaaccctttaccggtttccgtaacc

SEQ ID NO: 11544 - DNA, 684 bp, Eschscholzia californica
gtttgatccggaggaattccttctttgtcttgaacttttggagaaagagaaagatgcagatctttgtgaaaaccctaacggggaagacgatcacccttgaggttgagagcagtgacactattgacaatgtcaaagctaagattcaagacaaagaaggaattcctccggatcaacaaagactgatctttgctggaaagcaactcgaagatggccgaaccctagctgattacaacatccaaaaagagtctactcttcatttggttttgaggcttcgtggaggaatcattgagccttccttgatggctttggctaggaaatacaatcaagataagatgatctgcagaaagtgttacgctcgtctgcaccctagagccgtgaattgcaggaagaagaagtgtggtcacagcaatcagctgaggcctaagaagaagatcaagtgagctctagaatttccattttcagtatcagatagcagaactagcttcagacttggattcaagtgttgcaatagaagttgtttttgtttctgacattcaaactggttttttcttttttgtctgttctcttgtatgacattttgccatctacaatgtttaaaagttttgctacaagcatatgcttgagattttactttcatgttgaaattggtatgttaatcaatttggggagggtatcaaaaaaaaa

SEQ ID NO: 11545 - DNA, 649 bp, Eschscholzia californica
gcggaaaaaagttcagggaagatgcagatcttcgtgaaaaccctaactgggaagaccataaccctagaggtcgaatcaagcgacactatcgataatgtcaaagctaagatccaagacaaagaaggtattcctccagatcagcagcgtttgatcttcgccggtaaacaactcgaagatggccgtactcttgctgactacaacattcaaaaagaatcaactcttcatcttgttttgaggcttcgtggtggaattattgaaccatctttgatggctttagccagaaagtataaccaggacaagatgatttgccgcaagtgctatgctcgtctgcatccccgtgctgtgaactgcaggaagaagaaatgtgggcacagcaaccaattgaggcccaagaagaagatcaaatagatgttgagcaagactttactgaagctgctcaaacaagtcattttggtattaaactatcttttcttatttgcgtatttgttgtctcatcgtgtttaacccaacgatatttttcttacatgtgaacttagttgtatggaaacttgattggtgctcttctagcaaggttttgaactagaatttaatcaatgttaagaactagagttgctgtagtatttttcgtttttggtgttacttttatagt

SEQ ID NO: 11546 - DNA, 490 bp, Eschscholzia californica
gttcggtagcagagaaaattcagaaagagagaagatgcagatcttcgtgaaaaccctaactgggaagaccataaccctagaggtcgaatcaagtgacaccatcgataatgtcaaagctaagattcaagacaaggaagggatcccacctgatcagcagcgattgatcttcgctggtaaacagctcgaagatggccgtactctcgctgattacaacattcagaaagaatcaacacttcatcttgttttgaggttaaggggaggaattattgaaccatctctaatggctctggctagaaagtacaaccaggacaagatgatctgccgcaagtgttatgcacgtcttcacccgcgtgctgtgaactgcagaaagaagaagtgtgggcacagcaaccagttgaggccaaagaagaagattaagtagaccattcataaggttttggtgggcatagttagtaaaatcagtgtccagctagggattcagatatcatta

SEQ ID NO: 11547 - DNA, 526 bp, Eschscholzia californica
aagagagaagatgcagatctttgtgaaaaccctaactgggaaaaccataaccttagaggtcgaatcaagtgacaccatcgacaatgtcaaagccaagatccaagacaaggaaggaatccctccggatcagcagcgattgatcttcgctggtaaacagcttgaagatggtcgtactctcgctgattacaacattcagaaagaatcaacgcttcatcttgttttgaggctaaggggaggaattatcgaaccatctttgatggctttggctagaaagtacaaccaggacaagatgatttgccgcaagtgctatgcacgtctacacccacgtgccgtgaactgcaggaagaaaaagtgtggccacagcaaccagttgaggccaaagaagaagattaagtagatcatttacaaggttcttcaatttcaagttttagttccattttgtctgaactgtttttatcttaaactagttttaacttttcctttcgaacctgcagttattcaaattttgagtcctgtcttttggtta

SEQ ID NO: 11548 - DNA, 727 bp, Eucalyptus grandis
agtagtgattgctgaaaccgaaagagcgtcttctcggccgcagcgaaaatgcagatcttcgtgaaaaccctaaccggcaagaccatcaccctcgaggtcgagtccagcgacaccatcgacaatgtcaaggccaagatccaggacaaggaaggaatccctccggaccagcagaggttgatcttcgccgggaagcagctcgaggatggccgcacgctggccgattacaacatccagaaagagtcaactttgcacttggttctgaggcttcgaggaggcattatcgagccctcattgatggcattggccagaaaatacaaccaggacaagatgatttgccgcaaatgctatgctcgcctgcaccctcgtgctgtcaactgcaggaaaaagaagtgtggacacagcaaccagctgaggccaaagaagaagatcaagtagattgctgattttgaagagctttggcatgtgttcttttgtttggtggattttgacttgaaagcttaagtttttttatagatattgtgggaagcagaacctttttgggttaccggtactactagtcattggcaatacattgtgcccagcatttagaacattgcatcttctcgaaatttgatttgacatgttggtagtttcaatccaagatctcccttctgttctatttgtcggaattttgtttgcaattgaggattatcgttactaccgatgaataatgaatattgagaaccat

SEQ ID NO: 11549 - DNA, 681 bp, Eucalyptus grandis
gcctcagagttctcttccctccctccctctccccctcgtcgcaccgccgagacgcgcagagagagaatcgagagagagagagcgaagatgcagatcttcgtgaaaaccctaaccggcaagaccatcaccctcgaggtcgagagcagcgacaccatcgacaacgtcaaggccaagatccaagacaaggaaggaatcccgccggaccagcagcggctgatcttcgccgggaagcagctcgaggatggccggactctggcggactacaacatccagaaagagtccacgctccatctcgtcctgaggctccgcggagggatcatcgagccttctctgatggctttggctcgcaagtacaatcaggacaagatgatctgccgcaaatgttatgcccgcctgcatccaagagctgtcaactgccgcaagaagaaatgtggtcacagcaatcagctgaggcctaagaagaagatcaagtaaactttaggtggttacttagtccttactgttgcagagcatttgtttttacattgaagcgtgcttgtatggatgactagttgactcctttcattgtttcgaccgagaagaattcatttgggcatgtttttgctttttccctttggggctgagcagatgatgttgtttttgacctttgtaatggtagaaagtgattctcccttggttgaa

SEQ ID NO: 11550 - DNA, 571 bp, Euphorbia peplus
cggaaagaatgagaaatgagaaagcttgagacagaggggggcgaagatgcagattttcgtgaaaaccctaacagggaagaccattactctcgaggtagagagcagtgacaccatcgacaatgtcaaggctaagatccaggacaaggaaggtattccacctgaccaacaaaggttgatctttgccgggaagcagcttgaagatggccgtaccttggctgattacaatatccagaaagaatcgactcttcatcttgtgctcaggcttagaggagggatcattgagccttctctcatggctttggctcgcaagtacaaccaggacaaaatgatttgccgcaagtgctatgcacgtctgcacccaagggctgtcaactgccgaaagaagaaatgtgggcacagcaatcagctgaggccaaagaagaagattaagtagactttgaggaagagcaaatggtggatatttaaacgtttgattgttattttttggaagttaatttacatttttgttgtaatgaacatgtgagagttggatttagcaggcaacaatatgatcaagatttatgaaaaaaaa

SEQ ID NO: 11551 - DNA, 497 bp, Euphorbia peplus
agcaaagatgcagatcttcgtgaaaaccctaaccggcaagaccatcactcttgaggtcgagagcagcgacaccatcgacaatgtcaaggccaaaatccaagacaaagaaggtattcccccggaccagcagcgtttgatctttgccggaaagcagctcgaagatggccgtactttggccgattacaatatccagaaggaatcgactcttcatcttgtgctcaggcttaggggtggaattattgagccttctcttatggctttagctcgcaagtataaccaggacaagatgatttgccgcaagtgttacgctcgcctgcacccaagggctgttaactgccgtaagaagaaatgtggtcacagcaatcagttgaggcctaagaagaagatcaagtaaactctgatgaatagagcttggggcgtatttcgacattttaatgttagtttttggaagttaattacatttttaattgtaatgaacatgtgagttggtatttagt

SEQ ID NO: 11552 - DNA, 699 bp, Fagopyrum esculentum
gctgttctagagggtgaatcgaagagatcttcgtttcgaaagatgcagatattcgtgaaaaccctaaccgggaagaccatcaccctcgaggttgagagcagcgatacaatcgacaatgttaaggccaagatacaagacaaggagggcattcccccggaccagcagcgtttgatcttcgccggaaagcagctagaagatggccgaactcttgccgattacaacatccagaaagaatctacccttcacctcgttctgaggctgagaggaggaatcattgagccttcactcatggctttggcacgaaaatacaaccaggaaaagaccatctgccgcaagtgctacgctcgtcttcatcccagagctgttaactgcaggaagaagaagtgtggccacagcaaccagttgaggccaaagaagaagatcaagtagattcattttgaccttggcattggccaatcaattcctatgtggtctgggttgaatgtcaaaactagtttgtttgtttttctggaatcatttgtagcaaatacttgaaactcaaaatgttgaagtcttctgtacttggtatcaaagattttttctcttgaggattatggaaagacttgttgagatggcagtaggtttatttgttcatattttgttatcactgttgcatgctgtatgatacaattgtaaataccaacccagcttgtcaacaga

SEQ ID NO: 11553 - DNA, 511 bp, Flaveria ramosissima
cacaaagatgcagatcttcgtgaaaaccctaacggggaagaccataaccctcgaggttgagagcagtgacgccattgacaacgtcaaagccaagattcaagacaaggaaggtatcccaccggatcagcagcggttgatctttgctggaaagcagcttgaagatggtcgaactcttgctgattacaacatccaaaaagaatcgactcttcatttggttttgaggttgaggggaggaatcatcgaaccctctttgatggcactggctaggaagtacaatcaagataagaccatttgccgcaagtgttatgctcgtttgcacccaagggctgtaaactgcaggaagaagaagtgtggtcacagcaatcaactaaggccaaagaagaagatcaagtgaagacttagaagagcaacattcttgttaattttgggtctttatctttttcagtcattttatgttgttagttacctttgggatgaattgtttgtttgattcaagaagcaatactggttt

SEQ ID NO: 11554 - DNA, 786 bp, Linum usitatissimum
gatgtcggtgtagggctctccagctttcatgggtttctttcaacgtgaatataactggtgaggactgaggagggagctgtttaggcagaagagaagaaaaatgcagatcttcgtgaaaaccctaaccggcaagacaatcaccctcgaggtggaatcgagcgataccatcgataatgtcaaggctaagattcaggataaggaaggtattcctccggatcagcagcgactgatcttcgccgggaagcagctggaagatggccgtactcttgctgattacaatatccagaaagaatcaacacttcatttggttctgaggcttcgtggtggcatcatcgagccgtcgttgatggcattggccaggaagtacaaccaagataagatgatctgccgcaagtgttatgcacgcctccaccctcgagctgtcaactgcaggaagaagaaatgtggacacagcaaccagctgaggccaaagaagaagatcaagtagagtgttgatatgggtgttgctttgcagtttattgttagtagatcactcgctttgttgttgctacttggttccagaaagttttgcagtatttcaacagtggaactctagtattactgctgctgcctatgttctgtttgtgatctacttttgacacttttgatgctgaaatcttgatgtttcgacaatgtggtactgttattcgactgtttctctttgtcgttgaaccaaagaacgaatcttgtgacaatggaaacccgtcttggcttccttcattggtcactaaaatgacaagccactca

SEQ ID NO: 11555 - DNA, 668 bp, Linum usitatissimum
aaaccaaatccaatctgtggtcgccggcgcaaatcgccaagatgcagattttcgtgaaaaccctaaccgggaagaccatcaccctcgaggttgagagcagcgacactatcgacaacgtcaaggccaagatccaggataaggaaggaattcctccggatcagcaacgactgatcttcgctggaaagcagcttgaagatggccgtactctagctgattacaatatccagaaagagtcgactcttcatcttgttctgcggctcagaggaggaatcatcgagccttctttgatggctttggcgcgcaagtacaatcaggacaaaatgatttgtcgcaaatgctacgctcgtctgcacccaagggctgtgaactgccgcaagaagaagtgtggacacagcaatcagttgaggcctaagaagaagatcaagtagactgttgattgtggcacagagttcagcatctgggatagcttttgttgcagtgtatttgtttgtttcggttaaagcttgtttcgcagaatagtttggaatcagtattattacatgaacaaagtttcttgatctattgttaacgctggttactacattttctttggctatatgaactatcgagacgtctggatcaaaactgtactgatgtgtaccattcagaatctcatcgaggaatttccg

SEQ ID NO: 11556 - DNA, 664 bp, Linum usitatissimum
gagaagaaaaatgcagatcttcgtgaaaaccctaacgggcaagacaatcaccctcgaggttgagtcgagcgataccatcgataatgtcaaggctaagattcaggataaggaaggtattcctccggatcagcagcgtctaatcttcgccggaaagcaactggaagatggacgcactcttgctgattacaatatccagaaagaatcgacacttcatttggttctgaggcttcgtggtggcatcatcgagccatcgttgatggctttagccaggaagtacaaccaagataagatgatatgccgcaagtgttacgcacgcctccacccccgagctgtcaactgcaggaagaagaaatgtggacacagcaaccagctgaggccgaagaagaagatcaagtagagtgttgatatgggagttgctatgcagtttactgttagtagatcactctctgtgttgttcgatggtacttggttccagaaaattttagctgcagtattttccaacagttgaatgctagtactagtgcctgtgttctgtttctagtttacttttgacacttttgatggtgatatctttatgcagtgacaattttctactgtttttctctttgatggaattttcactctttggcgttgcaccaaaataaaacttgtgctatgaattttg

SEQ ID NO: 11557 - DNA, 696 bp, Linum usitatissimum
aatctgtgtgttcgccgccacaaatcgcgaagatgcagattttcgtgaaaaccctgactgggaagaccatcaccctcgaggttgagagcagcgacaccatcgacaacgtcaaggctaagatccaggataaggaaggaattcctccggatcagcagcgactgatcttcgctggaaaacagcttgaagatggccgtactctagctgattacaatatccagaaagagtcgactcttcatcttgtactgaggctgaggggaggaataatcgagccttctttgatggctttggcgcgcaaatacaatcaagataagatgatttgccgcaaatgctacgctcgtctgcacccaagggctgtgaactgccgcaagaagaaatgtggacacagcaatcagttgaggcctaagaagaagattaagtagactgtcgattgtgatgcagagttcagcaactgggatagcttttgttgcagtcttctttatttgtttgtttggtttaaagcttgttccgcagaatagttcggaaacagtattgttacatgaacaaagtttcttgatcttttgtaaacattattccaaatattcggaatctcaatgaggaatttctgaatcatctagctggagtaatcaatgtaaatatagctctatgcttgcgaacccagtaccaacaattgccaatggaaaatttgaaagaattatg

SEQ ID NO: 11558 - DNA, 632 bp, Fraxinus spp
gcatcagaaaatacagggccgccgaggaaaatgcagatcttcgtgaaaactctcactgggaaaaccataacgctcgaggtcgagtcgagcgacactattgacaatgtcaaagccaaaattcaagacaaagaaggcattcccccggatcagcagaggttgatttttgctggaaagcagctggaagatggccgcacccttgctgattacaatattcagaaagagtcgactttgcatttggttctcaggctgcgtggaggtattattgagccgtcgttgatggctttggctaggaagtataaccaggacaagatgatctgccgcaaatgttatgctcgtctgcaccctcgtgctgttaactgcaggaagaagaagtgtggacatagcaatcagttgaggccaaagaagaagattaagtagacattttgtcaagatttaaattgttgcagcctttctgcctcgaacgattcaaacagtttagaattgcatttgcttgtagtggaagatatgaaccatttatcagtttgttttgtttggaatgacaagaaatctaaggcattttcttacctaaaatgttcctcgtattcttggtttacaagtgatgctaaactctattgatagctgccatgttctat

SEQ ID NO: 11559 - DNA, 610 bp, Fraxinus spp
gcatcagaaagtacagcgccgccgaggacaatgcagatcttcgtgaaaactcttactgggaaaaccataacgcttgaggtcgagtcgagcgacactattgacaatgtcaaagccaaaattcaggacaaagaaggcattcccccggatcagcagcggttgatttttgctggaaagcagctggaagatggccgcacccttgctgattacaatattcagaaagagtcgactttgcatttggttctcaggctgcgtggaggtattattgagccgtcgttgatggctttggctaggaagtataaccaggacaagatgatctgccgcaaatgttatgctcgtctgcaccctcgtgctgttaactgcaggaagaagaagtgtggacatagcaatcagttgaggccaaagaagaagattaagtagacattttgtcaagatttaaattgttgcagcctttctgcctcgaacgattcaaacagtttaggattgcatttgcttgtagtggaagatatgaaccatttatcaatttgttttgtttggaatgacaagaaatctaaggcattttcttagctaaaatgttcctcgtattcttggtttacaaatgatgctaaactct

SEQ ID NO: 11560 - DNA, 557 bp, Fraxinus spp
gcatcagaaagtacagggccgccgaggaaaatgcagatcttcgtgaaaactctcactgggaaaaccataacgctcgaggtcgagtcgagcgacactattgacaatgtcaaagccaaaattcaagacaaagaaggcattcccccggatcagcagcggttgatttttgctggaaagcagctggaagatggccgcacccttgctgattacaatattcagaaagagtcgactttgcatttggttctcaggctgcgtggaggtattattgagccgtcgttgatggctttggctaggaagtataaccaggacaagatgatctgccgcaaatgttatgctcgtctgcaccctcgtgctgttaactgcaggaagaagaagtgtggacatagcaatcagttgaggccaaagaagaagattaagtagacattttgtcaagatttaaatttttgcagcctttctgtcttgaacgattcaaacagtttagaattgcatttgcttgtagtggaagagaaccatttatcaatttgttttgtttggaatgacaagaaatctaagacattttc

SEQ ID NO: 11561 - DNA, 669 bp, Fraxinus spp
aggacggtcgccgagagacgaaaatgcagatcttcgtgaaaactctaacggggaaaaccataacccttgaggtcgaatccagtgacaccatagacaatgtcaaagccaaaattcaagacaaggaaggaattccaccggaccagcagcgactgatctttgccggaaagcaactagaagatggccgcactctcgcagattacaatatccagaaagagtcgacattacatttggttctgaggttgcgcggagggattatcgagccttccttgatggcattggctagaaagtacaaccaggacaagatgatttgtcgaaagtgttatgcacgtctgcatcctcgtgctgtcaactgcaggaagaaaaagtgtggacacagcaaccagttgaggccgaagaagaagatcaagtagacgggatatggagttgcttttagaaagttactgtcaaaaggatatctcatgctgcagcctgtctgcatataaagattttaacaattttaaaaattgcatctcggtcattatggaccatctcatcttttttgtttgtttggagatatctgaattcttagttatttggatattttgagttctaaatgccattcccgtgctgttcattacagaatgctgtggttttatgatgaatttttatctgcacataccttaaaatggg

SEQ ID NO: 11562 - DNA, 549 bp, Gerbera hybrid cultivar
gcagatattcgtgaaaaccctaaccgggaagacgataaccctcgaggttgagagcagcgacaccatcgacaatgtcaaagcgaagatccaggacaaggaaggtattccaccggatcagcagcgattgatctttgccggaaagcagcttgaagatggacgaactcttgctgattacaacatccagaaagaatcaactcttcatttggtgttgaggctgaggggaggaatcattgagccctctttgatggcattggctaggaaatacaatcaagacaaaaccatttgccgcaagtgttatgctcgtttgcacccaagggctgtaaactgcaggaagaagaagtgtggtcacagcaaccagctaaggccgaagaagaagatcaagtgaagatttatgagtgttttgtgtgtcggagttaaaacttatctgcgtaattttggaacatttgcatgttttctaggcattttgttgttatgtaagtaaacttgagaaatagtttgtttaatttaagaagtactattggttttatgattaaaaaaaaaaaaaaaaaa

SEQ ID NO: 11563 - DNA, 633 bp, Gossypium raimondii
tgtccttgtgaaggaagagagagagagggaggaaaagatgcagatattcgtgaaaacgctaaccggcaagaccataactctcgaggtcgagagcagcgataccattgacaacgtgaaagccaagatccaagacaaagaaggaatcccaccggaccaacaacgtctcatcttcgccggaaaacagctcgaagatggccgtaccttggctgactacaacatccagaaagaatcaacacttcatcttgttctgaggttgagaggtggaattattgagccttctttgatggctttggctcgcaaatacaaccaagacaagatgatttgccgcaagtgttatgctcgtctacatccaagagccgtgaactgccgcaagaagaagtgtggtcacagcaatcagttgaggccgaagaagaagatcaagtagataccgactggtgttatcctgtctgctttaaaagaaattgaatgtcagaccaggaaaatatttccattgagttcttttgctattatattattttgttgagattttgtttgtgggttctggatttgatgttccaatgtatgtttggacaatcttatgtgttttgtcttggaattttaagtaacgctagttttagaaatattatttaaaaa

SEQ ID NO: 11564 - DNA, 626 bp, Gossypium raimondii
ggatcaaagagagaaacataagcggcataagagttttaaggaaaatgcagatcttcgtgaaaaccctaactgggaagaccataaccctagaggttgaatccagcgacactatcgacaatgttaaggctaagatccaggacaaggaaggtatcccgccggaccagcagaggttgatcttcgccggaaagcagcttgaggatggtcgtacacttgccgactacaatatccagaaagaatcaacattgcatctggttctgaggcttcgtggtggcattatcgagccatctttgatggcattggctaggaaatacaaccaggacaagatgatctgccgcaagtgctatgctcgtctacacccccgtgctgtgaactgcaggaaaaagaagtgtgggcatagcaatcagctgaggccaaagaagaagatcaagtagattggatatcttgatggagttttaaagtcattcaatttcagatgttctgtttggaatttgaatggtgtagtgctaataacagatcttaattaccttctaagttggctttgatttctttaagcttgaacctctccttgttttatgtcattaattttgaattttatgatatgatattggagttctctatttatggtt

SEQ ID NO: 11565 - DNA, 642 bp, Gossypium raimondii
tcttgtgaaggaagagagagggagggaggaaaagatgcagatattcgtgaaaaccctaaccggcaagaccataactctcgaggtcgagagcagcgataccattgacaacgtcaaagccaagatccaagacaaagaaggaatcccaccggaccaacaacgtctcatcttcgccggaaaacagctcgaagatggccgtaccttggctgactacaacatccagaaagaatcaacacttcatcttgttctgaggttgagaggtggaattatcgagccttctttgatggctttggctcgcaaatacaaccaagacaagatgatttgccgcaagtgttatgctcgtctgcatccaagagccgtgaactgccgcaagaagaagtgtggtcacagcaatcagttgaggccgaagaagaagatcaagtagatactgactggtgttatcctgtctgctttaaaagaaattgaatgtcagacgaggaaaatatttccatttggttcttttgctattattctattttgttaagattttgttttgggttccggatttgatgttccaatgtatgtttggacaatcttatgtgttttgtcttggaaattttaagaacactgttttagaaatattatttaaaaatgttagtgttaaaa

SEQ ID NO: 11566 - DNA, 614 bp, Gossypium raimondii
cagtatactttgttagattcagatacagaagcagaatcagaatcagggtttgaaaaaaatgcagatcttcgtgaaaaccctaacagggaagaccataaccctagaggtcgaatccagcgacactatcgacaatgttaaggccaagatccaggacaaggaaggtattccaccggaccagcagagattgatcttcgctggaaagcagctcgaagatggccgtactcttgctgactacaatattcagaaagaatcaaccttgcatctggttctgagacttcgtggtggcattatcgagccttctttgatggcattggctaggaaatacaaccaggacaagatgatctgccgcaagtgttatgctcgtctgcacccccgtgccgtgaactgcaggaaaaagaagtgtggacacagcaatcagttgaggccaaagaagaagatcaagtagattacatatctcgacggaggaattatacttttattatcagatttctggttggaaactattgttctaataacagacatctttaatttcgtttagcttgaaactctcttgtagtttatgttcttccatttgtacttgaatgcaagttcttcgtttttgaaatgatgatggc

SEQ ID NO: 11567 - DNA, 691 bp, Gossypium raimondii
gtagaaaaaccagtataaaaccctaacaatccgccgctaagcacagcttaaatcgaaagaaaaaaagatgcagatattcgtgaaaaccctaaccggcaagaccataactctcgaggtcgagagcagcgacaccatcgataacgtcaaagccaagatccaagacaaagaaggaattcccccggaccaacaacgtttaatttttgctggtaaacaacttgaagatggccgtacattggctgattacaacattcaaaaagaatcaacgcttcatcttgttttaaggttgagaggtggaattattgagccttctttaatggctttggctcgtaaatacaaccaagacaaaatgatttgccgcaagtgttatgctcggttgcatccgagagcggtgaactgtcgcaagaagaaatgtggtcatagcaatcagttgaggcccaagaagaagatcaagtaaactatgactgactatggtggtttatgtcatagctggatatggctgttgttgagaagtttttgagttataattgaggttaaaaattatactttttgactatgtttgggctagtcctcttttgggttgcaataatatgcacaaaatgttgttattatgctttcaatgtttttactttataatattagagctgtaatcccgatgaaacagttttatcatgcaatatatagtgcatttata

SEQ ID NO: 11568 - DNA, 512 bp, Vitis vinifera
gcgctgttattgtaaatcggttttagggcttcagcagaagaagaggaagataacgagagagaagatgcagatcttcgtgaaaaccctaacggggaagacgataaccctagaggtagagagcagtgacaccattgacaacgtcaaagcgaagattcaggacaaggaaggaatcccaccggatcagcagcgattgatcttcgccggaaagcagcttgaagatggacgaactcttgctgactacaacatccagaaagaatccactcttcatcttgtgctgaggcttcgtggagggattatagagccgtctctgatggctttggcacgcaaatacaatcaagacaagatgatttgccgcaaatgttacgctcgccttcatccaagggctgtaaactgtcggaagaagaaatgcggccatagcaatcagctgaggcctaagaagaagatcaagtgagctctgggtggctgttggttttgtgctttggattaatattgatttgtaattttgattgagg

SEQ ID NO: 11569 - DNA, 637 bp, Ipomoea batatas
tacggccggggagagtagactacggcagctggctacgggcttggcggtgcgagccgataaagatgcagatcttcgtcaaaactcttacggggaagaccataacgctcgaggtcgaatcgagcgacaccatagacaatgttaaggccaagattcaagacaaagaaggtattccaccggaccagcagcgcttgatctttgccgggaagcagctcgaagatgggcgtacgcttgcggattacaatatccaaaaggaatcgactttgcatctggttctaaggcttcgcggtgggatcatcgaaccatctcttatggctttagcccgcaaatataaccaggacaagatgatttgccgcaaatgctatgcccgtttacacccccgtgcagtcaactgcaggaagaagaagtgtggccatagcaatcagttgaggccaaagaagaagatcaagtaaagtggtggctggcttgtttgtctcaattgcttggttacaagacagtgtttaagatattaattgcttgtaactcagttgtaagacgttcgcctttgactatgttgagttttttgacatacaaaattgcaaggatcttagccattttcctgcttactagtctctttgttttctcagaaaaaaaaaaaaaa

SEQ ID NO: 11570 - DNA, 608 bp, Ipomoea batatas
aggatattggcgtgtgataaccgagaaaatgcagattttcgtgaagactctcaccggcaagaccatcacacttgaggtcgagtctagcgacactattgacaatgtcaaggctaagattcaagacaaggaaggaattccaccggatcagcagaggttgatttttgctggtaagcagctggaagatggccgtacccttgctgactacaatattcagaaagagtctactctgcatctggtgctgaggcttcgtggaggaattattgagccgtctttgatggctttggctaggaagtataaccaagataagatgatctgccgcaagtgctatgcacgtttgcatcctcgtgctgtcaactgccgcaaaaagaaatgtgggcacagcaatcagttaaggccaaagaagaagatcaagtagattttgtgtctgaagatttgccagtcttgtagtggatggtttttagaaatgtcaagaccaagggaattattattattctgctttattgtttgactgtatgagttgtccaaaactattgatacgggtattggtacttgtctattttccaatcatcttaaacatattttggcattatgttgaacttatctgtttc

SEQ ID NO: 11571 - DNA, 625 bp, Ipomoea batatas
cagaagagcggaagaagacaggaggccgcagagtttggcacgccagagccgtgaaagatgcagatcttcgtcaaaactctcactggaaagactatcactctcgaggtagagtctagcgatacgatcgacaatgtcaaggctaagattcaggacaaggaaggaatcccacctgatcagcaaaggttgatttttgctggaaagcagctggaggatggccgaactcttgcagactacaatattcagaaagagtccactctgcatctggttctgaggctgcgtggtggaattattgagccttctttgatggcattggctaggaagtacaatcaagacaagatgatctgccgcaagtgttatgctcgcttgcatccccgagctgtaaactgccgtaagaagaagtgtgggcacagtaatcagctgaggccaaagaagaagatcaagtagattatgagccttagtaactttcaactttacattggacggcttttaaagcccttcaaacatagaactaaggatgctcatttattattgttgtcagcttgtgctttatggttttgcctggttttgttatcctgaagattgaatgaattttggcacactaattattagcaatggttcatatttc

SEQ ID NO: 11572 - DNA, 605 bp, Ipomoea nil
aaagaggcataacagcggaagaagacaggaggccgcagagtttggcacgccagagccgggaaagatgcagatcttcgtcaaaactctcacggggaagactatcactctcgaggtagagtcaagcgatacgatcgacaatgtcaaggctaagattcaggacaaggaaggaatcccacctgatcagcaaaggttgatttttgctggaaagcagttggaggatggccgcactcttgcagactacaatatccagaaagagtccactctgcatctggtgctgaggctgcgtggtggaattattgagccttctttgatggcattggctaggaagtacaatcaagacaagatgatctgccgcaagtgttatgctcgcttgcatccccgtgctgtaaactgccgtaaaaagaagtgtgggcacagtaatcagttgaggccaaagaagaagatcaagtagattctgagccttagtaagtttcaactttacattggatggcttttaaagcccttcaaacatagaactaaggatgctcatttattattgttgtcagcttttgctttatggttttgttatcctgaagattgaatgaattttggcacactaattatta

SEQ ID NO: 11573 - DNA, 632 bp, Ipomoea nil
gggggaggcaacggagatcgggaagtgaggcgagagagaaaatgcagatcttcgttaaaactctcaccggcaagaccatcactctcgaggtcgagtccagcgacaccatcgacaatgtcaaagctaagattcaagataaggaaggaattccgccggatcagcagaggctgatttttgccgggaagcagttggaagatggccgtactctggccgactacaacattcagaaagagtcgactcttcacctggtgctgaggcttcgtggaggaattattgaaccatctttgatggctttggccaggaagtacaaccaagataagatgatctgccgcaagtgctatgctcgcttgcatccccgtgctgtcaactgtcgcaaaaagaagtgtgggcacagcaatcagttgaggccaaagaagaagatcaagtagattttgtttttgaagatgagccaaccttgtatcagatggtttctccaatatatggaactaagaatctctataatccttaaaatttgactaaactttagtatgatgttttgtttctttcttgtggttatacttgagattgaatttgtttcggtactgttttaacttttattaaaagctcttttgtttatcttttcttcattgatc

SEQ ID NO: 11574 - DNA, 675 bp, Ipomoea nil
ggaggaaattggcgtgtgatatcagagaaaatgcagattttcgtgaagactctcaccggcaagaccatcacacttgaggtcgagtctagcgacactattgacaatgtcaaggctaagattcaagacaaggaaggaattccaccggatcaacagaggttgatttttgctggtaagcagctggaagatggccgtacccttgctgactacaatattcagaaagagtctactctgcatctggtgctgaggcttcgtggaggaattattgagccgtctttgatggccttggctaggaagtataaccaagataagatgatctgccgcaagtgctatgcacgtttgcatcctcgcgctgtcaactgccgcaaaaagaaatgtgggcacagcaatcagttgaggccaaagaagaagatcaagtagattttgtgtctgaagatttgccagtcttgtagtgtatggtttttagaaatatcaagaccaagggaattaattattattattctgctttattgtttgactgtatgagttgtccaaaactattgatatgggtattggtacttgtcaatttttgaatcatcttaaaaatattttggcattatgttgaactttacctgttttgttcatgttgggtagagctgttaagtttgcgctattataatagatatttctgtgatgttc

SEQ ID NO: 11575 - DNA, 672 bp, Actinidia deliciosa
tccaatcttgaatccgcatacgcacagaggcagggatttgctgcgtagagagagaaaaatgcagatcttcgtgaaaaccctaaccgggaagaccataacactcgaggtcgagtcgagcgacaccatcgacaatgtcaaggccaagatccaggacaaagaaggcattccgccggaccagcagcggctgatattcgccggaaaacagctcgaagacggccggactctcgccgattacaatattcagaaagagtcgactctgcatctggttctaaggcttcgtgggggtatcatagagccgtctttgatggcgttggctcggaagtataaccaggacaagatgatctgccgcaagtgttatgctcgcctgcatcctcgcgcggtcaactgcaggaaaaagaagtgtgggcacagcaaccagctgaggccaaagaaaaagatcaagtagagaatttactgccagaaatgtttggcacatagtttgtcattgggatcaatttctgtgccagttatgagatgttgaagggattgataattttttatttcgacctttgtcgatctgcatgaaattgcatccttttttataattgatggcgtcatttgagagtggctattggcagggtaaaaactcaattttggcaactgctgttgattgtggtgatttcaattactcta

SEQ ID NO: 11576 - DNA, 608 bp, Actinidia deliciosa
tttaagcgccgcgacgcgaagagagagagaatgcagatcttcgtgaaaaccctaacggggaagacgatcacactcgaggtcgaatcgagtgacaccatcgataatgtcaaggctaagattcaagacaaggaaggtattccaccggaccagcagcgactgatctttgccggaaagcagcttgaagatggccgtactcttgctgactacaatatccagaaagagtcaacactgcatctggttctgaggcttcgcggtgggattattgagccgtcattaatggcgctggcgcgaaagtacaaccaggacaagatgatttgccgcaagtgttacgctcgcctgcatccacgtgctgttaactgcaggaagaaaaagtgtgggcacagcaaccagttgaggccgaagaagaagatcaagtaaatgtaatttgaagttttagttgtggtttgatttgtatagcagctttgactgctcgaggagatttaaagttttgaaaactgctgtctgcttagtggctctaagaccaactattttctgtttgtgatgacattatttgtggaattatcatgtgatttgctaagttgttttgtggctcaagcatgttcgttgtt

SEQ ID NO: 11577 - DNA, 581 bp, Actinidia deliciosa
agagagagagagagagatgcagatattcgtgaaaaccctaacggggaagacgataactctcgaggtagagagcagcgacaccatcgacaatgtcaaggccaagatacaagacaaggaaggaatcccaccggaccagcagcggctgatcttcgccggaaagcagctcgaagatggccgaaccctcgctgactacaacatccagaaagagtcgacccttcatcttgtactgcggcttaggggagggattattgagccttccttgatggctttggctcggaaatataatcaagataagatgatctgcaggaaatgttatgctcgcctccatcctagggctgtgaactgccggaagaagaagtgtggccacagcaatcagctgaggccaaagaagaagattaagtgaacactttggactaccattttctgtgccttgaggtgttactggagaatgaaattctatacaaagctagtaatgccattaagacaacaggcactatttctatatttatgtttcgattccccctaatgcattttggcagacatacttgtagttggaagagaattggatcttactccttata

SEQ ID NO: 11578 - DNA, 599 bp, Actinidia deliciosa
aaatgcagatcttcgtgaaaacgctaactgggaagacgatcacactcgaggtcgaatcgagtgatactattgacaatgtgaaggcgaagattcaagataaggaaggtattccaccggaccagcagcgactgatcttcgccggaaaacagcttgaagatggacgtactcttgcggactacaatattcagaaagagtcaaccctacatctggtactaaggcttcgaggtggcattattgagccctcattgatggcgttggcccggaaatacaaccaggataagatgatctgccgcaaatgttatgctcgcctgcatccccgtgctgttaactgcaggaagaaaaagtgtggacacagcaaccagttgaggcccaagaagaagatcaagtaggtgtaattttaattttgttcacccatcatttgtattttgctgtcctatggcagcctaactgcttgtagggatttgaagtttttgaactcatttgctgcttgtgactttgatggatcatcaaatattttgccattttggtgtttcaaaaacgtttatacattgcaagactattaagactgccttctttgcttttgttttccatgtttctgt

SEQ ID NO: 11579 - DNA, 725 bp, Liriodendron tulipifera
gaaaaagggtaggaggcggaggagaagatgcagatattcgtgaaaaccctaacggggaagaccataaccctagaggttgaatccagcgacaccatcgacaatgtcaaggccaagatccaggacaaggaaggaattccaccggatcagcagcgtctgatcttcgcaggaaagcagctcgaggacggccgtacacttgcggactacaatatccagaaagaatcgacactgcatcttgtgctgaggctccgtggtgggattatcgaaccgtctttgatggcgttggcccgaaagtacaatcaagataaaatgatctgccggaaatgctatgcccgcttgcatccccgagctgtgaactgtaggaaaaagaagtgcggccacagcaatcagttgaggccgaagaagaagataaagtaaatccataggtggagggtaggaagcgcagtggtaggtcatggtatttgccttatgtggttgatctcttcctattggatagaaaattgacactagacttcggttgatctcttcctataggataaaaaatcaagactagacttccataattagctgtcaacgcttttgttcttttgccccatcttctacatttgagttgagacttagttaactgttttgttctcttcaatcttttcatgatacacttattgttagttttctacttgcaaccacattttatcagtgcggtgtgtttaaaatagttattgtggcct

SEQ ID NO: 11580 - DNA, 592 bp, Lotus japonicus
aagaaggttgcttggcatcgttgatattcacgaagaagccgaagctgcaaagatgcagatattcgtgaaaaccctaactgggaagaccataacccttgaggtcgagagcagcgacaccattgacaatgtcaaagctaagattcaagacaaagaaggcattccaccggatcagcagcgtttgatcttcgccggaaagcagctggaagatgggcgaaccctagcggattacaacatccagaaggaatcaactcttcatcttgtcctcaggcttcgcggtggtatcattgaaccttcattgatggctcttgctcgcaaatacaatcaagacaagatgatttgccgcaaatgctatgctcgtttacatccgagagccgtgaactgccgcaaaaagaagtgtggtcatagtaatcagttgaggccaaagaagaagatcaagtaaattctgttattgttgttggaccttgatactcagattattgttctaatggttttacatgaatcaattctcatatgttttttacatgatgataaatgttttagaatttatcttttgtaacaatggattatattatgcgatgatgacttaatggtc

SEQ ID NO: 11581 - DNA, 629 bp, Lotus japonicus
ggacattcaacgacggtggtgcatttgcagttgatgaaggatgcagattttcgtgaaaaccctaactgggaaaaccatcactctcgaggtcgagagcagtgacaccatcgacaatgtcaaggccaagattcaagacaaggaaggcattccaccggatcagcagcgtctcattttcgctgggaagcagcttgaagatggaagaaccttggctgattacaacattcaaaaggaatccacgcttcatcttgtgctgagacttcgtgggggtatcattgagccttcattgatggctttggctcgcaaatacaatcaggacaagatgatctgccgcaaatgctatgctcgtctgcatccaagggctgtaaactgccgcaaaaagaagtgtggtcacagtaatcagttgaggccaaagaagaagatcaagtaaactaaggctgattttgttcgtctcttggggcgactcaggagtagtagttgatttctcttgttacagttggttatattcatacattggtgttaaccgggtttcaaatggttttggatttatttgtctagcatttgactatgtatgctatgatctgtttaaactttaaatacttccatgacatgatctgtttcaaaaaaaaaaa

SEQ ID NO: 11582 - DNA, 664 bp, Lotus japonicus
ggaatagccgattgtggaggaagagagaaccagagaagcagcaagatgcagatcttcgtgaaaaccctgaccggcaagaccatcaccctcgaggtggagtcaagcgacaccatcgacaacgtcaaagcgaagatccaggacaaagaagggattccaccggaccagcagaggttgatcttcgccgggaagcagcttgaggatggccgtaccctcgccgattacaacatccagaaagagtcaaccttgcatcttgttttgaggcttcgtggtggcattattgagccatctctgatggcattggccaggaagtataaccaggacaagatgatctgccgcaagtgttatgcacgtctgcatccccgtgccgtcaactgcaggaaaaagaagtgtggacacagcaaccagttgaggccgaagaagaagatcaagtaaactgttctgattgcaggaatgagtagtgttttcatggattgctggatgtcttgtgatcctgataattactttctcagcaatgtaggaattttgttggaaattggactggcatagttactctttatgatttttgttttcagtttgagacgggttgaaatctattatgctacaattctgtgcgatgacaattttgttgcttatgataatgcgtgatatccttgtttctcgtaaa

SEQ ID NO: 11583 - DNA, 663 bp, Lupinus angustifolius
caacgcaatcttcacagcagcatcatctcaaaaaaatgcagatcttcgtgaaaaccctaacgggtaaaacaataaccctagaagttgaaagcagtgacacaatcgacaatgtgaaagccaagatccaagataaagaaggagttccaccagatcaacaacgtttgattttcgctggtaaacaacttgaagatggaagaaccctagctgattacaatattcaaaaggaatctactcttcatcttgttcttaggctccgtggtggaattattgaaccttcattgatggctttggctcgaaagtataatcaagataaaactatttgcagaaaatgctatgctcgtcttcatccaagggctgtgaactgcaggaagaagaagtgtggccatagcaatcagttgaggccgaagaagaagatcaagtaaattctagttgatatttttatttttgtttttgatgttgcatcgaagacacttttgatttacacaccgttgctgctgattttaacttttgtttttgagtaatgtgtaaactgttttgtcccttacattttgttagtaatcaatcaattatatttgaatgatgacgttattctttgagtaacgggttctatgccaaaattacaagaatgttaaattgcttgagatgaaagtccttgcattttta

SEQ ID NO: 11584 - DNA, 802 bp, Pinus pinaster
gggccatcagagtcaggtcatgtgaccagcgccttatctcgaaatagcttgcttttcccacaaaaccctaacattgaaaccctagagacggactacaaaagcctcagatgatataatttctctctgaagtccactattgttggggagaaattgttagcagcgagcaagatgcagatcttcgtaaagaccctgacgggcaagaccataaccttagaagttgaaagcagcgatacaatcgacaatgtgaaggccaaaatccaggacaaagaagggatcccgcccgaccagcaacgtctgatatttgcgggcaagcagttggaagatggacgcactctggcggattacaacattcagaaagagtcaaccttgcaccttgtgctgaggcttcgtgggggtattatagagccttctttgatggcattggccaggaagtacaaccaagacaagatgatttgcagaaaatgctatgctcgtctgcaccctcgagcagtcaactgcaggaaaaagaagtgtgggcatagtaaccagctgcggccaaagaagaaaatcaagtaaatgtgatgccgcattgagattttatatctctaaagtcattcatgttctatgattccccatcattttaggtggttgtgccttgtcaaaagcatcacttttaaaccatgcttggcttataagcaaagccttcacgtttttgatatcatatattaaattaaactgggaatctgactcataacaattttgtttttcagttcattatatctctgtctgtgttaaggttacgtaaaaaaaaaaaaaaaagtaa

SEQ ID NO: 11585 - DNA, 679 bp, Cucumis melo
aaaagcaagaactgtaaagcagagagagccttcgtcggcgacataggatgcagattttcgtgaaaaccctaacggggaagacgattacgttggaagttgagtccagcgacaccatcgacaatgtcaaagctaagatccaggataaggaaggtattccccctgaccagcagagacttatctttgccgggaagcagctcgaggatgggcgaacgctcgctgactacaatatccagaaagagtcgacactacacctggtgctcaggcttcgtggtggtattattgagccgtctttgatggcattggctaggaagtacaatcaggacaagatgatctgccgcaagtgctatgcccgcctgcaccctcgtgctgtcaactgcaggaaaaagaagtgtggacacagcaaccagttgaggccaaagaagaagatcaagtagaccgttgattttgatcagagagtatgcaaaagtctatgctttgatttattttcaggattgcttatgcttagagccatttggcttatactcattaggagtttgaactgttgtgttttttgctttttaacattctcgagaaacggcatgttttgttgttgaactgagtacgaaattttcagcttcttatttccatttcttggctctttactttatcaaccaatataacaacgcaaaatactaaaaat

SEQ ID NO: 11586 - DNA, 647 bp, Momordica charantia
aggaaaagagagagccaagaaaatgcagatcttcgtgaaaaccctaacggggaagaccattacgctggaagttgagtccagcgacaccattgacaatgtgaaggccaagatccaggataaggagggtattccccccgaccagcagaggctgatctttgccggaaagcagctcgaggatggccgcactctcgccgactacaacattcagaaagaatcaacactacatctggttctgaggcttcgtggtgggattattgagccttctttgatggcattggccaggaaatataaccaggacaagatgatctgtcgcaaatgttatgcacgcctacatccccgtgctgtcaactgccggaaaaagaaatgtggacacagtaatcagctgaggccaaagaagaagatcaagtagactgctgatccagagaagggaacgttatggaacctgatatgtcactcaattcgctcgctggcctcttatggttcattaggattatgtgctcatcggtttaaggactcaatttttgtagtttgactttgaaagatttaagtttggttccgcttatcacaatttttggttgctttacaatggttttgactctatttgaatctattttagtgatgaaatgagtgttcattattctctcaat

SEQ ID NO: 11587 - DNA, 600 bp, Momordica charantia
atagaggagtaacgaaggcacgccaagatgcagatcttcgtgaaaacccttactgggaagacgattacgttggaagttgagtccagcgacaccatcgacaatgtcaaagctaaaatccaggacaaggaaggtatccccccggaccagcaaagacttatcttcgccgggaagcagcttgaggatgggcgaactctcgccgactacaatatccagaaagagtcaactctgcacttggtgcttaggctccgtggtggtattattgagccatctctaatggcattggctaggaagtacaatcaagacaagatgatctgccgcaagtgctatgcccgcttgcacccacgtgctgtaaactgcaggaaaaagaagtgtggacatagcaaccagttgaggccaaagaagaagatcaagtagacggttgattttgagagaggaaaactatgcagaagttttatgttttttactttcttgggcacttgtgcttacaactatttgctttatactctttaggagtttgaattgttacgattttgctttaacattctcaagtaatggcatattttgttcttgacttttgagtactaaatcttcagactgtct

SEQ ID NO: 11588 - DNA, 633 bp, Nicotiana benthamiana
ggaaaaacgcgaggagttgaaggaaaaaggaagccggagctcgtaacgaaaatgcagatattcgtgaaaactctcactggtaaaaccattactctcgaagttgaatccagtgatacaatcgacaatgttaaagccaaaatacaagacaaagaaggaattccaccggaccaacaaaggctgatttttgctggtaagcagctcgaagatggacgcaccttggccgattacaacatccaaaaagaatcgactctacatttggtgctgaggcttcgtggtggaatcattgaaccatcgttgatggctttggctaggaaatacaatcaggacaagatgatatgccgcaagtgctatgctcgattgcatccccgtgctgtcaattgccgcaagaagaagtgtggacacagcaaccagttgaggcctaaaaagaagattaagtagatgtaaatttctattgctgcggacttgtagttgttggcggtattagatctttcagaaactgaacttggatttcttaccaaaaaaacaaattgtacttgggtttatctttgggtttctgttctttttaccccttaagattcatggcttgtatttgggaggtaaatgaaatcaatcagtatactataattgctattt

SEQ ID NO: 11589 - DNA, 746 bp, Nicotiana benthamiana
agaagaggagctgcatagaagaggagtagaagatcgttggtgaggggcggagaaaatgcagatcttcgtgaaaactctgacgggtaaaactataacccttgaggttgaatccagtgacacaattgacaatgtcaaggccaaaattcaagacaaggaaggaattccaccggaccaacaaaggctgatttttgctggtaagcagcttgaagatggccgcacccttgctgactataacattcagaaagagtcgactctgcatttggtgctgaggcttcgtggtggaattattgaaccatctttgatggctttggctaggaagtacaatcaggacaaaatgatttgccgcaagtgctatgctcgtttgcatcctcgtgctgtcaattgtcgcaaaaagaagtgtggccacagtaaccagttgaggcccaagaagaagatcaagtagatggtgattttgaagtcctttcaacatgtagctgctaatgttgagatccttaagaaaattattagatatgttgttgggttgcctgttcaatttactataaaatattgatggatatgtttttgagctactttcatatttcttaatgagctagattctgatggtttcattactataagctttgctagatgtgtagttatatatgtgcttttatccagctatttcgattagtcttttcctctgttatgttttgcggaagtgagccaagaacataaacaatagcaacacaagttaaagttgatgttga

SEQ ID NO: 11590 - DNA, 741 bp, Nicotiana benthamiana
agaagaggagctgcatagaagaggagtagaagatcgctggtgaggggcggagaaaatgcagatcttcgtgaaaactctgaccggtaaaactattacccttgaggttgaatccagtgacactattgacaatgtcaaggccaaaattcaagacaaggaaggaattccaccagaccaacaaaggctgatttttgctggtaagcagcttgaagatggccgtacccttgctgactataacattcagaaagagtcgactctgcatttggtactgaggcttcgtggtggaattattgaaccatctttgatggctttggctaggaagtacaatcaggacaaaatgatttgccgcaagtgctatgctcgtttgcatccccgtgctgtcaattgccgcaaaaagaagtgtggccacagcaatcagttgaggcccaagaagaagattaagtagatggtgattttgaagtcccggcaacatgtagctgctaatgttgagatccttaagaaattattagatatgttgttgggttgcctgttcaatttactctgaaacattgaaggatttgtgtttgagctacttcaatatttcttaatgagctagattctgttggttacattacataagttttgctcgatgtgtagttctatgtgcttttatccagctatttcaattagtctttctatctgttatgtttgctgaattgagccaagaatataaacaatagcaacacaagttaaagttgatgttga

SEQ ID NO: 11591 - DNA, 629 bp, Nicotiana benthamiana
ttaatcagcgaagacaaagcgggtaagagaacagtgcgccgcaaaatgcagatcttcgtgaaaaccctaactgggaagacgatcacactcgaggttgaatcgagcgataccattgacaatgtcaaagctaagattcaagacaaggaaggtattccaccggaccagcagcggttgatcttcgccggaaagcagctcgaagatggacgtactcttgctgattataacatccagaaagagtcgactttgcatttggttttaaggcttcgtggaggaattattgagccttctctgatggctttggctaggaagtacaaccaggataagatgatttgccgcaagtgctatgctcgcctgcatcctcgtgctgttaactgcaggaagaaaaaatgtgggcacagcaaccagctgaggccaaagaagaagatcaagtaggcgtgatgtcttttctaagcttagatcaattttgtgcgttgcagctatatattgccagtccgttgtttttacaattttcggtcctgcttcaacttgatatcatggatagagaagcatttgtcttaaacatctaattattggataagatatctttgtgcactcgatatatgtcttgttagatggagtttagtatattt

SEQ ID NO: 11592 - DNA, 640 bp, Nicotiana benthamiana
aatataagcttcctgacggaaaaaaaaagcctgcaattctcgtatcggagagataagatgcagatcttcgtgaaaaccctaacggggaagaccatcacccttgaagtcgaatcgagcgataccatcgataatgtcaaggccaagattcaggataaggaaggtattccaccggaccagcagcgattgatctttgctggtaaacagcttgaagatgggcgtacactggctgattataatatccaaaaagagtcgactctgcatcttgtgctgaggctccgtggagggatcattgaaccatctcttatggcattggcaaggaaatacaaccaggataagatgatttgccgcaagtgttatgcccgtctgcatcctcgtgccgtaaattgcaggaagaagaaatgtggccatagcaaccagttgaggccaaagaagaagatcaagtaaacaggtggttgcatttgctgtctaaatgctatgccaattgcatgattttgtagttcttttgcttagctcacattttggtggctctatcgttgtctgtttaactgcagcacatttgtttcaacttcagttccatttacaaaaagaatttagtgctcattttttgagtttggtatgattatgacccgtgtttttattt

SEQ ID NO: 11593 - DNA, 690 bp, Nicotiana benthamiana
ggggtttcaatcagaaaaagcaaagcgggtaaactgaagagtgcgccgcaaaatgcagatcttcgtgaaaaccctaaccgggaagacaatcacgctcgaggttgaatcgagcgacaccattgataatgtcaaggctaagattcaagacaaagaaggtattccaccggaccagcagcggttgatattcgccggaaagcagctcgaagatggacgtactcttgctgattataacatccagaaagagtcaactttgcatttggttttgaggcttcgtggagggattattgagccttctctgatggctttggctaggaagtacaaccaggataagatgatttgtcgcaagtgctatgctcgcctgcatcctcgtgctgttaactgcaggaagaaaaaatgtgggcacagcaaccagctgaggccaaagaagaagatcaagtagacgtgatgtcttttctaagcttagatcaattttgcgcgttgcagctatatattgccagtccgttgtttttacagttttcagtcctgcttcaatttgatgtcatggataacaaacatgtcttaaacatctaattattggataagatatctttgtgcactcaatatatgtctgtttatgtttagtatgttcttcctgataagcaagcctacaggtgcatgatttgttctaatatctgttccataatcataatg

SEQ ID NO: 11594 - DNA, 802 bp, Quercus alba
atgggggactgctataaaaacccttgccattttcactctctccgtttctctgtacagagtgtagagaggtagagagagaaagatgcagatattcgtgaagaccctaacagggaaaaccataactctcgaggtcgagagcagcgacacaatcgacaatgtcaaagctaagatccaagacaaagaagggattccaccggatcagcagcgtttgatctttgctggcaagcaactcgaagatggccgaaccttagctgactataacattcagaaagagtcgacattgcatcttgtgctgagacttcgtggtgggatcatagagccttctttgatggctttggctcgcaaatacaatcaagacaagatgatttgccgcaaatgttatgcacgtctgcacccaagggccgtaaactgccggaagaagaagtgtggccatagcaatcagttgaggccaaagaagaagattaagtagactctggacctttattgcgttttatgtctcagattgtaattgaaattttgatattagaaccaagatatccagtatgtgattttttttcccattgacattaaggaatgtattccaattttgatatcacaaatattatgatgattctttttagttatcagattcaagataatgttggaaagattttcttaattgcttcgtaggaaaaacagtcttgtttatttatttgaaatttttttctcttttgcgtgaatcgcgtccaatccctctgagataaatgtttgtcttagttgaacatgttgtacttgctagacttttgaggaaaaggtatttctt

SEQ ID NO: 11595 - DNA, 1243 bp, Elaeis guineensis
ttttcacatggcaaagagacacaacatgagagatagaaagccggataagctctatttctttttcataaagtagagcaacacagcagagatagaaagcaggataagtagacgagagagaggtgattttgtcgccggccatggcaagacccgctccagagccatagccggttatttttagcaccaacaccctagttctaagtacagacaaactacagggcaccacacagacactagaaattaacaacactagcactcattaactccctccctccccgtctttgaggcttttgcgtctcatttacagttgcagggatcgcaggtgcagttggatccgcacttgcagccgccgttctcggatccagtcgccatctcgaacccttcaacttgccccttctgaggtgcaacccccatgatcacggtttgagtggtggtgctcctctcctcagccatgtcagggtacatcttgcatcctccacatccagtgccgcatttgcagccagatccacacccgcagttccctccgcagcaagacattttcttcactctgaaaatgaaatataaactctctctctttctctcaaacacccccgcgtacgcggggaggacttttgaggggagaacagggcgagaggttgagagatcttggtaacgatgcagatcttcgtcaaaaccctaacggggaagaccataacccttgaggtcgagagcagcgacaccatcgacaacgtcaaggccaagatccaggacaaggaagggattccgccggaccagcagcgtctgatctttgccggtaagcagctcgaggatggacggaccctcgcggactataacatccagaaagagtcgactctgcatctggtgctgaggctgaggggaggaatcatagagccctctcttatggctcttgccaggaagtacaaccaggacaaaatgatctgccgaaagtgctatgcaaggttgcatccaagggctgtgaactgccgcaaaaagaagtgtggccacagcaaccagctgaggcctaagaagaagatcaagtaaatgcttgcatggatgaagtttatttgtccctggaattcagaaattttagctgattagcttggaatctggactttaatgtttcctggtaatatgaatgtcagactaccttgagcttgttgtttgatccattcagttctttgaccgatgaagattaagaaactaagcattttgttgaatctcgagtattatcctgctttattataaa

SEQ ID NO: 11596 - DNA, 637 bp, Elaeis guineensis
tgaacgaaggagaggaggcggaggagagagatcgagcgaccaagatgcagatctttgtcaaaaccctcaccgggaagaccatcaccctcgaggtcgagtcctctgacaccatcgacaacgtcaaagccaagatccaggataaagaaggaattccaccggaccagcagcgtttaatcttcgccgggaagcaactcgaggatggacgaacgctagctgattacaacatccagaaagagtcgacacttcatctggtgctgaggctgaggggtggtatcatcgagccatcactcatggcccttgccaggaaatataaccaggacaagatgatctgcagaaagtgttatgctcgtctgcatcctagggctgtgaattgccgtaagaagaagtgtggtcatagcaaccagttgagacctaagaagaagatcaagtaaaccctggctgagctgtattccgcatttctagttatttctgatatggaatatatgagatcttttttgggaggaatttagcttgcatgttatttttctttcctagtttatcagcaaatacaaactgccttttggttctcgataagtgctggaaatgtgaatcgttaatgcatgttagatcttttccgagtaatgcaatcgtttgtttt

SEQ ID NO: 11597 - DNA, 622 bp, Elaeis guineensis
ggaccgccgcggctcccgtggcaggtttcagaggtgaagggagtcgagagcgcgatacttctctggaacgatgcagatcttcgtgaaaaccctaacggggaagaccataactctcgaggtcgagagcagtgataccatcgacaacgtcaaggccaagatccaagacaaggaagggattccgccagaccagcagcgtctgatctttgcgggaaagcagctcgaggatggacgaaccctcgccgactacaacatccagaaagagtcaacgctgcatctggtgctgaggctgaggggagggatcatagagccctctctcatggctctggccaggaagtacaaccaggacaaaatgatctgccgaaagtgctatgcacggttgcatccaagggctgtgaactgcaggaagaagaagtgtggccacagcaaccagctgaggcctaagaagaagatcaagtaaatgcttgcatggatgaagttcattttgttcttggaattcatatcttttattagattagcttggaattaagacttccattttcctaattatatcaatgtcagactactacttggagcttgttttgagaactatttagtagttttaaccgatgaagttggaaaaaaa

SEQ ID NO: 11598 - DNA, 1248 bp, Olea europaea
cagaactcccaattctgccatttcctatatcagaaataaattgcaagggctgccgcggagagaggaaaatgcagatcttcgtgaaaactctgacgggaaaaaccataaccctcgaggtcgaatccagcgacaccatcgataatgtcaaggccaaaattcaagacaaggaaggtattccaccggaccagcagcgattgatctttgctggaaagcaactggaagatggccgcactctcgctgattacaatatccagaaagagtcaacgttacatttggttctgaggttgcgtggagggattattgagccgtccctgatggcattggctaggaagtacaaccaggacaagatgatttgtcgaaagtgttatgcacgtctccatcctcgtgctgtgaactgcaggaagaaaaagtgtggacacagcaaccagttgaggccaaagaagaagatcaagtagatgagatatggggttgcttttagagagttattgtcaagagatatgtcttgctgcagatgttggccaatgtaaaaccatcctttctctctttaatttgtttggggacataagaattcttattcaatttggatattggagttatcagtgccttttctatgctgttcattttagatagaatgttgtcgtattactatgaatctctttggtttgtgctacctttaggcttctactagtaattattttatttgttatagtggggcagaaaacaaaaagtaatcatgtaatagaagtacaacagacacttggaattgaagctgcaagaaaggttataattgacgagattcagtataccatgtcaagccatggaatgaccattgacatacgtcatatgaagctattggcagatttaatgacatttaagggtgaagtcttgggaattacaaggcatggcgtgcagaaaatgagagatagtgtgctgatgttggcttcgtttgagaagactgcagatcaccttttcaatgcatctgtacacgggagagaggataagattgaaggagtaagtgaatgcatcattatgggcataccaatgcaaataggcacggggatgtttaaactcaggcaaagtatgaagcagcctgttgagctgatatacggtgcaaatccagttatacattgaaacaagcagcgtagatttggttccggaattatttcgctctgttaagtgtaatttataacgacgtctttgatcgtatgataagagttgacaggttcagtcgaagaacgaggatggaag

SEQ ID NO: 11599 - DNA, 860 bp, Olea europaea
ccggtttaacccgtttcgttaaccgtaaacgttacgttaaccgaaacttttacggttaacgttagttacgtaatttagttaccgttcgttacgttaggttaaggtaacgtaattagtaaccgacttaacttacgtaattacgtttagttttggttaagttagatagaaattaaagtaacaactttgttaattagtcgtacgtacctgcgttcgagtaccgactagcttaagtcgactggtagtctaacgacacgaggtaacacggggcggagtcagaagtaacacgacgccgacgaggaaaatgcagatcttcgtgaaaacgctcaccgggaaaaccataacgctcgaggtcgagtcgagcgatactattgacaatgtcaaagccaaaattcaagacaaagaaggaattcccccggatcagcagcgattgatatttgctggaaagcagctggaagatggccgcacccttgctgattacaatattcagaaagagtcgactttgcatttggttctcaggctgcgtggaggtattattgagccgtcgttgatggctttggctaggaagtataaccaagataagatgatctgccgcaaatgttatgctcgtttgcatcctcgtgctgttaactgcaggaagaagaagtgtggacatagcaatcagttgaggccaaagaagaagatcaagtagacatgttgtcaagattttaattgtcgcagcttttctgccttgaacgattcaaaccattttggattgcatttgcttgtagtggaagatatgaaccatttatcaatttgttttgtttggaatgataagaaaattaagacattttgttacatataaatgttccttgtattcttgg

SEQ ID NO: 11600 - DNA, 845 bp, Olea europaea
acggggggaaaatacagtgccgccgataaaatgcagatcttcgtgaaaactcttaccggaaaaaccataacgctcgaggtcgagtcgagcgacactattgacaatgtcaaggccaagattcaggacaaagaaggaattccaccggatcagcaacgattgatttttgccggaaagcagctggaagatggacgcaccctcgctgattacaatattcagaaagagtcgactctgcatttggttcttaggctacgtggcggcattattgagccgtctttgatggcactagctaggaaatataaccaggacaagatgatctgccgcaaatgttatgctcgtctacaccctcgtgccgttaactgcaggaagaagaaatgtggacatagcaatcagttgaggccaaagaagaagatcaagtaaacatgtcaccgatttaacctgttgcagcttttctgccttgaccgatttaaacaatttaggatttgcatttgcttgtagtggaagacataaaccgcttatctatttgttttgtttggaatgctcagaaatcaaagacattatgcagaaatgatgattaaggtgtctaatgcaatagatttccctacccacaacgccaatgaacttcgttttcttcttttcttttcgtggattcgttgtgggtgatcctagtgtatttggaattatatgccaacattcaaagaaaatgagcagaggtaaattctattaagaggaaattacggaaatatctgattttgacacatcatttgggggaaaaaagtcaaaaattgagaggtatgcatccgtggttattggaagaactcaaaactcatttttctttttcctagcct

SEQ ID NO: 11601 - DNA, 748 bp, Olea europaea
aaaccctaattctgagctcgatcacacaagtacctgggactcgcagttctgctatttcttatcagaaaataaggacggccgccgagagtggaaaatgcagatcttcgtgaaaactctaacggggaagaccataacccttgaggtcgaatccagtgacaccatagacaatgtcaaagccaaaattcaagacaaggaagggattccaccggaccagcagagattgatctttgccggaaagcaactggaagatggccgcactctcgcagattacaatatccagaaagagtcgacattacatttggttctgaggttgcgtggtgggattatcgagccatccttgatggcattggctagaaagtacaaccaggacaagatgatttgtcgaaagtgttatgcacgtctgcatcctcgtgctgtcaactgcaggaagaaaaagtgtggacacagcaaccagttgaggccgaagaagaagatcaagtagacgagatatggaattgcttttagaaagttactgtcaagaggatatctcatgctgcagcctgtctgcatataaggattttaacagttttaaaaattgcatcttggtcattatggatcatctcgtcttttttgtttgtttggagatattcgaattcttagttatttggatattttcagttataaatgccatttctctgtggttctttacagaatattgtggttttatgatgtattttcatatacatatgacaatttggtatttgatgta

SEQ ID NO: 11602 - DNA, 722 bp, Olea europaea
tgaaaatacgttgctgtggttaaaatgcagatcttcgtgaaaactctcaccggaaaaaccataacgctcgaggtcgagtcgagcgacactattgacaatgtcaaagccaagattcaagacaaagaaggaattccaccggaccagcaacgattgatttttgctggaaagcagctggaagatggacgcaccctcgctgattacaatattcagaaagagtcgactctgcatttggttcttaggctacgtggcggcattattgagccgtctttgatggcactggctaggaaatataaccaggacaagatgatatgccgcaaatgttatgctcgtctacaccctcgtgctgttaactgcagaaagaagaaatgtggacatagcaatcagttgaggccaaagaagaagatcaagtaaacatgtcaccgatttaacctgttgcagcttttctgccttgaccgatttaaacaatttaggatttgcatttgcttgtagtggaagatataaacctcttatctatttgttttgtttggaatgctcagaaatcaaagacattatgcagaaatgatgattaaggtgtctaatacaatagatttccctacccacaacgccaatgaactcgttttcttctttcttttcgtggattcgttgtgggtgatcctagtgtatttggaattatatgccaacattcaagaaaatgagcagaggtcaattctctaaaaaatgcg

SEQ ID NO: 11603 - DNA, 570 bp, Allium cepa
agataatcgtctcatctgttccgaaacggattcgtcctcccgcaaaaatgcagatcttcgtcaaaaccttaaccggaaaaacaatcactcttgaagttgagagctccgataccatcgctaatgtcaaagccaaaatccaggacaaagaaggaattcctccggaccagcagaggttgatttttgctggaaagcagctcgaggatggtcgtaccttagctgattacaacattcagaaggaatcaacgttgcatttggttctgaggttgagaggtggtattattgagccttctctaatggctcttgctaggaagtataatcaggataagaccatttgccgcaagtgctatgcaagacttcatccaagggctgtcaattgcaggaagaagaagtgtggccacagcaaccagttgaggcccaagaagaagatcaagtagatgcttgttcctgccgctggatgccttttaggcttttattttcattttcagagatcccttgttaagttttcgttattcgagttgttcacatgatttcattttattttgtgctttgttacagatttttgttaagtgc

SEQ ID NO: 11604 - DNA, 736 bp, Allium cepa
ccattacggcctagttacgggggatcatccgcaatcaaagatgcagatcttcgtgaaaaccctaaccgggaaaaccattactctcgaagtcgaaagctctgatacgatcgacaatgtgaaagccaaaatccaagacaaagaaggaatccctcccgatcagcagaggttgatctttgccggaaagcagctcgaggatggtcggactttggccgattacaacattcagaaagagtcgactttgcatttggtgttaaggttgagaggtggacttattgagccctcccttatggctcttgcaaggaagtataatcaggataagaccatatgccgcaagtgctatgcaagactccaccccagggctgttaattgcaggaagaaaaagtgtggtcatagcaaccagctgaggcccaagaagaagatcaagtagatgactggttctctattctagttgttttcttttaaattatttcgagctttgtgttattgaatcttgaacataattttgcttttctaaaatatttcgtaatatgagactttttagaagtcgtcatttcggagaatattgtgtctgatgaatgactgatttaaaagaatttcagaatattaaaggtgtattttatagtgaattatttcgatgattgagacaaaactaggatatagtatgcaatgaacaatgtaactggtgatctggaatcagtagaagcttaaacgagggataatgaaataatcaacataa

SEQ ID NO: 11605 - DNA, 707 bp, Allium cepa
caacaatgcagatctttgttaaaaccctaacagggaagacaatcaccctagaagtcgagagcagcgacacaatcgataatgtcaaagctaaaatccaagacaaagaaggaattcctccggatcagcaaaggctgatttttgcaggaaaacagctcgaagatgggagaactctagctgactataacatccagaaagagtctactttgcatttggtgttgaggttgagaggtggacttatcgagccttctctgatggcacttgcaaggaagtacaaccaggataagacaatttgccgcaaatgctatgcaaggttgcatcctagggctgtcaattgcagaaagaagaaatgtggccacagcaatcagctaaggccgaagaagaagatcaagtaggcactttggtcagttatttattgtgacggtgaaaatatgatggggaaccattcatttattcactttttatttatttactgaacaaatattttggtgtactttgcatcttgaattgaattatctgtggaccattaggaatttcaacactatttcctcgtgttatacatgcttattttttagttgcttgtctatgttgaatttgtctttcctgattttgtcacttcatttcaagttcttatatattgctttgtttgattttttgtgggctgtccatgtgttttgtagtcgagttaaaatgccttttgaactcctacc

SEQ ID NO: 11606 - DNA, 674 bp, Allium cepa
tcttcccgcagataacacaaaccctagccagtagaaacagtataaattttggccgtcaggtgctagaacttcatcatccgcaatcaaagatgcagatcttcgtgaaaaccctaaccgggaaaaccattactctcgaagtcgaaagctctgatacgatcgacaatgtgaaagccaaaatccaagacaaagaaggaatccctcccgatcagcagaggttgatctttgccggaaagcagctcgaggatggtcggactttggccgattacaacattcagaaagagtcgactttgcatttggtgttaaggttgagaggtggacttattgagccctcccttatggctcttgcaaggaagtataatcaggataagaccatatgccgcaagtgctatgcaagactccaccccagggctgttaattgcaggaagaaaaagtgtggtcatagcaatcagctgaggcccaagaagaagatcaagtagatgactggttctctattctagttgttttcttttaaattattgtgagctttgtgttattgaatcttgaacataattttgcttttcgaaaatatttcgtaatatgagactttttagaagttgtcattttggagaataagtttattggatttgtgtctaatgaatgactgatttaaaagaatttcagaatattaaaggttt

SEQ ID NO: 11607 - DNA, 744 bp, Allium cepa
cgcaatcaaagatgcagatcttcgtgaaaaccctaaccgggaaaaccattactctcgaagtcgaaagctctgatacgatcgacaatgtgaaagccaaaatccaagacaaagaaggaatccctcccgatcagcagaggttgatctttgccggaaagcagctcgaggatggtcggactttggccgattacaacattcagaaagagtcgactttgcatttggtgttaaggttgagaggtggacttattgagccctcccttatggctcttgcaaggaagtataatcaggataagaccatatgccgcaagtgctatgcaagactccaccccagggctgttaattgcaggaagaaaaagtgtggtcatagcaatcagctgaggcccaagaagaagatcaagtagatgactggttctctattctagttgttttcttttaaattattgtgagctttgtgttattgaatcttgaacataattttgcttttcgaaaatatttcgtaatatgagtactttttagaagttgtcattttggagaataagtttattggatttgtgtctaatgaatgactgatttaaaagaatttcagaatattaaaggtttgttttatagtgaattatttcgatgattgagacaaaactaggataaagtatgcattgaacaatgtaactggtgatctggaatcagcagaagcttaaacgagggataatgaaataatcaacataacaagttatattgtgatttgttttc

SEQ ID NO: 11608 - DNA, 765 bp, Citrus sinensis
aatctcgtaaccaaacaagagccatacagcccactaaaaccctaatcgtgaacagagtccttcatatataaacaaatcccaaaatcggctaattgcaaacgagctagagagagagagagagagcgagaggaaaaggagaaaaagggggaaaaaaatgcagatcttcgtgaaaaccctaacggggaagaccattaccctcgaggtcgaatccagcgacaccatcgacaatgtcaaggccaagatccaagacaaggagggtattccgccggaccagcagagacttatcttcgctgggaagcaacttgaggatggccgtactctagccgattacaatatccaaaaggagtcaactctgcatctggttctgaggcttcgtggtggtattattgagccttctttgatggcattggcaaggaagtataaccaggacaagatgatctgccgaaaatgttatgcacgcctgcacccccgtgctgtgaactgcaggaagaagaaatgtgggcacagcaaccagctgaggccaaagaagaagatcaagtagatattctgcagagaaatgctacattttatactgaaacaggatgttttgcctagaatatgtagcatcaactattgcctagtaatagttgtcacttagtacgtgatttctgtttcaagatgtttccagggttgagagtatttgtagactgattactatcgcctctatgtgccgtgacattgagcactttattataacttgcctgaatctactattttcttacactg

SEQ ID NO: 11609 - DNA, 972 bp, Citrus sinensis
tttttttttttctcccttctctcaaagggcataaacagaacgtgtgctagcctattggcaaaactgatttcatcccaagaaacttgcttcgggcctgtgtgttgggcccaatttaaggactcactacgacatcgtttagcaaagaaaccctaaccaagttctataaaaccctaatgacttgccagtcagctgccgtccttggaaaatcatcagagcgtgaagatgcagatcttcgtgaaaaccctaaccggaaagaccataactctcgaagtcgagagcagcgacaccatcgacaatgtcaaagctaagattcaagacaaggaaggaattcccccggatcagcagcgtctcatcttcgccggaaagcagctcgaagatgggcgtaccttggctgattacaatattcagaaagaatccactcttcatttggtgctgaggcttaggggaggtatcattgagccttcattgatggctttggctcgcaaatacaatcaggataagatgatttgccgcaaatgttatgctcgtctgcatcccagggctgtaaattgccggaagaagaaatgtggccacagcaatcagttgaggcctaagaagaagatcaagtagaccacttgccttagtcatgatatgtgccttcagagagacattccaattatgagatgtattttgtttgtttttgaataggatttgggatttgaattaagcgatcatctaagttggattgtagttgattcagttcaagtgcaattctgttaaacttttacggtatgaaattgggatatatttttgagctaattttgtttcattgtcggtgtaatttttgggacggatttatatcaaattgggatacataatctgcatgtattacaaaactcaaagatagcatcttgaaatacttacaacggcgttcacattaaatcctcataattaacaaatttaaaatttgggtttgcaactcaagagtcaaga

SEQ ID NO: 11610 - DNA, 606 bp, Carica papaya
aagttagagtaaggaggaaggcgaagatgcagattttcgtgaaaaccctaaccgggaagaccatcactctcgaggtcgagagtagcgacaccatcgacaatgtcaaggctaagattcaggacaaagaaggaatccctcccgatcagcagcggttgatttttgccgggaagcagctcgaagatggccgtaccttggctgattataatatccagaaagaatctacgcttcatctggtgttgaggcttaggggaggaatcattgagccttctctcatggctttggctcgcaagtacaaccaagacaagatgatttgccgaaaatgttatgcccgattgcatccaagggccgtaaactgtcggaagaagaagtgtggtcacagcaatcagttgaggcctaagaagaagattaagtgagctcttatgaagatcgttttctatgctgcaagagcttgatccatggtttctgactcatacatttgcttttttttttgttggagttattagtattcttctatgtccattctagaacagtggttgatctacttaaatgggaaccaaatttgttgaaggaattgaagatgaattccataactggaaaactagaggt

SEQ ID NO: 11611 - DNA, 733 bp, Arachis hypogaea
ggggttttgtgaggggggagaaagagagaggtagagaacaaagaaagatgcagatcttcgtgaaaaccctaacggggaagaccatcaccctggaggtggaatctagtgacaccatcgataacgtcaaggccaagattcaggacaaggaagggattccgccggaccagcagaggttgatcttcgccggaaagcagcttgaggatggccgtacactcgccgattacaacattcaaaaggagtcgacattgcatcttgttttgaggcttcgtggtggaattattgagccatctttgatggcattggccaggaaatacaatcaggataagatgatctgccgcaagtgttatgcacgtttgcaccctcgtgctgtcaactgcaggaaaaagaagtgcgggcacagcaaccagctgaggccaaagaagaagatcaagtaaactgttctgattgcaaccaatttcattagcgttttagtattatggggaatgtgttgaaaagtgtcctggcagttacgtttttttgaaagattttgttattcgggttgagtgtgttgccatcattggtgcttcagttccatgtgatgagacatgctttatgataataaaacatgtccacagcccacattatcggattctcatattttataatttacttgtgttatggtagcttcttgccagttacgagctatgagctactaatttactcggataatcataacactattctggctctatta

SEQ ID NO: 11612 - DNA, 776 bp, Arachis hypogaea
gcagtggtatcaacgcagagtacggggggaaccgaggttttgtgaggggggagaaagagagaagtagaaaacaaagaaagatgcagatcttcgtgaaaaccctaacggggaagaccatcaccctggaggtggaatctagtgacaccatcgataacgtcaaggccaagattcaggacaaggaagggattccgccggaccagcagaggttgatcttcgccggaaagcagcttgaggatggccgtacactcgccgattacaacatccaaaaggagtcgacattgcatcttgttttgaggcttcgtggtggaattattgagccatctttgatggcattggccaggaaatacaatcaggataagatgatctgccgcaagtgttatgcacgtttgcaccctcgtgctgtcaattgcaggaaaaagaagtgcgggcacagcaaccagctgaggccaaagaagaagatcaagtaaactgttctgattgcaaccaatttcattagcgttttagtattatagggaatgtgctgaaaagtgtactggcagttacctattttttaaagattttgttattcgggttgagtgtgttaccatcattcgtgcttcagttccatgtgatgagacatgctttatgataataaaacatgtccacagcccacattatcggattctcatattttacaatttacttgtgttatggtagcttcttgcccgttacaagctatgagctactaatttactcggataatcataacactattctggctctattattacgttgga

SEQ ID NO: 11613 - DNA, 811 bp, Arachis hypogaea
atatacatacatcaatctttagtaattgagtactactttaaatacataagcgtgcaaaataacaataagaaagcctttctatcacaggaatcgaccccgccactctgcgttgataccactgcttaagcagtggtatcaacgcagagtacgggggacggcgcagagcatcaccctaaggatgcagatattcgtgaaaaccctaaccggtaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacattcagaaggagtcaacgcttcatcttgtcctcaggcttcgcggtggcatcattgagccttctctcatggctttggcccgcaagtacaatcaagacaagatgatttgccgcaagtgctatgctcgccttcacccaagggcggttaattgccgcaagaagaagtgtggtcacagtaaccagttgaggccaaagaagaagatcaagtaaattctagattgtgctgttcttctcctgttgatgttggaatcggatcagtttttgatattatgttttctgttttagttaatgtcgaattgttttgagagtttattttggcaactaagaattatattgttatgatgatgacattatggtatcatttaagttacttattgtgttttgtaatgcacttagtcacttaaacgtttagcggtacagagcaatataataacaccaagggacctggttatcttt

SEQ ID NO: 11614 - DNA, 721 bp, Arachis hypogaea
agtggtatcaacgcagagtacgggggggcgcagagcatcaccctaaggatgcagatattcgtgaaaaccctaaccggtaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacattcagaaggagtcaacgcttcatcttgtcctcaggcttcgcggtggcatcattgagccttctctcatggctttggcccgcaagtacaatcaagacaagatgatttgccgcaagtgctatgctcgccttcacccaagggcggttaattgccgcaagaagaagtgtggtcacagtaaccagttgaggccaaagaagaagatcaagtaaattctagattgtgctgttcttctcctgttgatgttggaatcggatcagtttttgatattatgttttctgttttagttaatgtcgaattgttttgagagtttattttggcaactaagaattatattgttatgatgatgacattatggtatcatttaagttacttattgtgttttgtaatgcacttagtcacttaaacgtttagcggtacagagcaatataataacaccaagggacctgtttatcttgcaaaaaaaaagaaaaaaaacaaaagtactctgcgttgata

SEQ ID NO: 11615 - DNA, 658 bp, Arachis hypogaea
ggcgcagagcatcaccctaaggatgcagatattcgtgaaaaccctaaccggtaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacattcagaaggagtcaacgcttcatcttgtcctcaggcttcgcggtggcatcattgagccttctctcatggctttggcccgcaagtacaatcaagacaagatgatttgccgcaagtgctatgctcgccttcacccaagggcggttaattgccgcaagaagaagtgtggtcacagtaaccagttgaggccaaagaagaagatcaagtaaattctagattgtgctgttcttctcctgttgatgttggaatcggatcagtttttgatattatgttttctgttttagttaatgtcgaattgttttgagagtttattttggcaactaagaattatattgttatgatgatgacattatggtatcatttaagttacttattgtgttttgtaatgcacttagtcacttaaacgtttagcggtacagagcaatataataacaccaagggacctgtttatcttgcaa

SEQ ID NO: 11616 - DNA, 753 bp, Arachis hypogaea
ccctatcccctgtgtgccttggcagtctcagaagcagtggtatcaacgcagagtaggggggacggcgcagagcatcaccctaaggatgcagatattcgtgaaaaccctaaccggcaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacatccagaaggagtcaacgcttcatcttgtcctcaggcttcgcggtggcatcattgagccttctctcatggcattggcccgcaagtacaatcaagacaagatgatttgccgcaagtgctatgctcgccttcacccaagggcggttaactgccgcaagaagaagtgtggtcacagtaaccagttgaggccaaagaagaagatcaagtaaattctagattatgctgttattctcttcttgatgttggaatcggatcagtttttgatattatgttttctgttatagctaatgtcgaattgttttggagtttattttggctattttggcaactaagaattatattgttatgatgacattatggtatcatttaagttcctgattgtgttttgtaatgcacttagtcacttgaacgttcagcggtacagggcaatataataacaccaagggacctgtttatcgtgcaaaaaaaaagaaaaaaaaacaaaagtact

SEQ ID NO: 11617 - DNA, 559 bp, Capsicum annuum
tgcaaccccatttgagagagaagataagatgcagatcttcgtgaaaaccctaacgggtaagacgataaccctcgaagttgaatccagcgataccatcgacaatgtcaaggccaagattcaggacaaggaaggtattccaccggaccagcagcgactgatctttgctggtaaacagcttgaagatgggcgtacactggcggattataatatccaaaaagagtcgactctgcatcttgttctgaggctccgtggtgggatcattgaaccatcgcttatggcattggcaaggaaatacaaccaagataagatgatttgccgcaagtgctatgctcgtttgcatcctcgtgctgtgaactgcaggaaaaagaaatgtggtcacagcaaccagttgaggccaaagaagaagatcaagtagacagtcagttgtatttcctgtcaggatgttatgtcaattgcatgattttgtagttctatgtttagctcacattttggtggatctattgttatctgtttgactctggcacatttgcttcaactccagtttcaattataacaagag

SEQ ID NO: 11618 - DNA, 549 bp, Capsicum annuum
gtgaaagcttggtggtgagaggcggcgaaaatgcagatcttcgtgaaaactctgacgggtaaaaccataaccctagaggtcgaatccagtgacactattgacaatgtcaaggctaagattcaagacaaggaaggaattccaccggaccaacaaaggctgatttttgctggtaagcagcttgaagatggtcgcactcttgctgactacaacatccagaaagagtctactttgcatttggtgttgaggcttcgtggaggaattattgagccttctttgatggctttggctaggaagtacaatcaggacaagatgatttgccgcaagtgctatgctcgcttgcatccccgtgctgtcaactgccgcaagaagaagtgtggacacagcaaccagttgaggcctaagaagaagatcaagtagatgccgattttgaattcctgtctacatgtagttgctgatgttgagatccttgagaaactgattagatatattgttggtttgcctgttaaattttatcctaaagacattgttggatttgtgtttgatcttata

SEQ ID NO: 11619 - DNA, 521 bp, Capsicum annuum
tccatcataagagagaaagcgccgccaaaaatgcagatcttcgtgaaaactcttaccgggaagacgatcaccctcgaggttgaatcgagtgacactatcgacaatgtcaaagccaaaattcaagacaaggaaggtattccaccggatcagcagcgattgattttcgctggaaagcagctggaagatggacgtactttggctgattataacatccagaaagaatcaactttgcatttggttttgaggcttcgtggagggattattgagccttctctgatggctttggccaggaagtacaaccaggataagatgatttgccgcaagtgttatgctcgcctgcaccctcgtgctgttaactgcaggaagaaaaaatgtgggcacagcaaccagctgaggccaaagaagaagatcaagtaggcgctatatgttgttaagctagatgttatactgccagtctgtggtcttacagttttctgtcctgcttcaactttttgtaatggatactagcaattgtctttaac

SEQ ID NO: 11620 - DNA, 636 bp, Petunia hybrida
gaggcttgttggtgaaagctatacaaaaaatgcagatatttgtgaaaactctgactggtaaaaccataaccttagaggttgaatccagtgacactattgacaatgtcaaggccaagattcaagacaaggaaggaattccaccagaccaacaaagactgatttttgctggtaagcagctcgaagatggccgtacacttgctgattataacatccaaaaagagtcgactctgcatttggtgctgaggctacgtggtggaattattgagccatctttgatggctttggctaggaagtacaatcaggataagatgatttgccgcaagtgttatgctcgtttgcatcctcgtgccgtcaactgccgcaagaagaagtgtgggcacagcaaccagttgaggcctaagaagaagatcaagtagatggtggttttgaattcctttcagcatgtagctgccaatattgggatacttgagagactgatcaaaattttgttggaacattgatgttttggtgtttgagctatatcaaaatgttgggcaacttttatagttcttaatgagctagattttgatgttgattacatgcatctattaactttgtgaaagattagttgcatacacttttatctagctatttcca

SEQ ID NO: 11621 - DNA, 580 bp, Petunia hybrida
cgcggggattgccgaactaccgcaaaaaaataagatgcagatctttgtgaaaaccctaacagggaagaccattacccttgaagtcgaatcaagcgacactatcgacaatgttaaggccaagattcaggacaaggaaggaattccaccggatcagcagcgattgatttttgctggtaaacagcttgaagatggacgtacccttgctgattataacatccaaaaagagtcgactctgcatcttgtgttgaggctccgtggtggtattattgaaccgtctcttatggcgttggctaggaaatacaaccaggataagatgatttgccgcaagtgctatgcccgtctgcatcctcgtgccgttaactgcaggaagaagaaatgtggccatagcaaccagttgaggccaaagaagaagatcaagtaaactggcagttgcatttgctgttcgagatgttatatcgatgcactatttgtagtttttttcttaaatcagattttggtggacgtactgatgtatgtttaaccgcagcacatctgtttgaacttcagttctaattacataaaattttgttccgttttgagt

SEQ ID NO: 11622 - DNA, 609 bp, Lippia dulcis
ggcgactgcacggttgaggaaaaatgcagatctttgtgaaaacgctcaccgggaaaacaataacgctcgaggttgaatcgagcgacactattgataatgtgaaggccaaaattcaagacaaggaaggaattccaccggatcagcagcgtttgatttttgctggaaagcagctggaagatggccgcacacttgcggattacaatattcagaaagagtctaccttgcatttggttttgaggcttcgtggagggattatcgaaccgtcgttgatggctttggccaggaagtacaaccaggacaagatgatctgccgcaaatgttatgcgcggctccatccccgtgcagttaactgcagaaagaagaagtgtgggcatagcaaccagttgaggcccaagaagaagatcaagtagacgttcttatgcagtttttcccccgttgtcaaaactatttttattccagcagcctaactgcctatatgaatttcagccattttcgaatatgtggaccagttgctgttttttgtttaaatttggtaatgtcagaatattctatatatttagttgcctaaagttaagtcttttgttggaaattaaattacatttgttgttt

SEQ ID NO: 11623 - DNA, 750 bp, Lippia dulcis
tttccaagcaaaaatgcagatcttcgtgaaaactttgacaggcaaaaccataacgctcgaggttgaatcgagcgataccatcgacaatgtgaaggccaagattcaggataaggaaggaattccaccggatcaacagcgtttgattttcgcgggaaagcagcttgaagatggccgaacccttgctgattataacattcagaaagagtctactctgcatttggttctgaggctcaggggtgggatcattgagccatctctcatggcattggctaggaaatacaaccaggacaagatgatttgccgcaaatgctatgctcgcctgcacccccgcgctgtcaactgcaggaagaagaagtgtggacacagcaaccagttgaggccaaagaagaaaatcaagtagagtgctagctggataggagcttataatatcttcttgcatttgttagaggtcttagaaactactaaatttggcattttgctggtagacagacatttggaaatatttgatttatcccagatgtaacatagattatttgctttgtattctctgtaatttgggacaaggtgctcagtttttgttttggaaaagaatttggtaacgtgaagatcatgacattttagtagctattctggttcatgttcatttatccgaagaagattaaatccattgtgcgatcagatttagtttgagtcgaaattgtacgacaattaatttgataatctatacaattatattgcggtaaaaaagaa

SEQ ID NO: 11624 - DNA, 643 bp, Lippia dulcis
cgtcgactgtacaattgggagaaaatgcaaatcttcgtgaaaacccttaccgggaaaacaattacgctcgaggtcgaatcgagcgacaccatcgacaatgtcaaggccaaaatccaagacaaggaaggaattcctccagatcagcagcgtctgatctttgctggcaagcagctggaagatggccggacgctcgccgattacaatatccagaaagaatcgacgttgcatttggttttgaggcttcgtggaggaattatcgagccttccttgatggctttggccaggaaatataaccaggataagatgatctgccgcaaatgttatgcccgcctgcatccccgtgctgttaactgcagaaagaagaaatgtgggcacagtaaccagttgaggcccaagaagaagatcaagtagtcgtccagtgttttgcaagttatcaacaattcccctgaattttactccatttgcaactgcttttattggccttatattgggtttcttttcgcatggttaatgccagaatattaagatgttttggatactttatagttattactgcattgtgtttaatgtcagatgaaattgacatcaaagctaccagttaccttttctacttatttgttcttgtctccgcatcctattattg

SEQ ID NO: 11625 - DNA, 673 bp, Cajanus cajan
catttgttgagtctgagagggagtggaagcagcggaggcgcaaagatgcagatattcgtgaaaaccctaacggggaagaccatcaccctcgaggtcgagagcagcgacaccatcgacaatgtcaaggctaagatccaagacaaagaaggaatccctccggatcagcagcgtctgattttcgccggaaagcaacttgaagatggaaggaccttagccgattacaacatccagaaggaatccactctccaccttgttctcaggcttcgtggtggcatcatcgagccttcattgatggctttggctcgcaaatacaaccaagacaagatgatttgccgcaagtgctatgctcgtctgcatcctagggctgtgaactgccgcaagaagaagtgtggtcacagtaatcagttgaggccaaagaagaagattaagtaaattctggttgatactattggtctcttccatgttggactcaggggagggactgtttgttggtttacaaaattactgtttattgtttccggttttgattaatgttaaatgttttgaacgacatttttgtggtagtcaattatatttgttatgttgacattatgatctttttaagtggtagtttatgtttggtaatgcactctcatcgtagtaaattatatgctttcttatataatttttctct

SEQ ID NO: 11626 - DNA, 788 bp, Ananas comosus
aagatgcagatcttcgtgaaaaccctaacggggaagaccatcaccctcgaggtggagagcagcgacaccatcgacaatgtcaaggccaaaatccaagacaaggaagggatccctccggatcagcagcgactgatcttcgcggggaagcagctcgaggatgggaggaccctcgccgactacaacatccagaaggagtcgacgctgcatctggtgctgaggcttcggggtgggatcatcgagccctctctgatggctcttgcgaggaagtacaaccaggacaagatgatttgccgcaagtgctatgcacgtctacatcctagggctgtcaattgtcgtaagaagaagtgcggtcacagcaatcagctgaggccgaagaagaagatcaagtaaactcttgttctgtgtgctgtttagcactaaatgttgtttagacgtgaggctttgttttgtgctaggtttgatctgttatttgcattttaattttggaaaacccaactgccattttgctttcgcattttattttactttattattgaagtagaaagaatttttgaaattgatccctggatattttctttattttataattcgaatttatgggagcagggtgtgttcgcttgtatgctcgatacgcctcttaaatagatttctaatgcaggtcaggtgatgtgatgtgatatgttggtttccatatagtagtctagaagcccggaaaagtggccgggattattgccgttggcaagtttgagatgtttctgcaacattatgtttttcatggatcctttcat

SEQ ID NO: 11627 - DNA, 609 bp, Ananas comosus
gatgcagatattcgtgaaaaccctaacggggaagacaatcaccctcgaggtggagtcctccgacacaatcgacaacgtcaaggcgaagatccaagacaaggaagggattccgccggatcagcagcgcttgatcttcgcggggaagcaactggaggatggacgaaccctcgccgattacaacatccagaaagagtctacactacatttggtgctgaggttgagaggtgggatcattgagccctcgcttatggctcttgcccggaagtacaaccaggacaagatgatctgtagaaaatgctatgcacggttacacccgcgagctgttaattgtcgtaagaagaaatgcggccacagcaatcagctgagacctaagaagaagatcaagtgaaatagttctctgatcgagctttatttttcggtgcctaataggggaatttattgttattatcttttgctgcggcctattttcttcgcctcccccctgttctgaacatttttgacttgtgttactgctgaaccgttgttatgctctttggtcttatcaagtcgtttctgagcttatatctgacaagttgtattttcatcgagagcaagctatagtaccttttt

SEQ ID NO: 11628 - DNA, 873 bp, Ananas comosus
tggccgcaaaagacccgttgttgggtttcccatcgctcagccgcgaagatgcagatattcgtgaaaaccctaacggggaagacaatcaccctcgaggtggagtcctccgacacaatcgacaacgtcaaggcgaagatccaagacaaggaagggattccgccggatcagcagcgcttgatcttcgcggggaagcaactggaggatggacgaaccctcgccgattacaacatccagaaagagtctacactacatttggtgctgaggttgagaggtgggatcattgagccctcgcttatggctcttgcccggaagtacaaccaggacaagatgatctgtagaaaatgctatgcacggttacacccgcgagctgttaattgtcgtaagaagaaatgcggccacagcaatcagctgagacctaagaagaagatcaagtgaaatagttctctgatcgagctttatttttcggtgcctaataggggaatttattgttattatcttttgctgcggcctattttcttcgcctcccccctgttctgaacatttttgacttgtgttactgctgaaccgttgttatgctctttggtcttatcaagtcgtttctgagcttatatctgacaagttgtattttcatcgagagcaagctatagtacctttttgggggggggggggggggggggggggggcgcgacccccttttttagtgttcttagctgttgattctcccgaatgaaagaagtgaagtaaaaagaatttattatcttacgatgaaacaacaatctgggtcttttcttttgatagaaagctgtagtggtcctataaagttaaataagacctacacaaggtcacgttaaatattgtcaccgttattggttt

SEQ ID NO: 11629 - DNA, 708 bp, Ananas comosus
tgaaccctagccgtcaccttccccttccactcctgaaccctaaccctagccgtagctcgggcccttcggcggcgccggcgcagcgaagatgcagatcttcgtgaaaaccctaacggggaagacgatcacccttgaggtggagagcagcgacaccatcgacaacgtcaaggccaagattcaggacaaggaagggattccgccggatcagcagcggcttatcttcgccgggaagcagctcgaggatgggaggaccctcgccgattacaacatccagaaggagtcaacattgcacttggtgctgaggctgaggggtggtatcattgagccctctttgatggctcttgctaggaagtacaaccaggacaagatgatctgcagaaagtgctatgctcgtcttcatcctagggcagtgaactgtcgcaagaagaaatgtggtcacagcaatcagctgaggccaaagaagaagatcaagtaaatttctcagttgtttgcttcccgtgttatggtactactctatctgaatgctgaacatgtggtttggtattttcttgtacttccatatcactggttttagttttgttggctaaacagactatatcattttggcagtgctatattttagtcctcactgaagtagacttttcatcttttatattttccgcaaatgaaaacttttcctggaaattagtttttcaagatttgtctttc

SEQ ID NO: 11630 - DNA, 767 bp, Pinus taeda
aagtccactattgttgaggagaaattgttggcagcgagcaagatgcagatcttcgtaaagaccctgacgggcaagaccataaccttagaagttgaaagcagcgatacaatcgacaatgtgaaggccaaaatccaggacaaagaagggatcccgcccgaccagcaacgtctgatatttgcgggcaagcagttggaagatggacgcactctggcggattacaacattcagaaagagtcaaccttgcaccttgtgctgaggcttcgtgggggtattatagagccttctttgatggcattggccaggaagtacaaccaagacaagatgatttgcagaaaatgctatgctcgtctgcaccctcgagcagtcaactgcaggaaaaagaagtgtgggcatagtaaccagctgcggccaaagaagaaaatcaagtaaatgtgatgccgcattgagattttatatctctaaagtcattcatgttctatgattccccatcattttaggtggttgtgccttgtcaaaagcatcacttttaaaccatgcttggcttataagtaaagccttaacgtttttgatatcatatattaaattaaactgggaatctgactcataacaattttgtttttcagttcattatatctctgtctgtgttaaggttatgtattttttgagccttttgctttattgatctctatttaaattttaacatactagttagtaaatttgcgctgctgcagtctttgtaatatttatttgatgaacctttggagttg

SEQ ID NO: 11631 - DNA, 599 bp, Plantago ovata
gggggcgtcgtcttcaaagaggagctgctgtaggctgaaggcaacacaaacaggaaagcaaaaatgcagatcttcgtgaaaaccttgaccggcaaaaccatcacccttgaggttgagtcgagcgatacgatcgacaacgtcaaggctaagatccaagacaaggaaggaattcctccggatcagcagaggttgattttcgccggaaagcagctcgaagatggccgtacccttgccgattacaacatccaaaaagaatctacactccatttggtgctgaggcttaggggtggaatcattgagccttctctcatggcgctggcccgtaagtacaatcaggacaagatgatctgccgcaagtgctatgctcgtctgcaccctcgtgctgttaactgcaggaagaagaagtgtggacacagcaaccagttgaggcccaagaagaagatcaagtagactgctcgccgtgggagctgttatctctacttgttttttaagattaattgtcgtctgttgaacaaattgtgtggcattttgccatagacattctgaagttttgttagctatgtaacttaaaatgattttatttcagttctctgaatttg

SEQ ID NO: 11632 - DNA, 679 bp, Plantago ovata
gggcagctgaaaacaaaatgcagatattcgtgaaaaccctaaccgggaaaaccatcacccttgaggtcgaatcgagcgacaccatcgacaatgtcaaggctaagattcaggacaaggaaggaattcctccggatcagcagaggttgatcttcgccggtaagcagctcgaagatggtaggaccttagctgattacaacatccagaaagagtccacactccatctggtgttgaggcttaggggaggtatcatcgagccttctctgatggcattggccaggaaatacaatcaggataagatgatttgccgcaaatgttatgcccgcttgcacccacgtgctgtcaactgcaggaaaaagaaatgtggccacagcaaccagttgaggccaaagaagaagatcaagtagactgttcttcttgtgtgttgttttatttgttgtcaatggagagatctgttgtattcggcattacctacaacttggtgtttcttgaatgtaattctgtaccatggattttatctaagaatttagcttggatttggattgcatgtttaatgtaattcatagtgcttgtgtgtgtagagtaggtatgtcaatttcagattatggattggatcctattcaactctaaattgattggaatcataaatgtctcataaattgagttattatatggatttgga

SEQ ID NO: 11633 - DNA, 637 bp, Platanus occidentalis
agggcgagagacaggagagggaaagatgcagatctttgtgaaaaccctaacggggaagactataaccctagaggttgaaagcagtgataccattgataatgtcaaggcaaagatccaagacaaggaaggcattcctcctgatcagcagaggttgatcttcgccggaaagcagctcgaagatggtcgaaccctagcggactacaacatccagaaagagtctacgctgcatcttgtgctgaggcttcgtggaggaattatcgagccttctttgatggctttggctaggaaatataaccaggacaagatgatttgccggaagtgctatgcccgtctgcatccaagggctgtgaattgcaggaagaaaaagtgtggtcatagcaatcagctgaggcctaagaagaagatcaagtgagctgttgcacttctagttgcaccaatgttgttgcatctggtgggagaatcagatagttggtttattttggaatggattttgttgctatttgttctttatatgaatttaaatggctgattacattgctacaagattttggttggaagtaacttaaccagttaatagtatgttttgattgaacatcacccagtttacttcagcaatgacttcattattattttctag

SEQ ID NO: 11634 - DNA, 727 bp, Platanus occidentalis
aaagagggaaagatgcagatcttcgtgaaaaccctaacggggaagacgataaccctagaggtagagagcagtgataccattgacaatgtcaaggctaagatccaggacaaggaaggcattcctcccgatcagcaaaggttaatctttgccggaaagcagctcgaagatggtcgaactctggctgactacaatatccagaaagagtctacactccatcttgttctgaggcttcgtggaggaattatcgagccttctttgatggccttggctaggaaatataaccaggacaagatgatttgcaggaagtgctatgctcgtttgcatccaagagctgtgaattgccggaagaagaagtgtggtcatagcaatcagttgaggcctaagaagaagatcaagtgagctgctgtgagtctagtctgcgaccagggggagaatgcactggtattcacatctgtaggtcgttttagtttggaattgatttcatctcctttgttttgatttagattttcatttgattcagattgtgccgaatgcattttttgttgaagtacaaggattgcaaaatttagtaagttatatcgtggtgcgaataatttttccaatgtcgtggaatttcaccattgatagtattacaagtagtgttatcaataaataattatcatggtcagaacctccaagaagctgagaacattgtacattgagattcagcatctgaaccacaggcaat

SEQ ID NO: 11635 - DNA, 618 bp, Platanus occidentalis
cgagaagtaaagaagaagaagatgcagatcttcgtgaaaaccctaaccgggaagaccataactctcgaggtcgaatcgagcgacacaatcgacaatgtgaaggctaagattcaggacaaggaagggattcctcctgaccaacagcgactgattttcgctggaaaacagctcgaagatggccgtactttggctgattacaatatccagaaagaatcaacgctgcatcttgttttgaggcttcgcggtgggattatcgagccttctttgatggcgttggctagaaagtataaccaggacaaaatgatctgccgcaaatgttatgcccgcttgcatcctcgtgctgtcaactgcaggaaaaagaaatgtggacacagcaaccagttgaggccgaagaagaagatcaagtagatcggtttgcgaaggttctggtaggcgtagtggtagttcaatggatacattttaggatgaccttgaaattctgctataggactggaagtggacttatgacactgattacggacatgtgtttccttttataatatgactggtgagcttgttttgctgtctgaacctttattgccttaaccatttgcgaaagaatgaagagaggactctcct

SEQ ID NO: 11636 - DNA, 693 bp, Podocarpus macrophillus
gaagtgcacatcttttacgttttacaggacaaagtttgcgaggagagcagatcagtggaagggaggaagcaagatcagtgaagatgcagatcttcgtgaagaccctgacggggaagactatcactttagaagtcgaaagcagcgatacaatcgacaatgtcaaggccaagatccaagacaaggaaggaattccgccggaccagcagcggctgatatttgccggaaaacagttggaagatggtcgcactctcgccgattacaacattcagaaagaatctacgctacaccttgtgctgaggttacgcggtggaatcattgaaccatctctgatggcattggctaggaagtacaatcaggacaagatgatctgcagaaaatgctatgctcgtttgcaccccagagcagttaactgcaggaaaaagaagtgtgggcatagtaaccagctgcgaccaaagaagaaaatcaagtaaattggatgtgttaaagggagatcttgcttgttagaagttctcatttattttagagtggtttcatgtacaacttcaatggtatggggtaaaggtgacacagactaggttttttgaaatttgattctacagtgcaatgccattatgacattttgcagttatgatttggaggatatcaattttgacattttgctcttctgatgtggaagatatcaactctgacatt

SEQ ID NO: 11637 - DNA, 680 bp, Podocarpus macrophillus
gcaagatcagcgaagatgcagatcttcgtgaagaccctgaccgggaagacaatcactttagaagtcgaaagcagcgataccatcgacaatgtcaaagccaagatccaagataaagaagggattccgccggaccagcagcggttgatattcgctggaaagcagttggaagatggccgcactcttgctgattacaatattcagaaagagtctaccttgcaccttgtgctgaggctgcggggtggaataattgagccgtcgctaatggcgttagccagaaaatacaaccaggacaagatgatctgcagaaagtgctatgctcggttgcatcccagagcagttaactgcaggaaaaagaagtgcgggcatagtaaccagttgcgaccaaagaaaaagatcaagtaggggtaaactgtatgtttaagagtatgatcacaaaaatattaggcttcaaaggccatcttaaattgttactgtgaaagcatgctgcctttaagaagattttctttcatggtcggaaatacgatttaaagtatttgtccagcctttttcctgtattattttcaatgcttcttgaagttaaagaaaactttatgtgttaatcattgaaattttattgtagaacctgcaatgatatttttataactttctgttgtagccagacattagtagatgaaccataa

SEQ ID NO: 11638 - DNA, 584 bp, Papaver somniferum
agagagaagaaaaaaatgcagatcttcgtgaaaaccctaactgggaaaacaatcacccttgaggttgagagcagtgataccatcgataatgtcaaggctaagatccaagataaggaaggaattcctccagatcagcagagattgatcttcgctggaaaacaacttgaagatggccgtaccttggctgattacaacatccagaaggaatctacacttcatttggttttgaggcttcgtggaggtattattgagccttctttgatggctttggctaggaaatacaatcaagataagatgatttgcaggaaatgctatgctcgccttcatccaagagccgtgaactgtagaaagaagaagtgtggtcacagcaaccagttgaggcccaagaagaagatcaaatgagcactggtgttgcaagctgttgtgggaggtggtagaagtgcattttgtgttgtctcaaatctcctaagtttgtttagttttggaacctgactttattgttatcttcagttgactatgttcttcccctatatcacattcacctataaaattttgtttgaagtatgtttgaatttcttaagtca

SEQ ID NO: 11639 - DNA, 600 bp, Papaver somniferum
ttttagagaggcgaagaggtagagagaagaaaaaatgcagatcttcgtgaaaaccctaactgggaaaaccatcacccttgaggttgagagcagtgataccatcgataatgtcaaggctaagatccaagataaggaaggaattcctccagatcagcagagattgatcttcgctggaaaacaacttgaagatggccgtaccttggctgattacaacatccagaaggaatctacacttcatttggttttgaggcttcgtggaggtattattgagccttctttgatggctttggctaggaaatacaatcaagataagatgatttgcaggaaatgctatgcccgccttcatccaagagccgtgaactgtagaaagaagaagtgtggtcacagcaaccagttgaggcccaagaagaagatcaaatgagcactggtgttgcaagctgttgtgggaggtggtagaagtgcattttgtgttgtctcaaatctcctaattttgtttagttttggaacctgactccactgttatcttcagttgactatgttcttcccgtatatgacaattcacctataaaattttgtttgaagtaatatgtttgaatttct

SEQ ID NO: 11640 - DNA, 860 bp, Papaver somniferum
acaaacttctgaaaaacaggatgcagatcttcgtgaaaaccctaactgggaaaacaatcaccctagaggttgaatcaagtgacacaatcgataatgtcaaggctaagattcaggacaaggaagggattcctccggatcaacagagattgatctttgcgggtaaacaactcgaagatggccgtactcttgctgactataatattcagaaagaatcaactcttcatttggttctgagactccgtggtggaattattgaaccatctttgatggccctagcaaggaagtacaaccaggacaagatgatctgcaggaagtgctatgcacgtcttcaccctcgtgctgtcaactgccgcaaaaagaaatgtggacatagcaaccagttgaggccaaaaaagaagatcaaatagatcttttgtgggactctagtactgttacttacgttggaggaattcaggaagggagtttagatgtttaagattagactttagttcttagttattttcttttgattctgttgagccataatggatggttatggacctctcaaatatgttacctttatgaacttcaaatcatgtctatttagacctttttactctagtatttttgtgagatcttctctgtacggttaagtacttctggtgggctttttttccttccaattctgtgttcaaaaacgtcatatcccatgtgctgcaccctatgttggtggaactctctacctctttaagcaactggtttttcaaagcctttggcttctcttttttactgggaaaacagtattatcgttctttcgagcggcgatgccaactcttattcatctggctttccagtgttataccgccttgtgctcgtaaaaa

SEQ ID NO: 11641 - DNA, 693 bp, Primula obconica
gagagcggctcaaagaggagagagaaaatgcagatattcgtgaaaaccctaaccgggaagacgatcactcttgaggtcgaatccagcgataccatcgataatgttaaggctaagatccaagataaggaaggtatccctccggaccagcagaggctgatctttgctggaaagcagcttgaggatggacgtactcttgctgattacaatatccaaaaagaatccacacttcatctggttctgaggcttaggggtggcattatcgagccttctttgatggctttggctaggaaatacaaccaggacaagatgatctgcaggaagtgttatgctcgtctgcacccacgtgctgttaactgcaggaagaagaagtgcggacacagcaaccagctaaggcccaagaagaagattaagtagacgattaatcaaagctttggtgtatttgccagtggtctatccgatattttgctggcctgctctttggtcttttaagtttcaaaactagtgtttttgttccagactgttttctgcttttcgcttattaagatgctgttgcttcaccttaattctcttgtttgtctttcaaagcttaatggaaacgaaatattgttgattctagtttgtgcggaaatattgctttatcatgtgttggcttgatcagctataatgctttatcatgagttggtcggttttttt

SEQ ID NO: 11642 - DNA, 763 bp, Pseudotsuga menziesii
ggaaattgttcattgttttgttcaattttcttcgagggaaatttttggcagcgatcaagatgcagatcttcgtgaagaccctgacgggcaagaccataaccttagaagtcgagagcagcgataccatcgacaatgtcaaggctaaaatccaggacaaagaagggatcccacctgaccagcaacggctgatctttgcgggcaagcagttggaagatggccgcaccttggcggattataatatccagaaagagtctacattgcaccttgtgctgaggctccgtgggggtattatagaaccttcgttgatggcgctggctaggaagtacaaccaagacaagatgatttgcagaaaatgctatgcccgtttgcaccctagagcagtcaactgcaggaaaaagaagtgtgggcatagtaaccagttgaggccaaagaagaaaatcaagtaaatgttatgctggatcgagatttttataactcgaaatacattttattctatttccccatcattttagggctgttatgccattgcgaaaagcatcacttttaagtcatatttcgcttttaagcaaaacggtcgtttgattggatatatcaagtttcgagcttcaagttggaatatttttcttaagaattctgatttgcagtttattatttatgcgggtcagtgttatgtgttttagagcttttgttcgacggatctctaacattctaaaatactattaaaattttgctatgagttgcaatctttggagtttactaaagc

SEQ ID NO: 11643 - DNA, 835 bp, Pseudotsuga menziesii
caaaccttgaatttaaacggagttagcctcaaaccctacataaaaccctaatttcaaaccctaccaccgaaaacagtcattaaaagcagataacatatcattcaaaagagtttttatcagcgtgagatcgattcgtcggcaagatgcagatcttcgtgaaaaccctcacagggaaaaccataaccctcgaggttgagagcagtgatacgatcgacaatgtgaaggccaagatccaggacaaagaagggatcccacctgaccagcagcggttgattttcgccggaaaacagctggaagatggccgtactcttgctgactacaatattcagaaagagtctacactgcaccttgttttgaggcttcgtggagggattattgaaccttcattaatggctttggcaaggaagtacaaccaggacaagatgatttgcagaaagtgttatgcccgtttgcatcccagggcagtgaactgcaggaaaaagaagtgcggacatagtaatcagttgaggcctaagaagaagatcaagtaaagcggctgagtttcaagcagatggttatctgtactattttttgctaatcaattttcattgcctttgataagccaactggatcagatgattattttcttaaaaaagaatggatgttactatcatgtatactgcatgactggactggatgtgtgtcctgaaatttatctgtgtttccaattgggccagtttggaaaagttgaagatttgtttctggatttgagtttgaagttgtttactttttaacagagattagattttagtacgttgcccttttcatttgatttatgtgatttactgcattttct

SEQ ID NO: 11644 - DNA, 633 bp, Pteridium aquilinum
gagcagggttaggaaaatgcagatcttcgtgaaaaccctaacggggaagaccataaccctagaggtcgaatccagtgacactatcgacaacgttaaggctaagatccaggacaaggaaggtatcccaccggaccagcagagattgatcttcgccggaaagcagcttgaggatggccgtactcttgccgactacaacattcagaaagagtcaaccttgcatctggttctgaggcttcgtggtggcattattgagccttctttgatggcattggctaggaagtacaaccaggacaagatgatctgccgcaagtgttatgctcgtctgcacccccgtgctgtgaactgcaggaaaaagaagtgtggacatagcaatcagttgaggccaaagaagaagatcaagtagattgcaaaatttgagggaggaattctacatttagtattattagatttctggttgttatttttggacaatatagttctaaataacagacatcttgactatcccaaagatagctttaatttcattaagttgaacctcttttggtgcatgtgattttgtttgtctttgacagtgagttttcttattttgatataatgatggtttcatttctacaaaaaaaaaattggcccgct

SEQ ID NO: 11645 - DNA, 647 bp, Raphanus sativus
gggaccgattagaagacgaacctcaaagagatgcagatcttcgtgaaaaccctaacgggcaagaccatcactctcgaggtcgagtcctccgacaccatcgacaatgtcaaagccaagatccaagacaaagaaggtatccctccggatcagcagcgtctgatcttcgccggtaaacagctcgaagatggccgtactttggctgactacaacatccagaaagaatcgacgcttcatcttgtgttgaggcttaggggaggtatcattgagccttctttgatggcgttggctcgtaagtacaaccaagataagatgatttgccgcaaatgctatgctcgtcttcatccaagagctgtgaactgcaggaagaagaagtgtggccatagcaaccagttgaggcctaagaagaagatcaagtagactcgtttcaagaatctatcttgtttgcctctttttaattatctttcccttgactacgtcgtttttatgttatgtgaacagattatatcagtaaaatgattggttttcaatattggtttcctttattcctttatctatatgtttgtttctgattgtcttcttccgaaatatggttgcagtaatttacaagtgtacaatcattaattattctatcgaaatatgcttgcagt

SEQ ID NO: 11646 - DNA, 576 bp, Raphanus sativus
gtggacagcagacgaaactcactcaaaagatgcagatcttcgtgaaaaccctaaccggaaagaccatcaccctcgaggttgagtcctccgacaccatcgacaatgtcaaggccaagatccaagacaaagaaggtatccctccggatcagcagaggttgatcttcgccggtaaacagctcgaagatggccgtactttggctgactacaacatccagaaagagtcgacgcttcatcttgtgttgaggcttaggggaggtatcatcgagccttctttgatggctttggctcgtaagtacaaccaagacaagatgatttgccgcaagtgctacgctcgtcttcacccaagggctgtgaactgcaggaagaagaagtgtggccacagcaaccagttgaggcctaagaagaagatcaagtagactcgattcaagaacctgatctcttgcctccgttttttttgttttgttttgtctcacccttgataaggttgtttttgcttcagtgaaatttgatgttcaaagattttatcagtaaaaggatttggtttcctattcatgcttaatcattattccattctgc

SEQ ID NO: 11647 - DNA, 840 bp, Raphanus sativus
gagagacaagtggtgagcaccgaaagaaaggaaaagaaagagtttcatgtttcttgtttttttgcagtaaatgagtagaaagagataagagatatcttccaaaacgtttaatcgggctataattaacctttcactctgcgttgataccactgcttacggccgggggactgatacttgcggcggagaagaagatgcagatattcgtgaaaacgctgacgggcaagaccatcaccctcgaggtggagagcagtgacaccatcgacaatgtcaaggccaagatccaggacaaagaaggaatcccaccggatcagcagaggttgatcttcgccggaaaacagcttgaggatggtcgcaccttggctgactacaacatccagaaagagtcgactctgcatcttgttctgaggttaaggggaggtatcatcgagccttctttgatggctttggcgcgcaagtacaatcaagacaaaatgatttgccgcaagtgttacgctcgtctgcacccaagggctgtcaactgcaggaagaagaagtgtggacacagcaaccagttgaggccgaagaagaagatcaagtgatctgttttcttcacaacaaacttatttatctatgttttttttttccttgaaagacatctctagtgttttgacacaaactttgtttcagtgaattttaatcataaaagattgttgtttagtaaatctttttatctttggctttttttctttttacaaattccatccttctatagtcgtattcagtttgctaatagttgtgttagtttttatatcaattttattttcatgtagttttagttaagctaccattgagcaaaagctt

SEQ ID NO: 11648 - DNA, 594 bp, Raphanus sativus
gttgatagaagacgaaactaactcaaagatgcagatcttcgtgaaaaccctaaccggaaagaccatcaccctcgaggtcgagtcctccgacaccatcgacaatgtcaaggccaagatccaagacaaagaaggtatccctccagatcagcagagattgatcttcgccggtaaacagctcgaagatggccgtactttggctgactacaacatccagaaagagtcgacgcttcatcttgtgttgaggcttaggggaggtattatcgagccttctttgatggctttggctcgtaagtacaaccaggacaagatgatttgccgcaagtgctatgctcgtcttcacccaagggctgtgaactgcaggaagaagaagtgtggccacagcaaccagttgaggcctaagaagaagatcaagtagactcgtttcaagaacctgatctctttcctcctttttttgttttgtttcgtctcgcccttgataaggttgtttttgcttcagtgaaatttgatgtttcaaagattttatcagtaaaaggattttggtttcctattcatgcttaatcattattccattctgcatatggttcttccgattca

SEQ ID NO: 11649 - DNA, 548 bp, Salvia sclarea
ggaacacgataagaaaaaatgcagatcttcgtcaagacgctcaccgggaaaaccatcacgctcgaggttgaatcgagcgacaccatcgacaatgtcaaggccaagattcaggacaaggaaggaatcccaccggaccagcagcgtttgattttcgccggaaagcagcttgaagatggccggaccctagctgattacaacatccagaaagagtcgactctgcatttggtcctgaggcttagggggggtatcattgagccttcgcttatggcattggccaggaaatacaatcaggacaagatgatctgccgcaaatgctacgcacgtctgcaccctcgcgctgtcaactgccgcaagaagaagtgtggacacagcaatcagttgaggccgaagaagaagatcaagtagactgctggattggtcgcttatcttgttgccattttgtcccctctactttagttattgccaatgaaaactaaatagtgttgatgttttctctgttagacattgaagcgaaatgacacatttgcaattttatattgttgaaatga

SEQ ID NO: 11650 - DNA, 637 bp, Salvia sclarea
actactagaccttggctgtcactcaggaggtgtagagagagccaaaatgcagatcttcgtgaaaaccttgacgggcaagaccataacgctcgaggttgagtcgagcgatacaatcgacaatgtcaaggccaagattcaagacaaggaaggaatccctccggaccagcagcgtctaattttcgctggaaagcagctggaagatggccgaactcttgctgattataacattcagaaagaatctaccctgcatttggttctgaggcttaggggtggaatcatcgagccgtcccttatggctttggctaggaaatataaccaggacaagatgatttgccgcaaatgctatgctcgcttgcacccacgtgctgtcaactgcaggaagaagaagtgtggacacagcaaccagttgaggccaaagaagaagatcaagtagattatgaggtggatgagttttatttgtttggttttgttggatgaatgactttgaactacataatgtagcttttgctgatacgtttcagaattttggtgatgtggctttggttaatttacaatgagaaacccaaacttcaattatcaactcgttattggttaatgggagtgtgttatcacttgccatagttctttcttttctctg

SEQ ID NO: 11651 - DNA, 565 bp, Salvia sclarea
ctactagaccttggctgtcactcagaaaattcctgtggagagcgccgaccgcgattaggaaaaatgcagatcttcgtcaagactctcaccgggaagaccatcacgctcgaggtcgaatccagcgacaccatcgacaatgtcaaagctaagatccaggataaggaagggatcccaccggatcagcagcgtctgattttcgccggaaagcagcttgaagatggccgaactctcgctgattacaacatccagaaagagtcgactctgcatttggtgctgaggcttcgtggtggtatcattgagccttcgctcatggctttggctaggaaatacaaccaggacaagatgatctgccgcaagtgctacgctcgtcttcaccctcgtgccgtcaactgccgcaagaagaagtgtggccacagcaatcagttgaggccgaagaagaagatcaagtagactgctggattgattgttcgccttgttgccattttgtcccatttcccttttagttattccagtgaaactaaatagtgtttctgtttcctcttcgcagtgagtgacaggctagtag

SEQ ID NO: 11652 - DNA, 449 bp, Scabiosa columbaria
ctactagaccttggctgtcactcaattttgaaggccgggaggataaaggaaaagaagaaagatgcagatcttcgtgaaaaccctaacagggaagaccatcactcttgaggtcgaatcaagcgataccatcgacaatgtcaaagccaagatccaagacaaggaaggtattccaccggatcagcagcgattgatcttcgccggaaagcaacttgaggatggccgtactcttgctgattacaatatccagaaagaatcgacgttgcatctagttctgaggcttcgtggtggtatcattgagccatctttgatggctttggctcgtaagtacaaccaggacaagatgatttgccgcaagtgctatgctcgtcttcatccccgtgccgttaactgcaggaagaagaagtgtggacacagcaaccagttgaggccaaagaagaagatcaagtaga

SEQ ID NO: 11653 - DNA, 461 bp, Scabiosa columbaria
ggcggaggtgaaagctgcgaaagagaagaaaaaaatgcagatctttgtgaaaaccctaacagggaagaccatcacccttgaggtcgaatcaagcgacacaatcgacaatgtcaaggccaagatccaagacaaggaaggtattcctccggatcagcagcgtttgattttcgccggaaagcaacttgaggatggacgtactcttgctgattacaatatccagaaagagtcgactttgcatctggttctgaggcttcgtggaggtatcattgagccatctttgatggctttggctcgcaagtacaaccaggacaagatgatttgccgcaagtgttatgcccgccttcatcccagagctgtcaactgcaggaagaagaagtgtggtcacagcaaccagttgaggccaaagaagaagatcaagtagatgaatgagagttgcaagcatcttaagggccttgtttttc

SEQ ID NO: 11654 - DNA, 806 bp, Sciadopitys verticillata
aagcatacgtatgctaccatttctggtagtgaaggtgtgcaggaaaactggtgttaggtaacaagatgcagatcttcgtgaagaccctgacaggaaagaccattactttagaagttgaaagcagcgatactatcgacaatgtcaaggccaaaatccaggacaaggaaggcattccccctgaccaacagcgattgatatttgccggaaagcagttggaagatggacgcactctcgctgattacaatattcagaaagaatccacattgcaccttgttttgaggctccgcggtggaattattgagccttcgttgatggctttggccaggaaatataaccaggacaagatgatttgcagaaagtgctatgctcggctgcaccctagagcagttaactgcaggaaaaagaagtgtgggcatagtaaccagctgcggccaaagaagaaaatcaagtaaatgtgatggctctagggagtgttagtgtttttaaataaacctctttataagactatttatcatcgaagcgttgatctaaaactatgttgcttttaagcaaacttattttttgatctcaattgtgttgaacataaattgggctttgtattttcaattttgtgatttaaaattaaatatttccctgaatgtagagatttagagttcaataacctttagtagaaaacaaaaataggtgatctagttttgtgagattctatctcacaatccgcaatgtcatgatattgttggaaagcgagtgttaagtaaccctaaacattaaagactcttgttgtaaaatgatctattttcctgatc

SEQ ID NO: 11655 - DNA, 709 bp, Sequoia sempervirens
agggaagaagttcgggaggtaactaagatgcagatattcgtgaagaccctcacgggcaagactatcacgctagaggttgaaagcagcgatactatcgacaatgttaaggctaagatccaggacaaagaaggcatcccaccagatcaacaaaggttgatatttgcgggaaagcagctagaggatggccgtacactggctgactacaacatccagaaagaatcaactttacatctagtgttgcgtttgcgaggaggaattatcgagccttctttaatggctctcgcaagaaagtacaaccaagataaaatgatatgtcggaagtgctacgctcggctacacccaagagctgtaaactgcaggaaaaagaagtgtgggcacagcaaccaactgcgaccaaagaagaaaattaagtagatttgaagcttggagtatggtttaaggcaaatcaaacttctgttgttcaccttaaatctgtgttacttaaattaactttctgtccacaattttgttatttgaagttaagctctctgactttggagatttaatgcataatttaaatgatcttagtacaatatggccatagaagagtttgttgagattccactctattttgcaatttataattgtaggcaattggaagaccaattctatcattgttggaaacttattttttgttttcaatctgaaggatttgaaatccaaaacaaat

SEQ ID NO: 11656 - DNA, 611 bp, Sequoia sempervirens
agggaagaagtttgtgaggtagctaagatgcaaatattcgtgaagacccttacgggcaagacaataacgctggaggttgaatccagtgatacaatcgacaatgttaaggctaagatccaggacaaagaaggcatcccaccagatcaacaaaggttgatatttgcgggaaagcagttagaggatggccgtacactggctgactacaacatccagaaagaatctactcttcacctagtgttgcgtctccgagggggaattatcgagccttccctaatggcgttggctagaaaatataaccaagataaaatgatttgtcgcaagtgctatgctcggctacacccaagagctgtaaactgcaggaaaaagaagtgtgggcacagtaaccagctgcgaccaaagaagaaaattaagtagatttgaagcttggagtatgattaaaggcaaatcaaacttttgttgttcagtgttcaccttaaatctgtgttgacttaaattaaatttctgttcacaattttgttatttgaagttaaggtctctgaatttggaaatttaatgcataatttaaatgatcttagtacaatatggccatagtagagttttttgagattcca

SEQ ID NO: 11657 - DNA, 708 bp, Sesamum indicum
gttgtagcctaccaaagccggaagaatgcagatcttcgtcaaaaccctaaccggcaaaaccatcacgctcgaggttgaatccagcgacaccattgacaatgtcaaggccaagattcaggacaaagaaggaatccctccggatcagcagcgtctgattttcgccggaaagcagcttgaagatggccggacccttgctgattataacattcagaaagagtcgactctccatttggttctgaggcttaggggtggtatcattgagccctcactcatggcattggctaggaaatacaatcaggacaagatgatttgccgcaagtgttatgcccgcctgcaccctcgtgctgtcaactgcaggaagaagaagtgtggacacagcaaccagttgaggccaaagaagaagatcaagtagactgctggctggataattgcttggctttgccctttttgtctttgttttagattcttgccaatgagacacataatgtgggtgttttgctgattgacattaatattgatgaagctttaccctttcagttttgcaaccagatattgctgaaatgaatttggatttaatttacccaaaaggcttggctgccctctagcaattgttatgcttcctctgttgtccagtattagtaacttatgcctatggtgttacttgtggtgttgtataatgtttgtggcctctttactcttacctcggcg

SEQ ID NO: 11658 - DNA, 625 bp, Glycine max
ctctggaagaggagtgaagcagcagagggaggagcggcattaaaaatgcagatcttcgtgaaaaccctaacggggaagaccataaccctcgaggtcgaaagcagcgacaccattgacaatgtcaaggctaagattcaagacaaggaaggcatccctccggatcagcagcgtttgattttcgccggaaagcaacttgaagatggaaggaccttggccgattacaacatccagaaggaatcaacccttcaccttgtcctcaggcttcgtggtggcatcatcgagccttccctcatggctttggctcgcaaatacaaccaggacaagatgatttgccgcaaatgctatgctcgtctgcaccctagggctgtgaactgccgtaagaagaagtgcggtcatagtaaccagttgaggcctaagaagaagatcaagtaaattctgggtgggatattgttggtctctactttcgttttgtttgtcttagaacagtgacttgtttggtatttatcgtttctggttttgattaatgttaattgttttgagacaatagttttgaactagtcaattatatttttatgatgccattttggtcttagtcaattataatgttattatgacattttgatct

SEQ ID NO: 11659 - DNA, 662 bp, Glycine max
gcaggaaactaatagcagttttggaagagagggaaagatgcagatattcgtgaaaaccctaaccgggaagaccatcacccttgaggtggagtcaagcgacaccattgacaatgtcaaagccaagattcaggacaaagaagggattcctccggatcagcagaggttgatcttcgccggtaaacagctggaagatggccgtaccctcgctgattataacatccaaaaagagtcaacattgcatcttgttttaaggcttcgtggtggtattattgagccatctttgatggcactggcgaggaaatataaccaggataagatgatctgccgcaagtgttatgcccgtttacatccccgtgctgtgaactgcaggaaaaagaagtgtggtcacagcaaccagttgaggccaaagaagaagatcaagtaaactcttctgattgcaagatggaattttgtgttgtcatggattattggatgtcttgtaatcctgataactccattagcttcttagtactctagtaaatctttcggaaatttgacagtcagttactcttatgatttttgttttcagtttgagacggattgatattgattatgctacagttgcatgtgatgatacagttttatttttgataatactgcatgtgatgtctttatttcctgtc

SEQ ID NO: 11660 - DNA, 667 bp, Glycine max
ccgcctgcaggaaactagtagtagttttgaaagggaaggaaagatgcagatattcgtgaaaaccctaaccgggaagacaatcacccttgaggtggagtcaagcgacaccattgacaatgtcaaagccaagattcaggacaaagaagggattcctccggatcagcagaggttgatcttcgccgggaaacagctggaggatggccgtaccctcgccgattacaacatccaaaaagagtcaacattgcatcttgttttgaggcttcgtggtggtattattgagccatctttgatggcactggcgaggaaatataaccaggataagatgatctgccgcaagtgctatgcccgtttacacccccgtgctgtgaactgcaggaaaaagaagtgtggtcacagcaaccagttgaggccaaagaagaagatcaagtaaactgttctgattgcaagatggaattgtgttgtcatggattactgggatgtcttgtaatcctgataactccattagcttcttagtattatagtaaatctttcggaaatttgacagccaaagttactcgtgatttttgttttcagtttgagacggattgatatcaattatgctacagttcctggtgattatacagtttttgtttttgataataatgcgtgtcatgtctttatttcctgt

SEQ ID NO: 11661 - DNA, 621 bp, Glycine max
gttgtgtgagtgaagaagcagagggagtagcggcattaaaaatgcagatcttcgtgaaaactctgacagggaagactataaccctcgaggtcgagagcagcgacaccatcgacaatgtcaaggccaagattcaagacaaggaaggcattcctccggatcagcagcgtttgattttcgccggaaagcagcttgaagatggaaggaccctggccgattacaacatccagaaggaatcaacccttcatctcgtcctcaggcttcgtggtggcatcattgagccttccctcatggctttggctcgcaaatacaaccaggacaagatgatttgccgcaagtgctatgcccgtctgcatcctagggctgtgaactgccgcaagaaaaagtgcggtcatagtaaccagttgaggcctaagaagaagatcaagtgaattctgtgtgatattgttggtctcatccttcgtgttgttggatttggaacagggactggtttgatatttatagttctggttttgattaatgttaattgttttgagacaatagttttgaagtagccaattatattgttatgacgacattttgatctctcgtaagttgtatttcatgtttttgcaatgttctctt

SEQ ID NO: 11662 - DNA, 742 bp, Picea glauca
ttaattaaattaatcccccccccccccgaacggagttgatcgatcagggcgaaaagatgcagatattcgtgaaaaccctcacagggaaaaccataacccttgaggtcgagagcagcgatacgatcgataatgtgaaggccaaaatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaaagaagtgcggacatagtaatcagctgaggccgaagaagaagatcaaataaagcgtctgagtttgaagcagatagtttatctgcacaaatttttgctgatttattttcattgcctttaagaagccaattggattaaacgtttattttattaaaaaagattgtgactgcagaactggctctctagccagaatttatctttgtgcttccagttgggccagatttgaatagctgtagatgttatagttttgagtttaaagttgtgtttgttttttaaagagattaaatatttgtacgttgctcttttcattcaattatgtgatttactgcattttctaaaaaaaaaaaaaaaa

SEQ ID NO: 11663 - DNA, 764 bp, Picea glauca
tacaaaagcctcaaaagaaatgttttgagtgtttagtccacagttgtcgtggggaaattgggaaattgttggcagcgagcaagatgcagatcttcgtaaagaccctgacgggcaagaccataaccttagaagttgaaagcagcgataccatcgacaatgtcaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtgggggcattatagaaccttctttgatggcactggctaggaagtacaaccaagacaagatgatttgcagaaaatgctatgcccgtttgcaccctagagcagtcaactgcaggaaaaagaagtgtgggcatagtaaccagctgcgaccaaagaagaaaatcaagtaaaagttacgctgcattgagattttacatcctcttaatacattcatgttctattattccccatcattttaggttgttgtgccatgtcaaaagcatcacttttaaaccatactttgcttatagaaaaaccttcacgttttttgatattatatatgcattaaattaaattgggaatctttctcagaaggattttgatttgcagttcattatttctgtgttaaggttatgtattttttagcttttgttttactgatctctatttatattttaaaataccaattagtaaattcgtactaa

SEQ ID NO: 11664 - DNA, 699 bp, Picea glauca
aacggagttgatcgatcagggcgaaaagatgcagatattcgtgaaaaccctcacagggaaaaccataacccttgaggtcgagagcagcgatacgatcgacaatgtgaaggccaaaatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaaagaagtgcggacatagtaatcagctgaggcctaagaagaagatcaaataaagcgtctgagtttgaagcagatagtttatctgcacaaatttttgctgatttattttcattgcctttaagaagccaattggattaaacgtttattttcttaaaaaagactgtgactgcagaactggctctctagccagaatttatctttgtgcttccagttgggccagatttgaatagctgtagatgttatagttttgagtttaaagttgtgtttgttttttaaagagattaaatatttgtacgttgctcttttcattcaattatgtgatttactgcattttcta

SEQ ID NO: 11665 - DNA, 831 bp, Picea glauca
gaagcagattacgggctaccgaaaggagtttctaacggagttgatcgatcagggcgaaaagatgcagatattcgtgaaaaccctcacagggaaaaccataacccttgaggtcgagagcagcgatacgatcgacaatgtgaaggccaaaatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaaagaagtgcggacatagtaatcagctgaggcctaagaagaagatcaaataaagcgtctgagtttgaagcagatagtttatctgcacaaatttttgctgatttattttcattgcctttaagaagccaattggattaaacatttatttttttaaaaaagactgtgactgcagaactggctctctagccagaatttatctttgtgcttccagttgggccagatttgaatagctgtagatgttatagttttgagtttaaagttgtgtttgttttttaaagagattaaatatttgtacgttgctcttttcattcaattatgtgatttactgcattttctacccgaggttcaattattttcacattcatatgtaaaactctcttgcatccatgtagtatactctatataacctcatctttggagtgcaaatgagaaattt

SEQ ID NO: 11666 - DNA, 850 bp, Picea glauca
tcgatcagggcgaaaagatgcagatattcgtgaaaaccctcacagggaaaaccataacccttgaggtcgagagcagcgatacgatcgacaatgtgaaggccaaaatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaaagaagtgtggacatagtaatcagctgaggcctaagaagaagatcaaataaagcgtcttgagtttgaagcagatagtttatctgcacaaatttttgctgatttattttcattgcctttaagaagccaattggattaaacgtttattttcttaaaaaagactgtgactgcagaactggctctctagccagaatttatctttgtgcttccagttgggccagatttgaatagctgtagatgttatagttttgagtttaaagttgtgtttgttttttaaagagattaaatatttgtacgttgctcttttcattcaattatgtgatttactgcattttctacccgaggttcaattattttcacattcatatgtaaactctcttgcatccgtgtagtatactctatataacttcatctttggagtgcaaatgagaaattttaacgaaaggctatgaaaggcgtgcctagagaagaggccgttattaggaaaaaaaaaaaaaaa

SEQ ID NO: 11667 - DNA, 809 bp, Picea glauca
cggggggactacaaaagcctcaaaataaatgttttgagtgtttagtccacagttgtcgtgcggaaattgttggcagcgagcaagatgcagatcttcgtaaagaccctgacgggcaagaccatcaccttagaagttgaaagcagcgataccatcgacaatgtcaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtgggggcattatagaaccttctttgatggcactggccaggaagtacaaccaagacaagatgatttgcagaaaatgctatgcccgtttgcaccctagagcagtcaactgcaggaaaaagaagtgtgggcatagtaaccagctgcgaccaaagaagaaaatcaagtaaaagttacgctgcattgagattttacatcccctcttaatacattcatgttctattattccccatcattttaggctgttgtgccatgtcaaaagcatcacttttaaaccatactttgcttatagcaaaaccttcacgttttttgatattatatatgcattaaattaaattgggaatctttctgagaaggattttgatttgcagttcattatttctgtgttaaggttatgtattttttagcttttgttttactgatctctatttacattttaaaataccaattagtaattttgtactaatagattcaatctttggaatatttatttgattaaaaaaaaaaa

SEQ ID NO: 11668 - DNA, 888 bp, Picea glauca
ggaaaaaagactcaataaaagcagattacgggctaccgaatagcgtttctaacggagttgatcgatcagggcgcaaagatgcagatattcgtgaaaaccctcacagggaaaaccataacccttgaggttgagagcagcgatacgatcgataatgtgaaggccaagatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaaagaagtgtggacatagtaatcagctgaggcctaagaagaagatcaaataaagcgtcttgagtttgaagcagatagtttatctgcacaaatttttgctgatttattttcattgcctttaagaagccaattggattaaacatttatttttttaaaaagattgtgactgcagaactggctctctagccagaatttatctttgtgcttccagttgggccagatttgaatagctgtagatgttatagttttgagtttaaagttgtgtttgttttttaaagagattaaatatttgtacgttgctcttttcattcaattatgtgatttactgcattttctacccgaggttcaattattttcacattcatatgtgaaactttcttggatccatgtagtatactctatataacttcatctttggagtgcaaatgagaaattttaacgaaaggctatgaaagatgtgcctagagaagaggccg

SEQ ID NO: 11669 - DNA, 831 bp, Picea glauca
agaagtggatctcgaaagacagactctggatcttgatcacgaacatcattacaatcatccttatctcgaaatggctttctttttcccatagaaccctaaggttgaaaccctagaaacagactacaaaagcctcaaaagaaatgtattaagtgtttagtccacatttgtcgtggggaaattgttggtagtgagcaagatgcagatcttcgtaaagaccctgacgggcaagaccataactttagaagttgaaagcagcgataccatcgacaatgtcaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtgggggcattatagaaccttctttgatggcactggctaggaagtacaaccaagacaagatgatttgcagaaaatgctatgcccgtttgcaccctagagcagtcaactgcaggaaaaagaagtgtgggcatagtaaccagctgcgaccaaagaagaaaatcaagtaaaagtaacgctgcattgagattttacatcctcttaatacattcatgttctattattccccatcattttaggttgttgtgccatgtcaaaagcatcacttttaaaccatactttgcttatagaaaaaccttcacgtttttcgatattatatatgcattaaattaaattgggaatctttctcagaaggattttgatttgcagttcattatttctgtgttaaggttatgtattttttagcttttgttttact

SEQ ID NO: 11670 - DNA, 722 bp, Picea glauca
ggggagttgatcgatcagggcgaaaagatgcagatattcgtgaaaaccctcacagggaaaaccataacccttgaggtcgagagcagcgatacgatcgataatgtgaaggccaaaatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaaagaagtgcggacatagtaatcagctgaggccgaagaagaagatcaaataaagcgtctgagtttgaagcagatagaagatcaaataaagcgtctgagtttgaagcagatagtttatctgcacaaatttttgctgatttattttcattgcctttaagaagccaattggattaaacgtttattttcttaaaaaagattgtgactgcagaactggctctctagccagaatttatctttgtgcttccagttgggccagatttgaatagctgtagatgttatagttttgagtttaaagttgtgtttgtttttaaagagattaaatatttgtacgttgctcttttcattcaattatgtgatttac

SEQ ID NO: 11671 - DNA, 665 bp, Picea glauca
gaaacggactacaaaagcctcaaaagaaatgttttgagtgtttagtccacagttgtcgtggggaaattgggaaattgttggcagcgagcaagatgcagatcttcgtaaagaccctgacgggcaagaccataaccttagaagttgaaagcagcgataccatcgacaatgtcaaggccaaaatccaggacaaagaagggatccctcccgaccagcaacgtctgatctttgcgggcaagcagttggaagatggccgtactctggcggattacaacattcagaaagagtctaccttgcaccttgtgctcaggctccgtgggggcattatagaaccttctttgatggcactggccaggaagtacaaccaagacaagatgatttgcagaaaatgctatgcccgtttgcaccctagagcagtcaactgcaggaaaaagaagtgtgggcatagtaaccagctgcgaccaaagaagaaaatcaagtaaaagttacgctgcattgagattttacattctcttaatacattcatgttctattattccccatcattttaggctgttgtgccatgtcaaaagcatcacttttaaaccatactctgcttatagcaaaatcttcacgttttttgatattatatatgcattaaattaaattgggaatctttctcagaagga

SEQ ID NO: 11672 - DNA, 651 bp, Euphorbia esula
gcagtcgcagggagagggcaaagatgcagatcttcgtgaaaaccctaactggcaagaccatcactctcgaggtcgagagcagtgacaccatcgacaatgtcaaggccaaaatccaagacaaggaaggtattccaccggaccagcagcgattgatcttcgccggaaaacagcttgaagatggccgcactctggctgattacaatatccagaaggaatcgactcttcatcttgtgctcaggcttaggggaggaattattgagccttctctcatggctttagctcgcaagtataaccaggacaagatgatttgccgcaaatgttatgctcgtctccacccaagggctgttaactgccgcaagaagaaatgtggccacagcaatcagttgaggcctaagaagaagatcaagtagactccgatgaagagaaggcggggcgtatttcgaggtttgagtgttagttttttggaagtcgattacatttttaactgtaatgaacatgtgagttggatttagcagtcaacaatatgttctggatttatgaaatactgtcattttatgttttggaggttggtttgatataatctgcgttctgtttttccattttgcaactttaaattgatgcataaaatataatgctaaaaagcgtgctgcc

SEQ ID NO: 11673 - DNA, 522 bp, Helianthus annuus
aatgcagatcttcgtgaagacattgacggggaaaaccatcacgctcgaggttgaatcgagcgataccatcgacaatgtcaaggctaagatccaagacaaagaaggaattccaccggaccagcagcggttgatcttcgccggaaaacaactcgaggatggaaggactcttgcggattataatattcagaaagagtctacacttcatttggtgttgaggcttcgtggtgagattatcgaaccgtctttgatggctttggcgagaaagtataaccaggataaaactatctgccgcaaatgttatgctcgtctccacccacgtgctgttaactgcaggaagaagaagtgtgggcacagcaaccagttgaggccaaagaagaagatcaagtagatgatgttatggtactttgttttgaaggttgtttaaggttgtaaggatggttcttacattttacgccgtttttgaatttgaatgttatgtttgagacttaaaatttatgatttgtgatattgaaatgctattgc

SEQ ID NO: 11674 - DNA, 651 bp, Tamarix hispida
aagggggcggtcgccgtttcctgagcaaccagcagccaagatgcagatctttgtgaaaactctaaccggtaagacgatcactctcgaagtcgagagcagcgacaccatcgacaatgtcaaggctaagattcaggacaaggaaggtattccacctgaccagcagcgtttgatcttcgccggtaagcagcttgaggatggccgcacccttgctgattacaacattcagaaagagtcgacgcttcaccttgtattgaggctcagaggtggaattatcgagccttctttgatggctttggctcgtaaatacaaccaagacaagatgatttgccgaaaatgttacgcccgcctccaccctagggctgttaactgccggaagaagaaatgtggacacagcaatcagctgaggcccaagaagaagatcaagtaaactggtgctgttggctatctttgccgtttgtgtctgtcatgtctgatctggatcagttagtctggattgtgctctttgtggtagtaccgcttcggtcttttttcatatctttccagacttgttttgctggcacgtcagaaaaggattatagtttgtttctgtgaagttaatatatttactttgtcaatcaacttatttgcaatgactaatgcccattattatta

SEQ ID NO: 11675 - DNA, 434 bp, Tamarix hispida
ggggagggagaggacaggaaagatgcagatcttcgtgaagacactgacgggaaagaccatcacccttgaggtcgagtctagcgacactatcgacaatgtcaaggctaagattcaagacaaggagggtatcccaccggaccagcagaggttgatatttgctggaaagcaactagaagatggtagaacccttgctgactacaacattcaaaaggaatcaacattgcatcttgtactgaggcttcgtggtggaattattgagccatctttgatggctttggctaggaaatacaaccaagacaagatgatttgccgcaagtgctatgctcgccttcatccccgtgctgtcaactgcaggaagaagaagtgtggccacagcaaccagcttaggcccaagaagaagatcaagtagactgctaccttcttaattgttgcag

SEQ ID NO: 11676 - DNA, 807 bp, Taxus baccata
ctagaaactgagtataaacctcctaaccacagcttgctaagaacatttagcaggaaagaagtttttctcaagggaagcaacgagatgcagatcttcgtgaagacattgacgggcaagactatcacactagaagttgaaagtagtgataccatcgacaatgtgaaggcaaaaattcaggacaaagaagggatcccacccgaccaacagcgactgatatttgccggaaagcagttggaagatggacgcaccctggctgattacaatatccagaaagaatccacgttgcatcttgtgctgaggcttcgtggaggaataattgaaccttctttgatggcgttggctagaaagtataatcaggataaaatgatttgcaggaagtgctatgctcggcttcacccaagagcagttaactgcaggaaaaagaagtgtggacatagtaaccagctgcggccaaagaagaaaatcaagtagatctgatgctgggaaggagaggagatttattctgtttgttttaggttttatgtctctctctcttgagtaatccctttcaacctcaaattgggttgaattgggcttatgcataatttgacttaaactttttatctcaaatttgtgtgctccttattgggttttgtattttctatttggcaatttgaaggtaaataaccctgagtttacagagatgccattactaatggttgtgcaaattcttgcaaagtggaagactcttgttgaaagtcattttgttcgtcttttattgggttttgtattttctatttggaaatttgaagttaaataaccccgagt

SEQ ID NO: 11677 - DNA, 660 bp, Camellia sinensis
agagagagagagagagagaatgcagatcttcgtgaaaaccctaacggggaagacgatcacactcgaggtcgaatcgagtgacaccattgacaatgtcaaggctaagattcaagacaaggaaggtattccaccggatcagcagcgattgatcttcgccggaaaacagcttgaagatggccgtactctcgccgactataatatccagaaagagtcgactctgcatctggttctgaggcttcgtggtgggattattgagccgtccttgatggcgttggcccgaaagtacaaccaggacaagatgatttgccgaaagtgctacgctcgcctgcatccacgtgccgttaactgcaggaagaaaaagtgtggacacagcaaccagttgaggccaaagaagaagatcaagtagatatctgatttgatggttctatcagctagttgtagtttgatgtgccctgtgtcaacttcattgctagtagggatttatagttttggaactcatgtcagattgtactggctacaatggaccacaactattttttgtttcttaagaagttttaatttatgtaattcttgtcatttagattgcactttagtttttttgtggttcaaccaaggggcatattgttgtcgtcatttcattttaacccgaaagtaaattac

SEQ ID NO: 11678 - DNA, 596 bp, Eutrema halophilum
gcatttttgagacttgcggcgaagaagacgaaggcaaagatgcagatttttgtgaaaacactcactggcaagaccataactctcgaggtcgagtcctccgacacgatcgacaatgtcaaggccaagatccaggacaaagaaggaatccctccggatcagcagaggttgattttcgccggaaaacagcttgaagatggtcgcaccttggctgactacaacatccagaaagaatcgactcttcatcttgttctgaggctaaggggaggtatcattgagccttctttgatggctttggctcggaagtataatcaggacaagatgatttgccgcaagtgttacgctcgtctgcacccaagggctgtgaactgcaggaagaagaagtgtggccacagcaaccagttgaggccgaagaagaagatcaagtgatctgtttttcgccagaagctcatttttatctatgttatgtttttgtcttttcccttaaaagactcatctctagtgttttgacacaaacttgtttcagtggatttttattttgcaagattattcgtaactctgattatttttgcctttttaaaaaaatttcgaaaaagtct

SEQ ID NO: 11679 - DNA, 575 bp, Eutrema halophilum
agtggccattacggccgggggatagaagacgaactaaaaaagatgcagatcttcgtgaaaaccctaaccggcaagaccatcaccctcgaggtcgagtcctcagataccatcgacaatgtcaaggccaagatccaagacaaagaaggaatccctccggaccagcagcgattgatcttcgccggaaaacagctcgaagatggccgtactttggctgactacaacatccagaaagaatccacgcttcatcttgtgttgaggctcagaggaggtatcattgagccttctttgatggcgttggctcgtaagtacaaccaagacaagatgatttgccgcaagtgttacgctcgtcttcacccaagggccgtgaactgcaggaagaagaaatgtggccatagcaaccagttgaggcctaagaagaagatcaagtagactcatttcaacaatctgatcttgcttgcctcttttctttttttgtcttcccccttgataaaactgttctgattcagtggactttatgttaaaagattatatcagtaaaaggatttggttttctattcatgctgaatcagttttgg

SEQ ID NO: 11680 - DNA, 597 bp, Eutrema parvulum
cttttttgagatttacggcgaagaagacgaaggcgaagatgcagatttttgtgaaaacactcactggcaagaccatcaccctagaggtcgagagcagtgacaccatcgacaatgtcaaggctaagatccaggacaaagaaggaatccctccggatcagcagaggttgatattcgccggaaagcagcttgaagatggtcgcaccttggctgactataacatccagaaagaatcgactctgcatcttgtcctgaggcttagaggaggtatcattgagccgtctttgatggctttagctcgtaagtacaatcaagacaagatgatctgccgcaagtgttatgctcgtctgcacccaagggctgtcaactgcaggaagaagaagtgtggccacagcaaccagttgaggcctaagaagaagatcaagtgatctgtttttcaccagaagctcatttatctatgctatatttttgtgtttcgcttgaaagactcatccttagtgttttgacacaaagttgtttcagtgaattcttatgttaaaagatattttagtgaatctgattatttttggccttttatataatataagttccaaaatctct

SEQ ID NO: 11681 - DNA, 790 bp, Nicotiana tabacum
ggccattacggccgggggaagaggagctgcatagaagacgagtagaagattgttggtgaggggcggagaaaatgcagatcttcgtgaaaactctgaccggtaaaactattaccctagaggttgaatccagtgacactattgacaatgtcaaggccaaaattcaagacaaggaaggaattccaccggaccagcaaaggctgatttttgctggtaagcagcttgaagatggccgtacccttgctgactataacattcagaaagagtcgactctgcatttggtgctgaggcttcgtggtggaattattgaaccatctttgatggctttggctagaaagtacaatcaggacaaaatgatttgccgcaagtgctatgctcgtttgcatcctcgtgctgtcaattgccgcaaaaagaagtgtggccacagcaaccagttgaggcccaagaagaagatcaagtagatggtgattttgaagtcctggcaacatgtagctgctaatgttgagatccttaagaaattattagatatgttgttgggttgcctgttcaatttactctaaaacattgaagtatttgtgtttgagctatatcaaagattttgagatactttcgtatttcttgatgagctagattctattggttacattagtataagctttgctagatgtgtagttatatatgcgctttcatcctctgctatttcgattagtctttctctctgttatgtttgctgaagtgagccaagaacataaacaatagcagcacaagttaaagttgatgttgacagcaaaaa

SEQ ID NO: 11682 - DNA, 595 bp, Nicotiana tabacum
ggccattacggccggggatagcaaagagaactaaagatgcagatcttcgtgaaaaccttaacagggaagaccataaccctagaggtcgaatcgagtgacaccattgacaatgtcaaggctaagattcaggataaggaagggattccaccggaccagcaacgtctgatatttgctggtaagcagcttgaagatggccgtacgcttgcagattataatatccaaaaagagtccactttgcatcttgtgctgaggcttcgaggtgggattattgaaccgtctcttatggctttggcccggaagtacaaccaggataagatgatctgccgcaaatgctatgcccgtttgcaccctcgtgctgtcaactgcaggaaaaagaagtgtggccatagcaaccagttgaggccaaaaaagaagatcaagtaaacaggtggttgcatttgctgtcaagacgatttataatttggcacttttttgttttttatttgcttgttgactttggtctgtccttcggcgtctgtttcactatatacataaattgtaaaattttacccgtttgctttactttttaatctacttaactgagtttgatcgactg

SEQ ID NO: 11683 - DNA, 702 bp, Nicotiana tabacum
ccggggggggtttcaatcaggaaagacaaagcgggtaagagaagagtgcgccgcaaaatgcagatcttcgtaaaaaccctaaccgggaagacaatcacgctcgaggttgaatcgagcgacaccattgacaatgtcaaagctaagattcaagacaaagaaggtattccaccggaccagcagcggttgatctttgccggaaagcagctcgaagatggacgtactcttgctgattataacatccagaaagagtcaactttgcatttggttttgaggcttcgtggagggattattgagccttctctgatggctttggcgaggaagtacaaccaggataagatgatttgccgcaagtgctatgctcgcctgcatcctcgtgctgttaactgcaggaagaaaaaatgtgggcacagcaaccagctgaggccaaagaagaagatcaagtaggcgtgatgtcttttctaagcttaaatcaattttgtgtgttgcagctatattgccagtccgttgtttttacagttttcagtcctgcttcaacttgatgtcatgaatagacaagcatttgttttgaacatctaattattggataagatatctttgtgcattcaatatatgtctgtttcgatggagtttagtatgttcttcctgataagcaagcctacaggtgcctgctttgttctaatatccattccgtaatcatcaatg

SEQ ID NO: 11684 - DNA, 684 bp, Nicotiana tabacum
ggagaacaggagctgagcagaagacgagtggaagatcgttggtaaggggcggagaaaatgcagatcttcgtgaaaactctgaccggtaaaactataaccctagaggttgaatccagtgacactattgacaatgtcaaggccaaaattcaagacaaggaaggaattccaccggaccagcaaaggctaatttttgctggtaagcagcttgaagatggtcgtacccttgctgactataacattcagaaagagtcgactctgcatttggtgctgaggcttcgtggtggaattattgaaccatctttgatggctttggccaggaagtacaatcaggacaaaatgatttgccgcaagtgctatgctcgtttgcatcctcgtgctgtcaattgccgcaaaaagaagtgtggccacagtaaccagttgaggcccaagaagaagatcaagtagatggtgattttgaagtcctggcaacatgcagctgctaatgttgagatccttgagaaaatcattagatatgttgttgggttgcctgttcaatttactctaaaacattgacgtatttgtgtttgagctatatcaaagattttgagctactttcattttacttaatgagctaaattctgttggttacattactataagctttgttagatgtgtagttatatatatgcttttatccagctattt

SEQ ID NO: 11685 - DNA, 595 bp, Nicotiana tabacum
acaaagcgggtaagagaagagtgcgccgcaaaatgcagatcttcgtgaaaaccctaaccgggaagacaatcacgctcgaggttgaatcgagcgacaccattgacaatgtcaaagctaagattcaagacaaagaaggtattccaccggaccagcagcggttgatcttcgccggaaagcagctcgaagatggacgtactcttgctgattataacatccagaaagagtcaactttgcatttggttttgaggcttcgtggagggattattgagccttctctgatggctttggctaggaagtacaaccaggataagatgatttgtcgcaagtgctatgctcgcctgcatcctcgtgctgtcaactgcaggaagaaaaaatgtgggcacagcaaccagctgaggccaaagaagaagatcaagtaggcgtgatgtcttttttaagttcagatcaattttgtgcattgcagttatattgccagtccgttgtttttacagttttcagtcctgcttcaacttgatgtcatggatagactacccatttgtctcaaacatctaattattggataagatatctttgtgcattcaatatatgcctgttt

SEQ ID NO: 11686 - DNA, 696 bp, Nicotiana tabacum
cattacggccgggggaaggaaaaaggaagccgcagctcgtaacgaaaatgcagatattcgtgaaaactctcactggtaaaaccataactctcgaagttgaatccagtgatacaatcgacaatgttaaagccaaaatacaagacaaagaaggaattccaccggaccaacaaaggctgatttttgctggtaagcagctcgaagatggacgcaccttggccgattacaacatccaaaaagaatcgactctacatttggtgctgaggcttcgtggtggaatcattgagccatcgttgatggctttggctaggaaatacaatcaggacaagatgatatgccgcaagtgctatgctcgattgcatcctcgtgctgtcaactgccgcaagaagaagtgtggacacagcaaccagttgaggcctaaaaagaagattaagtagacgtaaatttctattgctgctgacttgtagttgctggcggtattatatctttcagaaactgaacttggctttcttgtcaaagaaacaaattgtacttggatttattgttgggtttctgttccatttaccttttaaagattcatggacttgtatttgggaggtaaatgaagagtctttgctgctttcatattttgggagatcaagtcgattagcatacagttattgctattttgctgtgatattggtttatgaatcgcaacaa

SEQ ID NO: 11687 - DNA, 639 bp, Valeriana officinalis
aaaatgcagatcttcgtgaaaaccctgacggggaaaaccatcacccttgaggtcgagtctagcgacaccatagacaatgtcaaagctaagatccaggacaaggaaggtattcctccggatcagcagaggttgatcttcgccggaaagcagctggaagatggtcgtactctggctgattacaatatccagaaagagtccaccttgcatctggttttgaggcttcgtggtggtatcattgagccatctctgatggctttggctcgcaagtacaaccaggacaagatgatttgccgcaagtgctatgctcggcttcatccgcgtgctgtgaactgcaggaagaaaaagtgtggccacagcaaccagttgaggccgaagaagaagatcaagtagatgcttaagcttttcaagcagtggtcggccaggttgaaccgaagatcagtcgtctttcccgttattgtttttcttttttattgagcttgtagtggtggccttatagcagacccctgaactaagttttgtttggttttgtttaagtcatgaatgctttggtttctcaaatttatttatataatggtgatgttatggattcttaagtttcatgttgcttgttttaactttctatttcaaagttatttttag

SEQ ID NO: 11688 - DNA, 716 bp, Citrullus lanatus
acaatagtcggaacgaaaggccctcccctcatcaccgggacgccgaggaaacagagaaatccaagaaaatgcagatcttcgtcaaaaccctaacggggaagactattacgttggaagtcgagtccagcgacaccattgacaatgtcaaggccaagatccaggataaggagggtattccccccgaccagcaacggcttatctttgccggaaagcagctcgaggatggccgcactctggccgactacaacatccagaaagaatcaacgctacacctggttctaaggcttcgtggtgggattattgagccatctttgatggcgttggccaggaaatataaccaggacaaaatgatctgccgcaaatgttatgcacgcctgcatccccgtgccgtcaactgccgtaagaagaaatgtggtcacagcaatcagctgagaccaaagaagaaaatcaagtagacagctgatcttaaggatgaaatgttgtggtaccttatacgtcacttcatacacttccctgctctcttgtagagccttggattgtctgctcgtttgttaaggattcaatttttgtagttcgacttaagaactttggttggtttacagtgatcatgagtgatggttttatctctctttttgaatctattttattatcgatgaaatatgtgctcattattctcacatcaatgtccgattttaactcaattgcagcccttgtga

SEQ ID NO: 11689 - DNA, 741 bp, Citrullus lanatus
accctaattcaaaaagcatataaaaggggctcatcgaggaggagtatgttgcaaagcagacttgtaaacccgagagagcgttaacgagcggcgccacaagatgcagatcttcgtgaaaaccctaacggggaagacgattacgttggaagttgagtccagcgataccatcgacaatgttaaagctaagatccaggataaggaaggtattcccccggaccagcagagacttatctttgctgggaagcagcttgaggatgggcgaacgctcgctgactacaatatccagaaggagtcaactttgcacttggtgctcaggcttcgcggtggtattattgagccctctttgatggcattggctaggaagtacaaccaggacaagatgatttgccgcaagtgctatgcccgcctgcaccctcgtgccgtcaactgcaggaaaaagaagtgtggacacagcaaccagttgaggccaaagaagaagattaagtagactgttgattttgagagaggaaatttatgcaaaagtttatgctttgatttattttctggatcggctatgcctagaactatttgctttatactcattaggagtttgaattgttatgttttttgctttttaacattctcgagtaatggcatgttttgttcttgacttatatgagtaccaaatcttcagcttgtcgtattttctatttttggctcattccctacgcataataacgagaatggaaaatactggataaa

SEQ ID NO: 11690 - DNA, 414 bp, Triticum aestivum
gaagaagaagatatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggcaaacagcttgaagatggtcgcaccttggctgactacaacatccaaaaagagtcgactctgcatcttgtcctgaggctaaggggaggtatcatcgagccgtctttgatggctttggctcgtaagtacaatcaagacaagatgatttgccgcaagtgttacgctcgtctgcacccaagggctgtcaactgcaggaagaagaagtgtggccacagcaaccagttgaggccgaagaagaagatcaagtgatctgttttgtttgtt

SEQ ID NO: 11691 - DNA, 751 bp, Zamia vazquezii
gctaccggaatacagtcatccggggcggcagtgtttagatcgagatgcagatattcgttaaaaccctaacgggcaagactataaccctagaggtcgagagcagcgatactatcgacaatgtcaaggccaaaatccaggacaaggaaggtattccgccggaccagcaacgactaattttcgctggaaaacagctggaagatgggcgaactcttgctgactacaacattcagaaagagtcgacactgcaccttgttctcaggcttcgtggaggaataattgagccttcattgatggctttggcaaggaagtacaatcaggacaagatgatatgcaggaaatgttatgcccgtctgcatcccagggcagtgaactgcaggaaaaagaaatgtgggcatagcaatcagctgaggccaaagaaaaagatcaagtaaatttgacaagttggaaattcagtttttcagcacggctgtttattttttagttcttgtttgtattgacttttgagactcacttagcaaacaagctttttgtgtttcatctctaaccatgacttaatgcatcccttattcagataccatattttacttggattttgcctatgaataattatgtcttacctagatttaaattggattctatttttagttaatgaatttggaaatccaagtatgacagtgagcagatggctgttgttggcttgctctgttttatatatttattgatatttaattgtgacaaaaaaaccggtagc

SEQ ID NO: 11692 - DNA, 740 bp, Abies balsamea
aaaaaagagtaaataaaaacagattgcctgcaccatcgagaagagattctatcggagtcggttgatcggagcgacaagatgcagatattcgtgaaaaccctcacgggtaaaaccataacccttgaagtcgagagcagcgatacgatcgataatgtgaaggccaagatccaggacaaagaagggatcccccctgaccagcagcggctgattttcgccggaaaacagctggaagatggccgtactcttgctgactacaatattcagaaagagtctacactacaccttgttttgaggcttcgtggagggattattgaaccttcgttgatggctttggcaaggaagtacaaccaggacaagatgatttgccgaaagtgttatgcccgtttgcattccagggcagtgaactgcaggaaaaagaagtgcgggcatagtaatcagctgaggcctaaaaagaagatcaagtagagcggttgagtttgaagtagatagtttatgtccagaacttttttgctcgtttatgctcatggcctttgagaagcccactcgattatgtcttcttgaaatagactgtggtactatcatgcagattgcagaactggctttctagccaggaatttacctgtatttctaattgggccagatttgaaaacgtttagaagttatttctggatttgactttgaagttgtgtttgggttttacaggatttaaattaaaatattagtaagttttgctcttaaaa

SEQ ID NO: 11693 - DNA, 640 bp, Acacia harpophylla
gatcgaacaaagggaggaggcacaaaggaaatcggccgcgatgcagatcttcgtgaaaacactgaccggcaagaccatcaccctcgaggtcgaatccagtgataccattgacaatgtcaaagctaagattcaggacaaagaaggcattccaccggaccaacagaggttgatcttcgccgggaagcagctggaggatggccgtactcttgccgattataacattcagaaagagtcaacattgcaccttgttttgaggcttaggggtggcattattgagccgtcattgatggcattggccaggaaatacaatcaggacaagatgatctgccgcaagtgtcatgctcgtttacaccctcgtgctgtcaactgcaggaaaaagaagtgtggacacagcaaccagctgaggccaaagaagaagatcaagtaaactgtttcttttgcaagtttttgccttagagtcctgatagctctttgacgtgttagaaccgtagttttgtagttgaactacaaatattttggttactgcactggcatagttcttttatgtttttcatcttttgtttgagatacattcaagcgagttatgtttaattctgcttccttaccgtgacaataatctggggaacgtccctgttttacc

SEQ ID NO: 11694 - DNA, 699 bp, Amsonia hubrichtii
gaaaaccctagctataagttgagctatttgagagtgctccagagctgtgaagggctgtcgtcggttgagagagggaagagagaagatgcagatattcgtgaaaactcttaccggtaaaaccatcactctcgaggttgagtcgagcgacactatcgacaatgtcaaggccaaaatccaagacaaagaaggaattccaccggaccagcaaagattgatttttgcaggaaagcagttggaggatggccgaacccttgctgactataatatccagaaagaatcaactttgcatcttgtgctgaggcttcgtggtggaatcatcgagccgtcgttgatggctttggctaggaagtacaatcaggataagatgatctgccgcaagtgctatgctcgtttgcattctcgcgccgtcaactgcaggaagaagaagtgcggacacagcaaccagttgaggccaaaaaagaagatcaagtagacgtatattttcaatatctatcaagcttgtagtggaaggttttcagagaatgatattcttgaatggttattttgagattatgattttacagtgttatgaacatcttttgttactcctgtttcttcaacttttgtgaaccaaagttcttattggcgaaatggtttatcgatacaattatgctaatggcttctacccatttatttcatgaaagctcttgttagcttccc

SEQ ID NO: 11695 - DNA, 650 bp, Amsonia hubrichtii
gccgcggagagctttggcagggaaaatgcagatcttcgtgaaaaccctaactggaaagactatcaccctagaggttgaatcctctgatactattgacaatgtcaaagctaagattcaagacaaagaaggtattccgccggaccagcagcggttgatttttgctggaaagcagctggaggatggacgtaccttggctgattacaacatccagaaagagtccactcttcatttggttctgaggctgcgaggagggattattgagccgtcgttgatggctttggccaggaagtacaatcaagacaagatgatttgtcgcaaatgctatgctaggttgcattctcgtgctgttaactgccgaaagaagaagtgtggacatagcaaccagttgaggccgaagaagaagatcaagtagacatgctgtccaatgcttgttacgttgcatgttatagctttttctgggcaacaattttgaaccttccttctgcttttaagtttggaaactgaatttattttgaattttgtttattagaatagttattttggtttatgtgaacaacagtggagttaattggcagaatttagttaattgtagtgttccgtgttttatttggatgggctgaattcttatggttgattagtatgttgaattt

SEQ ID NO: 11696 - DNA, 608 bp, Antirrhinum majus
gcaaaagagaggaaaaaaagatgcagatcttcgtcaaaactttaaccggcaaaacaatcacgctcgaggttgaatcgagcgacacaatcgacaatgtcaaggcgaagatccaggacaaggaggggatcccaccggaccagcagcgtttgattttcgccggaaaacagctcgaagatggacgaaccctagctgattacaacattcagaaagagtcaactctgcatttggttctgaggcttaggggtggaatcatcgagccgtctctgatggctttggctagaaaatacaaccaggagaagatgatttgccgcaagtgctatgctcgtctgcaccctcgtgctgtcaactgcaggaaaaagaagtgtggacacagcaaccagctgaggccaaagaagaagatcaagtagactgcttgttcgaggaactattatcttttcttgctttcacaagatgtcaatgaaacacataatttcgtattttgcctttagacagttaagatttttatgtagccccaatttttctggattaattatcgcccccttttatgatttgacataatgtctctagttcaattttgattatctccccccatcctatacccaaataaa

SEQ ID NO: 11697 - DNA, 589 bp, Malus domestica
ctctcagagtcacagcccaacgaacctcgagatgcagattttcgtgaaaaccctaaccgggaagaccatcactctcgaggtcgagagcagcgacactatcgacaatgtcaaggccaagatccaggacaaggagggcattcccccggaccagcagcgcctgatcttcgccggcaagcagctcgaagacggccgaaccctagctgactacaacatccagaaagagtcgactcttcatctggtgctgaggctccggggagggattatcgagccttctctgatggctttggctcgcaagtacaatcaggagaagatgatttgcagaaagtgctatgctcgtctgcatccaagggcagtgaactgcaggaagaagaagtgtggccacagcaatcagttgaggcccaagaagaagatcaagtagagtgtcggccgaatattttgttacttttgtctagactggagtttgaatttttgtaattcagttaacgtcatttgctatgtatcggagttgaattactgcagtttatattaacatttgatgggatcttgggataattttgatctatatttgttctatcgtttgatcaagttt

SEQ ID NO: 11698 - DNA, 948 bp, Malus domestica
agctgatcgtggcgaaacgaccacctacgtcgtcgtgggcttcgcctccaagctcttccactcttctccaaccccaaatacgaatgctaatgggcctcggacctcgaccctactcatctcccaaaccggggtgctgttcactatcaatgaggggggaataacctccggcgacgactggagcttcaaacctgttaccacttgaaatttgtagcaaaacagctttgccgccgccgagagcgagacacacacagagagacagagggagaggaagaaagagagccggagaagatgcagatcttcgtgaaaaccctaacagggaagactatcaccctcgaggtggagtctagcgacaccatcgacaacgtcaaggccaagatccaggacaaggaaggtattccaccggaccagcagaggctcatttttgccgggaagcagctcgaggatggccgtactctcgccgactacaacatccagaaagaatcaactctgcatttggttctaaggcttcgcggtgggattattgagccttctctcatggcattagctaggaagtacaaccaggaaaagatgatctgccgcaagtgttatgcacgcctgcacccccgtgccgtgaactgcaggaagaagaagtgcggacacagcaaccagctgaggccaaagaagaagatcaagtaaactgggaatcgagacagcggaatgtcgcatctttttggatcatttaggtcttggacattttattttaaagctttgttagcgtcaaccagggtactgttataaggtttagcatcaatatttttcaacttgctttggaatttttctctgtgatgttgcgtaatcttggcgttgtttaaacttctgtttggacccaattttgcaccatcggcccaagcaattgaggccgttgagtgaggggttctagaccattgagtacatgagatgttaagataa

SEQ ID NO: 11699 - DNA, 677 bp, Malus domestica
agagcaaaaccgcctcgttgccgccgagagagatacacacagacagcgggagaggaagagagagagccggagaagatgcagatcttcgtgaaaaccctaacagggaagactatcaccctcgaggtggagtctagcgacaccatcgacaacgtcaaggccaagatccaggacaaggaaggtattcccccggatcagcagaggctcatttttgccgggaagcagcttgaggatggccgtactctcgccgactacaacatccagaaagaatcaactctgcatttggttctgaggcttcgtggtgggattattgagccgtctctcatggcattggctaggaaatacaaccaggaaaagatgatctgccgcaagtgctatgcccgcctgcacccccgtgcagttaactgcaggaagaagaagtgtggacacagcaaccagctgaggccaaagaagaagatcaagtagactgggaatcgagacaggggaacgtcaagtctttttccggtcatttaggtcttgggccgtttcttttaaaacttggttagaacttattatgagaaatgactttcattaagtttgaatctctctatatcgagtcgttgacatggctaatgcatactttgatttttgtttgttgaatgaaagatggattagtgtatgaatactattttcccttccat

SEQ ID NO: 11700 - DNA, 558 bp, Arabidopsis lyrata
ctacgggagagaagacgaaacaccaaaagatgcagatcttcgtgaaaaccttgaccggcaagaccatcactctcgaggtcgagagcagcgacaccatcgacaatgtcaaggccaagatccaagacaaagaaggaatccctccggatcagcagagattgatcttcgccggaaaacagctcgaagatggccgtactttggctgactacaacatccagaaagaatccacacttcatcttgtgttgaggcttagaggaggtatcattgagccttcattgatgatgttggctcgtaagtacaaccaggacaagatgatttgccgcaagtgctatgctcgtcttcacccaagggctgtcaactgcaggaagaagaagtgtggtcacagcaaccagttgaggcctaagaagaagatcaagtagagatcaagaatcctatctcttgcttgcttctgtttgttgtcttccctttgatagggtttgctttttttgtttcagtgaatttctatgttaaaagataatatcagtaaaaggatttggttttctatttatcccgtatcgatta

SEQ ID NO: 11701 - DNA, 506 bp, Arabidopsis thaliana
gtttcgagacttccggcgaagaagacgaacgcaaagatgcagattttcgtgaaaacgctaaccggcaagaccatcaccctcgaggtcgagagcagtgacaccatcgacaatgtcaaggccaagatccaggacaaagaaggaattcctccggaccagcagaggttgatcttcgccggaaaacagcttgaagatggtcgtaccttggctgactacaacatccagaaagagtcgactttgcatcttgttctgaggcttaggggaggtatcattgagccttcattgatgatgttggctcgtaagtataaccaagacaaaatgatttgtcgcaagtgttatgctcgtctccacccaagagctgtgaactgcaggaagaagaagtgtggccatagcaaccagttgaggccaaagaagaagatcaagtgatcttttgttcaccaaaagcttatttacgttatttttgtgtttgctttgagaaagactcctctattgttctgacacaaaccttg

SEQ ID NO: 11702 - DNA, 547 bp, Arabidopsis thaliana
acgtgagagaagacgaaacacaaaagatgcagatcttcgtgaaaaccttgaccggcaagaccatcactctcgaggtcgagagcagcgacaccatcgacaatgtcaaggccaagatccaagacaaagaaggaatccctccggatcagcagagattgatcttcgccggaaagcagctcgaagatggccgtactttggctgactacaacatccagaaagaatctacacttcatcttgtgttgaggcttagaggaggtattattgagccttccttgatgatgcttgctcgtaagtacaatcaggataagatgatttgccgcaagtgctatgctcgtcttcacccaagagctgtcaactgcaggaagaagaagtgtggtcacagcaaccagttgaggcctaagaagaagatcaagtagagagactcttatcaagaatcccatctcttgcttgcttctttttgttgtcttccctttgatagggtttgtttttcttgtttcagtgactttctatgttaaaagataatgtcagtaaaaggatttggttttctatt

SEQ ID NO: 11703 - DNA, 721 bp, Brassica juncea
ggctagaacacaagaagaagccaacaaagatgcagatcttcgtgaaaacccttaccgggaagaccatcaccctcgaggtcgagtcctccgacaccatcgacaatgtcaaggccaagatccaagacaaagaaggtatccctccggatcagcagcgattgatcttcgctggaaaacagctcgaagatggccgtactctggctgactacaacatccagaaagagtccacgcttcatcttgtgttgaggcttagaggaggtatcatcgagccttctttgatggcgttggctcgcaagtacaaccaagaaaagatgatctgccgcaagtgctacgctcgtcttcacccgagggctgtgaactgcaggaagaagaagtgtggccatagcaaccagttgaggcccaagaagaagatcaagtagactctgttcaagaaactatcttgctcgcttgcttcttgcctctctttttttctttgccttctcgagttgttttgtttcagtgaatttttatgttattttcaaagattatatcagagaaaggatttggtgatctgtttatgctgaatcagttatttgctttctttattctgttatgcgcatcctagatgttgatgaagatgactttttaacgggagatgattacttgagaaaacaacaatgttgattttgaatatattatgcatggaatttgaaaagcaatgataaatactttgtttctaacaaag

SEQ ID NO: 11704 - DNA, 768 bp, Brassica juncea
ttcttcttcttcttcaaagcaatctaatctttttggagagttgcggcggcgaagatgcagattttcgtgaaaacgctcaccggaaagacgatcaccctcgaggtggagagcagcgacaccatcgacaatgtcaaggctaagatccaggacaaagaaggaatccctccggatcagcagagattgatcttcgccggtaaacagcttgaagatggccgcaccttggctgactatagcatccagaaagagtcgactctgcatcttgttctgaggctaagaggaggtatcatcgagccgtctttgatggctttggctcgtaagtacaatcaagacaagatgatctgccgcaagtgttacgctcgtctgcacccgagggctgtgaactgcaggaagaagaagtgtggccacagcaaccagttgaggccgaagaagaagatcaagtgatgtgttttttttttcaccagaagctcatttatctatgttatattattgtgtgtttccatctctagtgtttttgacacaagctcgttttggcgtttttaataattcgaaagtgtgacacaaactagattcagtgggttttaatcctagaggaagaaagccgccccttatattttccttagttgaatgatattcttaaaacgttttggaaaccatagccttcatgccgtagttgacaaaatcatatattataattgtgtatttgtgattgtaaaagaaagcatacgatcaatgccaacatgtgttgttgaaatcagaacaaaacaaaaa

SEQ ID NO: 11705 - DNA, 462 bp, Brassica juncea
aaccttttctgatacttttgcggcggagaagaagaagatgcagatattcgtgaagacgctgacgggcaagaccatcaccctcgaggtggagagcagtgacaccatcgacaatgtcaaggccaagatccaggacaaagaagggatccctccggatcagcagaggttgatcttcgccggaaaacagcttgaagatggtcgtaccttggctgactacaacatccagaaagattcgactctgcatcttgtcctgaggcttaggggaggtatcatcgagccgtctttgatggctttggctcgtaagtacaatcaagacaagatgatctgccgcaagtgttacgctcgtctgcacccaagggctgtcaactgcaggaagaagaagtgtggccacagcaaccagttgaggccgaagaagaagatcaagtgatctgttttgtttgttcacaacaagcttatttatctgtg

SEQ ID NO: 11706 - DNA, 601 bp, Musa acuminata
acgggggaaggaggagagacgataaggatgcagatcttcgtgaaaacccttacggggaagaccatcaccctcgaggtcgagagcagcgacaccatcgacaatgtgaaggccaagatccaggacaaggaagggattccgccggaccagcagcgactgatctttgctgggaagcagctcgaggacggacggaccctcgccgactacaacatccagaaagagtcgacgcttcatctggtgctgaggttgaggggcggcatcatcgagccttctctgatggctctcgccaggaaatataaccaggaaaagatgatctgcaggaaatgttatgcgagattgcacccaagggccgttaattgccgcaaaaagaagtgtggtcacagcaaccagctgaggcctaagaagaagatcaagtaggcgtgtgtttctcgtactgcaggtgcaaaaaccaagtatgcaacttgacctattagatatggtctgctaaaatatatgttagtttgatatcagacttaattatgtttgtgaaccgcaatcaagcagagaacatgttcaccggatggttttacacaacatctttagtttctaccgattgctggtattt

SEQ ID NO: 11707 - DNA, 601 bp, Musa acuminata
cacgcggcgcgagggaggtcggccaagatgcagatctttgtgaaaaccctaacggggaagaccataaccctcgaggtcgagagcagcgacaccatcgacaatgtcaaggccaagatccaggacaaggaagggattccgccggaccagcagcggctgatctttgcggggaagcagctcgaggatggaagaaccctcgctgactataacatccagaaagagtcgacgctgcatctggtgctgaggctgaggggtgggattatcgagccctcgcttatggctttagccaggaaatacaaccaggaaaagatgatttgcagaaaatgctatgcaagattgcatccgagggctgttaattgccgcaagaagaagtgtggtcatagcaatcagctgaggccgaagaagaagattaagtaaattgtggatggatagaacaacgttgctgctgagcctggatgtgttaggtgtcatcttatttctccattggcaatagactacatgttcaagtttttgttggttgttatggactaagttttatcgtatacttgtcataattttgtgaacattagcaacagggattcttgttatacatgtttcctgtcgt

SEQ ID NO: 11708 - DNA, 671 bp, Musa acuminata
ggttcgttgctcgcggagactgaggcggcgcggggtgaggagagagaccgacaaggatgcagatcttcgtgaagacccttacggggaagaccatcactctcgaggtcgagagcagcgacaccatcgacaatgtgaaggccaagatccaggacaaggaagggattccgccggaccagcagaggctgatctttgccgggaagcagctcgaggatggacgaaccctagccgactacaacattcaaaaagagtcgacgctgcatcttgtgctgaggctgaggggtgggatcattgagccctcccttatggctcttgccaggaagtacaaccaggaaaagatgatctgcagaaagtgttatgcacggttgcacccaagggctgtcaattgccggaaaaagaagtgtggtcacagtaatcagctgaggcctaagaagaagatcaagtaaattacttgtttgaatttcttttggcctcccgaggcaaagatattggcggacaccgattcctatatttgatcatcctggcctggagtctgtctgttatcaccttttgttattgttttgaagtggcatcaagacatttcttggatgttttgaattattattttccattctgaatactggtcttcccgttgacagtggttttatttcgaatactaaggacatctaatggtg

SEQ ID NO: 11709 - DNA, 636 bp, Phaseolus vulgaris
ctaatagcagtttgggaagacagggaaagatgcagatcttcgtgaaaaccctgacggggaagaccatcacccttgaggtggagtcaagcgacaccattgataatgtcaaaacaaagattcaggacaaagaagggattcccccggaccagcagaggttgatcttcgccgggaaacagctggaggatggccgtaccctcgccgattacaacatccaaaaagagtcaacattgcatcttgttttaaggcttcgtggtggtattattgagccatctttgatggcattggccaggaagtataaccaagataagatgatctgccgcaagtgttacgcacgtttacaccctcgtgctgtgaactgcaggaaaaagaagtgtggacacagcaaccagttgaggccaaagaagaagatcaagtaaactgttctgattgcaagatggagacatgttgttatgggttactgggtatcttgtagtcctgacaactccactagcttcttagtattgtaggaaatcttttggaaatttgatttttgttttcagtttgagactcattgttatcaattatgctacggttccttgtgaggatgatacagttttgtttttgacacatgcatttgaagtggttgtttcccgttta

SEQ ID NO: 11710 - DNA, 647 bp, Bruguiera gymnorhiza
aatgactcacgagtcatttgcgccggccacgctgaagctgcaaaggagagagagggagagcaaaagaaatgcagatattcgtgaaaaccctaactgggaagaccataactctcgaggtagagagcagcgacaccatcgacaatgtcaaggccaagatccaagacaaggaaggaattccaccggatcagcagcgattgatcttcgccggcaagcagctcgaagatggccgaaccctagccgattacaacatccagaaagaatctacactccatcttgtgctaaggcttaggggaggaatcatagagccttctctgatggctttggcccgcaaatacaatcaagagaagatgatctgtcgcaaatgttatgctcgtctgcatccaagggctgtgaactgccggaagaagaagtgtggacatagcaaccagttgaggcccaagaagaagatcaagtaaaactccagtggaggaaatcttttgtgttttggaaggacttctgctaaattttgccatttgatatttggcatgtttatctcctgtttttgacatatgggatttgaatttatcctgacattatatggtcaatactttcctattctattaagctatctttaaccttataaaaaaattatgtattcttgttttgcc

SEQ ID NO: 11711 - DNA, 717 bp, Cannabis sativa
tatatgatagtccaactcgttacagagccaaaaaccctagacgagtcggctaaagatgcagatcttcgtgaaaaccctaactgggaagaccatcacccttgaggtcgagtctagcgacaccatcgacaatgtcaaggctaagattcaggacaaggaaggtattcctccggaccagcagaggttgatcttcgccggaaagcagcttgaagatggtcgcactcttgctgattacaacatccagaaagagtccacattgcatttggttttgaggctccgtggtggaatcatcgagccatctctaatggcattggccaggaaatacaaccaagaaaagatgatttgccgcaagtgctatgcccgtctccaccctcgtgctgttaactgcagaaagaagaagtgtggacacagcaaccagttgaggccaaagaagaagatcaagtagattttcgttcctaccataaggtgctgcttctgcagtttcctattattagaacattaattttgtttttgctatcttttaggaattcaaagtatgttttggacaacattgctctattgggaaaacttatttcttatatttcgttgtagtttggaattttggttattcagatgttgagttcgacctattttaggttttacttttaactattctctaatacatttatatggttatgttcttgctcgattgtgtttcgccttcaagcatttttcttgaaa

SEQ ID NO: 11712 - DNA, 1015 bp, Cannabis sativa
aacatttttataaaattgggacattatgtactccaaaatataaattgggtcgtatgtgataaaagtaatataaatggagacctttatataataatatcagtcgaactccttacagagcaaaaaaaaccctagactagtcggcgagtgtgaggaagacagggagagatgcagatcttcgtgaaaaccctaactgggaagaccatcacccttgaggtcgagtctagcgacaccatcgacaatgtcaaggctaagattcaggacaaggaaggtattcctccggaccagcagaggttgatcttcgccggaaagcagcttgaagatggtcgcactcttgctgattacaacatccagaaagagtccacattgcatttggttttgaggctccgtggtggaatcatcgagccatctctaatggcattggccaggaaatacaaccaagaaaagatgatttgccgcaagtgctatgcccgtctccaccctcgtgctgttaactgcagaaagaagaagtgtggacacagcaaccagttgaggccaaagaagaagatcaagtagattttcgttcctaccataaggtgctgcttctgcagtttcctattattagaacattaattttgtttttgctatcttttaggaattcaaagtatgttttggacaacattgctctattgggaaaacttatttcttatatttctttgtactttggaattttggttattcagatgttgagtttgacctattttaggttttacttttaactattctctaatacatttatatggttttgttcttgctcgattgtgttttgccttcaagcatttttcttgaaaattatttagaaaaaagtttagggtgtaattgatttaggatttgaaaactgttttcaaaacaaaatctgaatattattttgagttttagataaaaaaaattaaacatcatttttatgttttcaaaccatggaatctaaaaactctttaaatatactcttacctttttattttgaggttctagtctcaac

SEQ ID NO: 11713 - DNA, 548 bp, Brassica napus
tgcagatattcgtaaaaacattgactggcaagaccattaccctcgaggttgagagcagtgacaccattgacaatgtcaaggcaaagatccaggacaaagaaggaatccctccggatcagcagaggttgatcttcgccggaaaacagctcgaagatggtcgcaccttggctgactacaacatccagaaagagtcgactctgcatcttgtcctgaggctaagaggaggtatcattgagccctctctgatggctttggctcgtaagtacaatcaagacaagatgatctgccgcaagtgttatgctcgtctgcacccaagggctgtcaactgcaggaagaagaagtgtggccacagcaaccagttgaggccgaagaagaagatcaagtgacctgttttgatttttcacgagaagctcatttatatatgttatgtttttgtgtttctcttgaaagacatctctagtgttttaacacaaaaactcgtttcagtcaaattttgatgttaaaaactattagtatatcctcatattataaaatgaaagcgaaatcat

SEQ ID NO: 11714 - DNA, 685 bp, Daucus carota
gtaaattttagagagatcaggcgagcaaaaggaggcggcggggcatcatccaaaatgcagatcttcgtgaaaacactgacggggaagacaattacccttgaagtcgagtccagcgataccattgacaatgtcaaggccaaaattcaggacaaggaagggattcctcctgatcagcagagattgatctttgcgggaaagcagctcgaagatggtcgtactcttgctgactacaatatccagaaggaatcaacattgcatcttgttttgaggcttcgtggaggaatcattgagccttccttgatggctttggcaagaaagtacaatcaggagaagatgatttgccgcaaatgttatgctcgtcttcatcctcgtgcagtgaactgcaggaagaaaaagtgtggccacagcaaccagttgaggccaaagaagaagatcaagtaaacaaaatgtcaagtttctgccatctccttttggtcggaaagtttttctgttaaagtgaatttatttagtcttaagagccatttttcagcagtaattttcaatgttttgtctctgagacatcttggctgttcaacagtttattcactgtgcttgaatgtgtttttctaaatatgcttttatattgtgatattctatgtgcattagtttgatatctatatatgcatgctccgaccacaaaagccaa

SEQ ID NO: 11715 - DNA, 621 bp, Daucus carota
gagcagagcggctgtttgttaagaacagagggcgaaaatgcagatcttcgtaaaaaccctaaccgggaagacaatcaccctcgaggttgaatccagtgatactatcgataatgtcaaggccaagattcaagacaaggaaggaatcccaccggaccagcagcgattgatcttcgccggaaagcagcttgaagatggccggactctcgccgattacaacatccagaaagagtctacgcttcatttggttctgaggcttcgtggtggtataattgagccttctttgatggctttggctaggaagtataaccaggaaaagatgatttgccgcaaatgttatgcccgcctgcatccccgtgctgtcaactgcaggaagaagaagtgcggccacagcaaccagctgaggccaaagaagaagatcaagtagatgttttcaagtttgtgtaagttgcagctggcgtctatctgcaccttttgttttttattagaaactaagcattttgtctggaggagcataactgttgatgctttctaaaacattgaattagcataatgttgatggattttattttgttacatttcagttggtttcgtgatatttaagatattttcttaatttaagcc

SEQ ID NO: 11716 - DNA, 603 bp, Chelidonium majus
cagatctttgtgaaaaccctaaccgggaagacaatcaccctagaggttgagtccagcgacactattgataatgtcaaagccaagatccaggataaggaagggatccctccggaccagcagcgtctgatcttcgctggtaaacaacttgaggatggccgtactctggctgactacaatattcagaaagaatcaacccttcatcttgttttgaggcttcgtggtggaatcatcgagccgtctttgatggctttggccaggaagtataaccaggacaaaatgatctgtcgcaagtgctatgcacgtctgcacccacgtgctgtgaattgcaggaagaagaaatgtggacacagcaaccagttgaggccaaagaagaagatcaagtagatattttgtgaggttttggtaggcatggctaaaatgagcttggttgacacagtctgcaacgaactcaagctagctaggatattagatattgaaattagacctttgttactgattggcaaattaagtttttttctgttgaactatcatgtttacttcatcaaaaccatttctgaacttaaatcctgtggcaattgaatgaatgtctcccttgttggtttc

SEQ ID NO: 11717 - DNA, 785 bp, Castanea mollissima
acaccacgactgcttaagagcgagcgcgagagagagaaaaaatgcagatcttcgtgaaaaccctaaccgggaagaccatcactctcgaggtagagtccagcgacaccatcgacaatgtcaaggccaagatccaagacaaggaaggtatcccaccggaccagcagaggttgatcttcgccgggaagcagctcgaggatggccgtactctcgccgattacaacatccagaaagagtcaactcttcatcttgttctgaggcttcgtggtggtatcatcgagccatctttgatgcaattggctaggaaatacaaccaagataagatgatctgccgcaaatgttatgctcgcttgcacccacgtgctgtcaactgcaggaagaagaagtgtggacacagcaaccagctgaggccaaagaagaagatcaagtagagtgctgatcttgaggaggaagtgctatccattgtcgtgggtcatttaatgtttctgaaccatggtagcattaaagagtttgctagtagaccagaaatcagacatgtagctttgaactcaataccttcgtagatgttgaaacgttactttgttttaatatgttttgcaccttgtttggctattggatatgcatttatgttgagctcttcatttttgatatgttgaaatcaaagctggtactttggttggttatttgtgcgctcctgttttgtgtgttcttatgattggaaatttgtatgggctcgggatccttgattttggggcaaaatatgtattgcccttgacctgaaattctgt

SEQ ID NO: 11718 - DNA, 505 bp, Cocos nucifera
caccacgaaatgaaaccctaaagaggcgaagtcgggcgcgcctcgataaaagggaccgccgcgcctccatcttggggacttctgaggggaagacagggcgagggctctagagatcttcgtaataatgcagatcttcgtcaaaaccctaacggggaagaccataaccctcgaggtcgagagcagcgacaccattgacaacgtcaaggccaagatccaggacaaggaagggattccaccggaccagcagcgtctgatcttcgccgggaagcagctcgaggatggacggacgcttgctgactataacatccagaaagagtccactctgcatctggtgctgaggctgaggggaggaatcatagagccctctcttatggctcttgccaggaagtacaaccaggacaaaatgatctgccgaaagtgctatgcaaggttgcatccaagggccgtgaactgccgcaaaaagaagtgtggccacagcaaccagctgaggcctaagaagaagatc

SEQ ID NO: 11719 - DNA, 776 bp, Gossypium hirsutum
agtataaaaccctaacaatccgccactaaagcacagcttaaatataaagaaaaaaagatgcagatattcgtgaaaaccctaaccggcaagaccataactctcgaggtcgagagcagcgacaccatcgataatgtcaaagccaagatccaagacagagaaggaattcccccggaccagcaacgtttaatttttgctggtaaacaacttgaagatggccgtacattggctgattacaacattcaaaaagaatcaacgcttcatcttgttttaaggttgagaggcggaattattgagccttctttaatggctttggctcgtaaatacaaccaagacaaaatgatttgccgcaagtgttatgctcggttgcatccgagagcagtgaactgtcgcaagaagaaatgtggtcatagcaatcagttgaggcccaagaagaagatcaagtaaaccatgactgacgatggtggtttatgtcatttgcttcaaaagaacttgaataccagacttgtcaaatattttttttcccatttggttctttgcttttctaatttctatttgaaatttcatagctggatatcgctgttgttgagaagttttttagtaataattgaggttaaaatttgtactttttgacaatgtttgggctagttttcttcttttgagttgcagtaatatgcacaaaatgttgttataatgctttcaatgttttcctttataatattagagctgtaatgccgttgaaacagttttatcatgcaatatatttagtgcttttatac

SEQ ID NO: 11720 - DNA, 671 bp, Vigna unguiculata
aaaaagggaaagatgcagatcttcgtgaaaaccctaacggggaagaccatcacccttgaggtggagtcaagtgacaccattgataatgtcaaaacaaagattcaggacaaagaagggatccccccggaccagcagaggttgatcttcgccgggaaacagttggaggatggccgtaccctcgcagattacaacatccaaaaagagtcaacattgcatcttgttttaaggcttcgtggtggtattattgagccatctttgatggcattggccaggaagtataaccaggataagatgatttgccgcaagtgctacgcacgtttacaccctcgtgctgtgaactgcaggaagaagaagtgtggacacagcaaccagttgaggccaaagaagaagatcaagtaaactgttctgactgcaagatgcaaacatatgttgttatggattactggatatcttgtaaacctgacaactccattagctttttagtatcgtaggaaatcttttggaaatttgacagtttctcatgatttttgttttcaatgagactcgtttgaattattctaccgttcctcttgatggtgatacaattttgtttgacaataatgcttttcaagtcattgtttccccgactattttttattacttttatttccattataaaaaaaaaaaaaaaa

SEQ ID NO: 11721 - DNA, 880 bp, Cryptomeria japonica
ggtcggtctctactgtctcataacatcggattttagcaaccctaaaccccaacatcttcggacccagttttattttaagcaacggtagggttttggttcgtcttatttgaaatcatttcagctgtgggtagggttttcgtgattttttcctgcaagcgtcgttgacagcaggacacaatttgtacagaatctggagttttgcagggaagacgtttgagaggtaacgaagatgcagatcttcgtgaagaccctcacgggcaagacaatcaccctcgaggtcgaaagcagcgacacaatcgacaatgtcaaggctaagatccaggacaaagaaggcatcccaccagaccaacaaaggttcatatttgcgggaaagcagctagaggatggccgtacactggccgactacaacatccagaaagagtccactttacacctagtattgcgtttgcgagggggcattattgagccttctctgatggcactggcaagaaaatacaatcaagataaaatgatttgtcggaagtgctatgcccggctgcacccaagagctgtaaactgcaggaaaaagaagtgtgggcacagtaaccagctgcgaccaaagaagaaaattaagtagatttgaagcttggagtatggttgaaggcgaagcaaactattgttgttcaccttaaatttgtgttgacttaaattgaatgttttgttcacagttttgttatttgaagttaagctcgctgtcttcggagatttaatgcataatttaaattatcttagtagttagtacaaaatggccatagtcagtgaggcttttttagttaccagtctacaatctgttttttctatctgacggcagtgaaatccaaacataaaattgttagtattc

SEQ ID NO: 11722 - DNA, 592 bp, Curcuma longa
aggcgatcgaggaaagccggcgcgatgcagatcttcgtgaagacgctcacggggaagaccatcaccctagaggtcgagagcagcgacaccatcgacaatgtcaaagctaagatccaagacaaggaagggattcctccggaccagcagaggctgatctttgctggtaagcagctcgaggatgggcggaccctcgctgactacaatatccagaaagagtctacactgcatcttgtgctgaggctgaggggtggaatcattgaaccttctctcatggctcttgctaggaagtacaaccaagagaagatgatatgcagaaagtgttatgcacggttgcatccaagagctgtcaattgccggaaaaagaagtgtggccacagcaatcagttgaggcccaagaaaaagatcaagtaaaaaactgctagaatggtttttatttggattcgaggtgctttaaaagaagactagtaatagtttgaatattgtgtgttctttcagaggatactgtctctgtcctttttggatgtttagacaaatatttctatttgattctgtggttgtctaatgagatttgactgatcaagtttgctagttt

SEQ ID NO: 11723 - DNA, 692 bp, Solanum melongena
aggggagagaagcaaaagggttaagggagagatagagcgccgccaaaatgcagatcttcgtgaaaactcttacggggaagacgatcacgctcgaggttgaatctagcgacaccattgacaatgtcaaagctaagattcaagacaaagaaggtattccaccggaccagcagcgattgatcttcgccggaaagcagctcgaagatggacgtactctggctgattataacatccagaaagagtcaactttgcatttggttttgaggcttcgtggagggattattgagccttctctgatggctttggcaaggaagtacaaccaggagaagatgatttgccgcaagtgttatgctcgcctgcatccccgtgctgtgaactgcaggaagaagaaatgtgggcacagcaaccagctgaggccaaagaagaagatcaagtaggcgtgatatcttgtttagctagatcaattgtgtctgttgcagttataatgccagcctgcgatcttacagtttctgtcgtgcttcaacttgctgtaatggatagactagcatttgtcttgaacttcaaatttattgttaaagagatatccctgtgacttgatcaatgactgtttagatgaaattttgcatgtttttcctgataagcacaagcctacactagcgtatttcattttaatattcatttgtgaaccgttgtcg

SEQ ID NO: 11724 - DNA, 619 bp, Solanum melongena
gggctcatcatcagagagacaagatgcagatcttcgtaaaaaccctaacagggaagaccataacccttgaagttgaatctagcgataccatcgataatgtcaaggctaagattcaggacaaggaaggtattccaccggaccagcagcgactgatctttgctggtaagcagcttgaagatgggcgtacactggcggattataatatccaaaaagaatcgactctgcatcttgtcttgaggctccgaggtgggattattgagccgtctcttatggccttggccaggaaatacaaccaagagaagatgatttgccgcaagtgctatgcgcgtttgcatcctcgtgcagtgaactgcaggaagaagaaatgtggtcacagcaaccagttgaggccaaagaagaagatcaagtagacagacatacaattgcatttcctgtcagagatgttatgccagttgcataattttgtagtttttttgcttagctcacagtttggtggatctattgttgtctctgtttaaatgcgacacacatttgtttgaattccggttccattataagaagaatttagtgcttgctttgtgtttggtaatatgagttgtgtttttgttctttatcttcg

SEQ ID NO: 11725 - DNA, 600 bp, Solanum melongena
cgttaagtctcaaggaagaaggcgaaaatgcagatattcgtgaaaactcttaccggtaaaaccattactctggaagttgaatccagtgatacaatcgacaatgttaaggccaagatccaggacaaggaaggaattccaccggaccagcaaagactgatttttgctggtaagcagctcgaggatggccgcaccttggccgattacaacatccagaaagaatcaactttgcatctggtgctgaggcttcgtggtggaatcattgagccatctttgatggccttggctaggaaatacaatcaggagaagatgatatgccgcaagtgctatgctcggttgcatcctcgtgctgtcaactgccgcaagaagaaatgtggacacagcaaccagttgaggcctaagaagaagatcaagtagatgctgaattcctattgctgcagacttcttgttacttggattttcttatcaaaattatcgtacttggattttttgttagtaattttgataatttgctatggtttatttccaatcaacacagttatctttgttgttgtgtagtataacttgtctcatttccaattctatatctattatggacttaat

SEQ ID NO: 11726 - DNA, 607 bp, Euphorbia peplus
cagatattcgtgaaaaccctaactgggaagaccataaccctcgaggtagagagcagtgatacgatcgacaatgtcaaagccaagatccaggacaaggaaggaattccaccggatcagcagcgattgatcttcgccgggaagcagctcgaagacggtcgaaccttggctgattacaatatccagaaagaatctacactgcatcttgtgctcaggcttcggggaggaattattgagccttctctcatggctttggctcgcaaatacaatcaggacaagatgatatgccgcaagtgttatgctcgactccatccaagggctgtgaactgccgcaagaagaaatgtggccacagcaatcagttgaggccaaagaagaaaatcaagtagactcttggtgggcaacggttgctgatcattgaaatatttggttgcattaggttcagatcttttgtttgaattttagttttattgaacatatgagagctgtttttacgagaacaattatgtgcttgacttttgtggaattaagctcacttattttggatgccatgttcgtacctgctgttttggttggctgcctactgagtaattagcatttcataattaacga

SEQ ID NO: 11727 - DNA, 546 bp, Fraxinus spp
ggccgccgagaaaaatgcagatcttcgtgaaaactctcacaggaaaaacgataacgctcgaggtcgagtcgagcgacactatagacaatgtcaaagccaagattcaagacaaagaaggaattccaccggaccagcaacgattgatttttgccggaaagcagctggaagatggccgcaccctcgctgattacaatattcagaaagagtcgactctgcatttggttcttaggctacgtgggggcattattgagccatcattgatggcactggctaggaagtataaccaggaaaagatgatctgccgcaaatgttatgctcgtctgcaccctcgtgccgtgaactgcaggaagaagaaatgtggacatagcaatcagttgaggccaaagaagaagatcaagtaaacacgttgtcacgatttaacttgttgcagcctctctgtcgtgaacgatttatacaattttggatttgcattttgcttgtagtggaagacatgaaccgtgtttatctatttgttttgtttggaatgatcagaaatcaagacattac

SEQ ID NO: 11728 - DNA, 719 bp, Panax ginseng
aagcagtggtatcaacgcagagtacatggggaaagaaggagaaaatgcagatcttcgtgaaaaccctaaccgggaaaacaatcacgctcgaggtcgaatccagtgataccatcgataatgttaaggctaagattcaggataaggaaggtattcctccggaccagcagcgattgatctttgccggaaaacagcttgaagatggccgtaccctggctgactacaatatccagaaggagtctacgttgcatcttgttctgaggcttcgtggtggaattattgaaccttcattgatggctttggcaagaaagtataatcaggaaaagatgatttgccgcaaatgctatgctcgcctgcaccctcgagccgtcaactgtaggaagaaaaagtgtggccacagcaaccagttgaggccaaagaagaaaatcaagtagacaaaatttcaagtttatatcgggcagttgaaatgggaaggatgtatcaactgcagctgatgatattttaggtagctaaaatttgaaaacgctgtttgttggtgattatgtttttgtttaaagaaaaactgaaatggtaaaattatgttgtttatttgttttttgtgacacttgtagttgcataacaatgttttcaagtgaggtattgaaacagttattttataaaataaaaaaaaaaaaaaaaaaaaaaaaaaaaaaaaaaaaaaaaaaaaaaaaaaaaaaaaaaaa

SEQ ID NO: 11729 - DNA, 1223 bp, Panax ginseng
tcaacgcagagtacatggggaacacaggcttgctcatcataacataggtggaagcaagccaagcgaatagagagaaaatgcagatcttcgtgaaaaccttgaccgggaagacgatcactctcgaggtcgagtcgagcgataccattgacaatgttaaggctaagatccaagataaggaaggtattccaccggatcagcagcgattgatctttgccggaaaacagcttgaagatggccgtacgctggctgattacaacatccagaaagagtcgacattgcatttggttctgaggcttcgtggtgggattattgagccttcattgatggctttggcaagaaaatataaccaggagaagatgatttgccgcaaatgttatgctcgccttcatcctcgtgctgtcaactgcaggaagaaaaagtgtggccacagcaatcagttgaggccaaagaagaagatcaagtagagacatgatttcaagtttctaccagctagttgcagcttagagggtttatctattgcagctagtgataggttcttgggagctaaatattttgaaaccgatatggcaatagtttaccattgacaatttatgctttttgttttgtctaaaacatgaatgttggttatgttctttttgttttgttgttggtagttttatgagattttgggtcaatgttttgaattattgatgaatacattggcagggatttcttttcttatttttagtttgttctgaagttttctttacttctcttacatgtgcaagtgtgtgcatgtaaacataatcaaggatggcacatgtttaacttgatttacgtttgtttacttcaaagtttggggaagtgacgagttactgatagagtgatagaaagatggccaataaaagcaatcttcagtgtcctagtcacaaaggtaaatatacttgaagaatcatatcaagcggcaatcagatcataattaaataaagatcccccatgcaaagttgagggagggcttttggtattttagaatgtgaaggtacttgctacaatttaaatcacaaatacaaacaccccttttcgggctatcgacccatgtctggattttcccttggatttagctctagcatttccagatttcccttggagcattgcaatgaatatatgttgtgggcttttccataaaaagtagtaacgagaacccccatgacagaaatgatgcaagagatgccgggcgttttcca

SEQ ID NO: 11730 - DNA, 704 bp, Panax ginseng
ggttactcggaaccaacgactgaaagcagtggtatcaacgcagagtacatggggaaagaggagaaaatgcagatcttcgtgaaaaccctaaccgggaaaacaatcacgctcgaggtcgaatccagtgataccatcgataatgttaaggctaagattcaggataaggaaggtattcctccggaccagcagcgattgatctttgccggaaaacagcttgaagatggccgtaccctggctgactacaatatccagaaggagtctacgttgcatcttgttctgaggcttcgtggtggaattattgaaccttcattgatggctttggcaagaaagtataatcaggaaaagatgatttgccgcaaatgctatgctcgcctgcatcctcgtgccgtcaactgtaggaagaaaaagtgtggccacagcaatcagttgaggccaaagaagaaaatcaagtagacagaatttcaagtttatatcgaccagttgaaatgggaggatgtatcaactgcagctgatgatattttaggtagttcaaatttgaaatcgatgtttgttggtgattatgtttttgtttaaagaaaaactgaaatggcaaaattatgttgttttatttgttttgtgacttgtggttgcataacaatgttttcaagcgaggtattgaaacagttattttatttagtatcgcagcgagttaaaagcccttttaa

SEQ ID NO: 11731 - DNA, 640 bp, Panax ginseng
gaaggagaaaatgcagatcttcgtgaaaaccctaaccgggaaaacaatcacgctcgaggtcgaatccagtgataccatcgataacgttaaggctaagattcaggataaggaaggtattcctccggaccagcagcgattgatctttgccggaaaacagcttgaagatggccgtaccctggctgactacaatatccagaaggagtctacgttgcatcttgttctgaggcttcgtggtggaattattgaaccttcattgatggctttggcaagaaagtataatcaggaaaagatgatttgccgcaaatgctatgctcgcctgcatcctcgtgccgtcaactgtaggaagaaaaagtgtggccacagcaaccagttgaggccaaagaagaaaatcaagtagacagaatttcaagtttatgtcggccagttgaaatgggaggatgtatcaactgcagctgatgatattttaggtagttcaaatttgaaatcgatgtttgttggtgattatgtttttgtttaaagaaaaactgaaatggcaaaattatgttgttttatttgttttgtgacttgtggttgcataacaatgttttcaaatcatgaacttgtgtgtttaaattagttttaagattttaaaatttcttta

SEQ ID NO: 11732 - DNA, 690 bp, Panax ginseng
agtggtatcaacgcagagtacatggggaaggagaaaatgcagatcttcgtgaaaaccctaaccgggaaaacaatcacgctcgaggtcgaatccagtgataccatcgataatgttaaggctaagattcaggataaggaaggtattcctccggaccagcagcgattgatctttgccggaaaacagcttgaagatggccgtaccctggctgactacaatatccagaaggagtctacgttgcatcttgttctgaggcttcgtggtggaattattgaaccttcattgatggctttggcaagaaagtataatcaggaaaagatgatttgccgcaaatgctatgctcgcctgcatcctcgtgccgtcaactgtaggaagaaaaagtgtggccacagcaatcagttgaggccaaagaagaaaatcaagtagacagaatttcaagtttatatcgaccagttgaaatgggaggatgtatcaactgcagctgatgatattttaggtagctaaactttgaaatccatgtttgttggtgattatgtttttgtttaaagaaaaactgaaatggcaaaattatgttgttttatttgttttgtgacttgtggttgcataacaatgttttcaagcgaggtattgaaacagttattttatttagtaaaaaaaaaaaaaaaagaaaaaaaaagaaaaaaaataaaagta

SEQ ID NO: 11733 - DNA, 781 bp, Gnetum gnemon
cgataaggcgtgaaggctgtacgaagggaaggtgcaacgagggttttgcaggaggtagggtttgtaggaagcaaagcccctaatattgtaaccctagcaagcaacgagcagagagcaatttgttacagagcagagggacgctgtgcgagcgaagcaggaagagatcacgatcaagatcaagatgcagatcttcgtgaagaccctgacgggcaagaccatcactctcgaggtcgagagcagcgacaccattgacaatgtcaaggccaagattcaggacaaggaaggaattccccctgaccagcagcgtctgatcttcgccggaaagcagctcgaggatggccgcacccttgcagattacaatatccagaaagaatcgacgttgcaccttgtgttgaggctgcgaggagggctcattgagccttctttgatggcgctggcccgcaaatataaccaagataagatgatctgcagaaagtgctatgcccgtttgcatccgagagccgttaactgcaggaagaagaagtgcggtcacagtaaccagctgcgcccaaagaagaagattaagtaaactatattgcttgagaacctaaaactgattcagtccgatcagatgttttggaacgttattttttaagggatgcaacagtgtgtgcatttacaattttaaaggattacagaattgatgtaaacgtgatctttttacttaactattgactgaattttgcacgaacgttatatttgccaatatggagttatcttattaaagaaccagttgttccaa

SEQ ID NO: 11734 - DNA, 672 bp, Vitis vinifera
tcctcagcaagcgacagaaggcggcgaaaatgcagatcttcgtgaaaaccctaactgggaagaccatcaccctcgaggttgaatccagcgataccatcgacaatgtcaaggccaagatccaggacaaggaagggattcctccggaccagcagcgactgatctttgctggaaagcagcttgaggatggccgcactcttgctgattacaatatccagaaagaatcaactctgcatctggttctgaggcttcgtggtggtattattgagccatccttgatgcaattggctaggaaatacaatcaggacaaaatgatctgccgcaaatgttatgcacgcctgcacccacgtgctgtcaactgcaggaaaaagaagtgtggccacagcaaccagttgaggccaaagaagaagatcaagtagatgactggattggaggttgccttggtgcatgcagtgttacacacggagcattggatgtgccatggctacatggatgagtttgctaatagaggatttttagggatcaaaagttgtaggcctagacctcttgcattgatttggtcacaaacgatgcttttgttttgatactctgtttcttggttgctgtttgacattattaagcttattaaatttttgcttaagacaattttaattcgaaaaaagatagttttctgtt

SEQ ID NO: 11735 - DNA, 772 bp, Humulus lupulus
gtctccagcctatcatatataaacaacctccacgagcacacaccagaagaaaaaccctaacgccgagtgtgtggaagacagagaacaaggccttgaagatgcagatcttcgtgaaaaccctaaccgggaagaccatcaccctcgaggtcgagtctagcgacaccatcgacaatgtcaaggccaagatccaagacaaggaagggattcctccggaccagcagaggttgatcttcgccggaaagcagctcgaggatggccgcactctcgctgattacaacatccagaaagagtcaacattgcatttggttctgaggctccgtggtggaattatcgagccatctcttatggcattggccaggaaatacaaccaggagaagatgatctgccgcaagtgctatgctcgcctgcaccctcgtgctgttaactgcagaaagaagaagtgtggacacagcaaccagttgaggccaaagaagaagatcaagtagacattctaccacaaggtgctgctgctatttccgattagaacattaattttgttttgccatctcaattttaggaactcaagtatgttttaaacaacatttgctttactgggataattattacctatttttctttgtacttgggaattttggttatgagtgataattttcagacattgagttttgcctttttgtgtgttaaattggtattgaatacagtcatattatcatatatgcatatttcgtaaaaaaaattacacaataaaacgaaaagcagcaaagaagatttt

SEQ ID NO: 11736 - DNA, 577 bp, Mesembryanthemum crystallinum
ccggttggggaagacgaacaaaatgcagatcttcgtgaaaaccctaactgggaagaccataaccctagaggtcgaaagcagtgacaccatcgacaatgtcaaggctaagattcaagacaaagaagggattccaccggaccagcagcgtttgatcttcgccggtaagcagctcgaagatggccgtactcttgccgactacaacatccagaaagaatcgactcttcaccttgtgttgaggctcagaggaggaattattgagccctctttgatggctttggctcgtaaattcaaccaagacaagatgatttgccgcaagtgctatgctcgtttgcaccctagagctgtcaactgccgaaagaagaaatgtggacacagtaatcagttgaggcctaagaagaagatcaagtgattgtataccgactgttttaccatcactatccttcatgttgtatctcggagcggcttccaagttttggtgattgtatttgctttagaatcacaaagtctgcgttatttactctgtttgtacctcaaactattgttgtctgtatttgttcccgcggtaaacacaggtatc

SEQ ID NO: 11737 - DNA, 676 bp, Ipomoea batatas
ggccggggacggagatcgggaagtgaggcgagaaaaatgcagatcttcgtcaaaaccctcaccggcaagaccatcactctcgaggtcgagtccagcgacaccaacgacaatgtcaaagctaagattcaagataaggaagggattccgccggatcagcagaggctgatttttgccgggaagcagttggaagatggccgtactctggccgactacaacattcaaaaagagtccactcttcacctggtgttgaggcttcgtggaggaattattgaaccgtctttgatggctttggccaggaagtacaaccaagataagatgatctgccgcaagtgctatgctcgcttgcatccccgtgctgtcaactgtcgcaaaaagaagtgtgggcacagcaatcagttgaggccaaagaagaagatcaagtagattttgtttttgaagatgagccaaccttgtatcagatggtttctacaacatatggaactaggaatctctataatctgcaaaatttgacttaaaactttagtatgaatgatgttttgtttctttcttgtggttatacttgagattgaatttgtttcggtactgttttaacttttggtaaaagctcctttgtttatcttttcttcattgattaaaattaatggagggatacgcaaagcgtacaatagtttgtcct

SEQ ID NO: 11738 - DNA, 560 bp, Ipomoea batatas
ttagagattcacagctctgaagaaggaagcaaaatgcagactttcgtgaaaactctaaccggaaaaaccataactctcgaggttgaatcgagcgacaccatcgacaatgttaaggctaagattcaagacaaagaaggcattcctccggaccagcagcgattgatctttgccggcaagcagcttgaagatggccgcacccttgctgattacaatatccaaaaggaatctaccttgcatttggttctgagacttagaggtgggatcattgaaccatctctcatggctttggcccgcaaatataatcaggacaagatgatttgccgcaaatgctatgctcgtctgcacccccgtgctgtcaactgcaggaagaagaagtgtggccatagtaaccagttgaggccgaagaagaagatcaagtagacatttagtcggctggagtgcttggattgctttcttattgggctgtgcttaaagatatttattccttgtaaccgtttgttggattcttgatgttctcaagattttcacttgctgatcataatatcatatattttcttgac

SEQ ID NO: 11739 - DNA, 582 bp, Actinidia deliciosa
cagatattcgtgaaaaccctaacggggaagacgataactctcgaggtagagagcagcgacaccatcgacaatgtcaaggccaagatccaagacaaggaaggaattccaccggaccagcagcggctgatattcgccggaaagcagctcgaagatggccgaaccctcgctgactacaacatccagaaagagtcgacccttcatcttgtactgaggcttagaggagggattattgagccttccttgatggctttggctcggaaatataatcaagacaagatgatctgcaggaaatgttatgctcgcctccatcctagggctgtgaactgccggaagaagaagtgtggccacagcaatcagctgaggccaaagaagaagattaagtgaacactttggactaccattttctgtgccttgaggtgttaactggagaatgaaattctatacaaagctagtaacgccattaagacaacaggcactatttctatattttatgttttcgattccccctaatgcattttgcagacatacttgtagttggaagagaattggatcttactccttatatctacaatttttgatata

SEQ ID NO: 11740 - DNA, 860 bp, Marchantia polymorpha
gctagttcgagaattgggccaagcgttgctggaattgggcgtcggtcgagatgcagatcttcgtgaagaccctcacgggcaagactatcaccttggaggtcgagagcagtgatactatcgacaatgtgaagactaagattcaggacaaggaaggaattccccctgaccagcagaggttaattttcgctggaaagcaactcgaggatgggcgcactctcgcggactacaacatccaaaaggagtcgaccctacatttggtgctccgtctgcgtggaggtatcatcgagccttcccttatggctttggccaggaagtacaaccaggacaagatgatctgccgaaaatgctacgccagattgcacccacgagctgttaactgtaggaagaagaaatgcggtcacagtaaccagctgaggccgaagaagaagatcaagtagacattggatcttgtttttgggtggaagtggattgggagtaaatcgcaatcttcacacgttgcaaatttttacgccttttatactgctcaacagttcacatctttttgaaacatatcaccatagctacaaccaccatatactcaatgtgtgatcttgagattctgtaacagaaggcacgtcacctgaaatggtatctggggtatcagggccatttagatttatcgaacacaaaaggttattattggcaagtgacattgttattgaaacctgtgatatttgaactcctggaatcagcagcaaagcaactacattttgagctcatgaggtgcggcgacgaaaagatgtttctgattcgtcctaattcactgtgctatgagacaattttgttatattttgtacatttcgttgagatcttctaccgtg

SEQ ID NO: 11741 - DNA, 535 bp, Marchantia polymorpha
cctcctcctttctcccactctcgaattctgtcacctgcaacgatgcagatcttcgtgaagaccctcacgggcaagactatcacgctcgaagtcgagagcagtgataccatcgacaatgtgaagaccaagattcaggataaggagggaattcccccggaccagcagcgtctgatcttcgctggaaagcagctcgaggatggccgcaccttggctgactacaacatccagaaagagtctaccctccaccttgttctgcgtctacgaggaggaattattgagccctcgctcatggctcttgccaggaagtacaaccaggacaagatgatctgccgcaaatgctacgctcgtctacaccctagggctgtcaactgcaggaagaagaagtgtggacactctaaccagttgcgaccaaagaagaaaatcaagtagaccatctttcatctggtttgggagcatgccatcaattttgtccacgaaattctggagtgtttctaattgttcaataaagagactttattatgaatcaaaaaaaaaa

SEQ ID NO: 11742 - DNA, 668 bp, Tropaeolum majus
atcagaaaccctcttagcagctgcttaaggcggatcgaagaagtttgggaacgaatcctttcaagatgcagattttcgtgaagaccttaaccgggaagaccatcaccctcgaggttgaatcgagcgataccatcgataatgttaaggccaagattcaggacaaggaaggtatccctccggaccagcagagattgatcttcgctggaaagcaactcgaggatggccgcactcttgccgactacaacatccaaaaagagtcaaccctccatttggttctgaggcttcgtggtggaatcatcgagccttctttgatggctttggctaggaagtacaaccaggaaaagatgatttgccgcaagtgttacgctcgtctccacccccgtgctgttaactgcaggaagaagaagtgtggacactcaaaccagttgaggccaaagaagaagatcaagtagagtgctgagcatgaaactgcaagtccatgtagtagctttaaagcatctttcaatagatatgttagtttcaattttcgacaattgggatctttatggtgtaaactgcttattatgactcgctatggagccctgaatttttgatttcatatgtttatgcaagtatgtttatctgtttttcaaatttgcataatacaatgctctatgcttccctctaaa

SEQ ID NO: 11743 - DNA, 791 bp, Tropaeolum majus
ctgcggaaaagtaaagggaggtgaacaacaaacttagtgaggatgcagatcttcgtcaaaaccctaaccggtaagaccattaccctcgaggtcgaatcaagcgataccattgacaatgtgaaggctaagattcaggataaggaaggtatccccccggaccagcaaaggctgatcttcgctggaaaacaactcgaggatggccgtactcttgctgactacaacatccagaaagagtcaaccctccaccttgttctgaggcttcgtggtggtattattgagccttctttgatggcattggccaggaaatacaatcaggaaaagatgatctgccgcaaatgttacgcacgtctgcatcctcgtgctgtgaattgcaggaagaagaaatgcggccacagcaaccagttgaggccaaagaagaagatcaagtagacgtctgagtttgctttgcttggatttagtcctttcttttcactagttatattacattgttcggtggacatgtctttaatttatattttcctttaagatggctgattaagtaatacattttgttactaagtttctttcttatccgttaatgcagatcagtgcataaattgtttttttgttttaaggcatgatggaaatacttttatagttgtgcactaattcttttttttatttaatttcagtctttgcattcttaataactagttattgtatagctccttagaaactacggcaaaattggtagtttacattataattatcatccaattataatcaaccgtcgaatctacccatgttggaat

SEQ ID NO: 11744 - DNA, 618 bp, Nicotiana benthamiana
gagaaaacttctaaaccctaaaaatcaccaatataagcttcctgaaagaaaaagagcctacaacggaagttccccgtatcggagagataagatgcagatcttcgtgaaaaccctaactgggaagaccatcacccttgaagtcgaatcgagcgataccatcgacaatgtcaaggccaagattcaggacaaggaaggtattccaccggaccagcagcgattgatctttgctggtaaacagcttgaagatgggcgtacactggctgattacagtatccagaaagagtcgactctgcatcttgtgttgaggctccgtggagggatcattgaaccgtctcttatggcattggccaggaaatacaaccaggataagatgatttgccgcaagtgctatgcccgtctgcatcctcgtgccgtaaactgcaggaagaagaaatgtggccatagcaaccagttgaggccaaagaagaagatcaagtaaacaggcggttgcatttgctgtctagatgctatgccaattgaatgattttgtagtttggtgggtttctattgttgtctgtttaactgcagcacatttgtttcaacttcagttccatttagtgctcatttttgagtttggta

SEQ ID NO: 11745 - DNA, 592 bp, Nuphar advena
agaagatatgcagatcttcgtgaaaaccctaacggggaagacgataaccctcgaggtagagagcagcgacaccatcgacaacgtcaaggccaagatccaggacaaggaaggcattcctccagatcagcagcgacttatttttgctgggaagcagcttgaggatggccgaaccctagccgactacaatattcagaaagagtcgacgctgcatcttgtactgaggcttcgtggtgggattatagagccttccttgatggctttggcaaggaagtacaaccaagaaaagatgatctgccggaagtgttatgctcgtttgcatccgagagctgtgaattgccggaaaaagaaatgtggtcacagcaatcagttgaggcccaagaagaagatcaagtgagcagtcactcgggctatatgctaccagtctttttttggttaagaagatgaaacgcttgggatatttattgttagactttagaaaacatatagtttatggtttaaattttcctttcttgatatgactgaggttctttgccctgtatcgaattgcagtttcccttttctttaatgctttgagaagttccctttatttcat

SEQ ID NO: 11746 - DNA, 701 bp, Nuphar advena
catatttcggtttaaggtaatctacaatatccatgaagacaaccatctgctcattcaggcagaagagaggtcaaggaaaagaggggaaagagatgcagatcttcgtgaaaaccctaacggggaagacgatcaccctcgaggtcgagagcagcgataccatcgacaatgtcaaggccaagatccaggacaaggaaggcattcctccggaccagcagcgtcttatttttgctgggaagcagcttgaagatggccgcaccctagctgactacaatattcagaaagaatcaacactgcatcttgttctgaggcttcgcggtgggattatagagccttctttgatggctttggctaggaagtacaatcaggaaaaaatgatctgcagaaagtgttatgctcgtttgcatccaagagctgtgaattgccggaaaaagaaatgtggccacagcaatcagctgaggcctaagaagaagatcaagtgaggcgcttgctctcctggttacagtgttacagagatgaccctttacattgttaagacttgaagtacattcaatttacttgtgactcaaattttgctttctggaaatctcggtgctttgcatagactgtatgaattgttgttgcagattttcttgcttgttatggggggagtcttctttaattcttgaaacttttagcattgaaccatatgtgttttccttggc

SEQ ID NO: 11747 - DNA, 523 bp, Allium cepa
tgcagatctttgttaaaaccctaacagggaagacaatcaccctagaagtcgagagcagcgacacaatcgataatgtcaaagctaaaatccaagacaaagaaggaattcctccggatcagcaaaggctgatttttgcaggaaaacagctcgaagatgggagaactctagctgactataacatccagaaagagtctactttgcatttggtgttgaggttgagaggtggacttatcgagccttctctgatggcacttgcaaggaagtacaaccaggataagacaatttgccgcaaatgctatgcaaggttgcatcctagggctgtcaattgcagaaagaagaaatgtggccacagcaatcagctaaggccgaagaagaagatcaagtaggcactttggtcagttatttattgtgacggtgaaatatgatgggaaccattcatttattctactttttatttatttacttgaactaaatatttggtgtactttgcatcttagaattgattatctgtgaccattaggaa

SEQ ID NO: 11748 - DNA, 1855 bp, Petroselinum crispum
gaaccctaataggcaagtataaaagcaagcgtttgagccaaacggcagctaataaagcagacggcaaaaatgcagatctttgtgaaaaccctaaccggaaagaccatcaccctcgaggttgaatccagtgatactatcgataatgtcaaggctaagatccaagacaaggaagggattccacctgaccagcagcgattgatcttcgccggaaagcagcttgaagatggccgtactcttgctgattacaacatccagaaagagtcgactcttcatttggttctgaggcttcgtggtgggattattgagccttctttgatggctttggctaggaagtacaatcaggagaagatgatttgccgcaaatgttatgcccgcctgcatcctcgtgctgtcaactgcaggaagaagaagtgtggtcacagcaaccagctgaggccaaagaagaagattaagtagatgattgcaaatttctgtgagctagttgcagcgagtgttctatctgcagccgagcttttgtcatgctgtttaaagaaactaaacattatgtcctaatatgcataattgatcttgctttctaagacattgaattagcataatgttgatggatttccttgtgttaacattccttttagtttttgatattatgatattttgttaattttagggccaaggtatcaaattttgctatatcttttattttagtctgaattgtttactggaatatgtggatgcagacagtgaactaattaagtagggactcccaacccctctccgtcatatacatgtattaggtggatggtgctatgaagaataaaattgatattatggataggaattatcatgttctgtgctcaatttgttattagatggaatcctttagttttatagggatatatgtagtctaaacacctagtgcattccttgaattcttgcactagagctacactttatattattccccctactgccatgttaccaataaatgcattaatgtatgaccttggccacacactagaaaaacagtaactttaatcgtcttttaaaggctcactaattctattgcttttggtactgaatgtaatacaagcctgatagctgattgttttcaccttctcggctgatgtcgcacttgatgcactgtcccaatgttaaaatgcattgtgatccatcgatggttgaatttagtaccttaagcatgaagttcatagaggtttcaaagttttaatagtgtttgggtagaagaaacagttgttcaaatctacgcatcactaaatagcatcaggagcaactcacaggcccttggtgtcctcgatgaaagatcagtaaagtatttgtattatattatgtttttgacgttcgtaacctaaatgaacagatgtcatccggagatggtagggctctgtcaaccttcatagtctttaacaaattttagaaagactaaagttgtaatggtttgattgatttcttatgccctagtcctatctcaaatttctgaaccaagtttttaacatctcaatgcaaatgggacaagaagccataaacttacatagagatgttaattttaagaagagtttgattttacagatgtgctttgagtaattaaatttgtggtcacctgctgatgaggaaaaaacaagggtgttaatcgaaaattttaatatcgtccacctggtgactagaattctttatttatgcggatgcctgatgccacagtaacaattcggagtcaaaaagctcaagtaaaaatattgggagtttttcattccttatccatattctctattacttcctgtgcatgttgcacttgagcatgatattgagtgtgcttttcataacagggttcaaagtatacgtg

SEQ ID NO: 11749 - DNA, 1036 bp, Petroselinum crispum
caagtatacaaataagctgcatatacacaaatgttgacatttataggcggataaaagcgagcaagaaaagaagggaggcggggcagaagaaagatgcagatcttcgtaaaaacactgacgggtaagaccatcactcttgaagtagagtccagcgatactattgacaatgtcaaggctaaaatccaggacaaggaaggtattcctcctgatcagcagagattgatctttgctggaaagcaacttgaggatggtcgcactcttgctgactacaatatccagaaagaatcaactttgcatcttgttttgaggcttcgtggaggtatcattgagccttctttgatggctttggcacgcaagtacaatcaggagaagatgatttgccgcaagtgttatgctcgccttcatcctcgtgcagtaaactgcagaaagaaaaagtgtggccacagcaaccagttgaggccaaagaagaagatcaagtaaacataatatcaagtgtcagtgttcttgttttatcttgggaggtgtctctgttgaagtgtattctctttagttttgaaaattaatattctgtagtaatttattaagttttgaattttgagacatccgggctgttcgacagttctccgtgttttaaattgaaattttctccatatgtatcttttaaattgtgatatattctgtgtgtattagtttcacatatatatgcaccgtgtaggatgcatttatatgtaatgttgtgatcacatatttgcttccaatgtgtttttgtgatcacatttgtatgttgtaatttaggatttgtgaattgagataggatcacagctaaataaaatttatgcctaaaatagtgttgtgcttgaaacaagttgcaagtttcttaatagatgataaacaatagctaaataacatacttctgagttctaacaacggatttgattctacaaattaaagagtaaaaatgctaatagaggatataaagcatttcttccaactttaaacgggtactcctcccctcatttgaaatagagtgattaca

SEQ ID NO: 11750 - DNA, 1427 bp, Petroselinum crispum
gaaccctaataggcaagtataaaagcaagcgtttgagccaaacggcagctaataaagcagacggcaaaaatgcagatctttgtgaaaaccctaaccggaaagaccatcaccctcgaggttgaatccagtgatactatcgataatgtcaaggctaagatccaagacaaggaagggattccacctgaccagcagcgattgatcttcgccggaaagcagcttgaagatggccgtactcttgctgattacaacatccagaaagagtcgactcttcatttggttctgaggcttcgtggtgggattattgagccttctttgatggctttggctaggaagtacaatcaggagaagatgatttgccgcaaatgttatgcccgcctgcatcctcgtgctgtcaactgcaggaagaagaagtgtggtcacagcaaccagctgaggccaaagaagaagattaagtagatgattgcaaatttctgtgagctagttgcagcaagtgttctatctgcagccgagcttttgtcatgctgtttaatgaaactaaacattatgtcctaatatgcataattgatgttgctttccaagacattgaattagcataatgttgatggatttccttgtgttaacattccttttagtttttgatattatgatattttgttaattttaggcccaaggtatcaaattttgctatatcttttatttttagtctgaattgtttactggaatatggggatgcagacaccgagctaattaagttgtgacccccaacccctttccctcaaatacatgtattaggtagatgatcctagtgaagaataaaattgatattatggataggaattctcatgttctgtgctcaatttgttattagatggaatcctttagttttatagggatatatgtagtctaaacagccaagccattccttgaactcttagactagagctacactttatatcattccccctgctgccatgttaccaataaatgcgttaatgtgtgcccttggccacacactagaaaaaacagtaactttaattgtcttttaaatgctcactgaattctattgcttttggtactgaatgtaatacaagcctgagagctgattattttcaccttcccggctgatgtcgcacttggtgcactgtcccaatgtacgaacacattgtgttctaccgatggtcgaatttagtaccttaagtatgaagttcatagaggtttcaaagttttaatagtgtttgggtagaagaaacagttgttcaaatctacgcatcactaaatagcatcaggagcaactcacaggcccttggtgtcctcgatgaaagatcagtaaagtatttgtattatattatgtttttgacgttcgtaacctaaatgaacagatgtcatccggagatggtagggctctgtcaaccttcatagtctttaac

SEQ ID NO: 11751 - DNA, 717 bp, Arachis hypogaea
gtggtatcaacgcagagtacgggggagaagaagaagaagaagatgcagatattcgtgaaaaccttaactgggaaaaccatcactctcgaggtagagagcagtgacaccatcgacaatgtcaaaaccaaaatccaagacaaggaaggaatcccacctgatcaacagcgtctgatatttgctgggaagcagcttgaagatggaaggaccttagctgattacaacattcaaaaggagtctactctgcatcttgtgctgaggctccgtggtggtatcattgagccttctttgatggctttggctcgcaagtacaatcaagacaagatgatttgccgcaaatgctatgctcgtcttcatccaagggccgtaaactgccgcaaaaagaagtgtggccatagtaatcagttgaggccaaagaagaagatcaagtaaactatgtctgttcttgtttgtcttcttcagtgttgtgcaactcctacaagttttcattttacaattgatttcatcccctttttggtactaatgggtttcaaacggttttggacttgttttgtagcattcaactatacatacttttacttatgatggcattatgatttctaccaaaaaaaaagaaaaaaaacaaaagtactctgcgttgataccactgcttctgagactgacaacgagacacagggataggcccccccccccccccccccccccccccccccccccccc

SEQ ID NO: 11752 - DNA, 579 bp, Phalaenopsis aphrodite
aggatttgcagcagtttcaccgtgaagatgcagatcttcgtgaaaaccctaacagggaagaccattactctcgaggtcgagagcagcgacaccatcgacaatgtgaagacgaagatccaggacaaggaaggaattccaccggatcagcagcggctgatctttgcggggaagcagcttgaagatggacgaacgctggctgattataacatacagaaagaatcgactctgcatttggtgctgaggctcaggggtggtatcatcgagccctctctgatggctcttgctaggaagtacaaccaggataagatgatctgccgcaagtgttatgcaaggctgcatccacgagctgttaattgcaggaagaaaaagtgtggacacagcaaccagctgaggcccaagaagaagatcaagtaaaccatgtttcaattctaaaaactattactcatttgctgctttcaactggatgttaattatattttttatgttcagactgtttctttttagcactggccttgttgccatacacactattgtctattttagtcctttgctgttccacttctgataaaaaaaaaaaaa

SEQ ID NO: 11753 - DNA, 556 bp, Phalaenopsis aphrodite
gttagggtttgctgcagcttcgtcgtgaaaatgcagatcttcgtgaaaaccctaacagggaagaccattactctcgaggtcgagagcagcgacaccatcgacaatgtgaagacgaagatccaggacaaggaaggaattccaccggatcaacagcggctgatctttgccgggaagcagcttgaagatggacgaacgctggctgattataacatacagaaagaatcaactctgcatttggtgctgaggctcaggggtggtatcatcgagccctctctgatggctcttgctaggaagtacaaccaggataagatgatctgccgcaagtgttatgcaaggctgcatccacgggctgttaattgcagaaagaaaaagtgtggacacagcaaccagctgaggcccaagaagaagatcaagtaaacaatgtttcaattctaaaaactattactcatttgctgctttcaactggatgttaattatattttttatgttcagactgtttctttttagcactggtcttgttgccatacactattgtctattttagtccttggttgtt

SEQ ID NO: 11754 - DNA, 564 bp, Phalaenopsis aphrodite
tggttagggtttgctgcagcttcgtcgtgaaaatgcagatcttcgtgaaaaccctgacagggaagaccattactctcgaggtcgagagcagcgacaccattgacaatgtgaagacgaagatccaggacaaggaaggaattccaccggatcaacagcggctgatctttgccgggaagcagcttgaagatggacgaacgctggctgattataacatacagaaagaatcaactctgcatttggtgctgaggctcaggggtggtatcatcgagccctctctgatggctcttgctaggaagtacaaccaggataagatgatctgccgcaagtgttatgcaaggctgcatccacgggctgttaattgcagaaagaaaaagtgtggacacagcaaccagctgaggcccaagaagaagatcaagtaaacaatgtttcaattctaaaaactattactcatttgctgctttcaactctatgttaattatatttttatgttcagactttctttttagcaatggtcttgttgccatacacactattgtctattttagtccttcgctgttccatttc

SEQ ID NO: 11755 - DNA, 638 bp, Lippia dulcis
ctgcgcggcgaggagaagagaacacaactcggaaaaaatgcaaatcttcgtgaaaaccctaactgggaagactatcacgctcgaggttgaatcgagcgacacgatagacaatgtcaagaccaagattcaggacaaggaaggaatcccaccggatcagcagcgtttgattttcgctggaaagcagctcgaagatggccgaacccttgctgactataacattcagaaagagtcgactctgcatttggttctgaggctgaggggtggaattatcgagccttctctgatggcgttggctaggaaatacaatcaggacaagatgatttgccgcaagtgctatgctcgtttgcatcctcgtgccgtcaactgcaggaaaaagaagtgtggacacagcaaccagttgaggccaaagaagaagatcaagtagactgtttgctggacagagattacctttgcttttccttttgcctttgttttagtaccttccattgaactcattgcgtggttgttttgccgatagtctggctatattactgcaaaaatgaattttggatcttgttttgcatttgttgtttctgctaattatgttgacaatcatgcagcctttatttctttatagtccttatatctgtggcgtgatc

SEQ ID NO: 11756 - DNA, 681 bp, Lippia dulcis
ctctaatttcgtgtagagagcggcggcgaacacgctaaggaaaaatgcagatcttcgtcaagacgctcaccggaaaaaccatcacgctcgaggtcgaatcgagcgacaccatcgacaatgtcaaggccaagatccaagacaaggaaggaatcccgccggatcagcagcgtttgattttcgctggaaagcagcttgaagatggccgaacactcgctgactacaacatccagaaagaatcgactctgcatttggtcctgaggctcaggggaggtatcatcgagccatcgcttatggcgttggccaggaaatacaatcaggagaagatgatctgccgcaaatgctacgctcgtctgcaccctcgcgctgtgaactgccgcaagaagaagtgtggacacagcaatcagttgaggccgaagaagaagatcaagtagactactggattgattgcgtatctcgttaccattttgtcccctctactttagttactgccatcgaaactgaatagttttgctgtctttttcacatgttgacattcgatcgaaattacagacatgctgcacttcattgatttgcagttttatattgttgaatggattggttttttcccacaaattcctgtcatggctgttgaagatttagttcatttgagaattaatgatttcatgttcccacaaaaaagaa

SEQ ID NO: 11757 - DNA, 554 bp, Lippia dulcis
aggtgtaaacgaaccagaaaaatgcagatcttcgtgaaaaccttgaccggaaaaaccataacgctcgaggttgaatcgagcgatacgatcgacaatgtcaaggccaagattcaggacaaggaaggaatccctccggatcagcagcgtctgattttcgccggaaagcagcttgaagatgggcgaactcttgctgattataacattcagaaagaatctaccctgcatttggttctgaggcttaggggtggaattatcgagccgtctcttatggctttggctaggaagtataaccaggaaaagatgatttgccgcaaatgctatgctcgcttgcaccctcgtgcggtcaactgcaggaagaagaagtgtggacacagcaaccagttgaggccaaagaagaagatcaagtagattacctggttgatcagttttgtctttgcttggtttttgttgatgaatactgattttgaacttcataatgcaagattttgctaatacatttcagaattttgatgatgtagcgctttgattaatctacaatcagaagacttctttca

SEQ ID NO: 11758 - DNA, 921 bp, Cajanus cajan
caacggaattagttctggagtagcataacctgggtatccaaacaccgagttctgaaaaccctaataaaaaaaattaaaattctaccccttatatatatattacgtacacagacactagaaaccctaatagtaagttgagaagagagggaggaaagatgcagatctttgtgaaaactctaaccgggaagaccatcacccttgaggtggagtcaagcgataccattgataatgtcaaaactaagattcaggacaaagagggaatccctccggatcagcagaggttgatcttcgcagggaaacagcttgaggatggccgtaccctcgccgattacaacattcagaaagagtcaacattgcatcttgttttgaggcttcgtggtggtattattgagccatctttgatggctttggctaggaaatataaccaggataagatgatttgccgcaagtgctatgcacgcctacacccccgtgctgtgaactgcaggaaaaagaagtgtggacacagcaaccagttgaggccaaagaagaagatcaagtagactgttctgcttgcccgaaggaattctgcgttgttatggattactggttgtcttgtaatcctaataactccattagctacttagtattgtaggaaatcttttggaaatgtgacagtcaaagttactctattatttttgtttagtttgagacggattgatatcaattatgcaacatttccttgtgatgacagttttgtttttgataataatgcgtgtgatgtctttgttccctatcaccataatttggtatactttacctttttcattttaactcgtgaaagactgagctgtaattgttgaatacctcgtacttattcctttttaactagtgaaagaccaggcccgataattacaagtagagtttcttgttgagttgtgt

SEQ ID NO: 11759 - DNA, 803 bp, Populus trichocarpa
gctataaagtcctaatgacacccaacaacacagccgttctcattttcaagagtggaagatagagagcaagtaaagatgcagatctttgtgaaaaccctaactggcaagaccattaccctcgaggttgagagcagtgataccatcgataatgtcaaggccaaaattcaagacaaggaagggattccaccggaccagcaaaggttgatttttgctggaaagcagctggaagatggcagaactttggctgattacaatattcaaaaagaatcaacacttcatttagtgttgaggcttagaggaggaattatcgagccttctttgatggccttggcgcgcaaatacaatcaagagaagatgatttgccgcaagtgctacgctcgtctgcatcccagggctgtcaactgtaggaagaagaagtgcggtcatagcaatcagttgaggcccaagaagaagatcaagtaaaggatcattactgcatttgtgcctgagatgaattcgagtgtgagattttggacttgtttttgtcattgttgtggaatctggatttactaagacaacctgtgattaatctacatgaatattattaagattttgctgtctttattttgatatttacaatatattctgttttctgatttttccctcgtcttaatcgtatgcggtgttttatcttgtgtgattgtgatctaattttttatgtgattttcccttctctctctaaacacatgttagtaagcaaaccatttccaaggacttttatttttaactgcatatttagtgtatgctatagatcttaaactttt

SEQ ID NO: 11760 - DNA, 942 bp, Populus trichocarpa
tgcctattctcgttcagcataccacaatcctaaaatacaaacaccacctcaaaacaggagtgaaaccctagctgccactgaccgtcaaactatataaagaaagcgggctcatacggtggcctcacatttggcagaatgcagatctttgtgaaaaccctgactggcaagaccatcactcttgaggtcgaatctagtgatactattgacaatgtcaaagccaaaatccaggacaaggaagggattcctcctgatcagcagagactgatctttgctgggaagcagctggaagatggccgtacccttgctgattacaatatccagaaggagtcaacactgcatctggttctgaggcttcgtggtggcattattgagccatctttgatggctttggccaggaaatataaccaggaaaagatgatttgccgcaaatgttatgcacgcctgcatcctcgtgctgtcaactgcaggaagaagaagtgtggccacagcaaccagttgaggccaaagaagaagattaagtagactattgatcaggaggcgtggttactgcatttcctattaggtttttggatgtttgtctttgattatgttggtatcaaatatttttctggttagggttcaagactttcatgttatttggttttagaatacttttgtactgtgatctttatttcgaatgcgtgatccaaacttaacacaaatcttttttagataatgtggcagatatcacttaatctgattaaagggaatattctgttgaagtggtatgtttatagaaaatgaaatttaggtcacttgactttgtagctacttggtccttgagatccgagtttcatcagaaaatgatagctttgtagttaccatgctctcaccagcagctttgtccatttcagttttcatatttttatgtttgtatccgttacatataacttgttctttaaa

SEQ ID NO: 11761 - DNA, 1001 bp, Populus trichocarpa
aagagaaaccctagctgtcttactatataaaaaagcaagctcaaatggaggcctcactcttggcacaatgcagatctttgtgaaaaccctaactggcaaaaccatcactcttgaggtcgaatctagtgatactattgacaatgttaaagccaaaatccaggacaaggaagggattcctcctgaccagcagaggctgatctttgctggcaagcagctggaagatggacgtacccttgctgattacaatatccagaaggagtcaacacttcatctggttctgaggcttcgtggtggaattatcgagccatctttgatggctttggccaggaaatataaccaggaaaagatgatctgccgcaaatgctatgcacgcctgcatcctcgtgctgtcaactgcaggaagaagaagtgcggccacagcaatcagctgaggccaaagaagaagattaagtagactgtttatcaggtggcggagttccagtacttcctattaggttatgggatgtttagtatctggttatgtcgaacattttgctggttagggttttaagacttccatggccgcagtttgaaattgcaatgttttatgattatgtggttattttgctatagaatactttaacaacgccatctttattctgaatgcttgcttcaagctcaacgcaatattttcatgtcctttataatggttacaagtgagaccttgataatgatatggacaagtgacttccatggctggatcctaagttgatatccagtgtgttgaatataaggtcaagtatgagatgcagcttcaaaacaactcaatgttattgttgcaccaagtttcccacaactcacatcagcgttttgctgcgtataacagagtatttcaaccccaggattccagtctctgttgataccatgttgaaatcttataacagagcattccaatgttcgaactccacggatttcaaaatgttggcattgattttaatgaagaacagttacagatgtttatg

SEQ ID NO: 11762 - DNA, 568 bp, Papaver somniferum
cagatatttgtgaagacattgactgggaagacgatcaccttggaggtagagtcgagtgatactattgataatgtgaaagctaagattcaagacaaagaagggattccaccagaccaacagagattgatttttgctggtaaacaacttgaagacggtcgtactcttgctgattacaacatccagaaagaatcgactctacatcttgttttgaggctacgtggtgggattattgaaccatctttgatggctttggcaaggaagtacaaccaggacaagatgatttgtcgcaaatgctatgcacgtcttcatcctcgtgctgtcaactgcaggaagaagaagtgtggacacagcaaccagttgaggccaaagaagaagatcaagtagatgctatcctgaattttggtgggtgcagagccagagaatttgttttatagcttcttagttggtacttttacttccaaacatttgaactttgtgtttttactcaagaatatcgttcaacgctttatagcccactctgcttaaaaggctggcaccttatattgttttagatctttttatgaatata

SEQ ID NO: 11763 - DNA, 638 bp, Solanum tuberosum
cgggcggggagagaagaagagtgaatattggtggcgagaggcggagaaaatgcagatcttcgtgaaaactttgacgggtaaaaccataaccctagaggttgaatccagtgatactattgacaatgtcaaggccaagattcaagataaggaaggaattcctccagaccagcaaaggctgatttttgctggtaagcagctagaagatggccgtactcttgctgactataacatccagaaagagtcgactttgcatttggtgctgaggcttcgtggaggaattattgagccttctttgatggctttggctaggaagtacaatcaggagaagatgatttgccgcaagtgctatgctcgcctacatccccgtgctgtcaactgccgcaagaaaaagtgtgggcacagcaaccagttgaggcctaagaagaagatcaagtagatggtgattttgaatttctgtcaacatgtagttgctgatgttgagaaacgtattgttgggttgcttgttcaattttatcctaaaaacattgatgaatttgtgttttatctatatcaaagattttgagctattttatttagtatctttttctgttatattttccgaagtgagccaagaacatcaactataggttacacgataa

SEQ ID NO: 11764 - DNA, 591 bp, Solanum tuberosum
ggagagaagatgcagatcttcgtgaaaaccctaacggggaagaccataacccttgaggttgaatccagcgataccatcgacaatgtcaaagccaagattcaggacaaggaaggtattccaccggaccagcagcgactgatctttgctggtaaacagcttgaagatgggcgtacactggcggattataatatccaaaaagaatcaactctgcatcttgtcctgaggctccgaggtgggatcattgaaccgtctcttatggccttggccaggaaatacaaccaagagaagatgatttgccgcaagtgctatgcccgtttgcatcctcgtgctgtgaactgcaggaagaagaaatgcggtcacagcaaccagttgaggccaaagaagaagatcaagtagacagtcggttgcatttcctgtggagatgttatgccaatcacatgattttgtagttcttttgcttagttcacattttggtggatctattgttgtctgtttaactgcggcacatttgtttagaccccagttccatttacaaaaagaatttagtgctcttttgagtttgttatgattatgggctgtgtttgttttctt

SEQ ID NO: 11765 - DNA, 746 bp, Solanum tuberosum
cctacatataaatttctgtcatacgttgaggagaaggtgaaggaagaaggagaaaatgcagatattcgtgaaaactctgaccggtaaaacaattactctggaagttgaatccagcgataccatcgacaatgttaaagccaagatacaggacaaggaaggaattccaccagaccagcaaaggctgattttcgctggtaagcagcttgaggatggccgcaccttggctgactacaacatccagaaagaatcaactttacatctggtgctgaggcttcgtggtggaatcattgagccatctttgatggctttggctaggaaatacaatcaggagaagatgatatgccgcaagtgctatgctcggttgcatcctcgtgctgtcaactgccgcaagaagaagtgtggacacagcaaccagctgaggcctaagaagaagattaagtagatactgaattctaattgcttccgacttgtagttgcttggattttcttatcaaaaaatattctactcggatttatttttcgctttttacccttttaagagattttgatcgacttgtatatgaagattttttgctactttgatagttcttgcagttgatcatatctttatcagatcagtaattaggtttatgttttttaacatcacctcatgtcataatggtatttgctaatttgctgtgatttattttctatcaacacacttatctttggtgctgaagtataggtagcattggtttaggtgattt

SEQ ID NO: 11766 - DNA, 592 bp, Solanum tuberosum
cccacctcgcctcgcactggcttgacactccattgaagaagatgcagatcttcgtgaaaaccctaacagggaagactataacccttgaggttgaatccagcgatacaatcgacaatgtaaaggctaaaattcaggataaggaaggcatccctccggaccagcagcgtttgatatttgctggtaagcagcttgaagatggacgtacgctagcagattataatatccaaaaagagtccactctgcaccttgttctgaggcttcgcggtgggattattgaaccttctcttatggctttggcccggaaatacaaccaggaaaagatgatttgccgcaagtgctatgcacgtttgcaccctcgtgctgtcaattgcaggaaaaagaagtgtggccatagcaaccagttgaggccaaagaagaagatcaagtaaacaggtgtttgcatttttgcagtcaagacactctatcatttggcactcttttgtattttatttgcttgtttaacttagttccatccttcgatgtttgtttcactatataacataagttctaaaatgttagtacttccatttgctctactcagctgagttttgtc

SEQ ID NO: 11767 - DNA, 1279 bp, Prunus mume
aagaatggttctaaaaagaaaaatgttgaaatctagtgcaagtgtagaattctcaaaatagggcccaatccagattagttacgcttctaagcaaccggcccaactacatcgggtccgttcgggtcaagccctgtctcgcagcgaaatgaaaccctagaaacagagattataaaaccctgacgaagccatttccgcctctcactgagtctttagacggaggcagggcaagatgcagattttcgtgaaaaccctaaccgggaagaccatcactctcgaggtcgagagcagcgacaccatcgacaatgtcaaggccaagatccaagacaaggagggcattccaccagaccagcagcgtttgatttttgctggcaagcagcttgaagatggccgcaccttggctgactataacatccagaaagaatcgactcttcatcttgttctgaggctccgtggaggtattattgagccttctttgatggctttggctcgcaagtacaaccaggacaaaatgatttgcagaaaatgttatgctcggctgcatccaagggcagtgaactgtaggaagaagaagtgtggccacagcaaccagttgaggccaaagaagaaggtcaaatagactattgttctagtaattttccccttgtctagactggagttcgaattttgcaattcggttaagtcatttgctttgtatttggagttaaacaagtgcagtttatattaagatatatgaattttgggataattttggtctcttggtttatatttgccttgttatctggtttccagatgctgcttgaattttcctttcggtcgagctttgtgtgatgtgaatgcagctaggttttttcttttcctttgcttggccagtttcatttttttagctatggcattgttaaatttccaatgtcaataacctacctaattgaaaaggaaatgtcaagtctttattcagtcttgtttaagacttgggatgttacatttccctttcggtttatgttgatgcccgaaagaaaactgaaggaaatgttttctctttggtggtcgtcattaagtggtattataatccatttgctcaatttgaacgtccgaggaagagctggtttcttactagttccaactgctcccaacgtccgagactgacccattttttccctcgctattcagccctttttcttttaacccttgtaagttgtatttgaggtctcctggtgcctcaatccttacctattccattttgttatgttttattgtaaaattcgagtacacatttttttct

SEQ ID NO: 11768 - DNA, 1145 bp, Prunus mume
gttaaatacggcccacttcattttcattttaaaaagcccatttttgttttactaactctcaaaaccctaatatgcgcatttcgtgtcgcatataaacaagaaagcttacgggcagaagaggtttgttgccgtcgagggagagacagagagagtcggagaagatgcagatcttcgtgaaaaccctaaccgggaagactatcacccttgaggtggagtccagtgacaccatcgacaacgtcaaggccaagatccaggacaaggaaggtattccaccggaccagcagaggctcatttttgccgggaagcagctcgaggatggccgaactctcgccgactacaatatccagaaagaatcaactttgcatttggttctgaggctccgtggtgggattattgagccgtctctcatggcattggctaggaaatacaaccaagataagatgatatgccgcaagtgttatgcacgcttgcaccctcgtgctgtcaactgcaggaaaaagaagtgtggacacagcaaccagttgaggccaaagaagaaggtcaagtagactgtggattgtgccagcagtatatcgtgttttgttaggtcatttaggttattggctgtttcttttgaaactctattagcctcagacagttttctgttagaaaatttagaaacatcaatatgttcgaacttaacttgttttgggatttctagtttcctatgttttatttcgccatggtttgaacctctttgaagattggcattcattaagtttgagcctttccatattgcatacttttatttttgtgtgtttgtgacatgaatgatgaaatttgtacttccagaatccatatataatttggatatgaccgtgattactgcgaatgataataagaacgtacattctctagcacacaagacaaggctaagttagggatactctttccaatatgaccagttgcgattatttgttgagtaatgttcgttttcccagcttctttacaccaaaagcaaataagtagcctctttcctgcttactttccccacttattcttcacattctgatcttgttaagggcactttcaatttcatttctcccgtgtattccatgttttaagtttcaacacaaaaactcgccaaagcttcttgtccaaattca

SEQ ID NO: 11769 - DNA, 657 bp, Prunus persica
ctcactgagtcttagacgtgggcagcgcaagatgcagattttcgtgaaaaccctaaccgggaagaccatcactctcgaggtcgagagcagcgacaccatcgacaatgtcaaggccaagatccaagacaaggagggaattccaccagaccagcagcgtttgatttttgctggcaagcagcttgaagatggccgcaccttggctgactataacatccagaaagaatcaactcttcatcttgttctgaggctccgtggaggtattattgagccttctttgatggctttggctcgcaaatacaaccaggacaaaatgatttgcagaaaatgttatgctcggctgcatccaagggcagtgaactgtaggaagaagaagtgtggccacagcaaccagttgaggccaaagaagaaggtcaaatagactattgttctagtaattttccccttgtctagactggagtttgaattttgcaattcggttaagtcatttgctttgtatttggagttaaacaagtgcagtttatattaagatatatgaattttgggataattttggtctcttggtttatatttgccttgttatctggtttccaaatgctgcttgaattttcctttcggtcgagctttgtgtgatgtgaatgcagctaggttttttctttt

SEQ ID NO: 11770 - DNA, 780 bp, Prunus persica
ttgttgccgtcgagggagagacagagagagtcggagaagatgcagatcttcgtgaaaaccctaaccgggaagactatcacccttgaggtggagtccagcgacaccatcgacaacgtcaaggccaagatccaggacaaggaaggtattccaccggaccagcagaggctcatttttgccgggaagcagctcgaggatggccgtactctcgccgactacaatatccagaaagaatcaactttgcatttggttctgaggctccgtggtgggattattgagccgtctctcatggcattggctaggaaatacaaccaagataagatgatatgccgcaagtgttatgcacgcttgcaccctcgtgctgtcaactgcaggaaaaagaagtgtggacacagcaaccagttgaggccaaagaagaaggtcaagtagactgtggatcgtgccagcagtatatcgtgttttattaggtcatttaggttattggctgtttcttttgaaactctattagcctcaaacagttttctgttagaaaatttagaaacatcaatatgtttgaacttaacttgttttgggatttctagtttcctatgttttatttcgccatggtttgaacctttttgaagaatggcattcattaagtttgagcctttccatatcgcatacttttatttttgtgtgttatttttgtaacaggaatgatgaaatttgtacttccacaatccatatataatttggatatgaccgtgattactgcgaatagtaataagaacgtacattctagca

SEQ ID NO: 11771 - DNA, 748 bp, Chenopodium quinoa
ctgaaaacaaagcttgaaagatgcagatcttcgtgaaaaccctaactggtaagaccatcacccttgaggtcgaaagcagtgataccatcgacaatgtcaaggccaagatccaagacaaagaaggaattcctccagaccagcaacgtttgatcttcgctggtaagcagcttgaagatggccgcactcttgctgactacaacatccagaaagagtcaacacttcacttggttttgaggttgaggggaggaattatcgagccttcattgatggctttggcccgtaaattcaaccaggacaagatgatttgccgcaagtgctatgcgcgtctccatcccagggctgtgaattgccgaaagaagaagtgtgggcacagtaaccagctgaggccaaagaagaagatcaagtaagctattgcagattgctgtatcatcattcaagttggctgtcatgatagtttcaaagttttggccgggtgtattctaaccaaggttgcccgtcaattgtctgtattgtgtttgtaccttaagttaatgttgtctgtattttgttctttggaaacaattactcatgttggccgtaggatgatgcagtttttgtttgtgtgtcgtgttttagaatggttgaatctgttgtattgatagaacagtcatgatatatggagtaacattttggtctatgattttggaattttctagcaattttgatttttgaattcgttccatctctcaattttatgtgaaatctggct

SEQ ID NO: 11772 - DNA, 658 bp, Raphanus sativus
tgatccttgcggcggagaagatgcagattttcgtgaagacactgacgggcaagaccatcaccctcgaggtggagagcagtgacaccatcgacaatgtcaaggccaagatccaggacaaagaaggaatccctccggatcagcagagcttgattttcgccggaaaacagcttgaagacggtcgcaccttggctgactacaacatccagaaagagtcgactctgcatcttgtcctgaggctaaggggaggtatcatcgagccgtctttgatggctttggctcgtaagtacaatcaagacaagatgatctgtcgcaagtgttacgctcgtctgcacccaagggctgtaaactgcaggaagaagaagtgtggccacagcaaccagttgaggccgaagaagaagatcaagtgatctgttttcacaacaaacttattttatctatgttgttttttccttgaaagacatctctagtgttttgacacaaacttgtttcagggaattttaatccaaaaagattgctgttagtaaatctgactatctttctcttttttattttcttatctttttttttacaaattccagcctttcattatcttcttcagtttgctaattgttgtcttagttttttttgtcaatttttattcccatttagttccagttga

SEQ ID NO: 11773 - DNA, 665 bp, Raphanus sativus
gagacttgcggcggcggggaagatgcagatattcgtgaaaacgctaacgggcaagaccatcaccctcgaggtggagagcagcgacaccatcgacaatgtcaaggctaagatccatgacaaagaaggaatccctccggatcagcagaggttgatattcgccggaaaacagcttgaagatggtcgtaccttggctgactataacatccagaaagagtcgactctgcatcttgttctgaggctaaggggaggtatcattgagccttctttgatggctttggcccgtaagtataatcaagacaagatgatctgtcgcaagtgttacgctcgtctacacccgagggctgtgaactgcaggaagaagaagtgtggccacagcaaccagttgaggccgaagaagaagatcaagtgatctgttttatcaccagaagctcatttatctatgttatatttttgtgtgtttcctcaatcttgttttgatacgaactcgtttcagtggattttagtcctaaaagattattagtaattctgattgtttttttttgcggttttaataattcgaaaatgtgacacaaactagtttcggtggattgccgccccttatattttcctttgaacgattcttaaaacggtttgtaaacaatagccatcatgccgtagttgacaac

SEQ ID NO: 11774 - DNA, 535 bp, Rhizophora mangle
ggctctctaggcgtatccgtcggccacactagctaggactgcaaaaggagagaggaggagagaacaaaagaaatgcagatattcgtgaaaaccctaactgggaagaccataactctcgaggtagagagcagcgacaccatcgacaatgtcaaggccaagatccaagacaaggaaggaattccaccggatcagcagcgattgatattcgctggcaagcagctcgaagatggccgaaccctagctgactacaatatccagaaagaatctacactccatcttgtgctaaggcttaggggaggaatcattgagccgtctctgatggctttggcccgcaaatacaatcaagacaagatgatctgtcgcaaatgttatgctcgtctgcatccaagggctgtgaactgccggaagaagaaatgcgggcatggcaaccagttgaggcctaagaagaagatcaagtaaaactctagtgggggaaatcttttgtgctttggaatgactactgttaaatttgtccactttgtatatttgtacatgt

SEQ ID NO: 11775 - DNA, 605 bp, Rhizophora mangle
gaatctaagccgcccaatttcgctgcagagagatagcaaaggtgagggaaaaaaacaatgcagatattcgtgaaaaccctaacagggaagaccataactctcgaggtagagagcagcgacaccatcgacaatgtcaaggccaagatccaagacaaggaaggaattccaccggatcagcaacggttgatcttcgctgggaagcagctcgaagatggccgaaccctagctgattacaacattcagaaagaatcgacgctccatcttgtgctgagacttaggggaggaatcattgagccttctctaatggctttggctcgcaaacacaatcaagacaagatgatctgtcgcaaatgttatgctcgtctgcatccaagggctgtgaactgccggaagaagaaatgcgggcatagcaaccagttgaggcctaagaagaagatcaagtaaaactctagtgggggaaatcttttgtgctttggaatgactactgttaaattttgccatttgatatttgacatgtgtatctcgtgtttttgacacctgggatttgaatttatcctgactcaacatgattgatgctttcctatgctattaagctgcccttaatc

SEQ ID NO: 11776 - DNA, 651 bp, Rosa hybrid cultivar
gaaaacaacaaactccgaaaccccagagcagagagactttagccgcggagagagagagagagggagagatacagagccagagaaagatgcagatctttgtgaaaaccctaaccgggaagaccatcacccttgaggtcgagtccagcgacaccatcgacaacgtcaaggccaagatccaggacaaggaaggtatcccgccggaccagcagaggctcattttcgccggaaagcagctcgaggatggccgtactcttgccgattacaacattcagaaagaatcaactctgcatttggttctgaggctccgtggtggtattattgagccttctctcatggcattggctaggaagtacaaccaagagaagatgatctgccgcaagtgctacgcacgccttcacccccgtgctgtcaactgcaggaagaagaagtgtggacacagcaaccagctgaggccaaagaagaagatcaagtagacattgaattgcttcggtggaatgcagcttatggaagaactggaaacattatgtttgctgttagaatctttagtaacatcaatatgtttgaacttaaatccttttggattactagttgcttatgtttgctttatctcttgacgacgtctgaaccttattttgtgtaatggcaaacttt

SEQ ID NO: 11777 - DNA, 489 bp, Rosa hybrid cultivar
agccaaagcttataaaacccggaggatcgcatttgaggctcccacaaacaagagccgccgcaagatgcagattttcgtgaaaaccctaacggggaagaccatcactctcgaggtcgagagcagcgacaccatcgacaatgtcaaggccaagatccaagacaaggaaggcattcctccggaccagcagcgtttgattttcgccggaaagcagctcgaagacggccgcaccttggccgactacaacatccagaaagagtcgactcttcatctggtgctgaggctccgtggaggtatcatcgagccttctttgatggccttggctcgcaagtacaatcaggagaagatgatttgcagaaaatgttatgctcgtctacacccaagggctgtcaactgtaggaagaagaagtgtggccacagcaatcagttgaggccaaagaagaagatcaagtaaaactgctcgaaggtctaggcttgagtttgaagtttata

SEQ ID NO: 11778 - DNA, 625 bp, Senecio madagascariensis
agcgtggtcgcggccgaggtacgcggggaccaaccaaaaatgcagatcttcgtgaaaaccctaactgggaagaccataaccctcgaggttgagagcagtgacaccattgataatgtcaaatctaagattcaagacaaagaagggattccacctgatcagcagagattgatttttgctggaaagcagcttgaagatggaaggactcttgctgattataatatccagaaagaatcaactcttcatttggtgttgaggcttaggggaggaattatcgagccctctttgatggcattggctaggaaatacaatcaagacaagaccatctgccgaaagtgttacgctcgccttcacccaagggctgtaaactgcaggaagaagaagtgtggtcacacaaaccagttgaggcctaagaagaagatcaagtaaatgcttgctttgttttcatgggtggattcagaactatctgcatcttttattctcgttatgttattgaactcttataagaagtaatcgagtaatctgactgcatttttgctttgtatgggacatgttacatttacttttggtctcttagacattcgagatacttccttctcaattttattttattttcttagttattaaa

SEQ ID NO: 11779 - DNA, 687 bp, Solanum phureja
atttttctatcagagaagagaaaggggtaagagagatagagcgccgccaaaatgcagatcttcgtgaaaactcttacggggaagacgatcacactcgaagttgaatcgagcgacactattgacaatgtcaaagctaagattcaagacaaggaaggtattccaccggaccagcagcgattgatcttcgccggaaagcagctcgaagatggacgtactctagctgattacaacattcagaaagagtcaactttgcatttggttttgaggcttcgtggagggattattgagccttctctgatggctttggctaggaagtacaaccaagagaagatgatttgccgcaagtgttatgctcgcctacatcctcgtgctgttaactgcaggaagaaaaaatgtgggcacagcaaccagctgcggccaaagaagaagatcaagtaggcgtgataccttgtttagctgagtgtgcattgcagttatactgccagtctgcggtcttacaattttctgtcctgcttcagcttgctgtaatggatagactagcattttttcttgaactaaaagtttgttgttaaagatgtcactgtgcacccgatctatgacactatatagatgaagttttgcatgtttttcctgataagtacaagcctacactagcgtgatttatcatcatatccatttgtgaactgt

SEQ ID NO: 11780 - DNA, 687 bp, Solanum phureja
agagcagagaagaagagtgaatattggtggcgagaggcggagaaaatgcagatcttcgtgaaaactttgacgggtaaaaccataaccctagaggttgaatccagtgatactattgacaatgtcaaggccaagattcaagataaggaaggaattcctccagaccagcaaaggctgatttttgctggtaagcagctagaagatggccgcactcttgctgactataacatccagaaagagtcgactttgcatttggtgctgaggcttcgtggaggaattattgagccttctttgatggctttggctaggaagtacaatcaggagaagatgatttgccgcaagtgctatgctcgcctacatccccgtgctgtcaactgccgcaagaagaagtgtgggcacagcaaccagttgaggcctaagaagaagatcaagtagatggtgattttgaatttctgtcaacatgtagttgctgatgttgagaaacgtattgttgggttgcttgttcaattttatcctaaaaacattgatgaatttgtgttttatctatatcaaagattttgagtatctttctctgttatattttccgaagtgagccaagaacatcaactatggttacacaatagatctcttgttgacatcctaatcgtaatttcaaacaaaattagaaatgctaattgcatctcaagtaat

SEQ ID NO: 11781 - DNA, 642 bp, Solanum phureja
cagaaagataagatgcagatcttcgtgaaaaccctaacggggaagaccataacccttgaggttgaatccagcgataccatcgacaatgtcaaagccaagattcaggacaaggaaggtattccaccggaccagcagcgactgatctttgctggtaaacagcttgaagatgggcgtacactggcggattataatatccaaaaagaatcaactctgcatcttgtcctgaggctccgaggtgggatcattgaaccgtctcttatggccttggccaggaaatacaaccaagagaagatgatttgccgcaagtgctatgcccgtttgcatccacgtgctgtgaactgcaggaagaagaaatgtggtcacagcaaccagttgaggccaaagaagaagatcaagtagacagtcggttgcatttcctgcggagatgttatgccaatcacatgattttgtagttcttttgcttagttcactttttggtggatctattgttgtctgtttaactgcggcacatttgtttagaccccagttccatttacaaaaagaatttagtgctcttttgagtttgttatgattatgggctgtgtttgttttctttattttcgattaagtactgttggttctttggttgaagggttttctgtt

SEQ ID NO: 11782 - DNA, 869 bp, Solanum phureja
actaaaccctacatataaatttctgtcatacattgaggagaaggtgaaggaagaaggcgaaaatgcagatattcgtgaaaactctgaccggtaaaacgattacgctggaagttgaatccagcgataccatcgacaatgttaaagccaagatacaggacaaggaaggaattccaccagaccagcaaaggctgatttttgctggtaagcagcttgaggatggccgcaccttggctgactacaacatccagaaagaatcaactttacatctggtgctgaggcttcgtggtggaatcattgagccatctttgatggctttggctaggaaatacaatcaggagaagatgatatgccgcaagtgctatgctcggttgcatcctcgtgctgtcaactgccgcaagaagaagtgtggacacagcaaccagctgaggcctaagaagaagattaagtagatactgattttgtagttgcttggattttcttatcaaaaaatattctattcggatttatttttggctttttaccctttagagattttgatcgacttgtatttgggaggtatatgaagattttttgctactttgatagttcttgcagttgctcgatcatatctttatcagagtaattaggtttatgttttttaacatcacctcatgtcatagtatttgctaatttgctgtgctttattttctatcaacacacttgatctttgttactcaagtattaggtagcattgttttaggtgattataacttaagtcacatttcctattttggatttaatggctgaccatcctccacttttatatcatttgaaaagtaagttgatctatgaaatataagcaaagaggagggagtattataattctgatc

SEQ ID NO: 11783 - DNA, 557 bp, Solanum phureja
aacaaagcccaccctcgcctcgcactggcttgacactccattgaagaagatgcagatcttcgtgaaaaccctaacagggaagactataacccttgaggttgaatccagcgatacaatcgacaatgtaaaggctaagattcaggataaggaaggcatccctccggaccagcagcgtttgatatttgctggtaagcagcttgaagatggacgtacgctagcagattataatatccaaaaagagtccactctgcaccttgttctgaggcttcgcggtgggattattgaaccttctcttatggctttggcccggaaatacaaccaggaaaagatgatttgccgcaagtgctatgcacgtttgcaccctcgtgctgtcaattgcaggaaaaagaagtgtggccatagcaaccagttgaggccaaagaagaagatcaagtaaacagttttccttgcaaatcattttggcaagctccttccagattctcggcacaatgggagaaagatcaactgggaatgaagtccctcctattctgtgcacacaaccttggctccatcaatgt

SEQ ID NO: 11784 - DNA, 723 bp, Fragaria vesca
agagagagagagagagagccgccgcagcaaagatgcagatattcgtgaaaaccctaacggggaagaccatcactctcgaggtggagagcagcgacaccatcgacaatgtcaaggccaagatccaagacaaggaaggcatccctcctgatcagcagcgtctcatcttcgccggaaagcagctcgaggacggccgcaccttggccgactacaacatccagaaagagtcgactcttcatttggtgctgaggcttcgcggagggatcattgaaccttcattgatggctttggctcgcaagtacaatcaggagaagatgatttgcagaaaatgttatgctcgtctccacccaagggcagtcaactgtaggaagaagaagtgtggccacagcaaccagttgaggccaaagaagaagatcaagtaaacaattcaaaggtctaggcttgagtctgaggttatattttggttgaactttatttttggttatatcagaatgtgcttgttcctaatattggaatcattgtagtttatacctaatggattttggatgcatgttgatgtttggtaatattctgccgtcattttatatcaaccatatttctgctcaagggcttaggcaaacaccccgattactgacctatactgtaaaatgtgttggaagaggttggttaatatgctctttattctcaaccagtaatatgaaagattcttgagtaaacaaaagaaga

SEQ ID NO: 11785 - DNA, 766 bp, Fragaria vesca
gagactttagccgcagagagaacgagagaggtgcacagagcttagagaagatgcagatctttgtgaaaaccctaaccgggaagaccatcacccttgaggtcgagtccagcgacaccatcgacaacgtcaaggctaagatccaggacaaggaaggtatcccgccggaccagcagaggctcatcttcgccggaaagcagctcgaggatggccgtactctcgccgattacaacatccagaaagagtctaccctgcatttggttctgaggcttcgtggtggtatcattgagccttcgctcatggcattggctaggaagtacaaccaagagaagatgatctgccgcaagtgctatgcacgtcttcacccccgtgcagtcaactgcaggaagaagaagtgtggacacagcaaccagctgaggccaaagaagaagatcaagtagacaatgaattgcatgtgtggaattcagcttctggaagactttatgtttgctgttagaatttttagtaacatcaatgtggttgaacttcaatccttttggatgacttcatatgcttgctttatctttgaagtctgaaccttattttgtgtaatggagctttcaattttgacatggccaatgttctctttagtttttgtttggttatgtggtgtgatatcacttatcaatgatctttagctcataaacccagagtgaagtgctgcaatagaactctaccaattttgtctgagagaacaaaatgttcaatttgaacacttaaggaagccagg

SEQ ID NO: 11786 - DNA, 535 bp, Helianthus annuus
atcttcgtgaaaaccctaaccggtaagaccataaccctcgaggttgagagcagcgacaccattgacaatgtcaaggccaagattcaggacaaggaaggtattccaccggatcagcagcggttgatcttcgccggaaagcagcttgaagatggcagaactcttgctgattacaacatccagaaagaatctactcttcatttggttttgaggttaaggggaggaatcattgaaccctctttgatggcattggctaggaaatacaatcaagacaagaccatttgccgcaagtgttatgctcgtttgcacccaagggcagtaaactgcaggaagaagaaatgtggccacagcaaccaactaaggccaaagaagaagattaagtgaagacttagacaagcaacttgtttggttaattttagaagttctgcatgcatctatttttatcatattttgttgttaagtacctatggataacttgtttgtttttttcaagaagcaatactggtttttatgtgtttttttgtgctatctgatgtgg

SEQ ID NO: 11787 - DNA, 590 bp, Tabernaemontana elegans
gacgttgttgttcgctgggagaaagaaggggaaagatgcagatattcgtgaaaactcttactggtaaaaccatcacgctcgaggttgagtcgagcgacaccatcgacaatgtcaaggccaagatacaagacaaggaaggaattccaccggaccagcaaaggctgatttttgctggaaagcagttggaggatggccgaacccttgccgactataacatccagaaagaatcaactttgcatcttgtgctgaggcttcgtggtggaattattgagccgtctttgatggccttggctaggaagtacaatcaggacaagatgatttgccgcaagtgctatgctcgtctgcatcctcgagctgtaaactgcaggaaaaagaagtgtgggcacagcaatcagttgagggcaaagaagaagatcaaatagacatatatgttgattacatatcaagtttgtagtggtttttttccagagttcagaatggttattttgatattttgatgattacagttgtgaacctattgtgtttacattgatgaaccaaagttgtttggtggccaagttatatcctaatggttgatggatacaattatg

SEQ ID NO: 11788 - DNA, 669 bp, Taxus baccata
tgcagatcttcgtgaagaccctgacgggcaagaccataacattagaagttgaaagcagcgataccatcgacaatgtcaaggcaaaaatccaggacaaagaagggatcccaccggaccaacaacgactgatattcgccggaaagcagctggaagatggccgtactctcgctgattacaatattcagaaagaatctactctgcaccttgttctgaggcttcgtggtggaattatcgagccttctttgatggcactggccaggaagtacaatcaagacaagatgatctgtagaaagtgctatgctcggctgcacccaagagctgttaattgcaggaaaaagaagtgtgggcacagtaaccagctccgaccaaagaagaagattaagtagatgtgaatctagggagagttgtatgcttttatttctaggctctaaaactgcctttttataaggaaacttgcattgtttaacttaaaatctgtgttgacttaaattgagtttactattcacattttgttgcttgaagtaaaacggatttctgactctagttttttaaagcagattacaggcctttccattttcgatttaaatataatttcattatatttctccctgttctatgagtttattcaggctggtttttccccttgacatcgtgttttgttgtactaat

SEQ ID NO: 11789 - DNA, 711 bp, Camellia sinensis
cccgtttaaagaataggttctcagctgagagagagggagagagagagcgccgcgaagagagagaaaatgcagatcttcgtgaaaaccctaaccgggaagacgatcacactggaggtcgaatcgagtgacaccatcgacaatgtcaaggctaagatccaagacaaggaaggtattccaccggaccagcagcgactgatcttcgccggaaaacagcttgaagatggccgtactctcgccgactacaatatccagaaagagtcaacactgcatctggttcttaggcttcgcggtgggatgattgagccgtcattgatggcgttggcgcgaaagtacaaccaggacaagatgatttgccgcaagtgttatgctcgcctccatccccgtgctgttaactgcaggaagaaaaagtgtggacacagcaaccagttgaggccaaagaagaagatcaagtagatatgatttgaagctttttatcagctagttgcattgatttgtttgttctatggcatcctgactgtttgtaggaatttgaagtttttaaaaccgctgtctgcttgtagtggctatgatggaccattaactatttttggtttgtttagatattattttgcagaattataatgatttgctagtatggttttttgtgttcaacaatacggcatattgttggtgtgtttattatatcatgaaatcaaagcacatttcccagcg

SEQ ID NO: 11790 - DNA, 667 bp, Nicotiana tabacum
gaagaaggcaggcgaagctcgtttcgaaaatgcagatattcgtgaaaactctcactggtaaaaccataactctcgaagttgaatccagtgatactatcgacaatgttaaagccaaaatacaagacaaggaaggaattccaccggaccaacaaaggctgatttttgctggtaagcagctcgaagatggccgcaccttggccgattacaacatccaaaaagaatcgactctacatttggtgctgaggcttcgtggtggaatcattgagccatcgttgatggctttggctaggaaatacaatcaggagaagatgatatgccgcaagtgctatgctcgattgcatcctcgtgctgtcaactgccgcaagaagaagtgtggacacagcaaccagttgaggcctaaaaagaagatcaagtagatgtaaatttctattgctgctgacttgtagttgcttggcggtattagatctttcggaaactgaactttgatatcttgttcaaataaacaatttgtacttggatttattttgtgtttctgttcgttttacccttcaagattcatggactttgtattcgggagaggtatatgaagagtctttgctactttcatattttgggagatcaagtcgattagcatacagttattgctattttgctgtgatattggttt

SEQ ID NO: 11791 - DNA, 672 bp, Solanum lycopersicum
gtattttatcagagaagaagagaaaggggtaacagagatagagccgccgccaaaatgcagatcttcgtgaaaactcttacggggaagacgatcacgcttgaagttgaatcgagcgacactattgacaatgtcaaagctaagattcaagacaaggaaggtattccaccggaccagcagcgattgatcttcgccggaaagcagctcgaagatggacgtactctagctgattacaacattcagaaagagtcaactttgcatttggttttgaggcttcgtggagggattattgagccttctctgatggctttggcaaggaagtataatcaggagaagatgatttgccgcaagtgttatgctcgcctccatcctcgtgctgtgaactgcaggaagaaaaaatgtgggcacagcaaccagctgaggccaaagaagaagatcaagtaggtgtttagcagacggtgtattgcagttatacctccagtctgtggtcttacaattttttgtcctgcttcaacttgctgtaatggatagtctagcattttcttgaaccgaaagtttgttgttaaaagatatcactatgcatccaatctatgactatttcgatgaagtttttcatgttatcctgacaagtacaagcctacactatcatgatttattcacatatccatttgcaaa

SEQ ID NO: 11792 - DNA, 692 bp, Solanum lycopersicum
gcagaggtagcaacggcagagtaagagaagaattggtggtgagaggcggagaaaatgcagatcttcgtgaaaactttgacgggtaaaaccataaccctcgaggttgaatccagtgacactattgacaatgtcaaggccaagattcaagacaaggaaggaattcctccagaccagcaaaggctgatttttgctggtaagcagctagaagatggccgcactcttgctgactataacattcagaaagagtcgactttgcatttggtgctgaggcttcgtggaggaattattgagccttctttgatggctttggctaggaagtacaatcaggaaaagatgatttgccgcaagtgctacgctcgcctacatccccgtgctgtcaactgccgcaagaagaagtgtgggcacagcaaccagttgaggcctaagaagaagatcaagtagatggtgattttgaatttctgtcagcatgtagttgctcatgttgagaaacggattagatttgcttgttcaattttatcctaaaaactttgatgaatttgtgttttatttgtatcaaagattttgatcatctttctgtgttatattttcccaagtgttccaagaacatcacacacaatagatgtcttgttgacttcctaatcgtaatttcaaacaaaattagaaatgctaattggatctcaagtaatgttttc

SEQ ID NO: 11793 - DNA, 642 bp, Solanum lycopersicum
ctacacttcaccagagagataagatgcagatcttcgtgaaaaccctaacagggaagaccataacccttgaggttgaatccagcgatacgatcgacaatgtcaaagcgaagattcaggacaaggaaggtattccaccggaccagcagcgactgatctttgctggtaaacagcttgaagatgggcgtacactggcggattataatattcaaaaagaatcgactctgcatcttgtcctgaggctccggggtgggatcattgaaccgtctcttatggccttggccaggaaatacaaccaagagaagatgatttgccgcaagtgctatgcccgtttgcacccacgtgctgtgaactgcaggaagaagaaatgcggtcacagcaatcagttgaggccaaagaagaagatcaagtagacagtcggttgcatttcatgtggagatgttatgcctattgcatgattttgtagttcttttgcttagctcacattttgctggatctattgttgtctgtttaactgtggtacaacattcgtttagactccagttccatttacaaaaagaatttattgctctttcgagtttgttataattatgggctgtttttgttttctttatcttcaattaagtgctgttggttctttgtttg

SEQ ID NO: 11794 - DNA, 669 bp, Solanum lycopersicum
tacgtaggggagaaggtgaaggaagaaggcgaaaatgcagatattcgtgaaaactctgaccggtaaaacgataacgctggaagttgaatccagcgataccatcgataatgttaaagctaagatacaggacaaggaaggaattccaccggatcagcaaagactgatttttgctggtaagcagcttgaggatggccgcactttggctgactacaacatccagaaagaatcaactttacatctggtgctgaggcttcgtggtggaatcattgagccatctttgatggctttggctaggaaatacaatcaggagaagatgatatgccgcaagtgctatgcgcggttgcatcctcgtgctgtcaactgccgcaagaagaagtgtggacacagcaaccagttgaggcctaagaagaagattaagtagatactgaattctagttgcttggatgttcttatcgaaaaatatcgtactccgatttatttttggctttcctggtctttttacccttgagagattttgattgacttgtatttgagaggtatatgaagattttttgctacttcgatagttcttgcagatgtccatttctttatcagtattttagctttatgttttttaagatcacatcttgtcatagtatttactaatttgctgtgttttattttctatca

SEQ ID NO: 11795 - DNA, 580 bp, Triphysaria pusilla
aaaaccttgaaaaccctaaaatgcatttccaactatataaacaaatcggaggcggaggtgtgtagacagcacacccgaaaaaaatgcagatcttcgtgaaaaccttgactggtaagaccattacgctcgaggttgaatcgagcgacaccatcgacaatgtcaaggccaagatccaagacaaggaaggtatcccaccggatcaacagcgtttgattttcgccggaaagcagcttgaagatggccgtactcttgctgattacaacattcagaaagagtccactcttcatttggttctgaggcttaggggtggcatcatcgagccgtctctcatggcattggctaggaaatataaccaggagaagatgatttgccgcaagtgctatgctcgtctgcacccccgtgcggttaactgcaggaaaaagaagtgtgggcatagcaaccagctaaggcccaagaagaagatcaagtagagggtgtgtctgatcagttgtatcttttctttgtttttgttgtatggaacattattttggcttttcttgtaatagacatttatgtatttctatgtaatgcacgcagtcca

SEQ ID NO: 11796 - DNA, 557 bp, Triphysaria pusilla
tagacaaacacccggaaaaaatgcagatcttcgtgaaaaccttgactggtaagaccattacgctcgaggttgaatcgagcgacaccatcgacaatgtcaaggccaagatccaagacaaggaaggtatcccaccggatcaacagcgtttgattttcgccggaaagcagcttgaagatggccgtactcttgctgattacaacattcagaaagagtccactcttcatttggttctgaggcttaggggtggcatcatcgagccgtctctcatggcattggctaggaaatataaccaggagaagatgatttgccgcaagtgctatgctcgtctgcacccccgtgcggttaactgcaggaaaaagaagtgtgggcatagcaaccagctaaggcccaagaagaagatcaagtagagcgtgtgtctgatcagttgtatcttttctttgtttttgttgtatggaacattattttggcttttgttgtaatagacatttatgtatttctatgtaatgcacgcagtccgttcagtgctttgagatactaaattttcgaaatgtcttaaa

SEQ ID NO: 11797 - DNA, 718 bp, Triphysaria pusilla
gtttgctatataaagcacagaaggaagcccactgaaactcgctgaggcgaatattgaaaatgcagatcttcgtaaaaaccctaaccggcaagaccatcacgctcgaagttgaatcgagcgataccatcgataatgtcaaggctaagattcaggacaaggaaggaatcccaccggatcagcagcgtttgatttttgctggaaaacagcttgaagatggccgaactcttgctgattacaacatccagaaagagtccactttgcatttggttctgaggcttaggggtggaattattgagccttctctcatggcgttggctaggaagtataaccaggagaagatgatttgccgcaagtgttatgctcgtttacacccacgggctgttaactgccgtaagaagaagtgtggacatagcaaccagctaaggccaaagaagaagatcaagtagactgcttgcaggattatttgccatctctcgtgttttcctgtttttccctgtttttctattgttgtcttcatttttatgtctctgaattgaacaacaaaacaccaagcatggatgttttgttgtagacattataatggtgaggttttgcaccttcgtttgatttcttcaaatgaatttggaattggattttgggttttatgttgattgctgtttttgaaaatggtgattgttatgttttatcaggactttttatttatataaaatgcttatta

SEQ ID NO: 11798 - DNA, 631 bp, Triphysaria pusilla
cgaatagtgaaaatgcagatcttcgtaaaaaccctaaccggcaagaccatcacgctcgaagtcgaatcgagcgataccattgataatgtcaaagctaagattcaggacaaggaaggaatcccaccggatcagcagcgtttgatttttgctggaaaacagcttgaagatggccgaactcttgctgattacaacatccagaaagagtccactttgcatttggttctgaggcttaggggtggaatcattgagccttctctcatggcattggctaggaagtataaccaggagaagatgatttgccgcaagtgttatgctcgtttacacccacgggctgttaactgccgtaagaagaagtgtggacatagcaaccagctgaggccaaagaagaagatcaagtagactgcttgcaggattatttgccatctctcatgtttttctgttttcccctgtttttctattgttggcttcatttttatgtctttgaattgaacaacaaaacacctagcatggttgttttgtcttagacattatgaatggtgaggttttgcaccttcatttgatttagcatctgcaagtttcttcaaatgaatttggaattggattttgggttttatgttgattgttgtttttg

SEQ ID NO: 11799 - DNA, 571 bp, Triphysaria pusilla
atcggaggcggaggtgtatagacaacccacccagaaaaatgcagatcttcgtgaaaaccttgactggtaagaccattacgctcgaggttgaatcgagcgacaccatcgacaatgtcaaggccaagattcaagacaaggaaggaatcccaccggatcaacagcgtttgattttcgccggaaagcagcttgaagatggccgtactcttgctgattacaacattcagaaagagtccactcttcatttggttctgaggcttaggggtggcataatcgagccgtctctcatggcattggctaggaaatataaccaggagaagatgatttgccgcaagtgctatgctcgtctgcacccccgtgcggttaactgcaggaaaaagaagtgtgggcatagcaaccagctaaggcccaagaagaagatcaagtagagcgtgtgtctgatcagttgtatcttttctttgtttttgttgtatggaacattattttggcttttgttgtaatagacatttatgtatttctatgtaatgcacgcagtccgttcagtgctttgagatactaaattttcgaaatgtct

SEQ ID NO: 11800 - DNA, 595 bp, Triphysaria pusilla
gctgaggcgaatattgaaaatgcagatcttcgtaaaaaccctaaccggcaagaccatcacgctcgaagttgaatcgagcgataccattgataatgtcaaggctaagattcaggacaaggaaggaatcccaccggatcagcagcgtttgatttttgctggaaaacagcttgaagatggccgaactcttgctgattacaacatccagaaagagtccactttgcatttggttctgaggcttaggggtggaattattgagccttctctcatggcattggctaggaagtataaccaggagaagatgatttgccgcaagtgttatgctcgtttacacccacgggctgttaactgccgtaagaagaagtgtgggcatagcaaccagctgaggccgaagaagaagatcaagtagactgcttgcaggaatatttgccatctctcatgttttcccgttttcccctatttttctattgttggcttcgtttttatgtctctgaattgaacaacaaaacaccaagcatggttgttttgttgtagacattataagtggtgaggttttgcaccttcatttgatttagcatctgcaagtttcttcaaatga

SEQ ID NO: 11801 - DNA, 656 bp, Triphysaria pusilla
cgaatagtgaaaatgcagatcttcgtaaaaaccctaaccggcaagaccatcacgctcgaagtcgaatcgagcgataccattgataatgtcaaagctaagattcaggacaaggaaggaatcccaccggatcagcagcgtttgatttttgctggaaaacagcttgaagatggccgaactcttgctgattacaacatccagaaagagtccactttgcatttggttctgaggcttaggggtggaattattgagccttctctcatggcgttggctaggaagtataaccaggagaagatgatttgccgcaagtgttatgctcgtttacacccacgggctgttaactgccgtaagaagaagtgtggacatagcaaccagctgaggccgaagaagaagatcaagtagactgcttgctggattatatgccatctctcatgttttcccgtttttccctgtttttctattgttggctttgtttttatgtatctgaattgaacaacaaaacaccaagcatggatgttttgttgtagacattataaatggtgaggttttgcaccttcatttgatttagcatctgcaagtttcttcaaatgaatttggaattggtttttgggttttatgttgattgctgtttttgtaaaatggtgattgctatgttttat

SEQ ID NO: 11802 - DNA, 641 bp, Utricularia gibba
tcagtttttgctggaaagcagcttgaagatggtcgtaccttggcggattataacatccagaaggagtccacacttcaccttgtcctccgtctccgtggtggaatgcagatcttcgtgaaaaccctcaccgggaagaccatcacgctcgaggtcgaatcgagcgatactattgataatgttaaggctaagattcaggacaaggaaggaattccgccggatcagcagcgtttgattttcgccggaaagcagctcgaggatgggaggacactcgctgactataacattcagaaggagtcaactctgcatttggtgctgaggctgaggggtgggattattgagccttcacttatggctctggctaggaagtataatcaggataagatgatctgccgcaagtgctatgctcggctacacccaagagctgttaactgcagaaagaaaaagtgtggacacagcaaccagttgagggttaagaagaagatcaagtagggtgctgggaagaggtattgtatttcgcttcttggagttgctgttgttgcacttttgtttttcaccttcgtgttcaacgaactgcatctgagttttctcgcttgactgatggatgtgttcagtttattaaagtaaacgattcgctgaatata

SEQ ID NO: 11803 - DNA, 546 bp, Vinca minor
atgcagatcttcgtgaaaaccctaaccggaaagaccataaccttagaggttgaatcctctgatactattgacaatgttaaggccaaaattcaagacaaggaagggattccaccggatcagcagagattgattttcgcgggaaaacagttggaggatggccgtactttggctgattacaacatccagaaagagtctactcttcatttggtgctgaggctgcgcggaggaattattgagccgtcactgatggctttggctagaaagtacaaccaagacaagatgatttgtcgcaagtgctatgcaaggttgcatcctcgggctgttaactgccgcaagaagaagtgtggacacaccaaccagttgaggcccaagaagaagatcaagtagatgtgttcaacgctctgtgtcattttgtagcttgcttagtataacctctttttgctgctactgttcagaagatggattattattgtatgtttgaattggtttacgagaatagtttttttataacgatggtttttatattccgcctggaccaaacacgaa

SEQ ID NO: 11804 - DNA, 676 bp, Vinca minor
ggaactcagaagggaagaagaagaaaagatgcagatattcgtgaaaaccctaactggaaaaaccataacccttgaggttgaatccagcgacaccatcgataatgtcaaggccaaaatccaggataaggaaggaatcccaccggaccagcaaagattgatttttgctgggaagcagttggaagatggccgtacccttgctgattataacatccagaaagaatcgactctgcatcttgttctgaggcttcgtggtggaatcattgaaccttctttgatggctttggctaggaagtacaaccaggataagatgatctgccgcaagtgctatgctcgtctgcatcctcgagcagtcaactgcaggaagaagaagtgtggccacaccaaccagttgaggcctaagaagaagatcaagtagacaaatgatttgatcgtcttctatcaagtttgtagtagaaggttttcagagatgatatttgaattgttattttgagaattttattttatagttgttttgtcaacaacttgtgtgaaccaaatatgtttttgccaagttatatcttaatggttaattgatacagtagttattattatgggttctgttttgtcccctccgaatttcttcatttattctttttgtaactgatgctctgtctatgtatgccaatgtttatctcgt

SEQ ID NO: 11805 - DNA, 782 bp, Juglans hindsii x Juglans regia
gggggcccagagagatgatgagagtagtgagagagcccaagcaaaaatgcagatattcgttaaaaccctgacggggaagaccatcaccctcgaggtcgagtccagcgatacaatcgacaatgttaaggccaagattcaggacaaggaaggtattcccccggaccagcagaggctgatctttgcaggaaagcagcttgaggatggccgtacgctcgcggattacaacatccagaaagagtcaacccttcatcttgttctgaggcttcgtggcggaattattgagccatctctgatggcattggccagaaaatacaaccaagaaaaaatgatttgccgcaaatgttatgcacgcctgcacccacgtgctgtcaactgcaggaaaaagaagtgtggacacagcaaccagctgaggccgaagaagaagatcaagtagattactgaatgtgaggaagaattgctattcattgtctttggtcaatggatctcttatatgaagctagcttggtagcatcgaacagtttgctagcaactcctagaaatcagacatctagcaatgttactttatatgattttctactttgaaattgagctattcattttttatgagttgaaattaaaacctattgctttgctagttatgtgtggggctgctgcctttgtttttgtctttttcctcttcaatattgagacgttggaatgaagcctatatagaatgtgaaatgatgcattttatttctaagggctcctgaccaattctttcttgaaaaaatcttgttttacgt

SEQ ID NO: 11806 - DNA, 787 bp, Juglans hindsii x Juglans regia
cgagcgtagcagacagagaaggaccaagaaaatgcagatcttcgtgaagaccttaactgggaagactatcaccctcgaggttgaatccagcgacaccatcgacaatgttaaggccaagattcaggacaaggaaggtattccgccggaccagcagaggctgatctttgcagggaagcagctcgaggatggccgtaccctcgcagattacaacatccagaaagagtcaactcttcatcttgttctgaggcttcgaggtggcattattgaaccatctctgatggcattggccaggaaatacaaccaggagaaaatgatctgccgcaaatgttatgcacggttgcacccacgtgctgtcaactgcaggaaaaagaagtgtggacacagcaaccagctgaggccaaagaagaagatcaagtagagtagttggtgtgaggaaaaattgctaaccattgtagtgggtcgctggatgtcttatctgaacgatggtagcatcaaacagttcgctagtagaattctagaaatccgacatgtagtacagtgttacttaatatgctttgaactttttgggcgttgaatatgccgtgacgttttgagtcattttttttggtgttgaaatcaaacctatgcttttgtttagttttatgtgggttctgttgcttaattatgtttgtttggtccttgagctcttcaattttgaggcgttggaatgaaagactgtctgactgtgtaagacggattttgtgggaatcttgagtcgtcaatcctcttgatttgaatctctccctag

SEQ ID NO: 11807 - DNA, 815 bp, Juglans hindsii x Juglans regia
cgggggccctcgagcgtagcagacagagaaggaccaagaaaatgcagatcttcgtgaaaaccttaactgggaagactataaccctcgaggtcgaatccagcgacaccatcgacaatgttaaggccaagattcaggacaaggaaggtattccgccggaccagcagaggctgatctttgcagggaagcagctcgaggatggccgtaccctggcagattacaacatccagaaagagtcaactcttcatcttgttctgaggcttcgaggtggcattattgaaccatctctgatggcattggccaggaaatacaaccaggaaaaaatgatctgccgcaaatgttatgcacggttgcacccacgtgctgtcaactgcaggaaaaagaagtgtggacacagcaaccagctgaggccaaagaagaagatcaagtagagtagtggatgtgaggaaaaattgctaaccattgtagtgggtcgctggatgtcttatctgaacgatggtagcatcaaacagttcgctagtagaattctagaaatcagacatgtagtacagtgttacttaacatgccttggaacttttgcgttgaatatgccatgacattttgagtcatttttttggtgttgaaatcaaaactatgcttttgtttagttttatgtgggttctgttgcttaagtatgtttgtttggtccttgagctcttcaattttgaggcgttggaatgaaagactgtctgactgtgcaaggacggattttatgggaatcttgagtcgtcaatccctcttgatttgaatctctctctagtaaaatggcatgtcccccc

SEQ ID NO: 11808 - DNA, 761 bp, Juglans hindsii x Juglans regia
gggggcccagagagatatggagagggagcgagagagcccaagcaaaaatgccgatatttgtgaaaaccctgacggggaagaccatcaccctcgaggtcgagtccagcgatacaatcgacaatgttaaggccaagattcaggacaaggaaggtattcccccggaccagcagaggctgatctttgcaggaaagcagcttgaggatggccgtacgctcgcggattacaacatccagaaagagtcaacccttcatcttgttctgaggcttcgtggtggaattattgagccatctctgatggcgttggccagaaaatacaaccaggacaaaatgatctgccgcaaatgttatgcacgcctgcacccacgtgctgtcaactgcaggaaaaagaagtgtggacacagcaaccagctgaggccaaagaagaagatcaagtagagtagttggtgtgaggaaaaattgctaaccactgtagtgggtcgctggatgtcttatctgaacgatggtagcatcaaacagttcgctagtagaattctagaaatccgacatgtagtacagtgttacttaatatgctttgaactttttgggcgttgaatatgccgtgacgttttgagtcattttttttggtgttgaaatcaaacctatgcttttgtttagttttatgtgggttctgttgcttaattatgtttgtttggtccttgagctcctcaattttgaggcgttggaatgaaagactgtctgactgtgtaagacggattttgtggg

SEQ ID NO: 11809 - DNA, 702 bp, Zostera marina
ggggagaataaattgacgtctccacgaaaataaaaaacacaaaccctattcttgtttgccgcagtcaaaaaatgcagatcttcgtgaagaccctcaccggaaagactatcaccttagaggttgagagtagcgataccatcgataatgtgaaggctaagatccaggataaggaagggatccctcccgaccagcaacgtctgatctttgctgggaagcagcttgaggatggaaggactctcgcagattataacatacagaaagagtcaaccttgcatcttgtgttgaggctgaggggtggaatcattgagccttccctaatggctcttgccaggaagtataatcaggaaaaaatgatctgccgcaagtgctatgctcgccttcatccaagggctgtgaattgtcgcaagaagaagtgtggtcatagtaaccagctaaggcccaagaaaaagattaagtgaagttgtagctgctaggacgatgctcgttaaagcagaaagctttttttattttcgtcactcttttatttaatatcaaacatcttgaaacctctttgtacttgtttggttttgtttttcatcaaatatgtgttatgcaaatgacattcttcatttttcacttttcttaattaatcagtattttgattacttcgtatttttctgtcttaagtggtataagttggaataaatttatcataatgaaaaa

SEQ ID NO: 11810 - DNA, 541 bp, Oryza sativa
cacccgcagcagcagcagcagcaaggagaagaagaagagccaagatgcagatcttcgtgaagaccctaacggggaagaccatcacgctcgaggtcgagagcagcgacaccatcgacaatgtcaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatc

SEQ ID NO: 11811 - DNA, 620 bp, Oryza sativa
aaaggggagagagccccggggaagaagaagaagcagcagctagggcgccaagatgcaaatcttcgtgaagaccctgactgggaagaccatcaccctcgaggtggagagcagcgacaccatcgacaatgtcaaggctaagatccaggacaaggagggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaaatgctatgcgcgcctgcaccctagggctgtcaactgccgcaagaagaagtgtggtcacagcaaccagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcg

SEQ ID NO: 11812 - DNA, 719 bp, Spinacia oleracea
attcaagatgcagatcttcgtgaaaaccctaactgggaagacaatcaccctagaggtcgaaagcagcgacaccatcgacaatgtcaaggccaagatccaagacaaagaaggaattcctccagaccagcagcgtttgatcttcgctggtaagcagcttgaagatggccgtactcttgctgactacaacatccagaaagaatcaactcttcatttggtgttgaggttgaggggaggaatcatcgagccttcgttgatggctttggctcgtaagttcaaccaagagaagatgatttgccgcaagtgctatgctcgccttcaccccagggctgtgaattgccgaaagaagaagtgtggacacagtaaccagctgaggcctaagaagaagatcaagtaagctgttgcagatgactgtatcatcattcgagttggctctcatgacggttccaaaattttggttgggtgtcctcaattgttgtctgtattctgtttgtaccctaagttaatgttgtttgtactttgctctttggaaacaatttatctcatgttagccgtagggtgatgcaatttttatgtctgtcgacttatgctgtttgtactgttgtgtctagaattgttgtattgatagaagagtcatgaatctcgtgatatatgataacattttgatctatgattacggaaatgtttaccaatttggctttttgacactttctatttgcccg

SEQ ID NO: 11813 - DNA, 740 bp, Spinacia oleracea
tctcaattttctcagaaactcagcagagagaaaacactcagagagggtaggaaggtcattcaagatgcagatctttgtcaaaactcttactgggaaaaccatcacccttgaggttgaatctagcgacactattgacaatgtcaaagctaagattcaagacaaggaaggtattccaccagaccagcagaggctgatctttgctggaaagcagcttgaagatggccgtactcttgctgactacaacatccagaaagaatcaactcttcatttggtgttgaggttgaggggaggaatcatcgagccttcgttgatggctttggctcgtaagttcaaccaagagaagatgatttgccgcaagtgctatgctcgccttcaccccagggctgtgaattgccgaaagaagaagtgtggacacagtaaccagctgaggcctaagaagaagatcaagtaagctgttgcagatgactgtatcatcattcgagttggctctcatgacggttccaaaattttggttgggtgtcctcaattgttgtctgtattctgtttgtaccctaaattgatggtgtttgtactttgctatttggaaacaatttctctcatgttagctgtagggtgatgcagtttttatggctgtcgacttgtgctgttgtatgtctagaatttttgtattgatagaagagtcatgaatctcgtaatatatgatacattttgatctatgattacggaaatgtttaccaatt

SEQ ID NO: 11814 - DNA, 839 bp, Spinacia oleracea
tctcaattttctcagaaactcagcagagagaaaacactcagagagggtaggaaggtcattcaagatgcagatctttgtcaaaactcttactgggaaaaccatcacccttgaggttgaatctagcgacactattgacaatgtcaaagctaagattcaagacaaggaaggtattccaccagaccagcagaggctgatctttgctggaaagcagcttgaagatggccgtactcttgctgactacaacattcagaaggagtcaactctccatctggttctgaggcttcgtggtggaattattgagccttctctgatggccctagctaggaaattcaaccaagagaagatgatatgccgcaaatgctatgctcgcctgcacccccgtgctgttaactgcaggaagaagaagtgtggccactccaaccagttgaggccaaagaagaagatcaagtagagcgttcatttgtttgcagctgatattcgggcaacagtttccatgaagttgatgttcgaaagaagctgtttactatggctcgtagggataatatacttctaattaggtttaaaagatttggtcattttagttctagtagttttatattttatgtcttcaaataaggcgtatatgactcgtttgttcagatatcagattttgttttgttgcctggatctttaatttgggttttgagcaagtatattagtggtaattttcatttatctatccaagttttttctgcattcttatagtcggctgaagtgttatttggcgataaaaacttgtgtttcagtccttattcgattcttgttgcacggtaaatcctcctacgagtattcttgttgaa

SEQ ID NO: 11815 - DNA, 908 bp, Amaranthus tuberculatus
gaaatagggtgaaggaggaggttatctagaactctcttcaccctattttcccccggccgtcgtcgtgcaaaagaagaaacctagaaaaaacccagaagaatcgaagatgcagatcttcgtgaaaaccctaactggtaagactatcacccttgaggttgaaagcagcgacacaatcgacaatgtcaaaactaagatccaagacaaggaaggaattccaccagaccagcaacgtttgatcttcgctggaaagcagcttgaagatggccgtactcttgctgattacaacattcagaaagaatcaactcttcatttggtgttgaggcttagaggaggaattattgagccttcattgatggctttggcccgtaaattcaaccaagacaagatgatttgccgcaagtgctatgctcgtttacaccccagggctgtgaattgccgtaagaagaagtgtggtcacagtaaccagctgaggcccaagaaaaagatcaagtaagctcgtgcaaatttctgtatcatcattcaatgtggctctcatgatggtttccgagtttttgctaggttaaacttgttcctcgatctattgaatagaattctgtttgtactaccttaatattcacatgttggagaactaccgatcatgttaagtcataggatgtgatactctgttgtatgttgttttaatgttgtgccttgagaatgaccgattgtatttgtgtttttgtactcaaaccgttttgaattttgatgatatttagtgaccttttggttgttaatggagttttcctttagttttggtataatcgatcaaataatgtacagtaaatgtgtttaaaacaaattcaatttgacattaaggatgaaacattcgatttaatgtaaatctattgttacaggcaatatacttcaat

SEQ ID NO: 11816 - DNA, 618 bp, Amaranthus tuberculatus
accacccattttatttctattgaattgccgttctcttcccaaactagaaccctaaaatttccaaggagaagagaagatgcagatcttcgtcaaaaccctcactggaaaaaccatcactcttgaggttgagagtagcgataccatcgacaatgtcaagactaagatccaagacaaagaaggaattcctccagaccagcagcgtttgatcttcgctggaaaacagcttgaagatggccgtactctcgcggactacaacatccagaaagaatcaactttgcatttggtgttgaggcttaggggaggaattattgagccttcattgatggctttggctcgtaaattcaaccaagacaagatgatttgcaggaagtgctatgcccgtttacatcccagggctgtaaattgtcgaaagaagaagtgtggtcacagtaaccagttgaggcctaagaagaagatcaagtaagctctgattactgtatcatcattcaaagctggctcacttggtagttggtagttctcaagtttcggctggattacaatctatttatgtatctccatttgttgtaaaactctgttgtatttggaaaatgtgattatatttagatccccacttgttgg

SEQ ID NO: 11817 - DNA, 789 bp, Amaranthus tuberculatus
ccacgaagtcctaaaccctaaccccatcaccaaactatttaaaagcaatcgcagaacatagtaaattcatcgccttctgccccattttttaccttcaacaaaatcaaatagagaagaaagagtgaggaagaaggtgtttgtcaagatgcagatctttgtgaaaaccttaacagggaagaccatcacccttgaagttgaatctagcgacaccatcgacaatgtcaagactaagattcaagacaaggaaggcattccacctgaccagcaaaggctgatctttgctggaaagcagcttgaagatggccgcactcttgctgattacaacatccaaaaggagtcgacacttcatctggttctgaggctccgtggtggaattatcgagccttctctaatggcccttgctaggaagtttaatcaagacaagatgatttgtcgcaaatgctatgcacgcttgcaccctcgtgctgtaaactgtaggaagaagaaatgtggccacagcaaccagttgaggccgaagaagaagattaagtagagcgatcagttgtttgcagctgatgccgggcagtggcttccatggggttggtgcttggacctagctgttttgctatggctcttagagcatttatcagtttagttagcatatttattttctaataaaggcgtattttctctatttaagcgccttatttttgtccggagatatttttgttgccttgatggaattttggttttatgatttcaaactaaacatttgggttattggacatctatggcttggctaccgttttt

SEQ ID NO: 11818 - DNA, 397 bp, Ambrosia trifida
aaagtcggcggcagcaaagaaaatgcagatcttcgtgaagacattgaccgggaagaccatcacactcgaggttgaatcgagtgatacgatcgacaatgttaaggctaagatccaggacaaggaaggaattcctccggaccagcagcgtttgatctttgctgggaaacagcttgaggatggaaggactctagctgattataatattcagaaagagtctacgcttcatttggtgctgaggcttcgtggaggtattattgagccgtcgttgatggctttagccaggaagtataatcaggataagactatctgccgcaagtgttatgctcgtctccatcctcgcgctgtcaactgtaggaagaagaaatgtggccacagcaaccagttgaggccaaagaag

SEQ ID NO: 11819 - DNA, 556 bp, Arabidopsis lyrata
gttttgagaattccggcgaagaagacgaaacacaaagatgcagattttcgtgaaaacactaactggcaagaccatcactctcgaggtcgagagcagcgacaccatcgacaatgtcaaggccaagatccaggacaaagaaggaattcctccggaccagcagaggttgatcttcgccggaaaacagcttgaagatggtcgtaccttggctgaatacaacatccagaaagagtcgactctgcatcttgttctgaggctaaggggaggtatcattgagccttcattgatgatgttggctcgtaagtataaccaagacaaaatgatttgtcgcaagtgttatgctcgtctgcacccaagggctgttaactgcaggaagaagaagtgtggccatagcaaccagttgaggccaaagaagaagatcaagtgatctgttttcatcaaaagctcttttatcttatagtttgtgttccccttgaaaaagacacttctctagtgttgacacaaaccttgtttcagtgaattttgattttacgattattatgtagtaaatctgattttt

SEQ ID NO: 11820 - DNA, 634 bp, Musa acuminata
acggagagggaggggaggcgcgggaagagggagcaagaacgagtgacaaagatgcagatcttcgtgaaaaccctcacggggaagaccatcaccctcgaggtcgagagcagcgacaccatcgacaacgtcaagaccaagatccaggacaaagaagggattccgccggaccagcagcgactgatctttgccgggaagcagctcgaggatggacggacactcgccgactacaacattcagaaagagtcgacgctgcatttggtgctgaggctgaggggcggtatcattgagccctctctgatggctctcgccaggaaatataatcaggaaaagatgatctgcagaaaatgctatgcaagattgcatccaagggctgttaattgccgtaaaaagaagtgcggccacagcaaccagctgaggcccaagaagaagatcaagtaagctgttggtttgagttgcttgatgcatgttctgagaagccaaaaatgtcccatctagattagctgtcatcggctgttttcatttttcacatgaagcttatttttattgctttgttgctgcaaacaaacgtgttggcacgtaaggaccatgttgttttctgaatgttttgaagtatctttagcaattaatatttcta

SEQ ID NO: 11821 - DNA, 838 bp, Beta vulgaris
actagttaatctgttgtaaatccagcagtaaaatttgatctcataaaaccctaattgacgccgaactataaataagtccaaccaaatccttttgcatagccgtccgtaacaaggaggaagaagaagaacaacaaacctcgaaaaagcagagaagatgcagatcttcgtcaaaaccctaactggcaagaccatcactcttgaggtcgaaagcagtgacaccattgacaatgtcaaggctaagattcaagacaaagaaggaattcctccagaccagcagcgtttgatcttcgctggtaagcagcttgaagatggccgtactcttgctgattacaacatccagaaagaatcaactcttcatttggtgttgaggctgaggggaggaatcattgagccttcattgatggctttggctcgtaaattcaaccaagagaagatgatttgccgcaagtgctatgctcgcttgcaccctagggctgtgaattgccgtaagaagaagtgtggtcacagtaatcagctgaggcccaagaagaagatcaagtaagcttttgctgatcgttgcaccatcattcgagttggctctcatggtagtttgaaaattttggttgggtgtcatctaattgtagttgcccctcaagtgttgaacctgtattcctctgtttgtacctgaagttaatgttgtctgtacttcgttcggaaccgctattctcatgttagccataggatgatgctgtttttgctttgtatgtcgactgacttgcgttgttgtgttgtgcctttagaatgatcaattatgttgtatccaaagaatagtcccgattatatggagtaatattttgtt

SEQ ID NO: 11822 - DNA, 878 bp, Beta vulgaris
cccaacgagtataaaagctcaaccacgacacaaaatttgggtatcgccttcctctacttctcacatcaaacaaaaaagtttcagagagagaaaaaaaaagagagagtaggaaggtctttgaagatgcagatctttgtgaaaaccctaactgggaaaaccatcacccttgaagttgaatcaagtgacactattgataatgtcaagactaagattcaagacaaggaaggcattccaccagaccagcagaggctgatctttgctggtaagcagctcgaagatggtcgcactcttgctgactacaacattcagaaggagtctactcttcatctggttctgaggctccgtggtggaatcattgaaccttctctgatggccctggctaggaagttcaaccaagacaagatgatttgccgcaaatgctatgctcgcttgcaccctcgtgctgtaaactgtaggaagaagaaatgtggccacagcaaccagttgaggccaaagaagaagattaagtagagcgttcagttgtttgcagctgatgttctggtagcgatttccatgggtcggtatttgaacagaagctgttttactatggctcttagtaggggtatacttaaaattaggttaaatcattcgttcgtttagtagttttgtagtagtattgactctattgcttcttcaaataaggcgtatattccctattagagccttatttgtttcggaatcggtttatattattctcttgatggtaattttgtgtctcgacttataccaggcaatttggttttgacgtttgagtaatgattataaatttactagtattttagacatttacttttcttgctcgtgttcttttggctttgttgtatacgcctcattttatt

SEQ ID NO: 11823 - DNA, 523 bp, Bupleurum chinense
aaggcttgttgtcaaaatgcagatattcgtgaaaaccctaactggtaagacaattactcttgaggttgaatccagtgataccatcgataacgtcaaggctaagatccaggacaaggaaggaattccaccggaccagcagcgattgatcttcgccggaaagcagcttgaagatggccgtactcttgcggattacaacatccagaaagaatcaacactgcacttggttcttaggcttcgtggtggaattattgagccttctttgatggctttggctagaaagtataaccaggaaaagatgatttgccgcaaatgttatgcccgactgcatcctcgtgctgtcaactgcaggaagaaaaagtgtggacacaccaaccagctgaggccaaagaagaagattaagtagacaatatcaagtttctatctgctagttgcagctgctgtttctctgctgcatttgttagtgttcaatgagactgtagtgagcaaaatcatcacttttcaatatttggttgttttgtctaaa

SEQ ID NO: 11824 - DNA, 677 bp, Cedrus atlantica
agatctttgtgaaaaccctcactggtaaaactataaccctcgaggtcgaaagcagcgatacgatcgataatgtgaaggccaagatccaggacaaagaagggatccctcctgaccagcagaggttgatttttgctggaaaacagctggaagatggccgtactcttgctgattacaatattcagaaagagtctacgctacaccttgttttgaggcttcgtggagggatcattgaaccttcgctgatggctttggcaaggaagtacaaccaagacaagatgatttgcagaaagtgctatgcccgtttgcatcccagggcagttaactgcaggaaaaagaagtgtggacatagtaatcagctgaggcctaagaagaagatcaagtaaagcggctgagtttgaattcgatagtttatctccacaattttgttgaggaattattttcttggcctttgagaagccaacttgattaaacatttattttattgaaaaagactgttactatcatgcagacttcagagctggttccctaaccatggatttacctttgtgtttcctgttgggccagatttgaatagttttaaatgttatttccagatttgagtttgaagttgtttatggttttaaagagattaaatattattgagttacccttttcattaaattctgtgatttattgca

SEQ ID NO: 11825 - DNA, 625 bp, Ceratodon purpureus
ctttctcgctctgttgtattgccgcggtgtgtctccgagcgtccgtcaccatgcagatcttcgtcaagaccctgacgggcaagaccatcacgctcgaggtcgagagctccgacactatcgacaatgtcaagaccaagatccaggacaaggagggcatcccgcccgaccagcagcgtctcatcttcgccggcaagcagctcgaggatggccgcactctcgcggactacaacatccagaaggagtccaccctgcacttggtgctgcgtcttcggggcggtatcattgagccctcgttgatggccttggctcgcaagtacaaccaggagaagatgatctgccggaagtgctacgctcgcctacacccccgagctgttaactgcagaaagaagaagtgtggacacagcaaccagctccgccccaagaagaagatcaagtagagaggtggctcattgccttcgtgcattgggtgcaagataagcttaaggaatgtgatagacctgcgccggtcgatgagacaggtttagggtacacgaagacctgtttagcttgtttgctgagcttgtaatgcatcccattttctctgtaagaacacattttcggtttcattgtccggatcattttacac

SEQ ID NO: 11826 - DNA, 794 bp, Ceratodon purpureus
ttcttcgcctaggaggtcgcgcgggacgttcaccggggcgggcaccatgcagatcttcgtgaagaccctcacgggcaagaccatcacgctcgaggtcgagtcctcggataccatcgacaatgtgaagaccaagatccaggacaaggagggcatcccgcccgaccagcagcgcctcatcttcgccggcaagcagctcgaggatggccgcactctggctgactacaacatccagaaggagtcgaccttgcacttggtgctgcgtctccggggtggtatcattgagccctcgctcatggctctcgccaggaagtacaaccaggagaagatgatttgccgcaagtgctacgctcgcctccacccccgtgctgtgaactgccgcaagaagaagtgcggacacagcaaccagcttcgcccaaagaagaagattaagtagatggttaagcttgcgcaattgtgcacctgtccaggttatgttgcgagggtgtgtgagatttcatacagtttgtgtgtgactttctcaggctacatgatacgggtgcatagaatgtgtagcccggtgccttggattacgattgaggttttctcactccatttacataaacttttcacggcttcacggagacattattgtgcttcttcgcttctttacgctgcaaataggaacattgtaggtgacatacttttgtcgcttgtttcttaggtctttggagatctttttcctggattggatgggtttttggagtctgagggcgttggaatttttctagtaagagttggttaatctaataattgtg

SEQ ID NO: 11827 - DNA, 565 bp, Ceratodon purpureus
tcagattgctgggaggcggaggggattgacgttaggcgccatgcagatcttcgtgaagaccctgacgggcaagaccatcaccttggaggtcgagagctccgataccatcgacaatgtgaagacgaagatccaggacaaggaggggatcccccctgaccagcagcggttgatctttgctgggaagcagctcgaggatggtcgtactcttgccgattacaacattcagaaggagagcactttgcacttggtgctgcgtctccggggtggtatcattgagccctcgctcatggcgttggccaggaagtacaaccaggagaagatgatctgccggaagtgctacgcccgcctccacccccgcgctgtgaattgccgcaagaagaagtgcggacacagcaaccagcttcgcccgaagaagaagatcaagtagagggttaattttttgcagttgtgcatcactggagggtttgtttcgaggtgtaaattgcacacaattctggtgtggaagaaagattaatataatgttaagcttggtccttggatcacatatcagggttattctctgcat

SEQ ID NO: 11828 - DNA, 640 bp, Cynodon dactylon
ggggggaggagaaggcgccgcagcagacccaggcggaggaagaagacccgagccagccaagatgcagatcttcgtgaagacgctgactgggaagaccatcaccctcgaggtcgagagcagcgacaccatcgacaatgtcaaggccaagatccaggacaaggaaggaattcccccggaccagcagcgtctgatcttcgccgggaagcagctggaggacggccgcaccctggctgactacaacattcagaaggagtccaccctccacctcgtgctcaggctccgcggtggaatcatcgagccctcgctgcaggctcttgctcgcaagtacaaccaggacaagatgatctgccgcaagtgctatgctcgcctgcaccccagggctgtcaactgccgcaagaagaagtgtggtcacagcaaccagctgaggcccaagaagaagatcaagaactgaagtgtcgctagacagtttcgtggactatttaaatcctctgtcggattgtatgttatgctgtgttgtctgaatgttgaactgtgtttgttgagccgaatcatgtctgtatgttgaaccttgttgatgatgacatatggcagtagctgctactctgcccgttaaattttgccccatccgtgctgtggattc

SEQ ID NO: 11829 - DNA, 644 bp, Cynodon dactylon
ggggcccgcccatccgtttcgcacgaagccgccgccaccgccgccgccgcgccgttgagcttcgtccgccgggccgggttcgtcaagatgcagatcttcgtcaagaccctgaccgggaagaccatcacccttgaggtcgagagcagcgacaccatcgacaatgtcaaggctaagatccaggacaaggaaggtatcccgccggaccagcagcgtctgatcttcgccggcaagcagctggaggacggccgtaccctggccgactacaacatccagaaggagtccaccctccacctcgtcctccgcctccgcggtggtatcatcgaaccttccctccaggccctcgctcgcaagtacaaccaggacaagatgatctgccgcaagtgctatgcgcgtctgcatcccagggctgttaactgccgcaagaagaaatgtggtcacagcaaccagctgaggcccaagaagaagatcaagaactgaagcctgacgtaccagtttcgtggatgggtagagtcaacaagaatattggagttacaatctttagagttgcataatgctgctttctttttaagtcggaaccttgaggtctttctgttcaggggtcttcagcatgttttgctggtataattagtgaaaacgtctgggtc

SEQ ID NO: 11830 - DNA, 670 bp, Echinochloa colona
gccatttcccggaatagccgccgcctccgcaaacacagaagctgggagaacatccagggccggcaagatgcagatcttcgtgaagacgctaacgggtaagaccatcaccctcgaggtcgagagcagcgacaccatcgacaatgtcaaggccaagattcaggacaaggaaggaatcccgccggaccagcagcgtctgatcttcgccggaaagcagctggaggatggccgcaccctggctgactacaacatccaaaaggagtccacgctccaccttgtgctcaggctccgtggtggaatcattgagccctcgctgcaggcgctcgctcgcaagtacaaccaggacaagatgatctgccgcaaatgctatgcacgcctgcaccccagggctgtcaactgccgcaagaagaagtgtggtcacagcaaccagctgaggcccaagaagaagatcaagaactgaggtgtgttgttgctagtcagtttcatggaaatcatctgctctagtggtgtaccgtatgctctgatgcgttgttgtctggatattgaaccgagttgttgtgccaaactttcctgccgtgatgttttatcttgttgtcgatggtggcagtactatatggcaatatagctactatgctgttgcacttttggtatatgctcgtttatttttgttgtc

SEQ ID NO: 11831 - DNA, 864 bp, Echinochloa colona
gtgtgctcttccgaccccgcccattcccgcacgaagccgacgagccgccgccgcgcctaagcttggtccgaggagcttcggaggagggccgggtaggtcaagatgcagatcttcgtgaagaccctgacggggaagaccatcaccctcgaggtcgagagcagcgacaccatcgacaatgtcaaggctaagatccaggacaaggaaggcatcccgccggaccagcagcgtctgatcttcgccgggaagcagttggaggatggccgcaccctggccgactacaacatccagaaggagtccaccctccacctcgtcctccgccttcgcggtggaatcattgaaccttccctccaggcgctcgcccgcaagtacaaccaggacaagatgatctgccgcaagtgctatgcgcgccttcaccctagggctgttaactgccgtaagaagaagtgtggccacagcaaccagctgaggcccaagaagaagatcaagaactgaggcttggtgtatcggttccgtgggtcttttggatcaagacgaagatcagagtttgaagtttcttctgctgcataatctctggtttcagtcagaacatcgaggtccttctgtttagggtcttcagcatgttttgctgtcataaattgtgacataagtgtgggttaaattacatggtagcctttaacttatattgtggtcgttactttagttgctgtttctgcgtgttaccttcgtttgaaatctgcccccactgttgctactttggtttcgcgggtagctccatggctccattgtttctcacgtgcctccttttatcgccaattgactggcagcaggcgtctggtttaaaagtggggatgttgtttccttacc

SEQ ID NO: 11832 - DNA, 666 bp, Echinochloa colona
atgcagatcttcgtgaagacgctgacgggtaagaccatcaccctcgaggtcgagagcagcgacaccatcgacaatgtcaaggctaagatccaggacaaggaaggtatcccgccggaccagcagcgcctgatcttcgccgggaagcagctggaggacggccgcaccttggccgactacaacatccagaaggagtccaccctccacctcgtgctccgccttcgcggtggtatcattgaaccttccctgcaggcgctcgcccgcaagtacaaccaggacaagatgatctgccgcaagtgctatgcgcgtcttcaccctagggctgttaactgtcgtaagaagaagtgtggccacagcaaccagctgaggcccaagaagaagatcaagaactgaggcttggcgtatcggttccgtgggtcttggatcaagatgagagtttagagtttctgctgctgcataatctccggtttcagtcagaacatcgaggtcttctgttttagggtcttcagcatgtttttgctggcataaattgtgacataagtctgggttatattacatggtaggctttaacttatatcttggtcgttactttagttgctttttctgtgtgttgctttcgattgaaatttgtgcccactattactaatttggttttccgagtcgtcgtgt

SEQ ID NO: 11833 - DNA, 781 bp, Euonymus alatus
tagttgtcaatcatctgtcatgaagttaggatgccgcctctccgaaagcccatgaaataaaacccgaccaaacaccatcccacaaatttaccctaggttggttgcgaagagagagagcaaagatgcagatcttcgtgaagaccctaactggcaagaccataactctcgaggtagagagcagcgacactattgacaatgtcaaggctaagatccaggacaaggaagggattccaccggaccagcagaggttgatttttgctggaaagcaactcgaagatggtcgtactttggctgactacaatattcaaaaagagtcgactcttcatcttgtgttgaggcttcgtggggggatcattgagccttctttgatggctttggctaggaaatacaatcaggaaaaaatgatctgccgcaagtgttatgctcgtctgcatcctcgtgctgtaaactgcaggaagaagaagtgtggtcacagcaaccagttgaggcccaagaagaaatccaagtgaacaatagtagtggctctctatagtgccatcaaagaggatctcggtgttgagtgttttccctgtgttttgttttgttctttatgttcaattagacaaatggatttagagttaaacaatgaatagcaccttattttggttgagtactatggcatcatattcggtttccgtagcgttgtttctggttctatgttcatgtagaattggagtttaacaacgaatagcatcgtatttgtggtgacaggtgcgctacatatttgtttctcttcctgttc

SEQ ID NO: 11834 - DNA, 447 bp, Euonymus alatus
ggttgtttgcgaagagagcgagcaaagatgcagatcttcgtgaagaccctgaccggcaagaccataactctcgaggtagagagcagcgacaccattgacaatgtcaaggcgaagatccaggacaaggaagggattccaccggatcagcagaggttgatttttgctggaaagcagctcgaagatggtcgtactttggctgactacaatattcagaaagagtcgacacttcaccttgtgttgaggcttcgtggagggatcattgagccttctttgatggctttggccaggaaatacaatcaagagaaaatgatctgccgcaagtgttatgctcgtctgcatcctcgtgctgtgaactgcaggaagaagaagtgtggtcatagcaaccagttgaggcccaagaagaaatccaagtgaacaacagtagtttccctcaaaaatgattttgtt

SEQ ID NO: 11835 - DNA, 772 bp, Euonymus alatus
ggaaaccaagttgccaatccgtcatgaagtcaggactcaggatgctgcctctctaaaaagcccatgaaaccgaaaccctatccgactataaaacccgagcaaacactaccttgcacacaaatttaccctaggttggttgcgaagagagagagcgaagatgcagatcttcgtgaagaccctaaccggcaagaccataactctcgaggtagagagcagcgacaccattgacaatgtcaaggctaagatccaggacaaggaagggattccaccggaccagcagaggttgatttttgctggaaagcaactcgaagatggtcgtactttggctgactacaatattcaaaaagagtcgactcttcatcttgtgttgaggcttcgtggggggatcattgagccttctttgatggctttggctaggaaatacaatcaggaaaaaatgatctgccgcaagtgttatgctcgtctgcaccctcgtgctgtaaactgcaggaagaagaagtgtggtcacagcaaccagttgaggcccaagaagaaatccaagtgaacaatagtagtggctctctatagtgccatcaaagaggatcttggtgttgagtgttttccctgtgttttgttctttatgttcaattagacaaatggatttagagttaaacaatgaatagcaccttattttggttgattactatggcatcatattcagtttccgtagcattgtttctggttctatgttcatgtggaattggagtttaacaacgaatagcatcgtatttgt

SEQ ID NO: 11836 - DNA, 831 bp, Euonymus alatus
actaaacggaaccctagttgtcttctctcgtcccggtttcatgaatctggatgccgcctctctaagcccacgttaaccgaaaccctagccgactataagtcataaaagactctagcaaacaatctcggttggttgcgaagagagcgagcaaatatgcagatcttcgtgaagaccctgaccggcaagaccattactctcgaggtagagagcagcgacaccattgacaatgtcaaggcgaagatccaggacaaggaagggattccaccggatcagcagaggttgatttttgctggaaagcagctagaagatggtcgtactttggctgactacaacattcaaaaagagtcgacacttcaccttgtgttgaggcttcgtggagggatcattgagccttctttgatggctttggccaggaaatacaatcaagagaaaatgatctgccgcaagtgttatgctcgtctgcatcctcgtgctgtgaactgcaggaagaagaagtgtggtcatagcaaccagttgaggcccaagaagaaatccaagtgaacaacggtagttaccctcaaaaatgaatttgttgagtgtttttccttcgtttttttctttatggtcaattagacatgtggatttgaagtttaaaaaatgaattgcactgtattttggtatatgacaattgcattgtatttggtcgcgttgtttttggttcattacgttcaattagaaatgtggatttagaatttgacaatgaatagcatcgaatttatggtccactacatatttgttttcctctctgctcttccaagtgtattcaagtgttttttcactgctcaaaaaaaa

SEQ ID NO: 11837 - DNA, 673 bp, Euonymus alatus
cggccggagacaaatttaccctaggctggttgcgagtagagcgagcaaagatgcagatcttcgtgaagaccctgactggaaagactataactctcgaggtagagagcagcgacaccattgacaatgtcaaggctaagatccaggacaaggaagggattccaccggaccagcagaggttgatttttgctggaaagcaactcgaagatggccgtactttggctgactacaatattcaaaaagagtctactcttcaccttgtgttgaggcttcgtggtgggatcattgaaccttctttgatggctttggctaggaaatacaatcaagaaaaaatgatctgtcgcaagtgttatgcccgtctgcatcctcgtgctgtgaactgcaggaagaagaagtgcggtcatagcaaccagttgaggcccaagaagaaatcaaagtgaaaaatggtagcctatattgccatcaaaggcgaacatggtgttgaatgttttccctatgttttgttctttacggtcaactagatgtgtcgattttgagttaaacaatgaatagctctgtattttggtagatgacgatggcatcatatttgctagtattgttttgagttcttttatgttcaattagacatgtggatttggagttcaacaatgaatagcatcttatttcttgtggtgcg

SEQ ID NO: 11838 - DNA, 704 bp, Euonymus alatus
ggccttgccaactataaaatcctagcaagcagcgtctgaaacacaaatttaccctaggctggttgcgaatagagcgagcaaagatgcagatcttcgtgaagaccctgaccggaaagaccataactctcgaggtagagagcagcgacaccattgacaatgtcaaggctaagatccaggacaaggaagggattccaccggaccagcagaggttgatttttgctggaaagcaactcgaagatggccgtactttggctgactacaatattcagaaagagtctactcttcaccttgtgttgaggcttcgtggtgggatcattgaaccttctttgatggctttggctaggaaatacaatcaagaaaaaatgatctgtcgcaagtgttatgcccgtctgcatcctcgtgccgtgaactgcaggaagaagaagtgcggtcacagcaaccagttgaggcccaagaagaaatctaagtgaacaatggtggcctatattgccatcaaaggcgaacatggcattgaatgttttccctatgtgttgttctttatggtcaactagatatgtcgattttgagttaaacaatgaatagctctgtattttggtagatgacgatggcatcatatttgctaatattgttttgggttctttatgttcaattagacatgtggatttggagttcgacaatgaatagcatcttatttgttgtggtgc

SEQ ID NO: 11839 - DNA, 620 bp, Fagopyrum esculentum
tttcgtgaaaaccctaaccgggaagaccataaccctagaggttgagagcagcgacaccatcgacaatgttaaggctaagatccaagacaaagaaggtattccaccagaccagcagcgtctgattttcgctggcaagcagctcgaagatggtcgaaccctagcggattacaacatccaaaaagagtcgacacttcaccttgttctcaggctcaggggaggaatcattgagccctctcttatggctttggcccgcaagtacaatcaggataaaaccatttgccgcaagtgctacgctcgtctgcatccgagagcagttaactgcaggaagaagaagtgtggccacagcaaccagctgaggccaaagaagaagatcaagtagatgcatcattttgttctgaggtccttgggatttaattttagaccagtttttggtttcaattcgagtcatctcaaccatctatacaagtttttgctaattctattttgttgtgacttttttgcaagctttgaataattttagtttattgaagtgtttttttttatgtttcaactttcaagattgcatgaacctatttttacttgctctattaggtgtgaattcccaaaacattcgacgtaac

SEQ ID NO: 11840 - DNA, 644 bp, Adiantum capillus-veneris
gggcctcacacacatgagttgaagaccttttgattgagtcttcctcttgaaccctaaccagaggaagaaaatgcagatcttcgtgaaaactcttacgggcaagaccatcactctcgaagtcgagagtagcgacaccatcgacaatgtcaaaacgaagattcaggacaaggaagggattccacctgaccaacagcgcctgatcttcgctggaaagcagcttgaggatggccgtactctcgcagactacaacatacagaaagaatcaactttgcaccttgtattgaggcttcggggcggaattatcgaaccatcgttgatggccttggcgaggaagtacaatcaggagaagatgatttgtcgcaagtgctatgcccgtttgcatcctcgtgcagttaactgtcgaaaaaagaaatgtgggcacagcaatcagcttcgtcccaagaagaagatcaagtagatgttctctatcggattgtagcttaggagctgagagttgtgagggtactcttttgagcttgtttcagagtgaaattttgactagtcaaaaactgtaatcaacttcatttgaaattcagagatgggctttgatctccccaaaataaaggtcttgcccaaaaaaatttttaacaaaaaaaagaccccaa

SEQ ID NO: 11841 - DNA, 707 bp, Adiantum capillus-veneris
tgttttctgccctagtcaaggtttgggagttctacacactggtgcttgagacggtcgtcggaaatgcagatcttcgtgaagaccctgacagggaagacgatcactctcgaggtcgagagtagcgataccatagacaatgttaaaaccaagatacaggacaaggaaggaattcctcctgaccagcagcgtcttatctttgctggaaaacagcttgaagatggccgaacactggcagactacaacattcagaaagagtcgaccctacaccttgttctgaggcttcgaggtggtattatagagccctccttgatggctttggcgaggaagtacaatcaggagaagatgatttgccgcaagtgctatgcccgcttacatccacgggcagtgaattgtcgaaagaagaaatgtggacacagtaatcagctccgtccaaagaagaagatcaagtagatatggtatcttgtgactcttttgcaactgcaacaaaggaagaaagttctttgaccttatttgatgtacctcaattaaacttgcaaattttggaagaggcagtgtttttgcagagtattttctatgtaggccattttcctggcctggtttacttgattgtggaagattcttcagtaagaagacactgtgagtgatggtaatagcttttatggtggtgtaactgattgtgtttctttaagacagcattgtaaggtggc

SEQ ID NO: 11842 - DNA, 1487 bp, Zingiber officinale
acgtattatcagattttagatgatgatgcatatattgtcactaccactgaggctttgtttttgttattcttcaagttttttgttttgttttgcttttttacgttttgcgaatgtgtttttagctcccatgatgattcaatattaaactttcgttcttctgagttcacaagcaatgcagaataaacatggagacctgaactgaggagtgtttcattttttgtagttcgtgatttgatgcttactttcatgtttttagggggtatcgttttgtttataaggtttcattctgttttctttttagatggtgcctatgattcctataaatatactttgatctaatattatgaaaagatttttaatctgaggcactaatgaaataatcctttctaatgttgtttatcgtctttaataatcttgggtttttgtgctttgtttgtcaattagttatcacgcccgataattttgctagattattcaggatttcagatccgtaaatcgctggagggaattttctccttctgcttcccatcttcaccgacacctggcatcttacagaattctgtataactttcccaacttgctatctattcagatgtctttgctcttcccatccggtagatactttattttttctcagacggtggaaaaattttgcatcgtcattgtgaagctacttttctttgataaatctgtggctgtaagaatctcatgcttttttctgctggcttgttggggaagcgttggaggcaagtctcagtcctctaaagagatactggttatcgttatagaactttgtaacatactctatatgagtaggcatatttatgtttctggcaaaaaaaaaaaaaaaaaaaaaggaaggtgatcgaggaaagccggcgcgatgcagatcttcgtgaagacgctcacggggaagaccatcaccctagaggtcgagagcagcgacaccatcgacaacgtcaaggctaagatccaagacaaggaagggattcctccggaccagcagaggctgatctctgctggtaagcagctcgaggatgggcggaccctcgctgactacaacatccagaaagagtctacactgcatcttgtcctgaggctgaggggtggaatcattgagccttctctcatggcccttgctaggaagtacaaccaagagaagatgatctgcagaaagtgttatgcacgcctgcatccaagggccgtcaattgccggaaaaagaagtgtggccacagcaatcagttgaggccaaagaagaagatcaagtaaactacttggttgatttttatctggatccaagaggctttagaagaacacctgcaatatattggattttgactgttctgtagtagacaagtagcaatactctgaggatcttaaatcttaatgacttgttggatgtttcctcaaatatttcttttcactgttttttgtatttttctaaatgagatttgactgcttcagtaatgataattttatgctcgaa

SEQ ID NO: 11843 - DNA, 745 bp, Panax ginseng
gacttgctcatcataacataggtggaagcaagccaagcgaatagagagaaaatgcagatattcgtgaaaaccttgaccgggaagacgatcactctcgagatcgagtcgagcgataccattgacaatgttaaggctaagatccaagataaggaaggtattccaccggatcagcagcgattgatctttgccggaaaacagcttgaagatggccgtacgctggctgattacaacatccagaaagagtcgacattgcatttggttctgaggcttcgtggtgggattattgagccttcattgatggctttggcaagaaaatataaccaggagaagatgatttgccgcaaatgttatgctcgacttcatcctcgtgctgtcaactgcaggaagaaaaagtgtggccacagcaatcagttgaggccaaagaagaagatcaagtagagacatgatttcaagtttctaccagctagttgcagctctgagggtttaccattgacaatttatgctttatgttttgtctaaaacatcaatgttggttatgttctttttgttttgttgttggtagttttatgagattttaggtcaatgttttgaattattgatacattgggacagggatttcttttcttatttttagtttgttctgaagttttttttacttctcttacatgtgcaagtgtgtgcatgtaaacataatcaaggatggcacatgtttaacttaatttacgtttgtttacttccaagtttg

SEQ ID NO: 11844 - DNA, 569 bp, Ipomoea nil
cgagtcatcgctgtctggaacagcgatgagagagattcacagctctgaagaaggaagcaaaatgcagattttcgtgaaaactctacccggaaaaaccatcactctcgaggttgaatcgagcgacaccatcgacaatgttaaggctaagattcaagacaaagaaggcattccaccggaccagcagcgattgatctttgctggcaagcagcttgaagatggccgcacccttgctgattacaatatccaaaaggaatctcccttgcatctggttctgagacttagaggtgggatcattgaaccatctctcatggctttggcccgcaaatataatcaggacaagatgatttgccgcaaatgctatgctcgtctgcacccccgtgccgtcaactgcaggaagaagaagtgtggccatagtaaccagttgaggccgaagaagaagatcaagtagatgtgtattcggctggagtgcttggattgctttcttattgggctgtgcttaaagatatttattccttgtcactgtttgttggattcttgatgttgtcaagattttagcttgctgatcataa

SEQ ID NO: 11845 - DNA, 527 bp, Eragrostis curvula
acttgagaggaaagcgcgctggaggaagcacatccaagccggcaagatgcagatcttcgtgaagaccctgacgggaaagaccatcaccctcgaggtcgagagcagcgacaccatcgacaatgtcaaggctaagatccaggacaaggaaggaatcccgccggaccagcagcgtctgatcttcgccgggaagcagctggaggacgggcgcaccctggccgactacaacatccagaaggagtcaaccctccacctcgtgctcaggctccgcggtggcatcatcgagccctcgctgcaggcgctcgctcgcaagtacaaccaggacaagatgatctgccgcaagtgctacgcacgcctgcaccccagggctgtcaactgccgcaagaagaagtgtggtcacagcaaccagctgaggccgaagaagaagatcaagaactaaagtgttaccagtcagtttcgcggaccatttaaatcctctgttggatcatatgtcatgctgtgttgttgtctggatattgaaccgggtttga

SEQ ID NO: 11846 - DNA, 682 bp, Pennisetum glaucum
gtcccgcttgacatcaacgctgccccacctgaggaaccccccgccgccgccgccgcagcaaacaaaggagctgagagaacatccaggaccgacaagatgcagatcttcgtgaagacgctgacgggtaagaccatcaccctcgaggtcgagagcagcgacaccatcgacaatgttaaggccaagatccaggataaggaaggaatcccgccggaccagcagcgtctgatcttcgccgggaagcagctggaggatggccgcactctggccgactacaacatccaaaaggagtccacgctccacctcgtgctcaggctccgtggtggaataattgagccctcgctgcaggcgctcgctcgcaagtataaccaggacaagatgatctgccgcaaatgctatgcacgcctgcaccccagggctgtcaactgccgcaagaagaagtgtggtcacagcaaccagctgaggcccaagaagaagatcaagaactgaggtggtgatgttgctgctaatcagtttcatgggccgttaaaatcgtccgttgtagtgggattttatgttatgttgcgttgttgtcccgatggtgaactaatgttgcgccaaacttttccaatgtcatgatgtttaattttaccttgttgtcgatggtgacagtactatttggcaatatagctaccatgatcctgca

SEQ ID NO: 11847 - DNA, 763 bp, Orobanche aegyptiaca
caaaggacgacgtcgtaggagcatcaaaaccctagtcttcttgtttaaaaggccagcagccaccaacttgcagccttatcccggtcaaaaatgcagatctttgtgaaaaccctaacgggcaagaccatcacgctcgaagtcgaatccagcgacaccatcgacaatgtcaaggtcaagatccaggacaaggaaggaatcccaccggatcagcagcgtctgattttcgccgggaagcagcttgaggatggccgcacacttgctgattacaatatccagaaagaatcgactctgcatttggttttgaggctcaggggtggaattattgagccctctctcatggcactagcgaggaaatataaccaggaaaagatgatttgccgcaaatgctatgcccgtcttcacccccgtgctgtgaattgccgcaagaagaagtgtggacacagcaaccagttgaggccaaagaagaagatcaagtagactcctcctggcaggatatcttgcgttattgttctgtttcctttattgtttttgttttagttgccgatgaaacatatatcatggttgttttgctctagacatttgaagtgattgtgttttgcatctttagggtgcctttatttattgtttaaataaaattcggatttggttttatgatttttgtcttattgtgtttttgttttctgttattctggttttggttttgtatgtgaagaggtatctttttggtctatttggatgttccattgactatttttcaaaaaaa

SEQ ID NO: 11848 - DNA, 539 bp, Capsicum annuum
ttctccgagtgggtgaagagagaagaggatgcaaatcttcgtgaaaaccctaacagggaagaccataaccattgaggttgaatccagcgatgccattgacaatgtcaaggctaagattcaggataaggaaggcatccctccagaccagcagcgtttgatatttgctggtaagcagcttgaagatggccgtacgctggcagactataatatccaaaaagagtccactctgcatcttgttctgaggcttcgtggtgggattattgaaccatctcttatggctttggccaggaagtacaatcaggataaaatgatttgccgcaagtgctatgcccgcttgcaccctcgtgctgtcaactgcaggaaaaagaagtgtggccatagcaaccagttgaggccaaagaagaagatcaagtaaacatgtggttgtttttgctgccaagacgcagtacaatttggcacactcttttgtattttatttgctgaacttttggtccgtcatgtctgtttcactatataagttttaaaaatctacttccatt

SEQ ID NO: 11849 - DNA, 728 bp, Physcomitrella patens
ggtctcttgagcttttatctgttgcgtgtttgtaattctaagggtgtgtcaccatgcagatctttgtgaagaccctcacgggcaagaccattactctcgaggttgaatcatcagatactatcgataatgtgaagacgaaaatccaggacaaggagggcattcctcccgaccagcagaggctcattttcgccggaaagcagctcgaggatggccgcacccttgctgactacaatatccagaaggagtccactttgcatttggtgctccgccttcgaggaggtattattgagccttcgttgatggctctggctcgcaagtacaatcaggagaagatgatatgtcggaagtgctatgcccgcctacacccccgagccgtcaattgcagaaagaagaagtgtggacatagcaaccagctccgccctaagaagaagatcaagtagagtggcggccttctgtattggtgcagtgtgtgcaatgcaagctcaggaaatgtgatagatcttcactggtctttgagcaggtttaagctacacggagaccaatatagcttgtttactgcctttgtaatgcgtcacactgccccacatgaacaccgactctctttaaatctttgtactatctattcactctggatttctcttctatggttatttatatatttttataaataacttccttgattgcctcaacagaacacgtgcacaccttgataattagtttttgactac

SEQ ID NO: 11850 - DNA, 711 bp, Physcomitrella patens
ctttttgatctttccctgtgagtttttcgcgttttggagcggaggatttgtcaccatgcagatctttgtgaagaccctgacgggcaagaccatcactctcgaggtcgagtcctctgatactatcgacaatgtgaagacgaagatccaggacaaggagggcattccgcctgaccagcagaggctgatcttcgccggcaaacagctcgaggatggccgaactcttgccgactacaacatccagaaggagtccaccttgcacttggtgcttcgtcttcggggaggtatcatcgagccctctttgatggccctggcgcgcaagtacaaccaggaaaaaatgatctgccggaagtgctatgcccgcctacacccccgggctgttaactgcagaaagaagaaatgtggacacagcaaccagctccgccccaagaagaagatcaagtagagaggtgaccacatgccttggtgcgtaggttgcagtacaagctcaagtaaagtggtagcctttgctcttacacttgtacagcttgtttgctacagttgtagtgcatcgcattttttctgtatgagcatacacgtgatcacgtttgtgatcgttatcattttgttgaactgcgtctacaaattcttgcttccttaacccttttccagctaccagaacgaattttgggtttcccatattcctgtggggacgagtgtttgtagattattgcg

SEQ ID NO: 11851 - DNA, 1584 bp, Physcomitrella patens
ctctttcgcctttgcggtttgttgtggcgagtgttgaggtgttggcgcggagcttattgtcaccatgcagatcttcgtgaagaccctgacgggcaagaccatcactctcgaggtcgagtcctccgacactatcgacaatgtgaagacgaagattcaggacaaggagggcatccctcccgaccagcagaggctcatcttcgccggcaagcagctggaggatggccgcactcttgccgactacaacatccagaaggagtctaccttgcacttggtgctccgtctgcggggcggtattatcgagccatctttaatggcactggctcgcaagtacaaccaggagaagatgatctgccggaagtgctacgcccgtctacacccccgggctgtgaattgtagaaagaagaagtgcgggcacagcaaccagcttcgccccaagaagaagatcaagtagagagggagcaaccggtctttgtgcatgtggtgcaaagcaagtggaaggggaatgctagggctgcctatgtcttattgagagctataggtcacccgaacacccgtacagcttgtttcgtggtaccgtaatgcattttattattgaacacaatttgcggggtccagtacctgagttctgaacacgttgtcaagtggattagatcgtgaatgaatggactgatctgcatgagatggtcatctgggcggcagtggtgtacgagttcacgatgctctacaacgcagaagctcatctggtggaaggagcgtggatgggttgaaatggttttacgtcgtcgtgtgtgtgtgatttcgaagttgtagtaagggagctagttgttctgaagtccggagatggagcgatggagcttgcttttgaaacggagaatgaactcatggtaaactggatttgatttcagaacatgtctcggacgttcttctggaattaccgtagtttccggtgtattcagttttgtgtcgcgaactggtaaagtggggtctaaattagatgcatgaccatcaacagtaatgtggagacttcaataacttgtgcgagatgaggcactgggggaaattaggaagtcagtgtaagttggatggcgcgatgaatatgggttggtaagcgaagctatcgaaatcgtctggagtggtacttcatgtagtcgatacgtgaggagtcttggtgcttcttgaatgattgtgaaggacagagagcggtgtgaatgattggaaagtttattctgcaattggatcagccaaaccccttaacttagcagctagacaacggctattgatacattgacacagtgagttagcggtcgagatatcaatttcaatttgccaggaagattgtggtgggttgtgtgggagatcgctgattgcccggttcactatgccgcttttctggctcggccgttgctgctacgctagctgcagctgcggctagtgttttcaggctgctgcgagtaatgctcttacctcggcgactccacgcgtgaactggctgtgtcacttcgattaggcgaccaagaaacagtggaggcatgtcatccctcgtccatgcccactaggtgtgggacttagcgagatccccttcag

SEQ ID NO: 11852 - DNA, 774 bp, Physcomitrella patens
ggaagactgttgcaaatcgcaacgaacgcgactgacggtgcttctatttgttgtggtcttcgactgtgctgagagttttggaagaggacttttggagcgcaggagccatgcagatcttcgtgaagacgctgacgggcaagaccatcacgcttgaggtcgagtcctctgatactatcgacaatgtgaaaacaaaaattcaggacaaggagggcattcctcccgatcaacagcgtctgattttcgccggcaagcagctcgaagatggtcgcaccctggctgactacaacatccagaaggagtctacgttgcacttggtgctgcgtcttcggggtggcatcatcgagccctcgctcatggccttggccaggaagtacaatcaagagaagatgatttgcaggaagtgctatgctcgcctccaccctcgcgctgtcaactgccgtaagaagaagtgtggacacagcaaccagcttcgccccaagaagaaaatcaagtagagggttaatctcttgcagctgtccgcctttgagggttttgctgcgaggtgcgtgactactgatttatggtgcgatttttataggcgcgcttggaatcttaatacactttggagctcgttgtatttgaatacaattcagagtttccctccttaacaacataaagctgcgtctcgtgacttttttcatgagtacattagtttgttagggtattccaggattttgaattatggttgcgaaggttttgtgccactgttcagatctatgaaacgttttttacttc

SEQ ID NO: 11853 - DNA, 586 bp, Physcomitrella patens
cttttgcttgattcccttgtctgtcgggtgcgaaatcgcagtgtgcttggaaccatgcagatcttcgtgaagaccctgacgggcaagaccatcacgctcgaggtcgagagttctgacactatcgataatgtgaaaaccaaaattcaagacaaggagggaattcctccggaccagcagcgtctcatcttcgccggcaagcagctcgaggatggccgcactctggctgactacaacatccagaaagagtctaccttgcatttggtgctgcgccttcgaggtggcattattgagccctcgctcatggccttggccaggaagtacaaccaagaaaagatgatttgcaggaagtgctatgctcgcctccaccctcgcgctgtgaactgccgcaagaagaagtgtggacacagcaaccagctccgcccaaagaagaagatcaagtagatgttagggcttgctcatgtatacacctgtcaaggttatattcctagtgggtttatgacttcacgcaattctgttgtgtacctctctggttccgatggaaagattaataccatgtgtggctggggccttgaattgctcttcagga

SEQ ID NO: 11854 - DNA, 699 bp, Pteridium aquilinum
ggctgtgtgtagaagaggagagtggaagatgcagattttcgtgaagaccctgacgggcaagaccattactctcgaggtcgagagcagcgacactatcgacaatgtcaagaccaagatccaggacaaagaaggaattcctcctgaccaacagcggctgatttttgctggcaagcagctggaagatgggcgtacattggcagactacaacatccagaaagagtccactttgcacttagttttgaggctgcgtggtggcatcattgaaccttcgttgatggcgctcgcaaggaagtacaaccaggagaaaatgatctgccgcaagtgctatgcgcgactgcatcctcgagctgtgaattgcaggaagaagaagtgtgggcatagcaaccagctccgacccaagaagaaaatcaagtagacgcacacaggctctttctgctattggttgaaatccttgggccttttgtcttttttttcaagtaaattattagtgtggaggaaaggtgagatagctgaagaagaagacagagtctcagtttcctacggcaatgtctttgtgatggaagacatgtgaattgtgttcttcttagcacgaagtgcaatgagatttggtatatttgaatttgaagtgcaagtgtttatgctaaattaggcacctttacagtttcttcgtagtatcctaaatcgcatattctttagttt

SEQ ID NO: 11855 - DNA, 722 bp, Pteridium aquilinum
gaagcgagagcattttgtgaagagaggagtcgaagatgcagatcttcgtgaagaccctgaccggcaagaccatcacgctcgaggtcgagagcagcgacactatcgacaatgtcaagaccaagatccaggacaaggaaggaattcctcctgaccagcagcgactgatctttgctggcaagcagctggaagatgggcgcactttggccgactacaatattcagaaagagtccacattgcacttggttttgaggctgcgcggtggcatcatcgaaccttcgctgatggcgcttgcaaggaagtacaaccaggagaaaatgatatgccgcaagtgctatgcgcgactgcatcctcgagctgtgaattgcaggaagaagaaatgtgggcatagcaaccagcttcgacccaagaagaagatcaagtagacacaggctctttcggttatcatttgaatggaatcctcgggctttttcttcttccagagtagattttgtgttcagagtagatgagatagctgaacttgaaggcagccttagttccccatggctatgtctatgtgatgcaaaacagttttgtattttgttataatgatcaagtgccatgagatttggtatttttgaacttgaaatgtaagcctctacatcaagagtaagcttcgaccttctgtttatgcaaattggcttggtgtggatagtctcctccctggctttaagtccaaaaaagaa

SEQ ID NO: 11856 - DNA, 671 bp, Oryza sativa
gaccttgctccacacccgcagcagcagcagcagcaaggagaagaagaagagccaagatgcagatcttcgtgaagaccctgacggggaagaccatcacgctcgaggtcgagagcagcgacaccatcgacaatgtcaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttattttgatgacataattgactacaaagtcaaggttatatggtccggccttaatttttgtccccttcgaagtttg

SEQ ID NO: 11857 - DNA, 677 bp, Oryza sativa
cccgccgccgcagcagcaaggagctagagagacaaaggggagagagccccggggaagaagaagaagcagcagctagggcgccaagatgcagatcttcgtgaagaccctgactgggaagaccatcaccctcgaggtggagagcagcgacaccatcgacaatgtcaaggctaagatccaggacaaggagggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaaatgctatgcgcgcctgcaccctagggctgtcaactgccgcaagaagaagtgtggtcacagcaaccagctgaggcccaagaagaagatcaagaactagagcgtcactcgccgggttcgtggactggttaaatcaatcgtcatattagacttttatgcttccgttgttatctccctggatgttgttgaaccgtgttttaatgtgctggatgcttcagcttcttgttttgacggtcgtggtatatggtaattggcagcaaactatattggtcatgtcgaaattgtcgtgcgtttcaatattt

SEQ ID NO: 11858 - DNA, 509 bp, Selaginella moellendorffii
agggttcttggaggcattagggttttgcagagccggaggagcagccaagatgcagatctttgtgaagacgctcacgggcaagaccatcacgctcgaggtcgagagcagcgatactatcgacaatgtcaagacgaagatccaggacaaggaaggcattcctccggatcagcagcggctcattttcgccggcaagcagctggaagatggccgcacgctcgcggattacaacatccaaaaggagtctacgctccatctcgtgcttcgcctccgcggaggaatcatcgagccttcgttgatggctctggcgaggaagtataaccaggagaagatgatctgccgaaagtgctatgcaaggcttcatcctcgcgctgtgaactgccggaagaagaaatgtggccactccaaccagctgcgtcccaagaagaagatcaaatagagagactaccaatgtagaaggaaacttctctgtcgaagggaaaattcaatcaatcgaagcattctataagcct

SEQ ID NO: 11859 - DNA, 523 bp, Selaginella moellendorffii
atcttgttttagggttcttggaggcattagggttttgcagagccggaggagcagcagccaagatgcagatctttgtgaagacgctcacgggcaagaccatcacgctcgaggtcgagagcagcgataccatcgacaatgtcaagacgaagatccaggacaaggaaggcattcctccggatcagcagcggctcattttcgccggcaagcagctggaagatggccgcacgctcgcggattacaacatccaaaaggagtctacgctccatctcgtgcttcgcctccgcggaggaatcatcgagccttcgttgatggctctggcgaggaagtataaccaggagaagatgatctgccggaagtgctacgcaaggcttcatcctcgggctgtgaactgccggaagaagaaatgtggccactccaaccagctgcgtcccaagaagaagatcaaatagagagactaccaatgtagaaggaaaattttctctcgaagggaaaattcaatcaatcgaagcattctataagccca

SEQ ID NO: 11860 - DNA, 688 bp, Panicum virgatum
cgcgccgccgccgccgccgccgcttcagtacccggagtagccgccgccgcgaacacaggaaggagcggcgggaacatccagggccggcaagatgcagatcttcgtgaagacgctgactgggaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaacatccaaaaggagtccacgctccacctcgtgctcaggctccgtggtgggattattgagccctcgctgcaggcgctcgcacgcaagtacaaccaggacaagatgatctgccgcaaatgctacgcacgcctgcaccccagggccgtcaactgccgcaagaagaagtgtggccacagcaaccagctgaggcccaagaagaagatcaagaactgaggtgtgttgctgctaatcagtttcatcgaccgtttaaatcatctgttgtagtggtgtaccgtatgctgtgttgtgttgttgtcgggatgttggaccgtgtctgtttagccaaacttttcggcctgccgtgatgtttcaccttgttgtcgacgatgacagttcttctatatggtaatacagccactgctcttgcaatttcgttttcct

SEQ ID NO: 11861 - DNA, 1575 bp, Panicum virgatum
ccttctgactgcgaactacgctcggggtggcttatttgtttttttttctttttgagaaacaatgggtggcctctgggtgtcactgaatccctttccgacagaaacggcccggcccaatgaaaaccctaacgcagggagctcgttcctccccggggtataaaatggaggggccgccgccctgcccacctcacccgcccattcccgcacgaagccgacgagtcgccgccgccgcgcaagagcttgtgaggggcttcggaggaaggccgggtaaggcaggatgcagatcttcgtgaagaccctgacggggaagaccatcaccctcgaggtcgagagcagcgacaccatcgacaatgtcaaggccaagatccaggacaaggaaggcatcccgccggaccagcagcgcctgatcttcgccgggaagcagcttgaggatggccgcacccttgccgactacaacatccagaaggagtccaccctccacctcgtcctccgcctccgcggtggcatcattgaaccctctctccaggcgctcgcccgcaagtacaaccaggacaagatgatctgccgcaagtgttatgcacgtcttcaccccagggcagtcaactgccgcaagaagaagtgtggccacagcaaccagctgaggcccaagaagaagatcaagaactgaggcatggcgtatcggttccatgggtcgtccggatcaactagagcgtccgaatttaagtttttgcagctgcataatgctcctctgatttgagtcagaacttagtggtctttctgttcagggtcttcagcatgtatttgctggcataaatttgtgacagaaattcgggtttatattatatggtaagattataactctataaattcgtggtcgtcgatacttgtgttcttcgtgtgctgtttcggatcgaatctcgtcttgtgtctccactgttgtctctcctgttatggattgttatctctgcgtaacagcttaggttaagcccgattccgcttggtgttgccagattgtgatcgtgtgctggggagaggcggctgggtttctgtttgggctttactcggatcctaacgggctttgagcaatccggaagggcaggatttcgctgagcctcgcgccgctcgcgttaacgcgtattgttttagtcccacatcgtccgcgcacgtctagtcgccgtcacatatagggcctgtttggtttggcgcctatggcgccacaccgtgcctaagctgcggcggccgattcggctgccacacctgcggcgcgggatgtgtggcgcggtgtggcgccgtaggtcacgaaccaaacacgcccataattcgcgatcctgacgcgtctctcgccgcgcggcaagcgcggttagcacatgtgatcctggtttctgattcgagtcaaggtacagtgctctctcctatgctgccacaattacccttggaatgaggtactgactttgcaaactggtgacgccgtgcggcatgcacggctagcaaaaataaatcaccaagccatgttgtcagggtcaggttctcgaaggaagccaaaccccgcatagggttgttgccatcctgcaaccg

SEQ ID NO: 11862 - DNA, 866 bp, Panicum virgatum
ccagtggtatcaacgcagagtggccgccgcccggccccacccgcccattccgcacgaagccgacgagccgccgccgcgcaagagcttactgtgaggggcttcggaggaaggcagggtagggcgagatgcagatcttcgtgaagactctgacggggaagaccatcaccctcgaggtcgagagcagcgacaccatcgacaatgtcaaggccaagatccaggacaaggaaggcatcccgccggaccagcagcgcctgatcttcgccgggaagcagcttgaggatggccgcacccttgctgactacaacatccagaaggagtccaccctccacctcgtcctccgcctccgcggtggcatcattgaaccctctcttcaggcgctcgcccgcaagtacaaccaggacaagatgatctgccgcaagtgctatgcacgtcttcaccccagggcagtcaactgccgcaagaagaagtgtggccacagcaaccagctgaggcccaagaagaagatcaagaactgagtcatggcgtatcggttccatgggtcgtccggatcaactagagggtcggagtttaagtttttgctgccgcataatactgcctctgttttgagtcagaacttagtggtctttctgttcagggtcttcagcatctatttgctggcataaatttgtgacagaaatttgggtttatattatatggtagattaactctgaattcttcggggtcgatactgttcttggtgtgctgttttggatcgattctcagtcttgcgtctccactgttatctcagcgtagctgctttggttctcgccttgttgcgcgtgtttttccaaattctgtgccagggtgaggcggctgggtttctgttt

SEQ ID NO: 11863 - DNA, 1041 bp, Panicum virgatum
ggacgaaaccctaaaaatccggcgcgacaaggtataaaaaccccgcacccgccgccgccgccgctccagtacccggaggagtagccgccgccgcgaacacaggagcagcgggaacatacaggaccggcaagatgcagatcttcgtgaagacgcttactgggaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaatatccagaaggagtccacgctccacctcgtgctcaggctccgtggtggaattattgagccctcgctgcaggcgctcgcgcgcaagtacaatcaggacaagatgatctgccgcaaatgctacgcacgccttcaccccagggccgtcaactgccgcaagaagaagtgtggtcacagcaaccagctgaggcccaagaagaagatcaagaactgaggtgtgttgctgctaatcagtttcatcgaccgtttaaatcatctgttgtagcggtgtatcgtgtgctatgttgtgttgttgtccggatgttgaaccgtgtctgtttatccaaacttttcggcctgccgtgatgtttcaccctgttgtcgatgatgacacttatatatggcaatacatgccactatgctcttgcaattttgtggtctgtgctcgtccttttcttgtcgaaccgtctaagcggcgtgccagtgcgtgtccaggctattcattcacagctgtttggccccggggcgtctgcgcggcgtttggtccgatgccccggccggcagtgctcttcagcctggacggatgattcattagccattcagctatgactgagaacggagcgagcaggttgacatgcttgtttgtccaaggttgctgaaccagaggcgaacgaatccaggcatcgacgcgatcccagcatctccgagctcaatgatcccggcgccgccgatgcttccgagttttggtttctcat

SEQ ID NO: 11864 - DNA, 764 bp, Tabernaemontana elegans
ttcatcacccagaaggcgccgcgaataggtcttgccggagaaaatgcagatcttcgttaaaaccctaactggaaagaccataaccctagaggttgaatcatctgataccattgacaatgtcaagactaagattcaagacaaagaaggtattccgccggaccagcagcggttgatttttgctggaaaacagcttgaggacgggcgtacgctggctgattacaacatccagaaagagtccacgcttcatttggttctgaggctgcgtggggggattattgagccgtcgttgatggctttggcccggaagtacaatcaagataagatgatctgtcgcaaatgctatgctcgtttgcatcctcgagctgttaactgcaggaagaagaaatgcgggcacagcaaccagttgagggcaaagaagaagatcaaatagatgtgctgttgaaggcttgccgtattccattttgtaggttgtccgagtataacaattttcaattggtttgaattggttgataagaggagttttatcggatgttggacaacattggtagcagcattatcgctagaaattagttaattacattgttttgtgttttagttgaatattctgaaattttatggtttgctgaatttcttgtggatattgaatcttaaggttggatcaaattgttatatgatgcagctgagataatttatattgaaatattggagattaaagtgggggaaaagggttagattaccctctcggtatcccgtaaagactcagg

SEQ ID NO: 11865 - DNA, 550 bp, Triphysaria pusilla
cagatctttgtgaaaaccctgaccgggaaaacaattacactcgaggtcgaatcgagcgacaccatcgacaatgtcaaggccaaaattcaagacaaggaaggaattcctccggatcagcagcgtctgattttcgccgggaagcagctggaagatggacgcacactcgcggattacaatatccaaaaagagtcgacattgcatttggttttaaggctgcgtggaggaattatagagccttcattgatggctttagctaggaagtataaccaggagaagatgatctgccgcaaatgttatgctcgtctgcatccgcgtgctgtgaactgtagaaagaagaagtgtggccacagcaaccagttgaggcccaagaagaagatcaagtagactattatgctgctttacatgtatcccaaagatttttcttttagcagcttggctgcatataatcacattttctaccggcgtgtattggccaattatgtaccaaatatttgttgtgtgttgtattaggtaaatgctgaatttttatgttaatctgaatgattatttt

SEQ ID NO: 11866 - DNA, 619 bp, Tripterygium wilfordii
agagcgagcaaagatgcagatcttcgtgaagaccctgaccggaaagaccataactctcgaggtagagagcagcgacaccattgacaatgtcaaggctaagatccaggacaaggaagggattccaccggaccagcagaggttgatttttgctggaaagcaactcgaagatggccgtactttggctgactacaatattcaaaaagagtccactcttcaccttgtgctgaggcttcgtggagggatcattgagccttctttgatggctttggctaggaaatacaatcaagagaaaatgatctgccgcaagtgttatgctcgtctgcatcctcgtgctgtgaactgcaggaagaagaagtgcggtcacagcaaccagttgaggcccaagaagaaatccaagtgaacaatggaagtggctctctatggtgccataaaagaggaacatggtgttgagtgttttccatgttttattcttttgtggtgtcaactagacatgaatttggagtaaacaatgaaatagcaccgtattggtagcatttgtttttgtttctttatgctctattagacttggatttggaatttaacaatgaataccatgttattttgttgtgcactatgtatt

SEQ ID NO: 11867 - DNA, 702 bp, Tripterygium wilfordii
ggttgtggtgagcgagcaaagatgcagatcttcgtgaagaccttgaccggcaagaccataactctcgaggtagagagcagcgacaccattgacaatgtcaaggcgaagatccaagacaaggaagggattccaccggatcagcagaggttgatttttgctggaaagcaacttgaagatggtcgtactttggctgactacaatattcaaaaagagtcgacacttcaccttgtgttgaggcttcgtggggggatcattgagccttctttgatggctttggctaggaaatacaatcaagagaaaatgatctgccgcaagtgttatgctcgtctgcatcctcgtgctgtgaactgcaggaagaagaagtgcggtcatagcaatcagttgaggcccaagaagaaatccaagtgaacaatggtagtgactctctatggtgccatgaaagatgaaattgatgttgagtgtttttcctgtgttttgttctttatggtcagttagacatgtggatttggagttaaacaattaatagctccatactttggtagatgatgattgcatcgaatttggtagcattgcttttggttctttatgttcaattagacatatggatttggaatttaacaatgaatatcattgtatttttggtgcactacattatttgttttcctccttgctcttcctagtgaattaaagcgtcttttcacc

SEQ ID NO: 11868 - DNA, 701 bp, Tripterygium wilfordii
gacgataaaaccctagcaaacagggtcacgtatacaattttaccctaggttggttgcgaacagagcgaggaaagatgcagattttcgtgaagacactgaccggcaagaccataactctcgaggtagagagcagcgacaccattgacaatgtcaaggctaagatccaggacaaggaagggattccaccggatcagcagaggttgatttttgctggaaagcaactcgaagatggtcgtactttggctgactacaatattcagaaagagtcgactctgcaccttgtgctgaggcttcgtggggggatcattgagccttctttgatggctttggctaggaaatacaatcaagaaaaaatgatctgccgcaagtgttatgctcgtctgcatcctcgtgctgtgaactgcaggaaaaagaagtgcggtcacagcaaccagttgaggcccaagaagaaatccaagtgaataatggtatggctatctagagttccatcaaagaggatcttggtgttgagtgttttccctgtgttttgttctttatgttcaattagacatgtggatttggagttaaacaatgaatagcgccttattttggtagattactatggcatcatatttgaatttgatagcattgtttttggttttatgttcaattagacatgcggatttggagtttaacaacgaatagagcttcgtatttgtcgt

SEQ ID NO: 11869 - DNA, 549 bp, Vinca minor
cagatcttcgtgaaaaccctaaccggaaagaccataaccttagaggttgaatcttctgataccattgacaatgtcaaggccaaaattcaagacaaggaaggtattccaccggaccagcagcggttgattttcgcgggaaaacaacttgaggatgggcgtactttagccgattacaatatccagaaagagtccacacttcatttggttctgaggctgcgtggaggaattattgagccgtcgttgatggctttggctaggaagtacaatcaagacaagatgatttgtcgcaagtgctatgcaaggttgcatcctcgtgctgttaactgccgtaagaagaagtgtgggcacactaaccagttgaggcccaagaagaagatcaagtagacgccctgtttaacggatgctctgttgcattttgtagcttgtcttaatttaattttttttctgctgctacagtttagaatatggagtattaaggtttacgggaatagtttctgtctggacttattatcagatttcaatgacattttcctttgtggatgttacatt

SEQ ID NO: 11870 - DNA, 650 bp, Hordeum vulgare
gccgccgccgcctcaacacccttcgccaaaatgcagatcttcgtgaagaccctcacggggaagaccatcaccctcgaggttgagagcagcgataccatcgacaatgtcaaggctaagatccaggacaaggaggggatcccgccggaccagcagcggctgatcttcgccggcaagcagctggaggacggccgcacccttgccgactacaacatccagaaggagtcgacactccatctcgtcctcaggctccgcggaggcatcatcgagccgtccctgcaggcgcttgcccgcaagtacaaccaggagaagatgatctgccgcaaatgctatgcgcgcctgcacccaagggctgtcaactgccgcaagaagaagtgtggccacagcaaccagctgaggcccaagaagaagatcaagaactagagtgctactactagtcagtttcatggaccggttaaatccatcgccgtgtcagagtttattctgttatcgtctcgttgtcgttgaaccttattttacttttgctttcagcctcctatcgttgtggtgatgattgacagtattcgtatatggtagcaaactactataattttgccgtatctcctctgtttgatctgctttttggttaattcttgaagtaatctctccccgaa

SEQ ID NO: 11871 - DNA, 555 bp, Artemisia annua
tcgtgaaaaccctaacagggaagaccataacccttgaagttgaaagcagtgatactattgacaatgtgaaagccaagattcaagacaaggaagggattcctccagatcagcagaggttgatctttgctggtaaacagcttgaagatggaaggactcttgctgattacaatatccagaaagaatcaactctgcatttggtgttgaggctaaggggagggatcattgaaccttcgttgatggcgttggctaggaagtacaatcaggacaagactatttgccgcaagtgctatgctcgccttcacccaagggcagttaactgcaggaagaagaagtgtggccacagcaaccagttgaggcccaagaagaagatcaagtgagcgcttgttgagtgttttgggtgttggattcagaagtatctgcatttcgtttttctagttttgttttgtacttgtattaaagtaaactatatcatttttgctttgttgccggaatgattattttactttaaatcttcctagacattttaaatctaatggatttcttgttacttggtta

SEQ ID NO: 11872 - DNA, 851 bp, Hordeum vulgare
cgcagctccattcgcgccgccaccagcccaagatgcagatcttcgtcaagaccctgacgggcaagaccatcaccctcgaggtcgagagcagcgacaccatcgacaatgtcaaggccaagatccaggacaaggagggtatcccgccggaccagcagcggctgatcttcgccgggaagcagctggaggacgggcgcacgctggccgactacaacatccagaaggagtcgacgctgcacctcgtgctccgcctccgcggcggcatcatcgagccctcgctccaggccctcgcccgcaagtacaaccaggagaagatgatctgccgcaagtgctacgctaggctgcatccaagggctgtcaactgccgcaagaagaagtgtggccacagcaaccagctgaggcccaagaagaagatcaagaactaggctgattgttgctttcgttgtctggataaatcagtagacataaaaatattttccggttatcgttttgctgctcctcaggatgttgaaccttggttactctagatgagtacttggccttgttttaatgtcatgacatagtgtgtctgttgctggtaatgttcatggttacttgtatgattgtgcaccctacacgttcggattttggtcttttgttgctctgccaccacaatgttagcaaatttgtgggcctgttttcagaaattcagaacagcttcgctgaatttaaaccaggattctgaaaaattgggactgaccttggtgtgtctgtctgtaaattgtgcttccaatccaaaacgcagtgttaaatttttgatttcctcaaagtagaactttatgactttcaagcttcattcaaattttagaaattag

SEQ ID NO: 11873 - DNA, 1046 bp, Hordeum vulgare
gccgccgccgcctcaacacccttcgccaaaatgcagatcttcgtgaagaccctcacggggaagaccatcaccctcgaggttgagagcagcgataccatcgacaatgtcaaggctaagatccaggacaaggaggggatcccgccggaccagcagcggctgatcttcgccggcaagcagctggaggacggccgcacccttgccgactacaacatccagaaggagtcgacactccatctcgtcctcaggctccgcggaggcatcatcgagccgtccctgcaggcgcttgcccgcaagtacaaccaggagaagatgatctgccgcaaatgctatgcgcgcctgcacccaagggctgtcaactgccgcaagaagaagtgtggccacagcaaccagctgaggcccaagaagaagatcaagaactagagtgctactactagtcagtttcatggaccggttaaatccatcgccgtgtcagagtttattctgttatcgtctcgttgtcgttgaaccttattttacttttgctttcagcctcctatcgttgtggtgatgattgacagtattcgtatatggtagcaaactactataattttgccgtatctcctctgtttgatctgctttttggttaattcttgaagtaatctctccccgaatgcttgtgtttccttccctctgcatctgggctacaggactggggttggttgagttttgattgctgatgctcaaatgctaatggtagtatgttttgttttgcactgagcaactatcgtctgccagtaagtttagcttgttgagttttaatcagacctgagtttagctttctatggcttcactctgtttataacaatgagaagtattaattaacccgagagttacaatcatgttgcatataatcttagaatcgctggaacagattgatccagggacccctcctaacttcactagcctgctaacctagtttatgttggtagagacttcatgaacaaatcatgtatcagtcacatgatttgatttgctagatatgcaatatagtgatgttgcttattggt

SEQ ID NO: 11874 - DNA, 596 bp, Brachypodium distachyon
ttgcagccgccattagccaagatgcagatcttcgtgaagaccctcaccgggaagaccatcaccctcgaggtcgagagcagcgacaccatcgacaatgtcaaggccaagatccaggacaaggaaggcatcccgccggaccagcagcgtctgatcttcgccgggaagcagctggaggacggccgcaccctcgccgactacaacatccagaaggagtccaccctccacctcgtgctccgcctccgcggtgggatcatcgagccgtctcttcaggcccttgcccgcaagtacaaccaggagaagatgatctgccgcaaatgctatgcacgcctgcaccccagggctgtcaactgccgcaagaagaagtgtggtcacagcaatcagctgaggcccaagaagaagatcaagaactagagctggaatcatcatctattcggtggatctgataaaatctctaggcgtatcagacataaagttttttgtttaatgttatgttagctcctcgtgtcggatgtttgaaccttgtttacgccatgtgagtacttggcctgctatgcataatggtgacgaagcctatgaacttcattggagcttaatcc

SEQ ID NO: 11875 - DNA, 610 bp, Brachypodium distachyon
gcggccgcctgcaggaaccccctcggccaaaatgcagatcttcgtgaagaccctcacgggcaagaccatcacacttgaggttgagagcagcgataccatcgacaatgtcaaggctaagatccaggacaaggaggggatcccgccggaccagcagcggctgatcttcgccggtaagcagttggaggacggccgcacccttgcggactacaacatccagaaggagtcgaccctccatctcgtcctcaggctccgtggaggcatcatcgagccctccctgcaggcgcttgcccgcaagtacaaccaggagaagatgatctgccgcaaatgctatgcacgcctgcatcccagggctgtcaactgccgcaagaagaagtgtggccacagcaaccagctgaggcccaagaagaagatcaagaactagagttccagtagtcatttccttcgaccggataaatccaccgtcatgtcaagagtttatgccttgttatcgtctgtctctgtttgtcgttgaaccttatttactttgctttcagcctcctgttgccctgttgttgtgggtgatacttgacagtactggtatatggtagcaaactgtattttctttgtatgt

SEQ ID NO: 11876 - DNA, 551 bp, Cenchrus ciliaris
atgcagatcttcgtgaagaccctgaccgggaagaccatcaccctcgaggtcgagagcagcgacaccatcgacaatgtcaaggccaagatccaggacaaggaaggcatccctccggaccagcagcgcctgatcttcgccgggaagcagctggaggacggccgcacccttgctgactacaacatccagaaggaatccaccctccaccttgtcctccgcctccgcggtggcatcattgaaccctctcttcaggcgctcgcccgcaagtacaaccaggataagatgatctgccgcaagtgctatgcgcgcctgcaccccagggctgtgaactgccgtaagaagaagtgtggccacagcaaccagctgagggccaagaagaagatcaagaactgagggtcggagtatcggtccagtcggtcgtttggatcaacaagaagatcctagtcttaagtttttgccgctgcataatgctgcttctgtttaaaaggagaacttcgtggtctttctgctgagggtcttcagcatgttattgctggcataaatggtgacagaag

SEQ ID NO: 11877 - DNA, 651 bp, Cynara scolymus
aactctatcataatcggcggcgactaagatagagagacgcaaagatgcagatcttccttaaaaccctaactggtacgaccatcactctcgaggttgagagcagtgacaccatcgacaacgtgaaagcaaagattcacgataaggaaggtattccaccggatcagcagcgattgatctttgccggcaagcagcttgaagatggccgaactctcgctgattataacatccagaaagaatcaaccctccatttggttttgaggctaagaggaggaatcatcgagccctctttgatggcattggctcggaaatacaatcaagacaagaccatttgccgcaagtgctatgctcgtttgcacccgagggctgtaaactgccgaaagaagaagtgtggccacagcaatcagctgaggccaaagaagaagaccaagtgaacatttgtggttgtttttgcttgcaaatttccatttttgttcctgatagtttattattatggttcagatcgttgattcagatggactttctgtaactaggatttaactgtttgacgagttatttctgtatgaaccatcccttgttgtttacttgctgctttttttgacaccattttatggttacccagtgtggaatatgtgattttattgtttcgttttg

SEQ ID NO: 11878 - DNA, 608 bp, Festuca arundinacea
agtggtatcaacgcagagtacgggggcggccgccattagccaagatgcagatcttcgtgaagaccctcactgggaagaccatcaccctcgaggtcgagagcagcgacaccatcgacaatgtcaaggccaagatccaggacaaggaaggtatcccgccggaccagcagcgtctgatcttcgccgggaagcagctggaggacgggcgcaccctcgccgactacaacatccagaaggagtccaccctccacctcgtgctccgcctccgcggcggcatcatcgagccctccctccaggccctcgcccgcaagtacaaccaggagaagatgatctgccgcaagtgctatgcacgtctgcatccaagggcagtcaactgccgcaagaagaagtgtggccacagcaatcagctgaggcccaagaagaagatcaagaactagaggtcgagccatactcacttccgtggcttgagttaaatcagtagaaatataagttttttttttggttacggttatgctgcccctgctggtaggaggatgttaaatctctaggggaaatacttggcgttgttttggtgtcaaaatggtgacaaagggtgcactttggggctgctt

SEQ ID NO: 11879 - DNA, 608 bp, Festuca arundinacea
agtggtatcaacgcagagtacgggggacaaacctcggccaaaatgcagatcttcgtgaagaccctcacggggaagaccatcaccctcgaggttgagagcagcgataccatcgacaatgtcaaggccaagatccaggacaaggagggaatcccgccggaccagcagaggctgatcttcgccggtaagcagctggaggatggacgcacccttgcggactacaacatccagaaggagtccaccctccatctcgtcctcaggctccgtggaggcatcatcgagccatccctgcaggcgctcgcccgcaagtacaaccaggagaagatgatctgccgcaagtgctatgcacgtctgcacccaagggctgtcaactgccgcaagaagaagtgcggtcacagcaaccagctgaggcccaagaagaagatcaagaactagagtgccgctagtcagtttcatggagcggttaaattcattccgtgtcagattttatgctttattatcgtgtctggttgtcgttgaaccttaagttaccttgctttcatgcctcctatcgttgtggtggtacttgatgacagtgttggtatatggtagcaaactacaattttgcggta

SEQ ID NO: 11880 - DNA, 653 bp, Festuca arundinacea
agtggtatcaacgcagagtacgggggacaaacctcggccaaaatgcagatcttcgtgaagaccctaacggggaagaccatcaccctcgaggttgagagcagcgataccatcgacaatgtcaaggcaaagatccaggacaaggagggaatcccgccggaccagcagaggctgatcttcgccggtaagcagctggaggatggtcgcacccttgcggactacaatattcagaaggagtccaccctccatctcgtcctcaggctccgtggaggtatcatcgagccatccctgcaggcgctcgcccgcaagtacaaccaggagaagatgatctgccgcaagtgctatgcacgtctgcacccaagggctgtcaactgccgcaagaagaagtgtggtcacagcaaccagctgaggcccaagaagaagatcaagaactagagtgcccatagtcagtttcatggagcggttaaatccattgccgtgtcagattttatgctttattatcgtgtctggttgctgttgaaccttaagttaccttgctttcatgcctcctatcgttgtggtgatacttgataacagtgttggtatatggtagcaaactataattttgtggtaaaaaaaaaaaaaaaaaaacaaaagtactctgcgttgataccact

SEQ ID NO: 11881 - DNA, 526 bp, Flaveria ramosissima
cgtgaagacattgacggggaagacaatcacgctcgaggtcgaatcgagcgatacgatcgacaatgtcaaggctaagattcaagacaaagaaggaattccaccggatcagcagcgtctgatctttgctggaaaacaactcgaggatggaaggactctcgccgattacaacatccagaaagagtctacgcttcatttggtgttgaggctccgtggaggtattattgaaccgtctttgatggctttagctaggaagtataaccaggataaaaccatctgccgcaaatgttacgctcgtctccatcctcgtgctgtcaactgcaggaagaagaaatgtgggcacagcaaccagttgaggccaaagaagaagatcaagtagacgaagatgttgctatgcgtgtttttgaaagaaggatattttacatgtaagggtggtgcttttgttttacaccatttttgaatgttactggaggatctttagacccttaaaatttaagtctggtgatttttattagctattgtaatgact

SEQ ID NO: 11882 - DNA, 515 bp, Flaveria ramosissima
cgtgaagacattaacggggaaaacaatcaccctagaggttgaatcgagcgatacaatcgacaatgttaaggcgaagattcaggacaaagaaggaattccaccggatcagcagcgtttgatcttcgccggaaagcaactggaagatggaaggactctcgccgattacaacatccagaaagaatcgacgcttcatttggtgttgaggcttcgtggagggattattgaaccctcgttgatggctttagcgaggaagtataatcaggataaaaccatctgccgcaaatgttatgctcgtctccatcctcgtgctgttaattgcaggaagaagaagtgtggacacagcaatcagttgaggccaaagaagaagatcaagtagatgatgattgtgatgatgttatggtatttgcttctgaaggttgtttgaatctgtaagaggtgttgctttctttttagaatatttttgaagtttttttaagtatgttttggatcttaacatttatgttgtgattttgata

SEQ ID NO: 11883 - DNA, 513 bp, Flaveria ramosissima
cgtgaagacattaacggggaaaacaatcaccctagaggttgaatcaagcgatacaatcgacaatgttaaagctaagatccaagacaaagaaggaattcctccggatcagcagcgtttgatcttcgccggaaagcaactcgaagatggaaggactctcgccgattacaacatccagaaagaatcgacacttcatttggtgctgaggcttcgtggagggattattgaaccctcgttgatggctttagcgaggaagtataatcaggataaaaccatctgccgcaaatgttatgctcgtctccatcctcgtgctgttaattgcaggaagaagaagtgtggacacagcaatcagttgaggccaaagaagaagatcaagtagatgatgatggtgatgatgttatggtacttgctcttgaaggttgtttgaatctgtaagaggtggtgctttctttttagaatctttttgaagtttttaagtatgttttggatcttaagatttatgctgtgattttgata

SEQ ID NO: 11884 - DNA, 567 bp, Setaria italica
gccgccgcctgcaacatttctcggaggagaagccgccgcagcagcaaacacaggagctgagagaacatccagggccggcaagatgcagatcttcgtgaagacgctgacgggtaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaacatccaaaaggagtccacgctccacctcgtgctcaggctccgtggtggaatcattgagccctcgctgcaggcgctcgctcgcaagtataaccaggacaagatgatctgccgcaaatgctacgcacgcctgcaccccagggctgtcaactgccgcaagaagaagtgtggtcacagcaaccagctgagggccaagaagaagatcaagaactgaggtgatgttgctgctagtcagttccatggaccatttaaaccatctgttgtagtggtgtaccgaatgttatgttgcgttgttgtctggatgttgaa

SEQ ID NO: 11885 - DNA, 538 bp, Setaria italica
caccccgcccgttcccgcaatcgacgagccgccgccgcgcttagcttgttccgaggagcttcggaggagggccgggtaggacaagatgcagatcttcgtgaagactctgacggggaagaccatcaccctcgaggtcgagagcagcgacaccatcgacaatgtcaaggctaagatccaggacaaggaaggcatcccgccggaccagcagcgcttgatcttcgccggaaagcagctggaggacggacgcacccttgctgattacaacatccagaaagagtccaccctccacctcgtcctccgcctccgcggtggcatcattgaaccctctcttcaggcgctcgcccgcaagtacaaccaggataagatgatctgccgcaagtgctacgcgcgccttcaccccagggctgttaactgccgcaagaagaagtgtggccacagcaaccagctgagggccaagaagaagatcaagaactgaggcttggagtatgggttccgcgggtcgttcggatcgacaagaagatccgagtctaagtttttg

SEQ ID NO: 11886 - DNA, 611 bp, Actinidia deliciosa
agatattcgtgaaaaccctaacggggaagacgataactctcgaggtagagagcagcgacaccatcgacaatgtcaaggccaagatccaagacaaggaaggaattccaccggaccagcagcggctgatcttcgccggaaaacagctcgaagatggccgaatcctcgctgactacaacatccagaaagagtcgacccttcatcttgtactgaggcttagaggagggattatagagccttccttaatggctttggctcggaaatataatcaagacaagatgatctgcaggaaatgttatgctcgcctccatcctagggctgtgaactgccggaagaaaaagtgtggccacagcaatcagctgaggccgaagaagaagattaagtgaacactttggactaccattttctgtgccttgaggtgttactggagaatgaaattctatacagagctagtaatgccattaagacaacaagcactatttctatatttatgtttccattccccctaatgcatggtgcagacgtacttgtagtaggaagagaattggatcttaatctttttacaaagcttcaattttgatatattttggggtgcatttgcttgttaaaaaaaa

SEQ ID NO: 11887 - DNA, 630 bp, Lolium multiflorum
atcagccaggatgcagatcttcgtcaagaccctgacgggcaaaaccatcaccctcgaggtcgagagcagcgacaccatcgacaatgtcaaggcaaagatccaggacaaggaaggaatcccgccggaccagcagcggctcatcttcgccgggaagcagctggaggacggccgcaccctggccgactacaacatccagaaggagtccaccctccacctcgtgctccgcctccgcggtggcatcatcgagccctccctccaggccctcgcccgcaagtacaaccaggagaagatgatctgccgcaagtgctatgcaaggctgcatccaagggctgtcaactgccgcaagaagaagtgtggtcacagcaaccagctgaggccaaagaagaagatcaagaactagaactccagtcattgttattcacgtggtcaactagacaaaagttttctcttgttttgtttcctctgtgttatcaggacgttgaatctaactctatgatagtacttggccttgtaatgtcatgatggggacaatatatatgattgttcatgttcattttctgcttgtgtttagtaatcatgcggtggacagttccaggtgattgttgctcttttgccagtgtggtatcaaaa

SEQ ID NO: 11888 - DNA, 645 bp, Lolium multiflorum
aggtacgcgggggcacaaacctcggccaaaatgcagatcttcgtcaagaccctcacggggaagaccatcaccctcgaggttgagagcagcgataccatcgacaatgtcaaggctaagatccaggacaaggagggaatcccgccggaccagcagcggctgatcttcgccggtaagcagctggaggatggccgcacccttgcggactacaacatccagaaggagtccaccctccatctcgtcctcaggctccgtggaggcatcatcgagccatctctgcaggcgctcgcccgcaagtacaaccaggagaagatgatctgccgcaagtgctatgctcgtctgcacccaagggctgtcaactgccgcaagaaaaagtgtggtcacagcaaccagctgaggcccaagaagaagatcaagaactagagtgccactagtcagtttcattgagcggctaaatctattgctgtctcagattttatgctttattatcgtgtctggttgtcgttgaaccttaagttacttctctttcatgcctcctatcgttgtggtggtacttgataacaatgttcgtatatggtagcaaactataattttgtggaatgtgctctgtttgctgtgatatattgtggctctagatgttagttgtct

SEQ ID NO: 11889 - DNA, 712 bp, Zea mays
ctattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgagggccaagaagaagatcaagaactgaggtgttgctgctagtcagtttcatggacaatgttgtttggttgttgaaccgtgtttgtttacgagctgtatttttgtttggttgttgaaccgtgtttgtttaccgaacatattggccttatgttatgttttaccatgttgtcgatgacacaatactatatgacgatagcaactatgctattgtagttttggtcattgttcacctgatatgtgccatatttcggtacaatttcgttagtgggcatcccgaac

SEQ ID NO: 11890 - DNA, 1229 bp, Zea mays
cttcatgcgggggtcaagcagaaaaagcccagcccaattaaaaccctagacttcctggcgtgctataaaagcaggtggccgccgcctttgccttgctcaccctgcccttctgtgtacgaagccgacgagcagccgacgctaaagcttggtccggtgagcttcagagaaggggcgggtacgtcaagatgcagatcttcgtgaagaccctgacgggaaagaccatcaccctcgaggtcgagagcagcgatacaatcgacaatgtcaaggccaagatccaggacaaggaaggtatcccgccggaccagcagcgactaatcttcgcggggaagcagctcgaagacggccgcaccttggccgactacaacatccagaaggagtccacccttcaccttgttcttcgccttcgcggtggcatcattgaaccttccctccaggcgctcgcccgcaagtacaaccaggacaagatgatctgccgcaagtgctatgcacgcctgcaccccagggctgttaactgccgcaagaagaagtgtggccacagcaaccagctgagggcaaagaagaagatcaagaactgaagcttgccaaatcggttccttgcatggtttgcgtcaacaagacgaagtttcaaagcttttgtagctgcataggctgctgcaacgtttttcagtcgtaactcgtgtgttcctgttcagggtcttcagcatgacataaatcgtttcagaagtctagtaatattattactatatggtgtcatgtcgtattgtggctcttcctttttgttgctgttgtgctgcagtagagggaaacgttccgtaattttctccaccgccaatttaatcagctagaaaacagagggaaacgcatgacataaatcgtttcagctggaaatttcgaagcgaaacatggtttaatactatggtcatgactcatgagtgtctaaataaagcaccacaaaactttccaacagctactacaaattttccttgaagtcaagaccttccaagagcatacatcattcaaagtgtttagggcactaaaaataaactgtgttaaatcatgtatttttgaggtgaattacattattagaaaagagaagtgtgagaatgatgtagaaaagtgtttagggcactaaaaataaactgtgttaaatcatgtatttttgaggtgaattacattattagaaaagaaaagtgtgagaatgatgtagaaaacaaagtggacactaggtt

SEQ ID NO: 11891 - DNA, 674 bp, Zea mays
attcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgcttcacctcgtgcttaggctccgcggtggcatcattgagccctcgctgcaggcgctcgctcgcaagtacaaccaggacaagatgatctgccgcaaatgctatgcacgactgcaccctagggctgtcaactgccgcaagaagaagtgtggtcacagcaaccagctgagggccaagaagaagatcaagaactgaggtgctgctcctagtcagtttcatggacaatgttgggctgtattgctgtgtggttgttgaaccgtgtttgtttacccaacatttgggccttctgttatgttttaccttgttgtcgatgacacaatactatatgacaatagcaactctgttattgtagttttggtcactgttcacctgatatgtgccatatttcggtaaagtatcgttagtgggc

SEQ ID NO: 11892 - DNA, 826 bp, Pennisetum glaucum
tgcagatcttcgtgaagaccccgcccattcccgcagccaacgagccgccgccgcagcgttcagcttgttccgaggagcttcggaggagggccgggttggacaagatgcagatcttcgtgaagaccctgacggggaagaccatcaccctcgaggttgagagcagcgacaccatcgacaatgtcaaggctaagatccaggataaggaaggcatccctccggatcagcagcgcctgatctttgccgggaagcagctggaggacggccgcactcttgctgactacaacatccagaaggagtccaccctccatctcgttctccgcctccgcggtggcatcattgaaccctcccttcaggcgctcgcccgcaagtacaaccaggataaaatgatctgccgcaagtgctatgcgcgcctgcaccccagggctgttaactgccgcaagaagaagtgtggccatagcaaccagctgagggccaagaagaagatcaagaactgagttctggagtaccgtttctgtgggtcgtttggatcaaacaagaagatccgcccgtacaagtttttgccgttgcatgatgctgcttttgtttctagtcagaacttcgtggtcttttctgttgacggtattcagcatgctattgctggcataaatggtggcacacaagtctgggtcgtattatatggtagcttaaaactataaattcgtggtcgttaaaaaagaacttgttttaaacttcatttcaatccatgtccagtcaacaggaaataactgagctagaggttgaaacttgaaatatctttagacagaatgctgcatatctacatcagatg

SEQ ID NO: 11893 - DNA, 795 bp, Avena sativa
acaaccctcggccaaaatgcagatcttcgtgaagaccctcaccgggaagaccatcaccctcgaggtcgagagcagcgataccatcgacaatgtcaaggctaagatccaggacaaggagggaatcccgccggaccagcagcgtctgatcttcgcaggcaagcagctggaggatggccgtacccttgcggattacaacatccagaaggagtccaccctccatctcgtcctcaggctccgtggaggcatcatcgagccctcgctgcaggcgctcgcccgcaagtataaccaggagaagatgatctgccgcaagtgctacgcacgtctgcaccccagggctgtcaactgccgcaagaagaagtgtggccacagcaaccagctgaggcccaagaagaagatcaagaactagagtgcctctagtcagtttcatggaccggttgaatccattgccggtgtcagagattttatgctttattatcgttgtctggtcgtcgttgaacctttagttactttgctattatgctcttatcgttgtggtgatacttgacagtattggtatatggtagcaaactactcataattttgtggtatctgctctgtttgctgtgcaatcttgtggatctagttgtttgtgttctgcaatactgtcctgcggttggtcaatcctggcagatgtctggtttctcctataaccctggccatgagcgcctgtgtgtggcttagcactacagtatggttttatcatcaaaatctactcaaatggtttctcgttaaaagaggtcattcctttattttcac

SEQ ID NO: 11894 - DNA, 805 bp, Avena sativa
ggcagccgccaccatccaggatgcagatcttcgtgaagaccctgacggggaagaccatcaccctcgaggtcgagagcagcgacaccatcgacaatgtcaaggccaagatccaggacaaggaaggaatcccgccggaccagcagcggctgatcttcgcgggcaagcagctggaagacggccgcaccctggccgactacaacatccagaaggagtccaccctccacctcgtgctccgcctccgcggaggcatcatcgagccctcgctccaggccctcgctcgcaagtacaaccaggagaagatgatctgccgcaagtgctatgcacgcctgcacccaagggctgtcaactgccgcaagaagaaatgtggccacagcaatcagctgaggcccaagaagaagatcaagaactagggctcaagccatcattgcctctgtgaaatcagtagacataaaacttcagtttttctgttctgtcatgctcctctttgggtggtgtcacgatgtttgaacctgttaactgtatgcgagtacttcggtcttgctgtaatgttaacaacatggtaacaaagtcatcgtttcgtttgttcatggttattttttatgttcgtgtcaagtgatcagtaagtgttctcttagctgtggcttgcatcttatttaatttagtttggagtgtatctggctgtgaaacctcgagtttcaatccgtcaaactgagttagtactgagtttagtttttgtggagttttggttaagagtcagatgtactactaacagaatgcaaggtggaagtaaatttaagttctcgcg

SEQ ID NO: 11895 - DNA, 1054 bp, Avena sativa
acccagtcgtggtcacccgtgccgtacggggctctttctccccacgctcccctccggcctcgctcccaccggagccgcctataaattcccacagcctcccgtctcctctccacacagatccaaatccaatccagtcatctccccgatctcacggaagcaatcgaagcgaaggcgctctcgtcctcctcctcaagatgcagatcttcgtgaagaccctgacggggaagaccatcaccctcgaggtcgagagcagcgacaccatcgacaatgtcaaggccaagatccaggacaaggaaggaatcccgccggaccagcagcggctgatcttcgccggcaagcagctggaggacggccgcaccctggccgactacaacatccagaaggagtccaccctccacctggtcctccgcctccgcggcggcatcatcgagccctcgctccaggccctcgctcgcaagtacaaccaggagaagatgatctgccgcaagtgctatgcacgcctgcacccaagggctgtcaactgccgcaagaagaagtgtggccacagcaatcagctgaggcccaagaagaagatcaagaactagagctcaagccatcatcattgcctttgtgaaattagtagacataaaacttcagtttttctgttctgtcatgctgctctttgggtggtgtcaggatgtttgaacctgttaactgtatgccagtactttgtcttgctgtaatgttaacaacatggtaacaatgtcgtcgtctcgtttgttcatggtatttttctgttcctgttatgtgataattaacgctttgttcggatgtagtaattggccttcagcattagatattcgggactggtgaggcccgaataccacagatcacagcgtccggctggtcttggcattgaggcttgtaatttggtctcaatattgtgggcagctcggaaccagagaaaacgatgagggccaatctctagctggaaggggatggcttgttcgagcgccggcaacaggacgcgtgtgtacatcgtgaccaacggcgtctggcctagtatgccttgaat

SEQ ID NO: 11896 - DNA, 637 bp, Avena sativa
aaaatgcagatcttcgtgaagaccctcaccgggaagaccatcaccctcgaggtcgagagcagcgataccatcgacaatgtcaaggctaagatccaggacaaggagggaatcccgccggaccagcagcgtctgatcttcgcaggcaagcagctggaggatggccgtacccttgcggactacaacatccagaaggagtccaccctccatctcgtcctcaggctccgtggaggcatcatcgagccctccctgcaggcgctcgcccgcaagtacaaccaggagaagatgatctgccgcaagtgctacgcacgtctgcatcccagggccgttaactgccgcaagaagaagtgtggccacagcaaccagctgaggcccaagaagaagatcaagaactagagtgcctctagtcagtttcatggaccggttaaatcgattgccggtgtcagagattttatgctttattatcgtgtctggttgtcgttgaacctttagttactttgctattatggatcttatcgttttggtgataattgacagtgttggtatatggtagcaaactactataattttgtggtatctgctctgtttgctgtaatatcttgtggatctagtgttgttgtttggcttagcactgtcctat

SEQ ID NO: 11897 - DNA, 430 bp, Arachis hypogaea
aagcagtggtatcaacgcagagtacgggggacggcgcagagcatcaccctaaggatgcagatattcgtgaaaaccctaaccggcaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacatccagaaggagtcaacgcttcatcttgtcctcaggcttcgcggtggcatcattgagccttctctcatggcattggcccgcaagtacaatcaagacaagatgatttgccgcaagtgctatgctcgccttcacccaagggcggttaactgccgcaagaagaagtgtggtcacagtaaccagttgaggccaaagaaga

SEQ ID NO: 11898 - DNA, 687 bp, Papaver somniferum
tttgtgaagacactgactgggaagacgatcaccttagaggtggagtcaagcgatactattgataatgtgaaagctaagattcaagacaaagaaggtattccaccagaccaacagagattgatttttgctggtaaacaacttgaagatggtcgtacacttgctgattacaacatccagaaagaatcgactctacatcttgttttgaggctacgtggtgggattattgaaccatctttgatggctttggcaaggaagtacaaccaggacaagatgatttgtcgcaaatgctatgcacgtcttcatcctcgtgctgtcaactgcaggaagaagaagtgtggacacagcaaccagttgaggccaaagaagaagatcaagtagatgctatactcaattttggcgggtgcagagccagagaatttgttttatagcttcttagttggtacctttacttccaaacatttgaactttgtgtttttagtcaagtatatcgttcaacgctttataacccactctgcttaaaagtctggcacgttatattgttttagatctttttatgaatatattgactttcttaattctgtcagaagcattgtcaactgttaaccgcttttctcatagtagcttttgcttcttgctgtttgcctgatgaacttcaagtttatataacctatatttaccaaaaaaaaa

SEQ ID NO: 11899 - DNA, 587 bp, Papaver somniferum
tttgtgaagacattgactgggaagactatcaccttagaggtggagtcaagtgatactattgataatgtgaaggctaagattcaagacaaagaagggattccaccagaccagcagagattgatttttgctggtaaacaacttgaagatggtcgtacgcttgctgattacaacatccagaaagaatcgactctacatcttgttttgaggctacgtggtgggattattgaaccatctttgatggctttggcaaggaagtacaaccaggacaagatgatttgtcgcaaatgctatgcacgtcttcatcctcgtgctgttaactgcaggaagaagaagtgtggacacagcaatcagttgaggccaaagaagaagatcaagtagatgctatcctcaattttggtgggtgcagagccagagaatttgttttatagcttcttagttggtacttttacttccaaacatttgaactttgtgtttttactcaagaaaatcgttcaacgctttacaacccactcaacttaaaaaggctggcacgatatattatttaagatatttttatgaatatatcgactttcttagttctgtttgaa

SEQ ID NO: 11900 - DNA, 572 bp, Secale cereale
gactgtgatatccttcgccaaaatgcagatcttcgtcaagaccctcaccggcaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgtaagaagaagtgtggccacagcaaccagctgaggcccaagaagaagatcaagaactagagtgctactagtcagtttcatggaccggttgaatccatcaccgtgtcagagtttatgcttcattattgtcgtcgaaccttattttactttgctttcagcctatcgatgtggtgatgataattgacaatattggtatatggtagcaaacctataattttgc

SEQ ID NO: 11901 - DNA, 660 bp, Secale cereale
gactccaaaaatgcagatcttcgtcaagaccctcaccgggaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgcaagaagaagtgtggccacagcaaccagctgaggcccaagaagaagatcaagaactagagtgctactagtcagtttcgtggaccggttgaatccatcaccgtgtcagagtttatgctttattattgtcgtcgaaccttattttactttgctttcagcctatcgatgtggtgatgataattgacaatattggtatatggtagcaaacctataattttgccgtatctctgtttgatctgcactcattggcaatctttctgtcaatgcttgtgctttctttctctgcattggggctactggacaggggttggttgtgattt

SEQ ID NO: 11902 - DNA, 604 bp, Secale cereale
agccgagatgcagatcttcgtcaagaccctgacgggcaagaccatcaccctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctgcgtgggggtatcatcgagccctcgctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcggtgtctggataaatcagtagacaataaaattgtttttggttattcgtttgtctcgcccctcatgtcgaggattgttacgtaaccgtttaggttaactctagctgagttacttggcctttagttttaatgtcagaactgaagtgaatcttggcaattagtctctagttaaatgttcattaaagt

SEQ ID NO: 11903 - DNA, 540 bp, Secale cereale
gactatgcagatcttcgtcaagaccctcaccggcaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgcaagaagaagtgtggccacagcaaccagctgaggcccaagaagaagatcaagaactagagtgctactagtcagtttcgtggaccggttgaatccatcaccgtgtcagagtttatgctttattattgtcgtcgaaccttattttactttgctttcaggctatcgatgtggtgatgataattgacaatattggtatatggtagcaa

SEQ ID NO: 11904 - DNA, 694 bp, Sorghum bicolor
gcaatcacaggagccccccagccccgagaacatccaggttcaacaagatgcagatcttcgtgaagaccctgactgggaagaccatcaccctcgaggtggagagcagcgacaccatcgacaatgtcaaggccaagatccaggacaaggaaggaatcccgccggaccagcagcggctgatctttgccgggaagcagctggaggatggccgcaccctcgcggattataacatccaaaaggagtccacgctccacctcgtgctcaggctccgcggtggtatcattgagccctcgctgcaggcgctcgcacgcaagtacaaccaggacaagatgatctgccgcaaatgctatgcacgcctgcaccccagggctgtcaactgccgcaagaagaagtgtggtcacagcaaccagctgagggccaagaagaagatcaagaactgaggtgttgccgctagtcagtttcatggacaattgaagtcctctgttgtagcaatgcatgttgtactgtgttgttgtcttgttgaaccgagtttgtttacccaacatttgggtctgttgtgatgtttcaccttgtcgattgtcgatgacgacagtactatatggcaatagctaattagctactgtgatttggtcacagtgtggtgctgcaattttgtttagtgggcagccggggccgtgtcctacccactccatttgaa

SEQ ID NO: 11905 - DNA, 1250 bp, Sorghum bicolor
ccaatgaaaaccctagccctcctgccgtggtataaaagcaggtggccgccgcctgccgttcctcaccctgcccctttgtgcacgaagccgacgagcagccgccgcgctaaagcttcgtccggggagctccggagaagggccgggtaggtcaagatgcagatcttcgtgaagaccctgacggggaagaccatcaccctcgaggtcgagagcagcgacaccatcgacaatgtcaaggccaagatccaggacaaggaaggcatcccgccggaccagcagcgtctgatcttcgccgggaagcagctggaagacggccgcaccctggccgactacaacatccagaaggagtccaccctccacctcgtcctccgcctccgcggtggcatcattgaaccttctctccaggcgctcgcccgcaagtacaaccaggacaagatgatctgccgcaagtgctatgcgcgcctgcatcccagggctgttaactgccgcaagaagaagtgtggccacagcaaccagctgagggcaaagaagaagatcaagaactgaaacttggcaaatcggttccgtgtgcgacgtttgggtcaacaagatgtctagaagtttcaaagcttttgtcgctgcataatgctgctgcttcttttctaagtcagaactttgtggtgttcctgttcagggtcttcagcatgtatgtgctggcataaatcgtgacagaagtctgggttaatattatcactatatatgttagcgtaactctattgtggctgttccttttagttgctgatggtgtcgtgctgccttatacgtaaatgttagcccaataagcccaacagcgaatttcatgtaatggctggcttgcttgctttagttttgttagtcgcaattaccagcttacactttcttttggaactcaggaatatggtagtgggcggcggcagcagaagacaggcatacacggtagcctaattagttttaaccgtccgatagaaagttaatggatctccttggtagcggttgaaattcacgcattaacataggcctcgtttagtttctaaaatttttcagtattctctgggctgaaataaaaaaaattaattgcatagattgtctgtaatttataagataatttttttgagtctagttagtttgtaattgagcaataattattgaatatacacaaaagtgctacagaagcaaaagcggacttatccgttttagtatatataaggcgtaaatactttttatttatatatcta

SEQ ID NO: 11906 - DNA, 680 bp, Picea glauca
attcgtgaaaaccctcacagggaaaaccataacccttgaggtcgagagcagcgatacgatcgataatgtgaaggccaagatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaaagaagtgcggacatagtaatcagctgaggcctaagaagaagatcaaataaagcgtcttgagtttgaagcagatagtttatctgcacaaatttttgctgatttattttcattgcctttaagaagccaattggattaaacgtttattttcttaaaaaagactgtatgttacaatcatgtagactgcagaactggctctctagccagaatttatctttgtgcttccagttgggccagatttgaatagctgtagatgttatagttttgagtttgaagttgtgtttgttttttaaagagattaaatatttgtacgttgctcttttcattcaattatgtgatttactgcattttcta

SEQ ID NO: 11907 - DNA, 728 bp, Saccharum officinarum
gcacgaagccgacgagcagccgccgcgctaaagcttggtccggggagcttcggaggagggcggggtaggtcaagatgcagatcttcgtgaagaccctgacggggaagaccatcaccctcgaggtcgagagcagcgacaccatcgacaatgtcaaggccaagatccaggacaaggaaggcatcccgccggaccagcagcgtctaatcttcgccgggaagcagctcgaagacggccgcaccctggccgactacaacatccagaaggagtccaccctccacctcgtcctccgcctccgcggtggcatcattgaaccttctctccaggcgctcgcccgcaagtacaaccaggacaagatgatctgccgcaagtgctatgcgcgcctgcaccccagggctgttaactgccgcaagaagaagtgtggccacagcaaccagctgagggcaaagaagaagatcaagaactgaaacttggcaaatcggttccgtgtgtcgtttgggtcaacaagatggctagaagtttcaaagcttttgttgctgcataatgctgctgctgcttttctaagtcagaactttgtggtgttcctgttcagggtcttcagcatgtatgtgctggcataaatcgtgacagaagtctgggttattattactatatggtagcataactctattgtggttttccctttctgttgctgttgtgttgtgctgccgccagccgtagacggaaacgtt

SEQ ID NO: 11908 - DNA, 640 bp, Triticum aestivum
aattcggcacgaggcgagatgcagatcttcgtcaagaccctgacgggcaagaccatcacgctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctccgcggcggcatcatcgagccctcgctccaggccctcgcccgcaagtacaaccaggagaagatgatctgccgcaagtgctacgccaggctgcatccaagggccgtcaactgccgcaagaagaagtgtggccacagcaaccagctgaggcccaagaagaagatcaagaactagagctcgttcgtaaatttcgttgtctggataaatcatcagtagacataaaaatggtttccggttatcgttttgctgcccctcatgtcaggatgttgaacattggttaaacttagctgtgagttcttgcctcgttttaatgtcagaactgaagtgaaccttggcaattcgtgtgcctgttcatgttcatggttacttgtgtatgcttgtgtgaagcgaacgctaccgtcaccca

SEQ ID NO: 11909 - DNA, 724 bp, Triticum aestivum
cttccccaataaatccagccggacccgagccgaagagacacccacccgtggagaaaagaaaggattttcgtttcgttttcgtctgcttccgcctctgctccgtcgtccgcacgcgaccagcttgactccctcgcgcacgagcaacaggagcgcgaggagatgcagatcttcgtcaagaccctcacggggaagaccatcaccctcgaggttgagagcagcgataccatcgacaatgtcaaggccaagatccaggacaaggaggggatcccgccggaccagcagcggctgatcttcgccggcaagcagttggaggacggccgcacccttgccgactacaacatccagaaggagtcgaccctccatctcgtcctcaggctccgcggaggcatcatcgagccatccctgcaggctcttgcccgcaagtacaaccaggagaagatgatctgccgcaaatgctacgcgcgcctgcacccaagggctgtcaactgccgcaagaagaagtgtggccacagcaaccagctgaggcccaagaagaagatcaagaactagagtgctactagtcagtttcatggaccggttgaatccattgctgtgttagcgtttatgctattgtcgtctcgttgtcgttgaaccttattttactttgctttcagcctccaatcgttgtggtgatgataattgacagtattggtatatggtagcaaacctataattttgccgtaaa

SEQ ID NO: 11910 - DNA, 857 bp, Triticum aestivum
ggagaaaagaaaggattttcgtttcgttttcgtccgcttccgcctctgctccgtcgtcctcacgcgacctgcagcttgactccctcccgcaccgcacgcacgagcagcaggggcgcgagaagatgcagatcttcgtcaagaccctcacggggaagaccatcaccctcgaggtcgagagcagcgacaccatcgacaacgtcaaggccaaaatccaggacaaggagggaatccctccggaccagcagcgtctgatcttcgctggcaagcagttggaggatggccgcacgcttgctgactacaacatccagaaggagtccaccctccatctcgtcctcaggctccgtggaggcatcatcgagccgtccctgcaggctcttgcccgcaagtacaaccaggagaagatgatctgccgcaaatgctacgcgcgcctgcatccaagggctgtcaactgccgcaagaagaagtgtggccacagcaaccagctgaggcccaagaagaagatcaagaactagagtgctgctagtcagtttcatggaccggttgaatccatcactgtgtcagagtttatgctattatcgtctcggttgtcgttgaaccttattttactttgctttcagcctcctatcgttgtggtgatgataagtgacagtattggtatatggtagcaaacctataattttgccgtatctcccctgtttgatctgctttctggttaattcttgcctcgttggtaatctgcccacgaaagctagtggtttcctctctatccggcctaccagacaagggttggttgcgtttagatttcccatgttgtgttgctaaaaaatgctaatcgagctctttgagttttggttcca

SEQ ID NO: 11911 - DNA, 458 bp, Abies balsamea
cttcgtaaagaccctgacgggcaagaccataaccttggaagtcgaaagcagcgatactattgacaatgtcaaggctaaaatccaggacaaggaagggatcccgcccgaccagcagcgtctgatctttgcgggcaagcagttggaagatggccgcactctggcagattacaatatccagaaagagtctaccttgcaccttgtgctcaggctccgtgggggtattatagagccttctttgatggcactggccaggaagtacaaccaagacaagatgatttgcagaaaatgctatgctcgtttgcactctagagcagtcaactgcaggaaaaagaagtgtgggcatagtaaccagctgcggccaaaaaagaaaatcaagtaaattatatgctgcaatgagattttataattccaaatacattcatgttctattgttccccatcattttaggctgttatgcc

SEQ ID NO: 11912 - DNA, 646 bp, Vaccinium corymbosum
tcgtgaaaaccctaacggggaagacgatcactctcgaggtagagagtagcgataccattgacaatgtcaaggccaaaattcaagacaaggaaggaattcctccggaccagcagaggctgatcttcgccggaaaacagcttgaagatggccgaaccctcgccgactacaacatccagaaagaatcaactcttcatcttgtgctgaggcttagaggagggattatagagccttcgttgatggctttggctcggaagtacaatcaagacaagatgatctgcaggaaatgttatgctcgccttcatcctagggctgtgaactgccgtaagaagaagtgtggccacagcaatcagctgaggcccaagaagaagatcaagtgagatactgagatggctacgttcttttgtgacttgatttggaactggagcatcaaattctagacaaactcagcgaagtactgtactttatatttgatacattagacgatatcccttaaattgtgtttcaatttcgaccgaatgcattcctcattaccaagatactattagttgctacaggattggatcttatggtcactatattttcttcttcaattttgatggatttgatcgcatttgttttgtggaatcatattattgggtattttgtt

SEQ ID NO: 11913 - DNA, 594 bp, Flaveria ramosissima
gaaaaccctaaccgggaagaccataaccctcgaggttgagagcagcgacaccatcgacaacgtcaaggccaagattcaagataaggaaggtatcccaccggatcagcagcggttgatcttcgccggaaagcagcttgaagatggccggactcttgctgattacaacatccagaaagaatcgactcttcatttggttttgaggttgaggggtggaatcatcgaaccctctttgatggcattggctaggaaatacaatcaagataagaccatttgccgcaagtgttatgctcgtttgcacccaagggctgtaaactgcaggaagaagaagtgtggccatagcaatcaactaaggccaaagaagaagatcaagtgaagacttagaaaagcaacatatcggattaattttgggtctttcattctattttagtctatcttatgttgttagctacctatggatgagttgtttgtttgatttaagaagcaatactggttttaaatttctgtgtcatcttatgtgaagctttatgttttgattttaactgttttaatgttagtgagctagtattggagtccggatgtcgtttaacatttaaa

SEQ ID NO: 11914 - DNA, 629 bp, Quercus alba
cttcgtgaaaaccctaaccgggaagaccatcactctcgaggtcgagtccagcgacaccatcgacaatgtcaaggccaagatccaagacaaggaaggtatcccaccggaccagcagaggttgatcttcgccgggaagcagctcgaggatggccgtactctcgccgattacaacatccagaaagagtcaactcttcatcttgttctgaggcttcgtggtggtattatcgagccatctttgatgcaattggctaggaaatacaaccaagataagatgatctgccgcaaatgttatgcacgcctgcacccacgtgctgtcaactgcaggaagaagaagtgtggacacagcaaccagctgaggccaaagaagaagatcaagtagagtgctgatcttgaggaagaagtgctatccattgttgtgggtcatttaatgtttctgaaccatggtagcattaagagtttgctagtagaccagaaatttgacatgtagctttgaactcaataccttcgtagatgttgaaacgttactttgttttaatatgttttgcaccttgtttggctattggatatgcatttatgttgagctcttcatttttgatatgttgaaatcaaagctggtactttgtctggtt

SEQ ID NO: 11915 - DNA, 664 bp, Quercus alba
cagagcgagagagcgcgagagagcaaaaaatgcagatcttcgtgaaaaccctaaccgggaagaccatcactctcgaggtcgagtccagcgacaccatcgacaatgtcaaggccaagatccaagacaaggaaggtatcccaccggaccagcagaggttgatcttcgccgggaagcagctcgaggatggccgtactctcgccgattacaacatccagaaagagtcaactcttcatcttgttctgaggcttcgtggtggtattatcgagccatctttgatgcaattggctgggaaattcaaccaagataagatgttttgccgcaaatgttatgctcggttgcacccacgtgctgtcaactgcaggaagaagaagtgtggacacagcaaccagctgaggccaaagaagaagatcaagtagattgctgatcttgaggaagaagtgctatccgttgttgtgggtcatttaatgtttctgaaccatggtagcattaaagagtttgctagtagaccagaaatcagacatgtagctttgaactcaatactttcgtagattttgaaactttactttgttttaatatgttttgtcaccttgtttggatattggatatgcatttatgttgagctcttcatttttgatatgttgaaatcaaagctggtactttgtct

SEQ ID NO: 11916 - DNA, 457 bp, Ananas comosus
ctcgaggacggccgcaccctcgccgactacaacatccagaaagaatccactctccacctcgtccttcgcctgaggggagggatgcagatttttgtgaaaaccctcaccggcaagaccatcacccttgaggtggagagctccgacaccatcgacaacgtcaaggccaagatccaggacaaggaaggtattcccccggaccagcagagactgatcttcgccggaaagcagcttgaagatgggcgcactcttgccgactacaacatccagaaagagtcgactctgcatctggttctgaggcttaggggtgggatcattgagccatctttgatggctttggccaggaagtacaaccaggacaagatgatatgccgaaagtgttatgcccgtctgcatccccgcgctgttaactgcaggaagaaaaagtgcggacacagcaaccagctgaggcccaggaaga

SEQ ID NO: 11917 - DNA, 659 bp, Secale cereale
tgcagatcttcgtcaagaccctcaccggcaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgtaagaagaagtgtggccacagcaaccagctgaggcccaagaagaagatcaagaactagagtgctactagtcagtttcatggaccggttgaatccatcaccgtgtcagagtttatgcttcattattgtcgtcgaaccttattttactttgctttcagcctatcgatgtggtgatgataattgacaatattggtatatctgtttgatctgcactcattggcaatctttctgtcaatgcttgtgcttcctttctcgtgcattgcggctactggacaggggttggttgcgatttctcagtttggtagaattggtaaaatatgctaaacgaat

SEQ ID NO: 11918 - DNA, 467 bp, Secale cereale
cagatcttcgtcaagaccctcaccggcaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgtaagaagaagtgtggccacagcaaccagctgaggcccaagaagaagatcaagaactagagtgctactagtcagtttcatggaccggttgaatccatcaccgtgtcagagtttatccttcattattgtcgtcgtaacct

SEQ ID NO: 11919 - DNA, 559 bp, Secale cereale
gactgcagatcttcgtcaagaccctgacgggcaagaccatcacgctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgccttcgtgggggtatcatcgagccctccctccaggccctcgcccgcaagtacaaccaggagaagatgatctgccgcaagtgctacgccaggctgcatccaagggctgtcaactgccgcaagaagaaatgtggccacagcaaccagctgaggcccaagaagaagatcaagaactagagctcggcgcatcatcatcgccgctttccttgtctggataaatcagtagacataaaatgttttcggttatcgttttgctgcccctcatgtcaggatgttgaaccttggttaactctagctgagtacttggccttgttttaatgtcagaactgaagtgaatcttggca

SEQ ID NO: 11920 - DNA, 700 bp, Silene vulgaris
gcaaaagagaaagaggggggaggaaggtcaattgaagatgcagatctttgtgaaaaccctaactgggaaaaccatcactcttgaagttgaatccagtgataccatcgataatgttaagactaagattcaagataaggaaggcattcccccagaccagcagaggctgatctttgccggcaaacaacttgaagatggccgtacccttgctgactacaacatccagaaggagtcaactcttcatcttgttctgaggctacgtggtggaattattgagccttctttgatggccctggctaggaagttcaaccaggaaaagatgatttgccgcaaatgctatgctcgtctccacccacgtgctgtaaactgtagaaagaagaaatgtggccacaccaaccagttgaggcctaagaagaagatcaagtagagcgatcagttttttgcagtcaatatcctggcaccgcattcatgctgtcggtgtcaggatcaaagctacttcactatggctcttatggacgttgtattgtagtagctacattagatcttttagtaatggattctcaccaataaggtgtatgacttggtttgatttattttgagtttcttgaacttttgtttttgcgtaatactaatgtggtatccttaatttggttatccttctgtgtttgccgtctgttatcaaaattttaagtttgagaaccat

SEQ ID NO: 11921 - DNA, 978 bp, Silene vulgaris
tctctaataagtggtgaaatgttacattatatattctacaattggtcttgcttgtgacggaggtattcgtcacaagcttgcgacggggcgaatcgtactgttttcgggggaaatggtatggagtttgaccgggtaggggaagttgactaggcataatttttggaaaatgcgcgtggttcgaacgaatcctcataaccacaaataaactccctccctctctcttcattttctttacttcgtacaatccgtctctctctcttcttttttcttatttccgagagaaacacaagaaaaacaaaaatgcagatatttgtgaaaaccctaactgggaaaacaatcactcttgaagttgaatccagtgatactattgacaatgtcaagactaagattcaagacaaggaaggaattcccccagaccagcagaggctcatctttgctggaaagcagcttgaagatggtcgcacccttgctgattacaacattcaaaaggagtcgactctacatcttgttttgaggctgcgtggtgggatcattgagccctctttaatggccttggctaggaagttcaaccaagagaagatgatctgccgcaaatgctacgcgcgtctccacccccgtgctgtcaactgtagaaagaagaaatgtggccacactaaccagttgaggccaaagaagaagattaagtagagcctttgcttttttggctgtggatggtccagcagtggctttgaacaagccggtgtcaggatcaaagcttcagcagtgcggcttttataagatgtattgtagcttccttttctcatcagctaaaacggctttgtaatagacgggccttgttttgccttcaactttgtttcatttgtgttttgatgttttgctattgaatgatatactaatgtgacatcatttaattaattatgtccttgctcattgtcatcaaaactagaagctgtgtttgttttctgtcgccatggtttc

SEQ ID NO: 11922 - DNA, 418 bp, Picea glauca
ggggagtccacagttgtcgtgcggaaattgttggcagcgagcaagatgcagatcttcgtaaagaccctgacgggcaagaccatcaccttagaagttgaaagcagcgataccatcgacaatgtcaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtgggggcattatagaaccttctttgatggcactggccaggaagtacaaccaagacaagatgatttgcagaaaatgctatgcccgtttgcaccctagagcagtcaactgcaggaaaaagaagtgtgggcatagtaaccagctgcgaccaaaga

SEQ ID NO: 11923 - DNA, 591 bp, Antirrhinum majus
gcggcaaaaaaaagcagatcttcgtcaaaaccctaaccggcaaaaccataaccctcgaggttgaatcgagcgacacaatcgacaatgtcaaggccaagattcaagacaaggaaggaatccctcccgatcagcagcggttgattttcgccggaaaacagctcgaagatggacgtactttagccgattacaacattcagaaagagtcgactcttcatttggttctgaggcttaggggtggaatcattgagccttctctcatggctttggcgaggaagtacaaccaggagaagatgatttgccgcaagtgttatgctcgcctgcaccctcgtgccgtcaactgcaggaagaagaagtgtggacacagcaaccagttgaggccaaagaagaagatcaagtagacttgctgtccagatcaagtattatgttatcttgcttttgctatttcaaatggaacacattatgcagttttttgcctataaacattctaagattttgatgtagcttgaccttttaatgatttgctatcagatatctagtatttatttggatcacattttctgttatcctttatgattgccaattaataaaaaa

SEQ ID NO: 11924 - DNA, 617 bp, Cenchrus ciliaris
ttcgtgaagacgctgacgggtaagaccatcaccctcgaggtcgagagcagcgacaccatcgacaatgttaaggccaagatccaggataaggaaggaatcccgccggaccagcagcgtctgatcttcgccgggaagcagctggaggatggccgcactctggcggattacaacatccaaaaggagtctaccctccacctcgtgctcaggctccgtggtggaatcattgagccatcgctgcaggcgctcgctcgcaagtacaaccaggataagatgatctgccgcaaatgctacgcacgcctgcaccccagggctgtcaactgccgcaagaagaagtgcggtcacagcaaccagctgaggcccaagaagaagatcaagaactgaggtgatgtcgctgctagtcagtttcatgcaccatttaaatcgtctgttgtagtgggatttatgttatgttgcgttgctgttgctgtctcgatgttgaacttctgttgcgcaaaacttttccgatgtcgtgatgttttattttaccttgttgtcaatggtgacagtactatatggcaatatagctaccatgctcctgcactatattgtgtgtgctcatccagtatttgggtctaaag

SEQ ID NO: 11925 - DNA, 558 bp, Cenchrus ciliaris
ttcgtgaagacgctgacggggaagaccatcaccctcgaggtcgagagcagcgataccatcgacaatgttaaggccaagatccaggataaggaaggaatcccgccggaccagcagcgcctgatcttcgccgggaagcagctggaggatggccgcactctggcggactacaacatccaaaaggagtccacgctccacctcgtgctcaggctccgtggtggaatcattgagccctcgctgcaggcgctcgctcgcaagtataaccaggacaagatgatctgccgcaaatgctacgcacgcctgcaccccagggcagtcaactgccgcaagaagaagtgtggtcacagcaaccagctgaggcccaagaagaagatcaagaactgaggtgatgttgctgctaatcagtttcatggaccatttaaatcgtctgttgtagtggaattttatgttatgttgcgttgttgtctcgatgttgaacttgtgttgcaccaaacttttccgatttcgtgatgttttaccttgttgaaagtcgatggtaacagtactgtatggcaatatagc

SEQ ID NO: 11926 - DNA, 600 bp, Euphorbia peplus
gaaaaccctaactggcaagaccatcactctcgaggtcgagagcagtgacaccatcgacaatgtcaaggccaaaatccaagacaaggaaggtattccaccggaccagcagcgattgatcttcgccggaaaacagcttgaagatggccgcactctggctgattacaatatccagaaggaatcgactcttcatcttgtgctcaggcttaggggaggaattattgagccttctctcatggctttagctcgcaagtataaccaggacaagatgatttgccgcaaatgttatgctcgtctccacccaagggctgttaactgccgcaagaagaaatgtggccacagcaatcagttgaggcctaagaagaagatcaagtagactccgatgaagagaaggcggggcgtatttcgaggtttgagtgttagttttttggaagtcgattacatttttaactgtaatgaacatgtgagttggatttagcagtcaacaatatgttctggatttatgaaatactgtcattttatgttttggaggttggtttgatataatctgcgttctgtttttccattttgcaactttaaattgatgcataaaatataatgcta

SEQ ID NO: 11927 - DNA, 610 bp, Euphorbia peplus
gaaaaccctaactggcaagaccatcactctcgaggttgagagcagtgacaccatcgacaatgtcaaggccaaaatccaagacaaggaaggtattccaccggaccagcagcgattgatcttcgccggaaaacagcttgaagatggccgcactctggctgattacaatatccagaaggaatcgactcttcatcttgtgctcaggcttaggggaggaattattgagccttctctcatggctttagctcgcaagtataaccaggacaagatgatttgccgcaaatgttatgctcgcctccacccaagggctgttaactgccgcaagaagaaatgtggccacagcaatcagttgaggcctaagaagaagatcaagtagactctgatgaagagaaggtggggcgtatttcgacgtttgaatgttagttttttggaagttaattacatttttaattgtaatgaacatatgagagttggatttagcaggcaacaatatgttctagatttatgaaatactgtcattttatgcttctatgttttggaggttggtttgatataatctgcattctgtttttacattttgcaactgcaaattgatgcataaaatataatgcta

SEQ ID NO: 11928 - DNA, 659 bp, Zingiber officinale
gtgaagaccctcacggggaagacgataaccctagaagtcgagagcagcgacactatcgacaatgttaaggcgaagattcaagacaaggaaggcattccgcctgaccagcagaggctgatctttgccggtaagcagctcgaggatggacgaaccctcgcggactacaacatccaaaaagagtctactctgcatctggtgctgaggctgaggggtggaatcatcgagccctctcttatggctcttgctaggaaatacaaccaagagaagatgatctgcagaaagtgctatgcacgtttgcatccgagggctgtaaactgccggaagaaaaaatgtggccacagcaatcagctgaggcctaagaagaagatcaagtaaattatgcgattcaaatttcttttcccaagctgaattgccgtatcaaaaaattctacaccttcgcgttgattaaacttactgcgcttctgctgttgtaaccttgtcaaacggttaactaagttggtgctcgtttggatgactatttgttggcattatgttttgaaacaaatttgactaagttaaaatggtggactaggagttttattttggaggattaatgagacaatctagcatttttagattcacataaatattacccacagcatatatttcgtgcctcgtgc

SEQ ID NO: 11929 - DNA, 683 bp, Plantago ovata
aaaaccctaaccgggaaaaccatcacccttgaggtcgaatcgagcgacaccatcgacaatgtcaaggctaagattcaggacaaggaaggaattcctccggatcagcagaggttgatcttcgccggtaagcagctcgaagatggtaggaccttagctgattacaacatccagaaagagtccacactccatctggtgttgaggcttaggggaggtatcatcgagccttctctgatggcattggccaggaaatacaatcaggataagatgatttgccgcaaatgttatgcccgcttgcacccacgtgctgtcaactgcaggaaaaagaaatgtggccacagcaaccagttgaggccaaagaagaagatcaagtagactgttcttcttgtgtgttgttttatttgttgtcaatggagagatctgttgtattcggcattacctacaacttggtgtttcttgaatgtaattctgtaccatggattttatctaagaatttagcttggatttggattgcatgtttaatgtaattcatagtggttcagtagattttatggatgagtcctgcttgtgtgtgtagagtaggtatgtcaatttcagattatggattggatcctattcaactctaaattgattggaatcataaatgtctcataaattgagttattatatggatttggaactaagtt

SEQ ID NO: 11930 - DNA, 608 bp, Sarracenia psittacina
ctaaacagcacgttgtaagctctgcgaaaatgcagattttcgtgaaacctacggagacgatcacactcgaggtcgaatcgagtgacactatagacaatgtcaaagctaagattcaggacaaggaaggtattccacctgatcagcagcgactgatcttcgccgggaaacagcttgaagatggtcgtactcttgccgactacaacatccagaaagagtcgacactgcatctggttctgaggcttcgcggtggaatcattgagccgtcattgatggctttggcgcgaaagtacaaccaggataagatgatttgccgcaagtgttatgctcgcctccaccctcgtgctgttaactgcaggaagaaaaagtgtggacacagcaaccagttgaggccaaagaagaagatcaagtagatatgatttcaagtttctttcagctatttggagtttgatttgtcttatagcagcactgcctgcttatggagatttatgatttgaaactgttgcttacttgttgtggatataatggacatctatttttggtttgttaaaatgtttttatttgcagtgttatcctgatttgctaatttgtttacagaattagcgcgattg

SEQ ID NO: 11931 - DNA, 438 bp, Papaver somniferum
tgcagatcttcgtgaaaaccctaactgggaaaacaatcaccctagaggttgaatcaagtgacacaatcgataatgtcaaggctaagattcaggacaaggaagggattcctccggatcaacaaagattgatctttgcgggtaaacaactcgaagatggccgtactcttgctgactataatattcagaaagaatcaactcttcatttggttctgagactccgtggtggaattattgaaccatctttgatggccctagcaaggaagtacaaccaggacaagatgatctgcaggaagtgctatgcacgtcttcaccctcgtgctgtcaattgccgcaaaaagaaatgtggacatagcaaccagttgaggccaaagaagaagatacaaatagatcttttgtgagactctagtactgttacttttactttcgttggaggaattc

SEQ ID NO: 11932 - DNA, 482 bp, Secale cereale
ttcgtcaagaccctgacgggcaagaccatcaccctcgaggtcgagagcagcgacaccatcgacaatgtcaaggccaagatccaggacaaggaggggatcccgccggaccagcagcggctcatcttcgccgggaagcagctggaggacgggcgcacgctggccgactacaacatccagaaggagtcgacgctgcacctcgtgctccgcctccgcggcggcatcatcgagccctccctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcgttgtctggataaatcagtagacataaaatgttttggttatcgttttgcttgcccctcatgtcaggatgttgtaaccg

SEQ ID NO: 11933 - DNA, 550 bp, Hevea brasiliensis
ttgtgaaaccttaaccgggaaaaccattactctcgaggttgagagcagcgataccatcgacaatgtcaaggccaagatccaggacaaggaaggaattccacctgaccaacagagattgatctttgctgggaagcagcttgaagatggccgaaccctggctgattacaatatccagaaagaatcaaccctccatcttgtgctgaggcttaggggaggaattatagagccttctctcatggctttggctcgcaagtacaatcaagacaagatgatctgccgcaagtgttatgctcgtctgcatccaagggctgtaaactgccgaaagaagaaatgcggtcatagcaatcagttgaggcctaagaagaagatcaagtaaactctgatgcagaatagtgatttttgggcatttaaagatttgagcattagatttgttgtttcaccatgcgggtggttttaaatatgttggttgtggatttagcaaaattctatgttaaacttttattcaatgctgttaaattgagctgatttctatttttgaaattgtgatctg

SEQ ID NO: 11934 - DNA, 455 bp, Flaveria ramosissima
agcctcaggtcatccaatcagatcacaaagatgcagatcttcgtgaaaaccctaacggggaagaccataaccctcgaggttgagagcagtgacaccattgacaacgtcaaagccaagattcaagacaaggaaggtatcccaccggatcagcagcgattgatcttcgccggaaagcagcttgaagatggccgtactcttgctgattacaacatccagaaagaatcaactcttcatttggttttgaggttgaggggaggaatcatcgaaccctctttgatggcactggctaggaagtacaatcaagataagaccatttgccgaaagtgttatgctcgtttgcacccaagggctgtaaactgcaggaagaagaagtgtggtcacagcaatcaactaaggaccaaagaagaagatcaagtgaagacttagaagagcaacatatcttattaattttgggt

SEQ ID NO: 11935 - DNA, 667 bp, Chlamydomonas reinhardtii
gcacggaagcgggcagccatgcaaatcttcgtgaagaccctcacgggtaagaccatcaccctcgaggtggagtcttcggacaccatcgagaatgtgaaggccaagattcaggacaaggagggcatccctccggaccagcagcgtctgatcttcgccggcaagcagctggaggacggccgcaccctggcggactacaacatccagaaggagtccaccctccacctggtgctgcgtctgcgcggtggtatcattgagccctcgctgcaggccctggcccgcaagtacaaccaggagaagatgatctgccgcaagtgctacgcccgcctgcacccgcgcgccaagaactgccgcaagaagtcgtgcggccacaccaaccagctgcgccccaagaagaagctcaagtaaaccttgggcccacctcttggcgccctggcacacgcgggcgagccgccccgcgcccgcgtggcctgcggcagcggcggcagcagcagcggctgcggcgggaggcgacgacggcggacggtcctctcgcgggccgctgcgcttttttgatgctccgctgtggatggcgcggtgaccccccggcgagctctccactcgccggggactagcacacgggtctctgttcttccgagcgcgcggggtgaccctccgctgtgggacagga

SEQ ID NO: 11936 - DNA, 548 bp, Zingiber officinale
aagacgctcccggggaagaccatcacccttgaggttgagagcagcgacacaatcgacaacgtcaaggccaagatccaagacaaggaaggtattccgcctgaccagcagaggctcatctttgccgggaagcagctcgaggatggacgaactctagcggattataacattcaaaaagagtcgacccttcatctggtgctgaggcttaggggtggaatcattgagccttctcttatggctcttgcccggaagtacaaccaggaaaagatgatctgcagaaagtgttatgctcgtttgcacccaagggctgttaattgccgtaaaaagaagtgtggccatagcaatcagctgaggcctaagaagaagatcaagtaagcttgaggctcaatgatgatttctcgatcttctggtgggactatttacctcttattttttccatcaacacttgctaatttttagtttctgttgaattgtagttaaatatgaagttctcatattgactttcaatttccatccattaatgcatcaatgcttgtttgcattttatcatc

SEQ ID NO: 11937 - DNA, 482 bp, Pennisetum glaucum
ggacaagatgcagatcttcgtgaagaccccgcccattcccgcagccaacgagccgccgccgcagcgttcagcttgttccgaggagcttcggaggagggccgggttggacaagatgcagatcttcgtgaagaccctgacggggaagaccatcaccctcgaggttgagagcagcgacaccatcgacaatgtcaaggctaagatccaggataaggaaggcatccctccggatcagcagcgcctgatctttgccgggaagcagctggaggacggccgcactcttgctgactacaacatccagaaggagtccaccctccatctcgttctccgcctccgcggtggcatcattgaaccctcccttcaggcgctcgcccgcaagtacaaccaggataaaatgatctgccgcaagtgctatgcgcgcctgcaccccagggctgttaactgccgcaagaagaagtgtggccatagcaaccagctgagggcca

SEQ ID NO: 11938 - DNA, 557 bp, Secale cereale
gtcaagaccctgacgggcaagaccatcaccctcgaggtcgagagcagcgacaccatcgacaatgtcaaggccaagatccaggacaaggaggggatcccgccggaccagcagcggctgatcttcgccgggaagcagctggaggacggccgcacgctggccgactacaacatccagaaggagtcgacgctgcacctcgtgctccgcctccgcggcggcatcatcgagccctccctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcgttgtctggataaatcagtagacataaaatgttttcggttatcgttttgctgcccctcatgtcaggatgttgaaccttggttaactctagctgagtacttggccttgttttaatgtcagaactgaagtgaatcttggcaatttttagtgttcgggg

SEQ ID NO: 11939 - DNA, 613 bp, Secale cereale
cgtcaagaccctgacgggcaagaccatcaccctcgaggtcgagagcagcgacaccatcgacaatgtcaaggccaagatccaggacaaggaggggatcccgccggaccagcagcggctgatcttcgccgggaagcagctggaggacggccgcacgctggccgactacaacatccagaaggagtcgacgctgcacctcgtgctccgcctccgcggcggcatcatcgagccctccctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcggtgtctggataaatcagtagacataaaatgttttggttatcgttttgctgcccctcatgtcaggatgttgaaccttggttaactctagctgagtacttggccttgttttaatgtcagaactgaagtgaatcttggcaattagtctctgttaaatgttcattgttacttgtatgcttttgtctagtgaacgctatcacctaccaaaaagtc

SEQ ID NO: 11940 - DNA, 1302 bp, Volvox carteri
gctgcagcctatttaactatgtttcaattgtctttaataaaagcggcggcggttgtgcactgcaggcacggatacagcgggcagccatgcaaatcttcgtgaagaccctcacgggtaagactatcaccctcgaggtggagtcttcggacaccatcgagaatgtgaaggccaagattcaggacaaggagggtattccccctgatcagcagcgtctgattttcgctggcaagcagctggaggacggccgcacactggccgattacaacatccagaaggagtccaccctccatctggtgctccgtctgcgtggcggtatcattgagccgtcgctgcaggctctggcccgcaagtacaaccaggagaagatgatctgccgcaagtgctacgctcgcttgcacccgcgtgccaagaactgccgcaagaagtcgtgcggtcacaccaaccagctgcgccctaagaagaagttgaagtaaacctcggacatccagcggtcgaggtgtctgggccgcagttcgattcggtgtgaggagcggcggacggagttgccttgagggtggtgcatggattcctgcgttgtgccgttgctgttcatggggatacgcatcggcatgcgccgcatctcgatcccttcacttcctgcgtgggtggtcctggccctacgggcaagacgggctccgtgctacggagagagagcgcattcactgatggtcctgcgcttgtaaccaggatgaggttttcatcacaccgcttagcaggcaaccctgattgaaactaagtctgcagcaggccgttatgccgtttgtttcctcaatttaggattgaggaaaaaccgtacgatataatcgccagcgacgattcgatttgtaattagtgcttttgaagcaacgcagacgaagtcataattaagggtaaaagttgctgtgctacgaggaagaattggcaatgaatactgattcgaaccgtactactgaatatgtcgtagcgcgggagccacaggcagacatgcttagcctgaaagccaccccctgtcaacccttcgtgatgtgctcgcgggtttctgtcacaaacaaatcaggtaacttcaaccttaaaaaactgccttgtaaacgagtcgcaaccgtaaaagcatgggcgggctcaagccatacattcacgcctatgtattaaagccacattgaagatgattgcatgcaggcgcaagaaccgctacaagcagttctggccaggcaaaatgcactgtaactacgtgtcacggaacaacgagcctctatcccactctggcatgaatttacgaacttccga

SEQ ID NO: 11941 - DNA, 815 bp, Triticum aestivum
tcgtcaagaccctgacgggcaagaccatcacgctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctccgcgggggcatcatcgagccctcgctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagagctcgtaaaaccgttattgccgctttcattgtctggataaatctgtagacataaaatgtttctgggttatcattttgctgctcatgtcaggatgttgaaccttgtttaactctagatgagtacttggcctcgttttaatatcataactgaagtgaaccgtgcaattagtgtgtctgttgcttatgcttgtggtgttttttgattctggtgctagttgctctcctggcatatagcaccatgttgtggacagatttgtccacctcgagttcagaaattcagaaccagctatatgagcaacaaatccagtagtggcttccaaaccaaaagtgcatagaggtccggattttggaaataaaacatattgacattcaagcttttgttaaattttagtactgaatttcagaacttgggaagcctttttggattcagacaag

SEQ ID NO: 11942 - DNA, 524 bp, Abies balsamea
acaacgaaaatgcagatcttcgtgaagaccctgacgggcaagactatcaccctcgaggtggagtcttctgacaccatcgacaatgtcaagtccaagatccaggacaaggagggcattcccccggaccagcagcgcttgatcttcgccggcaagcagcttgaggacggccgcactctctccgactacaacatccagaaggagtcgactctccacttggtcctccgtctccgtggtggtatcatcgagccctcactcaaggctcttgcctccaagtacaactgcgacaagatgatctgccgcaagtgctacgctcgcctgccgccgagggctgtcaactgccgcaagaagaagtgcggtcacaccaaccagctccgccccaagaagaagctcaagtaaatcattcgcacaacggcgtctggcgaggtcggggtcggtggaacgaatgcgacgaatgcatgcgacggacggtcataacgaaaacactgtcgtctttgcacagtggagtcttatctgtgcttatcact

SEQ ID NO: 11943 - DNA, 435 bp, Ambrosia trifida
gggaagaccataacccttgaggttgagagcagcgacaccattgacaatgtcaaggccaagattcaggacaaggaaggtattccacctgaccagcagcggttgatctttgctggaaagcagcttgaagatggtcgcactcttgctgattacaacatccagaaagagtcaactcttcatttagttttaaggttaagaggaggaatcattgaaccttctttgatggcattggctaggaagtacaatcaagacaaaaccatttgccgcaagtgttatgctcgtttgcacccaagggctgttaactgcaggaagaagaagtgtggacatagcaaccaactaaggccaaagaagaagattaagtgaggacttggaatttccgcatgcatctgtttttgtcatattttgttgttaagtacctctggatgaatttttgtttag

SEQ ID NO: 11944 - DNA, 529 bp, Arnica chamissonis
gggaagacaatcacgctcgaggttgaatcgagcgatacgatcgacaatgttaaggctaagatccaggacaaggaaggtattccaccggaccagcagcgtctgatcttcgccggaaaacaacttgaggatggaagaactctcgcggattacaacatccagaaagagtctacgcttcatttggtgttgaggcttcgtggagggattatcgaaccatctttgatggctttagcaaggaaatataaccaggataaaaccatctgccgcaaatgttatgctcgcctccatcctcgtgctgtcaactgcaggaagaagaaatgcggacacagcaaccagttgaggccgaagaagaagatcaagtagatgagaatgatgttatggtactttgcttttgaagattttaatggtggtgctttctctttacatcatttttgaatgtttctggagtatgttttagacctgaagatctatgttttgagattttgataagctattgcaatgtttctttaatgttttatttgtgatctgtttt

SEQ ID NO: 11945 - DNA, 369 bp, Arnica chamissonis
ccggaaagaccataaccctcgaggttgagagcagcgacaccatcgacaatgtcaaagccaagattcaggacaaggaaggtattccaccggatcagcagcggctgatctttgccggaaagcaactcgaagatggccgaactcttgctgattacaacatccagaaagaatcaactcttcatttggttttgaggttaaggggaggaatcattgaaccctctttgatggcattggccaggaaatacaatcaagataagaccatttgccgcaagtgctatgctcgcttgcacccaagggctgtaaactgcaggaagaagaagtgtggccatagcaaccaactaaggccaaagaagaagatcaagtgaagattta

SEQ ID NO: 11946 - DNA, 724 bp, Cirsium arvense
ccgggaagaccatcaccctcgaggttgagagcagtgacaccatcgacaatgtcaaagctaagatccaagacaaggaaggtattccaccggatcagcagcgattgatctttgccggaaagcagcttgaagatggccgaactcttgccgattataacatccagaaagaatcaactcttcatttggttttgaggctaaggggaggaatcattgagccctctttgatggccttggctaggaaatacaatcaagacaagaccatttgccgcaagtgctatgctcgtttgcacccaagggctgtaaactgcaggaagaagaagtgtggccacagcaatcagttgaggccaaagaagaagatcaagtgaagggtgcttgtgttggattggaagtatctgcttctttttatctggtcgttttttgctggttttttataaaatgtaaaactaattgaatttttgctgtgttgaaatggtattattactttagatactctggaaaagtttgttgttttgattagttaaagctttcaaattagcattttcgttcttgatcgttgaaaaagaaaaaagtaccgactgcgactttttcgtttggaggatctcctctttgtccttttcttcttcctcctatcttcctcttcagagttgtcggtggaatcgtctgattcattctcactcacagatatagacttcctgcttctacgcctatgcttaaaactcgaactctt

SEQ ID NO: 11947 - DNA, 732 bp, Cirsium arvense
ccgggaagaccatcacccttgaggtcgagagcagcgacaccatcgacaatgtcaaggccaagattcaggacaaggaaggtattcctccggatcagcagcgattgatcttcgccggaaagcagctcgaggatggccgaactcttgccgattacaacatccagaaagaatcgactcttcatttggtgttgaggctcaggggaggaatcattgaaccttctttgatggcattggctaggaaatacaaccaagacaagaccatttgccgcaagtgttatgctcgcctgcacccaagggctgtaaactgcaggaagaagaagtgtggtcacagcaaccagctaaggccaaagaagaagatcaagtgaagagttacaagtggtttgtgcttgagaaaagtagtactgatattgttaaattttggaacatctgcatctattttgattagtcattttgtttgtaaggaccaatgaaagtaaacttgatgaattgttcatctaaatcaggattggttttcaatttttgcatttgatttttggctttagtgataagcaaaaacctgctatgatgattggttataactagtcttttggtcatataaagcttcatgatatattgtagttaaaagatattgcagatggattatatggattgcatcaccaccaccatgctaattgtttataaatgttatacaaggagagaaaggctctgaaagctttcagacatccaataattgtt

SEQ ID NO: 11948 - DNA, 526 bp, Cirsium arvense
gggaagaccatcactctcgaggttgagagcagcgacaccatcgacaatgtcaaagctaagattcaagacaaggaaggtattccaccggatcagcagcgattgatctttgccggaaagcagcttgaagatggcagaactctcgctgactataacatccagaaagaatcaaccctccatttggttttgaggctaagaggtggaatcattgagccttctttgatggccttggctaggaaatacaatcaagacaagaccatttgccgcaagtgctatgctcgtttgcacccgagggctgtaaactgcaggaagaagaagtgtggccatagcaatcagttgaggccaaagaagaagattaagtgaagggttggcgagtgttttgtttgtgttggatcggaagtatctgcagtcatttatctagtcgttttgttttgaaatgtaaactgattgaaattttgctgtgctgaaatgatttaagatattctgaaatgttggttatttgcttgacaaaaaaaagaaaaaagtaccg

SEQ ID NO: 11949 - DNA, 608 bp, Gossypium hirsutum
acccttcacgacaacggcaccatgcagattttcgtgaagaccctgacgggcaagactatcaccctcgaggtggagtcctctgacaccatcgacaatgtcaagtccaagatccaggacaaggagggcattcccccggaccagcagcgcttgatcttcgccggcaagcagctcgaagatggtcgcactctctccgactacaacatccagaaggagtcaactctccacctggtcctccgtctccgtggtggtatcattgagccttcgctcaaggctcttgcctccaagtacaactgcgacaagatgatctgccgcaagtgctacgcccgtctgccgccaagggctgtcaactgccgtaagaagaagtgcggtcacaccaaccagctccgccccaagaagaagctcaagtaaatcattcgcacaacggcgtctggcgagttggggtcggtcgaggtggaacgaaagcgacgaaagcatgcgacggacagtcctatgaaaatactgttcgcttttgcacatggagtcttatctgtgcttatcacccggctaaggagcatgatgatgggattggggcttgtagagtgaatacgattctacctttccttcttgcg

SEQ ID NO: 11950 - DNA, 662 bp, Phalaenopsis aphrodite
gcaattaatagcccgggtttagggtttgttagtttgctgcagtttcgtcgccgctgtgaagatgcaggtcttcgtgaaaaccgggaagaccatcactctcgaggtcgagagcagcgaagcaatccacaatgtgaagtggaagatccaggacaaggaaggaattccaccggatcagcagcggctgatctttgccgggaaacagcttgaagatggacgaactctggcggattataacatacagaaagaatcgactctgcatttggtgctgaggctcaggggtggtattattgagccctctcttatggcccttgctaggaaatacaaccaggataagatgatctgccgcaagtgttatgcaaggctgcatccacgggctattaattgcaggaagaaaaagtgtggacacagcaaccagctgaggcctaagaagaagatcaagtaaacaatgtttcagttctaaaaatatttctcatttgctgctttcaactggatgttaattatatttttatgttcctgattgttttattggagcactggccttgttgccatgcacactattgactattttagttgttttctgttcaactttgatatcaatagtgtgcatggcaacaaggccagtgctccaataaaacaagcagtcaccacaggaccagaaccat

SEQ ID NO: 11951 - DNA, 785 bp, Secale cereale
tcaagaccctgacgggcaagaccatcaccctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctgcgtgggggtatcatcgagccctcgctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcggtgtctggataaatcagtagacataaaatgtttttggttatcgttttgctgcccctcatgtcaggatgttgaaccttggttaactctagctgagtacttggccttgttttaatgtcagaactgaagtgaatcttggcaattagtctctgttaaatgttcattgttacttgtatgcttttgtctagtgaacgctatcacccaccacttgttttgattctgctgctcgttgctctcctgtcatggagcaccacgttgtcgataaatttttgcccatgttttcagaaattcagaactagcttttgggaattggaaccagaattccaaaaaactgtaatggctttctgaaatttgggcttccaatacaaacagtgtgtccaaaaaaaa

SEQ ID NO: 11952 - DNA, 575 bp, Secale cereale
aagaccctcaccgggaagaccatcaccctcgaggttgagagcagcgataccatcgacaatgtcaaggccaagatccaggacaaagaggggatcccgccggaccagcagcggctgatcttcgccggcaagcagttggaggacggccgcacccttgccgactacaacatccagaaggagtcgaccctccatctcgtcctcaggctccgtggaggcatcatcgagccatccctgcaggctcttgcccgcaagtacaaccaggagaagatgatttgccgcaaatgctatgcgcgcctgcacccaagggctgtcaactgccgcaagaagaagtgtggccacagcaaccagctgaggcccaagaagaagatcaagaactagagtgctactagtcagtttcgtggaccggttgaatccatcaccgtgtcagagtttatgctttattattgtcgtcgaaccttattttactttgctttcaggctatcgatgtggtgatgataattgacaatattggtatatggtagcaaacctataattttgccgtatctctgtttgatctgcactcattggcaatctttctt

SEQ ID NO: 11953 - DNA, 882 bp, Secale cereale
tcagcgtcaagaccctgacgggtaagaccatcacgctcgaggtcgagtgcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctgcgtgggggtatcatcgagccctcgctccaggccctcgcccgcaagtacaaccaggagaagatgatctgccgcaagtgctacgccaggctgcatccaagggccgtcaactgccgcaagaagaagtgcggccacagcaaccagctgaggcccaagaagaagatcaagaactagaagccatcatcttacccgctttcgttgtttggataaatcagtagacataaaatgttttccggttatcgttttggtgcccctcatgtcaggatgttgaaccttggttaactctagctgagtacttggccttgttttaatgtcagaactgaagtgaatctgcaattagtctctgttaaatgttcattgttacttgtatgcttttgtctagtgaacgctatcacccacaatgctctcctgtcatggagcaacacgttgtggataggatttgtgcccatgttttcagtaaattcagaaccagcctttgggaataggaaccagaattccaaaaactgtaataggctttctgaaatttgggctttccgaatccaaaacagtagtggttccaaattacgaattccttttaggggtactttaccggtaaacctaaaaaaaaaaaaaaaaccgttagaaacggtaactagtaccaacgggacacgacaagggtagtagggggggaggc

SEQ ID NO: 11954 - DNA, 446 bp, Secale cereale
caagaccctgacgggcaagaccatcaccctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctgcgtgggggtatcatcgagccctcgctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcgttgtctggataaatcagtagacataaaatgttttcggttatcgttt

SEQ ID NO: 11955 - DNA, 491 bp, Triticum aestivum
ggagaaggatgcagatcttcgtcaaaactttgacgggtaagaccatcaccctcgaggtggagtcttcggacaccatcgagaatgtgaaggccaagattcaggacaaggagggcatcccccctgaccagcagcgcctgattttcgccggcaagcagctggaggacggccgcaccctggccgactacaacatccagaaggagtccaccctccacctggtgctgcgcctgcgcggtggcatcattgagccctctctgctgatcctggccaggaagtacaggcaggacaagatgatctgccgcaagtgctacgcgcgcctgcaccctcgtgccaccaactgccgcaagaagaagtgcggcaggaccaaccagctgaggatgaagaagaagatcaagtaatccattcgccatcccgagctcgcacacacacgggcgtgtcatgaaaggggcatgtgcatgcgatgtggtgtaagcatgcgaaacagaaaaaaaaaa

SEQ ID NO: 11956 - DNA, 528 bp, Humulus lupulus
cttagcaaagatgcagatcttcgttaagaccctgacgggcaagaccatcaccctcgaggttgagtcttccgacaccatcgacaatgtgaagagcaagatccaggacaaggagggcattcccccagaccaacagcgtctcatcttcgctggcaagcagcttgaggatggccgcaccctgtcggactacaacatccagaaggagtctaccctccacctggtcctccgtctccgtggtggtatcattgagccctcgctcaaggcccttgcctccaagtacaactgcgacaaggccatctgccgcaagtgctacgctcgtctccctccccgtgccaccaactgccgcaagaagaagtgtggccacaccaaccagctccgccccaagaagaagctgaagtgatctactcgccttcggctggcgcgcaaagttcgacagaggaagacaagaacgtcggagcttttttggtggattactgcggcgtacccgtcttataggtagcgggaaatgccaactgccatgtttgaatgcca

SEQ ID NO: 11957 - DNA, 528 bp, Humulus lupulus
cttagcaaagatgcagatcttcgttaagaccctgacgggcaagaccatcaccctcgaggtcgagtcctccgacaccatcgacaatgtgaagagcaagatccaggacaaggagggcattcccccagaccaacagcgtctcatcttcgctggcaagcagcttgaggatggccgcaccctgtcggactacaacatccagaaggagtctactctccacctggtcctccgtctccgtggtggtatcattgagccctcgctcaaggcccttgcctccaagtacaactgcgacaaggccatctgccgcaagtgctacgctcgtctccctccccgtgccaccaactgccgcaagaagaagtgtggccacaccaaccagctccgccccaagaagaagctgaagtaaactactcgctcccggctggcgcgcaaggttcgacagaggaaggcaagaacgtcggagctttttttggtggattaccacggcgtacccgtattataggtagcgggaaatgccaacactgccatgtttgaatg

SEQ ID NO: 11958 - DNA, 597 bp, Elaeis guineensis
ggcgagaggttgagagatcttggtaacgatgcagatcttcgtcaaaaccctaacggggaagaccataacccttgaggtcgagagcagcgacaccatcgacaacgtcaaggccaagctcggagtagagagggtcgcgcagcagcgtctgatctttgccggtaagcagctcgaggatggacggaccctcgcggactataacatccagaaagagtcgactctgcatctggtgctgaggctgaggggaggaatcatagagccctctcttatggctcttgccaggaagtacaaccaggacaaaatgatctgccgaaagtgctatgcaaggttgcatccaagggctgtgaactgccgcaaaaagaagtgtggccacagcaaccagctgaggcctaagaagaagatcaagtaaatgcttgcatggatgaagtttattttgtccctggaattcagaaattttagctgattagcttggaatctggactttaatgtttcctggtaatatgaatgtcagactaccttgagcttgttgtttgatccattcagttctttgaccgatgaagattaagaaactaagcattttgctgaaaaaaaaaaaaaaaa

SEQ ID NO: 11959 - DNA, 796 bp, Ananas comosus
acaaggcaaggggtaatgtcgtcattccgcgcgcgaaatgtcaaaaccctagcgaggcgccgcgcctataaaaccccctcatcctcttcgaaccctaattagttgagagacgaacgacaaggtcggcggagatgcagatcttcgtgaaaaccctaacggggaaaaccatcaccctcgaagtcgagagcagcgacaccattgacaatgtcaaggccaagatccaagacaaagaaggaattccgccggatcagcaacgtttgatctttgcagggaagcagcttgaggatggacgaaccctagccgactacaacatccaaaaagagtcgacgctgcatctagtgcttaggttgagaggtgggatcatcgagccgtcactcatggctctcgcgaggaagtacaaccaggacaaaatgatctgtaggaagtgctatgctcggttgcatccaagggctgtcaattgccggaagaagaaatgtggtcacagcaatcctgcagctgaggcctaagaagaagatcaagtaaatggtgctgtttgaacttattagctccttttatagcccaggtggggaattagaattatctatgagttagctttggaaaattaaacctttgttttttgccgtttatgttggatgtttgactccactgtgtgacgctggtagatatgataatgcattttttcgattgttcttgacatatcattgttcttttcttctctatcatcaaatatatgatgctaataagacctctcatggcagttctttttaatgatctgaatcttatgatgctgtcgctc

SEQ ID NO: 11960 - DNA, 654 bp, Pinus taeda
ccatgcagatcttcgtcaagacccttacgggcaagaccatcacccttgaggtcgagtcctccgacaccatcgacaatgtcaagtccaagatccaggacaaggagggcattcccccagaccaacagcgtctgatctttgccggaaagcagctcgaggatggccgtaccctttccgactacaacatccagaaggaatctaccctccacctggtcctccgtctccgtggtggtatcattgagccttcccttaaggctcttgcctccaagtacaactgcgacaagatgatctgccgcaagtgctacgcccgtctccccccaagggcaaccaactgccgcaagaagaagtgtggtcacaccaaccagctccgtcccaagaagaagctcaagtaaactattcgctgttggttatgggagaaggcgtttgggaaatttcatgccctgagagtagtgattagctcatcagaaatgtcatcacgttctcccgcttttggttgaaaagcaatcaacacttttctctgcgaatcatcctctggtgggctcttcacagcggagaaagtgtgcgctggcttggatccgttcccgatccatgaaacttcagttgctcgggacaacatcttcagctattactgccgaagtatatgcaatacaaaagaca

SEQ ID NO: 11961 - DNA, 596 bp, Secale cereale
agaccctgacgggcaagaccatcacgctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctgcgtgggggtatcatcgagccctcgctccaggccctcgcccgcaagtacaaccaggagaagatgatctgccgcaagtgctatgccaggctgcatccaagggctgtcaactgccgcaagaagaagtgtggccacagcaaccagctgaggcccaagaagaagatcaagaactagaagccatcatcatcgccgctttcgttgtctggataaatcagtagacataaaatgttttccggttattgttttgctgcccctcatgtcaggatgttgaaccttggttaactctagctgagtacttggccttgttttaatgtcagaactgaagtgaatcttggcaattagtctctgttaaatgttcattgttacttgtatgcttttgtctagtgaacgctatca

SEQ ID NO: 11962 - DNA, 608 bp, Secale cereale
cccgaccctgacgggcaagaccatcaccctcgaggtcgagagcagcgacaccatcgacaatgtcaaggccaagatccaggacaaggaggggatcccgccggaccagcagcggctgatcttcgccgggaagcagctggaggacggccgcacgctggccgactacaacatccagaaggagtcgacgctgcacctcgtgctccgcctccgcggcggcatcatcgagccctccctccaggccctcgcccgcaagtacaaccaggagaagatgatctgccgcaagtgctacgccaggctgcatccaagggctgtcaactgccgcaagaagaagtgtggccacagcaaccagctgaggcccaagaagaagatcaagaactagaagccatcatcatcgccgctttcgttgtctggataaatcagtagacataaaatgttttcggttatcgttttgctgcccctcatgtcaggatgttgaaccttggttaactctagctgagtacttggccttgttttaatgtcagaactgaagtgaatcttggcaatttttagtgttcattgttactttgatgcttctgtgtagtgaatgctgtcacccatcacttattttgatt

SEQ ID NO: 11963 - DNA, 418 bp, Picea glauca
atcacgaagatactgtaaaaatgcagatcttcgttaagaccctaacgggcaagacaatcacccttgaggtggagtcttcggacaccatcgacaatgtcaagagcaagatccaagacaaagagggcatcccacccgaccagcaaagattgatcttcgccggcaagcaactcgaggacggccgaactctttccgactacaacatccaaaaggaatcgactctccaccttgtcctccgtctccgaggtggaatcatcgagccatcgctcaaggcccttgcctccaagtacaactgcgagaagatgatctgccgaaagtgctacgcccgtctaccacccagagccaccaactgccgaaagaagaagtgtggacacaccaaccaactccgaccaaagaagaagatcaaataaacgactcgttc

SEQ ID NO: 11964 - DNA, 470 bp, Taxus baccata
cgaagatactgtaaagatgcagatcttcgttaagaccctaacgggcaagaccatcacccttgaggtcgagtcctcggacacgatcgacaatgtcaagagcaagatccaagacaaggagggcatcccacccgaccagcagagattgatcttcgctggcaagcaacttgaggacggccgaactctttccgactacaatattcagaaggaatcgaccctccatctcgtgctccgtctccgaggtggtatcattgagccttcgctcaaggcccttgcctccaagtacaactgcgagaagatgatctgccgaaagtgctacgctcgtctaccacccagagccaccaactgccgaaagaagaagtgcggacacaccaaccaactccgaccaaagaagaagatcaaatagacgttcgttttattggcgggtgccacggtatcgtgtgggaggttattgggtgtatgtcacgaatgtc

SEQ ID NO: 11965 - DNA, 512 bp, Epimedium sagittatum
aagaccatcactttggaggtcgaatccagtgacaccatcgacaacgtcaaggccaaaatccaagacaaagaagggattccacctgaccagcagaggttgatcttcgccgggaaacagcttgaggatggtcgtactcttgccgattacaacatccagaaagagtcgactctgcatcttgttctgaggcttcgtggaggaatcatcgaaccctctttgatggctttggccagaaagtataaccaggataagatgatatgtcgcaaatgctatgctcgccttcatcctcgtgcagtgaactgcagaaagaagaagtgtggccacagcaaccagttgaggccaaagaagaagatcaagtagattttattgcctagaattggtagcgtaatcattaggtcagcttggcccttttgtcgatctaagagttctgttagcatttgagattcagacttcgctgatttaaatatttgtgttttatatcctatgttactttggtgctttggcaattattcttc

SEQ ID NO: 11966 - DNA, 572 bp, Jatropha curcas
ctggaagaccataactctcgaagtagagagcagcgacaccattgacaatgtcaaggccaagatccaggacaaggaaggaattccaccggaccagcagcgattgatcttcgccggaaagcagcttgaagatggccgaactttggcggattacaatatccagaaagaatcaaccctccatcttgtgttgaggcttaggggaggtattattgagccttctcttatggctttggctcgcaaatataatcaggacaagatgatttgccgcaagtgttatgctcgtctgcatcctagggctgtgaactgccggaagaagaaatgtgggcatagcaatcagttgaggccaaagaagaagatcaagtaaactgttatgaagcatgcattagctttggaagatttgattgttagatgcctaccttctttattttggatttggatttagatttattaagccagtatggagttggattttattgtatgttgaactgagcagggtatttgtttgtttttcaatcaatcaagcgcaatacattttatattttgcaatagataataatctgtttcgatgtgtggat

SEQ ID NO: 11967 - DNA, 759 bp, Mesostigma viride
gctatagaggcggggcaccatgcagattttcgtgaaaaccctgacgggtaagaccttcacgctcgaggttgagagtagtgataccatcgacaacgtgaaggctaacatccaggacaaggagggaatcccccctgaccagcagcgtctgatcttcgccggaaagcagctcgaggatgggcgcaccctggctgactacaacattcagaaggagtccaccctgcacttggttctccgtctccgtggaggcatcatcgagcccagcttgatcgccctggcgaagaagaccaactgcgaaaagaagatttgccgcaagtgctacgctcgcctgcacccccgtgctgtgaactgccgcaagaagaagtgcggccacacaagccagctgcgcctgaagaagaagatcaagtaaatgccggcatcctggggtggccatcgttgcatgtcgtgggaatcgttcgccaattggtgaaggccaaagaggacccatggcatcacgtttggtgccaaacacttcttgaccagtcgagaggggttcatgagccatgcttgcagggttccagccatgccatcatccgcagggctaggagcgtgattgcgccatgttgaatgacatgtacaaagagggttgcacagttgcgcgcacttgcgagatgggccctgtgcccagataataagaatggcaggcactgcctgtgctcgctgctgtttccagcatgatggtacacccatattattttagaaataaagggacaatttttattt

SEQ ID NO: 11968 - DNA, 756 bp, Mesostigma viride
agattttcgtgaaaaccctgacgggtaagactatcacgctcgaggttgagagcagtgataccatcgacaacgtgaaggctaagatccaggacaaggagggaatcccccctgaccagcagcgtctgatcttcgccggaaagcagctcgaggatgggcgcaccctggctgactacaacattcagaaggagtccaccctgcacttggttctccgtctccgtggaggcatcatcgagcccagcttgattgccctggcgaagaagaccaactgcgaaaagaagatttgccgcaagtgctacgctcgcctgcacccccgcgctgtgaactgccgcaagaagaagtgtggccacacaagccagctgcgcctgaagaagaagatcaagtaaatgacggcatcctggggtggccatcattgcatgtcgtgggaattgttcgccgattggtgaaggccagggaggacctatgacatcacgttggtgccaaacattgggcatttgtgaagttgagaggggctggtgagccatgcttgcagggttccagtcatgccataagcagggctagaagcgtaattgcgccatgttgaatgacatgtacagagtggttgcacagttgcgcgcacttgcgagatgggccctgtgcccagataataagaacggcaggcactgcctgtgctcgctgctatttccgcatgatggtgcacccagattattttagaaataaagcacaatttttatttacgtgatatgacaagcatacata

SEQ ID NO: 11969 - DNA, 683 bp, Pinus taeda
ggggatcgaagacctttgtacccataccgattgccaggagactgtaaagatgcagatcttcgtaaagaccctcacgggcaagactatcacccttgaggtggagtcctcggacacaattgacaatgtcaagagcaagattcaagacaaggagggtatcccacctgaccagcaacgattgatcttcgctggaaagcaacttgaggatggccgaactctttccgactacaacatccagaaggagtcaacacttcacttggtcctccgactccgaggcggtattatcgagccctctctcaaggctcttgcctccaagtacaactgcgagaagatgatctgccgaaagtgctacgctcgtctgccaccgagagccaccaactgccgaaagaagaagtgcggccacaccaaccagctcagaccaaagaagaagctgaagtagtggtatgcttctgtggggagaagtcatgggattcgtgctggtatggagattatgtactggtgtttgactcgcagttcaagacagtggcgcacatcacgagctgtggttgaattcatgtagtcgcatcaagacaagagaacaggcgacagccgttttctgtagacatgaccgttggggaggatgaatagcttttactaccaatgttcacggaaatgatacaagcactcacgaaaaaaaaaaaaaaaaa

SEQ ID NO: 11970 - DNA, 420 bp, Silene vulgaris
aatcatgcagattttcgttaaaactttaactggaaagaccatcactcttgaggtcgaaagctctgacactattgagaatgtcaagcaaaagatccaagataaggaaggaatccctcccgatcaacaacgacttattttcgccggaaaacaacttgaggatggaagaactctttctgattacaatattcagaaagaatctactcttcaccttgttttgagactcagaggaggagttattgagccatctcttcaagttcttgcaagatcttacaatgtagacaagatgatttgcagaaagtgctatgctagactcccacccagagcagtcaattgcagaaagaagaaatgtggtcactcaaatcaattgagaccaaagaagaagctgaagtaatttttccggttctgtggaataaatgtcgt

SEQ ID NO: 11971 - DNA, 580 bp, Picea glauca
cgctaacatgcagatcttcgtcaagaccctcacgggcaagaccatcactctcgaggtcgaatcctcggacacaattgacaatgtcaagtccaagatccaggacaaggagggcattccgccggaccagcagcgcctgatcttcgctggcaagcagctcgaggacgggcgcacccttagcgactacaatatccagaaggaatccaccctccacctcgtcctccgcctgcgcggcggcatcatcgagccctcgctcaaggccctcgccagcaagtacaactgcgaaaagtccatctgccgcaagtgctacgcgcgcctgccgccgcgtgccaccaactgccgcaagcgcaagtgcgggcacagcaaccagctccgcccgaagaagaagctaaagtagtggtgtgcgggttgtgcgtggtgggtgctgtggatgtggaaggggatgagttgctggctgtttatcaggaggctgcagtaggctgtggagttgtggtactggaagaatgctgcgcatgggtcgataggttatatgagctatgaaggcaaatccaaacacagtctgacagcaaaaaaaaaaaaaaaa

SEQ ID NO: 11972 - DNA, 540 bp, Picea glauca
tcgttcaggctaagcagtccgacggagtttgcaaagatgcagatctttgtgaaaacgttaacggggaagaccatcacccttgaggtggaacccagtgataccatcgaaaatgtcaaggcaaaaatccaggacaaagaaggtatccctcctgatcagcagcgtctgatcttcgctggcaaacagctcgaggatggccgcacactgtcagactacaacattcaaaaagagtctactctgcaccttgtgctccgcctgcgaggaggcatcattgagccttctctgaggcaactggcccagaagtataactgcgacaagatgatctgccgcaagtgctatgctcgccttcacccccgcgccgtcaactgccgcaagaagaagtgtggccacaccaacaacctgcgccccaagaagaagctgaagtagacgctccgcgctgttctcttggccctatgcagtttgcattagttggttaaataaatgttaaaaaaaaaaaaaaaaagaaatactgcgtgtacacacagctctcagatagcacgagca

SEQ ID NO: 11973 - DNA, 745 bp, Triticum aestivum
acttagcaaagatgcagatcttcgttaagaccctgacgggcaagaccatcaccctcgaggtcgagtcctctgacaccatcgacaatgtgaagagcaagatccaggacaaggagggaattcccccagaccagcagcgtctgatcttcgccggcaagcagctcgaggacggccgcaccctctccgactacaacatccagaaggagtccactctccacctggtcctccgtctccgtggtggtatcattgagccttccctgaaggcccttgcctccaagtacaactgcgagaagtccatctgccgcaagtgctacgctcgtctccctccccgtgccaccaactgccgtaagaagaagtgcggtcacaccaaccagctccgccccaagaagaagctcaaatagacgactcgcttatcggtgttgtgctcggtgtgctggggtgcagaatccaggtctggtgtatggctggaacgcgacacgcagaggtttttacatggcgttagaaatgatgaaacaatcacagccagtcatactgtttttagttggcacctctcaataaggtcgcaatccatgaattgaagtaaaagttcaaacgttcaaatcaggcatcagtctatcagcccttgctttttgactgtcgtttcattgttttatccattatatccgattggacttcttggtttttcaagtattccatgtacgaccgtgcaaacgccctatgaaggaaattgaggtcttcaaatcatgcc

SEQ ID NO: 11974 - DNA, 540 bp, Echinochloa colona
ggtaagaccatcaccctcgaggtcgagagcagcgataccatcgacaatgtcaaggccaagatccaggacaaggaaggaatcccgccggaccagcagcgtctgatcttcgccggcaagcagctggaggatggccgcaccctggctgactacaacatccaaaaggagtccacgctccaccttgtgctcaggctccgtggtggaatcattgagccctcgctgcaggcgctcgctcgcaagtacaaccaggacaagatgatctgccgcaaatgctatgcacgcctgcaccccagggctgtcaactgccgcaagaagaagtgtggtcacagcaaccagctgaggcccaagaagaagatcaagaactgaggtgtgttgttgctagtcagtttcatggaccatttaaatcatctgctgtagtggtgtaccgtatgttctgatgcgttgttgtctggatgttgaaccgagttgttgtgccaaactttcctgccgtgatgtttcaccttgttgtcgatggtgacagtactatatggcaatatagctact

SEQ ID NO: 11975 - DNA, 571 bp, Conyza canadensis
tgggtataaaccacgtttcaagagaggtaaaaaaccaaccgaaaatgcagatattcgttaaaactttgaccggtaagaccatcacacttgaggtcgagccgagcgacacaatcgaaaatgtcaaagcgaaaatccaagacaaagagggtattccaccagatcagcaacgtctgatttttgctggcaaacaattggaagatggacgtacattgtccgactacaacatccaaaaggaatcgacactccatttggtgttacgtctacgtggtggtatcatcgaaccatcgttgcgtattttggcacaaaaatacaattgcgacaaaatgatttgccgtaagtgctatgcccgtttgcatccgagagccaccaattgccgtaagaagaagtgcggccacaccaacaatttgcgcccaaagaagaagttgaagtagacgatcgtttttgtgctgtatgtctggaggaaagcgaaacttggatccattcactgttgttatcattttgaataatcgaaattatgtgaaacattcattgggtacagcctgaataaacttcgttttctgatgaatcggac

SEQ ID NO: 11976 - DNA, 610 bp, Taraxacum officinale
ataaccctcgaggttgagagcagcgacaccatcgacaatgtcaaggccaagattcaggacaaggaaggaatcccaccggatcagcagaggttgatctttgccggaaagcaactcgaagatggccgtactcttgccgattacaacatccagaaagaatctacccttcatttggtgttgaggctaaggggaggaatcattgaaccttctttgatggcattggctaggaaatacaatcaagataagaccatttgccgcaagtgttatgctcgccttcacccaagggctgtgaactgcaggaagaagaagtgtgggcacagcaaccagctaaggcccaagaagaagatcaagtagacttgtgagtgttggaaaaggaacattttgtttaattcagaaagctgtttttttgagtaatttttgttgttaacagattaaaggcacttgatgggttgtttgtttaattcaaagaagcactattggtttgaaatttctagtctttaagcctaggtttctacattccttttgggtttcttgtttttaccttttatcctttgtggttttcattatctttgctaataaaatactgttcatttgtgaaaaaaaaaaaaaaaaa

SEQ ID NO: 11977 - DNA, 601 bp, Festuca arundinacea
agtggtatcaacgcagagtacggtaggaaacttcaacatctccagcgtcaccaaatcagtcaagatgcagattttcgtcaagactctgacgggcaagaccatcacccttgaggtcgagtcctcggacacgatcgacaatgtcaagtccaaaatccaagacaaggagggcattccccctgaccagcagcgattgatcttcgctggcaagcagcttgaggacggtcgaaccctgtccgactacaacattcagaaggagtctactctacacttggtcctccgtcttcgtggtggtatcattgagccctcgttgaaagctctggcctccaagttcaactgcgacaagatgatctgccgcaaatgctacgctcgtcttcctcctcgtgccaccaactgccgcaagcgaaagtgcggccacaccaaccagctccgacccaagaagaagctcaagtaaacgggttcacctatggatgtggcgtctggattttggtattctggggatggcaaggacaaaagtgcttcacgattgacaagcctggcttagtttctataatagcatatacagctcaggcgatacaatctcgatgatgcctatgaattgagg

SEQ ID NO: 11978 - DNA, 677 bp, Ananas comosus
acgcaccaaggaatttgagggaacattttcaagcctctccgtacaatcaacctcatttgtctacgaggaagacgtcaacatgcagatcttcgtcaagacactcaccggcaagaccatcaccttggaggtcgagtcttcggacacgatcgacaatgtgaagtccaagattcaggataaggagggcattcccccagaccaacaacgattgattttcgcgggcaagcaactggaggatggccgaaccctctccgactacaacatccagaaggagtccaccctacatctagtgctccgcctgcgtggtggtatcattgagccctcgctgaaagctctggccagcaagttcaactgcgacaagatgatctgccgaaagtgctacgctcgtcttccgccccgagcaactaactgccggaagcggaagtgtggacacaccaaccagctccgccccaagaagaagctcaagtaaacggttcatcatggtcttcggcgtcctggtttcggtatcatgaggagtggcaaggcagggggagaaattagactgtggctgtaaaatcataacggatagcatttgcaaatccaacagcttgcttggtagtctgccaacgacgacccttcatgcattctacgtcatctcgcctagccacggagccatagaaagagatcagagcaagatcgga

SEQ ID NO: 11979 - DNA, 681 bp, Pteridium aquilinum
ggtaaaaccatcacgctcgaggtcgaaagcagtgatactatcgacaatgtcaagacgaagatacaggacaaagaagggattcctcctgaccagcagcgtctgatcttcgccggcaaacagctcgaagatggacgcacattggcagattataacatccagaaagagtctactctacatctggtgttgaggcttcgaggcggtatcattgagccttctctgatggccttagcaaggaagtacaaccaggagaagatgatatgtcgcaagtgttatgcacgcttacatccacgtgcagtgaattgccggaagaaaaagtgtggacacagcaatcagctgcgacccaagaagaagattaagtagacatttttggagaccattcactatctaaacatgcgacttgatgtaactgaatacttaatgtcaaggaaagcctcattttttgaccaagctgttctaagctcttaggtatgcctggaaatttttctgcgtgtgcgcattgggcatgtgccaatagcctggcaagaggtcatctttagtatactaaagatctttgcactatcagtgaatttttaggttgtgcttatattctgcgataatcttccagtaattgtcaatgaaagccatttaatgatattattttggtattctaactgggggtgcaatagttgactgaaaaaagaa

SEQ ID NO: 11980 - DNA, 770 bp, Secale cereale
gtcggctttccaatcctcacatcgtcaccgtcacagaaatcagtcaagatgcagattttcgtgaagaccctgacgggcaagaccatcaccctcgaggtcgagtcttcggacaccatcgacaatgtcaagtccaagatccaggacaaggagggcatccccccggatcagcagcgattgatcttcgccggcaagcagctcgaggatggccgaaccctctccgactacaacatccagaaggagtctaccctccacctggtcctccgtctccgtggtggtatcattgagccttcgctcaaggctcttgcctccaagttcaactgcgacaagatgatctgccgcaagtgctacgcccgtctccctccccgtgccaccaactgccgtaagcgcaagtgtggtcacaccaaccagctccgacctaagaagaagctcaaataaacgattacttcatggatgtggcgtctgggatttggcatttgggggtcgatggcgaggacagaggagagctttcttttgttcacacgaggctggttttttattaaaatagcatgtgcagctccggcaatacattctagatgatgcccatatgacgatgtgccgtgccggaaggtgtcccggccagacccctcaaagaaataaacagcattcaagcttggaacaatgcttgtgcatcgaaatgaccgtggttgtgggcaaggagctcggctttgcgcctcctgactctgtagaaataaatgccacagaattggagggttataaagaagcacgaaaaa

SEQ ID NO: 11981 - DNA, 504 bp, Tamarix hispida
ggggagcgtcacaaaaatcagtcaagatgcagattttcgtgaagaccctcacgggcaagaccatcacccttgaggtcgagtcctcagacaccattgacaatgtcaagtccaagatccaggataaggagggcatccccccggaccagcagcgcttgatcttcgctggcaagcagcttgaggatggccgcaccctctccgactacaacatccagaaggagtctaccctccaccttgtcctccgtctccgtggtggtatcatcgagccctcgctcaaggccctagcctccaagttcaactgcgacaagatgatctgccgcaagtgctacgctcgtctcccgcctcgcgcgaccaactgccgtaagcgaaagtgcggacacaccaaccagctccgacccaagaagaagctcaaataaacgattctctccatggatgcggcgtctggttaatattggcattctggggtcggtggcaaggacagaggagcttctttgttcacgagtctgg

SEQ ID NO: 11982 - DNA, 640 bp, Triticum aestivum
cagcgaccgaccgccgacaccaacgaaaactcgcaaccatgcagattttcgtcaagaccctgacgggtaagaccattaccctcgacgtcgagtcgagcgacaccatcgacaacgtcaagaccaagatccaggacaaggagggcattcccccagaccagcagcgcctgatcttcgccggcaagcagcttgaggatggccgcaccctgagcgactacaacatccagaaggagtccacccttcacctcgtcctgcgcctgcgtggtggtatcatcgagccctccctcaaggccctcgcttccaagtacaactgcgagaaggccatttgccgcaagtgctacgctcgtcttcctccccgtgccaccaactgccgtaagaagaagtgcggtcacaccaaccagctccgccccaagaagaagctgaaatagacgattcgctttgttggtgttgcgctcggtgtattgtggttcagaatccaggtctggggtttcaacaggatcgcgactcggagaggttacatatggcgttagaaatgatgaaacaatcacagccacagtcatacttattctagttggctcctcccggcttgcaagtcgcagtccgctcaattgaagtaaaagttcaaaatatttcaaaaaaaaaa

SEQ ID NO: 11983 - DNA, 646 bp, Triphysaria pusilla
tcgactgacggcaaaaccctagctaggaataccaaaatgcaaatcttcgtgaaaaccttgactgggaaaaccattacgctcgaggtcgagtcgagtgacaccattgacaatgtcaaggtcaagattcaagacaaagaaggtatccctccggatcaacaacgtttgatctttgccgggaaacaacttgaagatggtcgtactcttgccgattataacattcagaaagagtcaacactgcatttggttctaaggcttaggggtggggtgaatatgattgagccgtctcttaagttgttggctcagaaatataaccagcagaagatgatttgccgcgtatgttatgctcgcttgcatccacgcgctgtaaactgcaggaagaagaaatgtggacacagcaaccagttgaggccgaagaagaagagcaaatatgcataagcttattagacttatggatttcattccactttgtttggttttcaataataagacgattttgaatcttacgttctttgtttggtgcttttggatcattatcaataattgtttggttttaaataaatttacattttagttgattatatcttcatctgtaatattcaatattctgcataatatttattagtttggacaaaaaaaaaaaaaaaaa

SEQ ID NO: 11984 - DNA, 622 bp, Lolium multiflorum
acacaatcaacgtagagttggacgccaccatgcaaatcttcgtcaagacattgacgggtaaaaccatcaccctcgaggtagaatcttcggacaccatcgataatgtcaagtccaaaattcaagacaaagaaggcattcctcctgaccagcaacgattaattttcgctggcaagcaactcgaagatggtcggactctactcgactacaacatccaaaaggagtcaactcttcaccttgtgcttcgccttcgtggtggaatgattgagccctccctaagagctcttgcatcaaaattcaactgcgaaaagatgatttgccgcaaatgctacgctcgcctaccccctcgagctacaaactgccggaaaaagaaatgtggtcacaccaatcagctccgacccaagaagaagataaagtcgtgatgtacttgaatattctagaaattcgtcttcactaagatccgctgtcactagaacggacgtaagggatgtcaaatataattaaagaacgcggagcacttggaaactagcggatgttaactcagaggtaatgggatgtaccttgccttagatggaaacaacaagtcatgtatcagacgcaataatcaaaacattattagtaatgt

SEQ ID NO: 11985 - DNA, 602 bp, Triticum aestivum
ccggggcagatcttcgtgaagactctgactggcaagaccatcaccttggaggtcgagtcctcggacacgatcgacaatgtgaagtccaagattcaggacaaggagggaattccccctgaccaacagcgtcttatctttgctggcaagcagctggaggacggccgtactctctccgactacaacatccagaaggagtcgaccctccacttggtcctccgcctgcgtggtggtatcatcgagcccagcttgaaggctctggccagcaagttcaactgcgacaagcagatttgccgcaagtgctacgctcgtctcccaccccgtgccacaaactgcaggaagagaaagtgtggacactcgaaccagcttcgccccaagaagaagctcaaataaacgatttcaccctcatcacggtctttggcgtcacggtttttcggttcgcgatcatcgagagtacagggaggggttatttcggaaaagctttggcgcacagggaagccagggacatctgacaagtcaaggactttgtcgctgccatacatccaaagagcctcagaacatgattccatgaattttttcatcaaaatacctgataccttgaaaaa

SEQ ID NO: 11986 - DNA, 489 bp, Rosmarinus officinalis
cgtattcgtggttaataaacgccaaatttcacttgcgaatagcttttggtctgtgcacaaccgaaagaatacatcaagatgcaaatttttgtgaaaacccttacagggaagaccatcacccttgaggtcgagtcttctgacactatcgaaaatgtcaaagctaaaatccaagataaagaaggtatccctcccgatcaacaacgtttgatcttcgccggcaagcagcttgaagatggacgtacattgtcggattataacatccaaaaagaatctacattgcatttggtattacgtctccgtggtggtgttattgagcccactcttcgtttgttggcccagaaatacaactgtgacaaaatgatttgccgtaaatgttatgctcgtcttcacccaagagcaactaactgccgtaagaagaagtgtggacacacaaacaacttgcgtccaaagaagaaattgaagtaaacgcattttggttgcactccgagg

SEQ ID NO: 11987 - DNA, 581 bp, Cicer arietinum
cttgcctcccacgactgcgggttctattcgcgtttcgtatactccgaaatttacttgcggaaaacttttggtctgcgcacaactgaaagaacacatcaacatgcaaattttcgtgaaaacccttacagggaagaccatcacccttgaggtcgagtcttctgacactatcgaaaatgtcaaagctaaaattcaagataaagaaggtatcccacccgatcaacaacgtttgatcttcgccggcaagcagcttgaagatggacgtactttgtcggattataacatccaaaaggaatctacattgcatttggtattacgtctgcgtggtggtgttattgagcccactcttcgtttgttggcccagaaatacaactgtgataaaatgatatgccgcaaatgttacgctcgtcttcacccaagagcaactaactgccgtaagaagaagtgtggacacactaacaacttgcgcccaaagaagaagttgaagtaatcgcattttgcttgtactccgaggaacactacgaacattttcttggttttaaattttatcattcaattgtaaaattacaaatttataatactac

SEQ ID NO: 11988 - DNA, 551 bp, Chrysanthemum coronarium
ataaacgccaaatttcacttgcgaatagcttttggtctgtgcacaaccgaaagaatacatcaagatgcaaatttttgtgaaaacccttacagggaagaccatcacccttgaggtcgagtcttctgacactatcgaaaatgtcaaagctaaaatccaagataaagaaggtatccctcctgatcaacaacgtttgatcttcgccggcaagcagcttgaagatggacgtacattgtcggattataacatccaaaaagaatctacattgcatttggtattacgtctccgtggtggtgttattgagcccactcttcgtttgttggcccagaaatacaactgtgacaaaatgatttgccgtaaatgttatgctcgtcttcacccaagagcaactaactgccgtaagaagaagtgtggacacacaaacaacttgcgtccaaagaagaagttgaagtaaacgcattttggttgcactccgaggaaaaccaccaactttttcttggttttacattttatcattcaattgttaaataacaaatttataaacataaataaac

SEQ ID NO: 11989 - DNA, 445 bp, Arachis hypogaea
cagattttcgtcaagactttgacgggaaagacgatcaccctcgaggtggaatcgtctgacactattgacaatgtcaaggctaagatccaagacaaggaaggaattcctcctgaccagcagcgattgatcttcgctggaaagcaacttgaggatggccgcaccctgagcgactacaacattcagaaggagtcgactcttcaccttgtcctccgtctccgtggtggaatcattgagccttcgctcaaggtgttggcttccaagtacaactgcgacaagcaaatttgccgcaagtgctatgctcgtctccctcctcgcgccaccaactgccgcaagcgttcgtgtggacactcttctcagctccgccctaagaagaagctcaagtagtggttgtctacacggtttgttcgggtgttgctttctgtgtactacctctatcctatcattt

SEQ ID NO: 11990 - DNA, 580 bp, Triticum aestivum
acttttctttacaaatcacatttcttcctattggactgtattcgtggttttaaacgacaaaatttacttgcgaatagcttttggtctgcgcacaaccagaagaacacatcaacatgcaaatcttcgtgaaaacccttacagggaagaccatcacccttgaggtcgagtcttctgacactatcgaaaatgtcaaagccaaaatccaagataaagaaggtatccctcccgatcaacaacgtttgatcttcgctggcaagcaacttgaagatggacgtacattgtcagattataacatccaaaaagaatctacattgcatttggtattacgtctccgtggtggtgttattgagcccactcttcgtttgttggcccagaaatacaactgtgacaaaatgatatgccgtaaatgttatgctcgtctccacccaagagcaactaactgccgcaagaagaagtgtggacacactaacaacttgcgcccaaagaagaagttgaagtaaacatattttggtcatactccgaggaaaactaccaactttttcctggttttacattttatcattcaattgttaaataacaa

SEQ ID NO: 11991 - DNA, 661 bp, Triticum aestivum
gagcgttggccttgccggattcctcaagaaatcgttcaagatgcaaatcttcgtcaagactctcaccgggaagacgatcaccctcgaggtcgagtcctccgacaccatcgacaatgtcaaggccaaaatccaagacaaagaaggcatccccccagaccaacaacgattgattttcgctggtaaacaactcgaagatggccgaactttagccgactacaacatccagaaagagtctactcttcatttggtacttcgtctgcgtggtggtcttatcgagccatccttgaaagctttggcctccacctacaactgtgaaaagatgatctgccgaaagtgctacgctcgtcttcctcctcgtgctaccaactgccgcaaacgctcatgtggccactcctctcaactccgacctaagaagaaattgaaatagatgatgatgatgatcaatctacctgttgatcttagccaatgtctacgctgtttctcattccttcggtctcgactgcccatcgcttacaattgggaccccctcaatgcttatgatgaggtctgttgaagacgtgtttatcacgcctgatccgtgtcggtctatgaatttatgatgctattttgatgtaccatcattcaacgtccatttcttttcacctacaccacacggcgtcct

SEQ ID NO: 11992 - DNA, 635 bp, Antirrhinum majus
tgaattgcgtgaagaccccgaaataaaaataaaaaatgcgatcttcgtgaaaaccctaacgggcaaaactatcacgctcgaagttgaatcgagcgacacaatcgacaatgtcaaggccaagattcaagacaaggaaggtatcccaccggatcagcagcggttgattttcgctggtaaacagctcgaagatggtcgcacacttgctgattacaacattcaaaaagagtcgactctgcatttggtcctgaggctcaggggtggtatcatcgagccgtctctcatggcgttggctaggaagtacaatcaggaaaagatgatctgccgcaagtgctatgctcgcttgcaccctcgagctgtcaactgcaggaagaagaagtgtggacacagtaaccagttgaggccgaagaagaaaatcaagtagactgcttggaaggatcgcggtcatctattatgttacttgtttttgctagttcccaacgaaacaaagtgtagcattttgcttatagacatacaacggtttatgtagctttatcccttcaatgactttccatgtgtctctaaacttgttttgaatcaactgcgttattatgtctctttgctggttggaattaaggcgcatagtttaatgctttgct

SEQ ID NO: 11993 - DNA, 420 bp, Conyza canadensis
tgcaaatcttcgtgaagactcttaccggtaagactattactcttgaagtagaagcttctgatactatcgaaaatgtgaaggcaaagattcaggataaggagggtattcctccagatcagcagcgtctgatctttgccggcaaacagcttgaggatggccgtaccctttcggattacaatatccagaaagaatcaactcttcatcttgttctccgtctccgtggaggtatcattgagccttcccttcgtcagctcgctcagaagtacaactgtgataagcagatctgtcgcaagtgttatgctcgcctgcctcctcgtgctactaactgcagaaagaagaagtgcggtcactccaatgatcttcgcatcaagaaaaagctgaagtaaacttgtatgttggggagatacatccaataaatgt

SEQ ID NO: 11994 - DNA, 460 bp, Flaveria ramosissima
ccagaacataaaacctccgttgcacctcatttgacctacagacaaaaagatgcagatcttcgtgaaaaccctaactggaaaaaccataaccctagaggttgaaagcagcgacaccatcgataatgtgaaagcgaagattcaggataaagaaggtattccaccggatcagcagcggttgatctttgccggaaagcagcttgatgatggccgaactcttgctgattacaacattcagaaagaatctactcttcatttggttttgaggctgaggggaggaatcattgaaccttcattgatggcattggctaggaaatacaatcaagacaagaccatctgccgcaagtgctatgctcgcttgcacccaagggctgtaaactgcaggaagaagaagtgtggtcacagcaaccaattaaggaccgaaaaagaagattcaagtgaagagatgtgcatgtctttactg

SEQ ID NO: 11995 - DNA, 372 bp, Secale cereale
aaagaccttaactggtaaaaccatcactttggaagtcgaatccagcgacaccatcgaaaacgtcaagaccaagatccaagataaggaaggtatcccaccagatcaacaaagacttatcttcgccggaaaacaattagaagatggtagaacccttgctgactacaacatccaaaaggaatctactttacacttggtcttaagattaagaggaggagttattgaaccatctctccaagtgctcgctagaaagtacaactgtgacaagatgatttgcagaaaatgctacgctcgtttaccacctcgtgctgtcaactgtagaaagaagaagtgcggtcactccaaccaattgagaccaaagaagaagctcaagta

SEQ ID NO: 11996 - DNA, 491 bp, Saccharum officinarum
gcatcaccgacaccaagatgcaaatcttcgtcaaaaccctcaccggaaagaccatcaccctcgaggtcgagtcttcggacaccatcgacaatgtcaagtccaaaatccaggacaaggagggtatcccccctgaccagcaacgtttgatcttcgccggaaagcagctcgaggacggacgaacacttagcgactacaacatccagaaggaatcaacccttcacttggtcctccgtctgcgaggtggtatcattgagccctcgctcaaggtccttgcctccaagttcaactgtgacaagatgatctgccgaaaatgctacgcccgtctccctccccgtgccaccaactgccgaaagcgcaaatgtggacactcgtcccagctccgacccaagaagaagctcaagaactagatggggtttttgatgtttttggctaggaccggattagtcagagtagaccatgctctatgtattcctgcccacaccccacacccc

SEQ ID NO: 11997 - DNA, 641 bp, Artemisia annua
acgagtgcgtatggtatcaacgcagtactccgacgggaccacgatacattcataaccgccgttgagagggtgaagaaagaagaaaaatgcagatcttcgtgaaaacactgacagggaagacaataacccttgaagtcgaatcctcggacaccattgacaatgttaaggccaagattcaggacaaagaaggaattccaccggatcagcagaggttgatatttgcaggaaagcagcttgaagatggtcgtactcttgctgactacaacatccagaaagagtcgactcttcatttggtcttaaggctgaggggaggaatggggaagacgataaagattgagccttatttgatggcgttggctaggaagaccaaccaaaacaaggctgtgtgccgcaagtgttatgcccgtcttcccccaagggctgtaaactgcaggaaaaagaagtgtggccacagcaaccaactaaggccgaagaagatgatcaagatggactgagtgtttggtgtgttggagaggaacttgtcttgttatcttaagaacttgtcttgtttttaactacttatgaaagtaaacttgttgaattgtttgtttaaacttgctgaattgtgtgtttaattcaagaagcattcttgatttgatatt

SEQ ID NO: 11998 - DNA, 393 bp, Aquilegia formosa
atgcagatatttgtgaaaaacctgaaagggaagacaataacccttgaggttgaatcaagtgatactatcgacaatgttaacgctaagattcaagacaaagaagaaattcctcctgaccagcagcgtttgatctttgctgggaaacaacttgaagatggtcgtactcttggtgattacaacattcagaaggagtcaactttgcatcttgttctaagacttcgtggtgggcttattgagccatctcttaaggctttggctttgaagtacagagagaaaaaaatgatctgtcggaaatgttatgctcgtctgcaccctcgtgctgtgaactgtaggaaaaagaagtgtgggcacagcaaccagttgaggcccaagaagaagggcaagtacaactga

SEQ ID NO: 11999 - DNA, 520 bp, Cynara scolymus
ctcgcgggggcgatcagacggaagatgcagatcttcgtgaaaccttgaccggcaagaccatcacgctcgaggttgagagcagtgacaccatcgacaatgtgaaagctaagattcaagataaggaaggtattccaccggatcagcagagattgatctttgccggcaagcagcttgaagatggccgaactctcgctgattataacatccagaaagaatccactctccatttggttttgaggctaaggggaggaatcattgagccttctttgatggcattggctaggaaatacaaccaagacaagaccatttgccgcaagtgctatgctcgtttgcacccgagggctgtaaactgccggaaaaagaagtgtggccacagcaatcagctgaggccaaagaagaagatcaagtgaagagttgagtattgttttatgtgttggatctgggtcaaaatgtgtttattacattagatattctggatatgttggttgtttttgcttgcaaatttccattttttttcttg

SEQ ID NO: 12000 - DNA, 505 bp, Amborella trichopoda
ataactggctcttttttaggttgggtttagtggtagcacgttgtctgaacaataaaaccaccatgcagattttcgtgaaaaccctcactggtaaaaccattactctcgaggtagaagcctctgataccatcgaaaatgtgaaagccaagattcaggataaagagggaattccaccagatcagcagcgacttatctttgctggaaaacagctggaagatggacgtactctctctgattataatatccaaaaagaatccactctccatctcgtacttcgtcttcgagggggtgtaattgaacctactttgcgtatacttgcacagaaatataactgtgacaaaatgatatgtcgcaaatgttatgctcgtcttcatcctagagcaactaattgccgtaagaaaaaatgtggtcatacaaataacatccggccaaagaagaagttgaagtaaactaaatacccaagtttccattttcatgtggaaatggaaatatatatttcttatat

SEQ ID NO: 12001 - DNA, 493 bp, Chrysanthemum coronarium
cgacaccacgttgcagaataaggctgcaacatgcagatcttcgtcaagacccttacgggcaagaccatcactcttgaggtcgagccctcagattccattgagaatgtgaaggctaagattcaggataaggaaggtatccccccagaccagcagcgtctcatcttcgctggcaagcagcttgaagatggcaggacattgtctgactacaatattcagaaagaatctactcttcacttggtgctgcgtctccgtggtggtgtcattgagcccactctccgtatccttgccatgaagtacaactgtgacaagatgatctgccgcaagtgctatgcccgtcttcaccctagggcaactaactgccgcaagaagaagtgtggtcacacaaacaacctccgccccaagaagaagctgaagtagacttttattgttttatttgtgtttgggaggtgttccatctgtcatactcaatgttctattttaaattcaataaaac

SEQ ID NO: 12002 - DNA, 489 bp, Glycyrrhiza uralensis
ggtaacgtaattgggtttgggtctcgactcaagatattggaaatccaataaaccctagaaaaatgcgagtataaaaagccatcaccattctcaaatgcaaattatttttctttttcttttcagtaattaagaagaagaagaagcagcgatgcagatattcgtgaaaaccctaacggggaagacgataacactcgaggtggagagcagcgacaccatcgacaatgtgaaggccaagattcaagacaaggaagggatcccaccggatcagcagcgtctcatattcgccggaaagcaactcgaagatggaagaaccttagccgattacaacattcaaaaggaatcgacactacatctggtgctgagacttcgtgggggtatcattgagccatccttgatggctttagctcgcaaatacaatcaggacaagacgatctgccgcaaatgctatgctcgtttgcatccaagggctgtaaactgccggaaaaagaa

SEQ ID NO: 12003 - DNA, 507 bp, Arachis hypogaea
ggtttccagtcaaagcgttatcttagaaaccctaatcgtaaaaatccgacccctatatatcgtaaagtacgcagaaaccccaaaactaaccggggttttgtgaggggggagaaagagagaggtagagaacaaagaaagatgcagatcttcgtgaaaaccctaacggggaagaccatcaccctggaggtggaatctagtgacaccatcgataacgtcaaggccaagattcaggacaaggaagggattccgccggaccagcagaggttgatcttcgccggaaagcagcttgaggatggccgtacactcgccgattacaacattcaaaaggagtcgacattgcatcttgttttgaggcttcgtggtggaattattgagccatctttgatggcattggccaggaaatacaatcaggataagatgatctgccgcaagtgttatgcacgtttgcaccctcgtgctgtcaattgcaggaaaaagagtgcgggcacagcaaccagctgaggccaa

SEQ ID NO: 12004 - DNA, 430 bp, Pinus taeda
acgtgcgaccttggctgtcactcagaacgacacacgaagaaccgccaccatgcagatcttcgtcaagacccttacgggcaagaccatcactcttgaggtcgagtccagcgacaccatcgacaatgtcaagagcaagatccaggataaggagggaatccccccggaccagcagcgtttgatctttgccggcaagcagctcgaggatggccgcactctgagcgactacaacatccagaaggagtctactctccacctggtcctccgtctccgtggtggtatcattgagccatcgctcaaggctcttgcctccaagtacaactgcgacaagatgatctgccgcaagtgctacgcccgtcttcccccaagggccaccaactgccgcaagaagaagtgcggtcacaccaaccagcttcgcagtgagtgacaggcc

SEQ ID NO: 12005 - DNA, 531 bp, Nicotiana tabacum
catgcggccgctgcacctctttgagaaggctcctcaagaatgtctggtatgcaaattttcgttaagaccctcgcgggcaaaaccatcactctggatgtggactccagtgacaccatcgaggctgtcaagcagaagatccaagacaaagagggtatcccccctgatcaacaacgtctgatcttcgctggtaagcagctcgaagacggccgaaccctcgccgactacaacatccagaaagagtctactcttcacttggtgctccgccttcgaggtggtgtcattgaagcctctcttcaagtgcttgcccgcaagtacaacactgacaaggtcatctgccgcaaatgctatgcccgtctgtaccctcgtgccaagaactgccgcaagaagaagtgcggtcactccaaccaactccgacccaagaagaagctcaaataagcgttctgtacattctttgttccatcctctctatcttccttccccagcctgattaaattggtgacgttcttgagcggccgcatgaggggatcctct

SEQ ID NO: 12006 - DNA, 593 bp, Flaveria ramosissima
acacaagcaaaattagggttctgaaaatcggctgaagagaaaatgcagatcttcgtgaagacattgacggggaagacaatcacgctcgaggtcgaatcgagcgatacgatcgacaatgtcaaggctaagattcaagacaaagaaggaattccaccggatcagcagcgtctgatctttgctggaaaacaactcgaggatggaaggactctcgccgattacaacatccagaaagagtctacgcttcatttggtgttgaggctccgtggtggtattattgaaccttcgttgatggctttagctaggaagtataaccaggataaaaccatctgccgcaaatgttacgctcgtctccatcctcgtgctgtcaactgcaggaagaagaaatgtgggcacagcaaccagttgaggccaaagaagaagatacaagtagacgacgatgttactatgcgtgttttagaaagaaagatattttacatgtaagggtggtgcttttgttttacatcacttttgaatgtttctggaagatctttagacccttaaatattaagtctggtgatttttataagctattgtaatgactttgatgttttaag

SEQ ID NO: 12007 - DNA, 568 bp, Cucurbita pepo
ggaaaaaaaggagccaagaaaaatgcagatcttcgtcaaaaccctaacggggaagaccattacgctggaagtagagtccagcgacactattgacaatgtcaaggcgaagatccaggacaaggagggtattcccccagaccagcaacgactgatctttgctggaaagcagctcgaggatggccgcactctcgccgactacaacatccagaaagaatcaacacttcatctggttttaaggcttcgtggcggtataatcgaaccatctttgatggcactggccaggaaatataaccaggacaagatgatctgccgcaaatgctatgcacgcctgcatcctcgtgctgtcaactgccggaaaaagaatgcggacacagcaatcagctgaggccaaagaagaaaatcaagtagaatgctgatgatcccaagaagaaaatgttatggtacctgcttcattcacttgctgtcttcttcttgtagagccttagattatgttctcattagtattgatacaacttttgtagtttgactcaagtttggatggtttacattgattatgagtgatgatgtg

SEQ ID NO: 12008 - DNA, 511 bp, Chrysanthemum coronarium
ccgccgttgagagagtgagagaaagaagaaacaaaaatgcagatcttcgtgaaaacattgacagggaagacaataacccttgaagtcgaatcctcggacaccatcgataatgttaaggccaagattcaggacaaagaaggtattccaccggatcagcagaggttgatatttgccggaaaacagcttgaagatggtcgtactcttgctgactacaacatccagaaagagtcgactcttcatttggtcctaaggctgaggggaggaatggggaagacgataaagattgagccttatttgatggggttggctaggaagtccaaccaattcaaggctgtttgccgcaagtgttatgcccgtcttcccccaagggctgtaaactgcaggaaaaagaagtgtggccacagcaaccaacttaggcccaagaagatgatcaggatggaatgagtgtttggagtgttggagaggaacttgtctcgttatttttagaacttgtcttgtttttaactacgta

SEQ ID NO: 12009 - DNA, 630 bp, Chrysanthemum coronarium
taagaaaaagaaccaaaaatgcagatcttcgtgaaaactttgacagggaagacaatcacactcgaggttgagtcctctgataccattgacaatgttaaggctaaaattcaggacaaagaaggtattccaccggatcagcagaggttgatctttgccggtaaacagcttgaagatggacgcactcttgctgattacaacatccagaaagagtcgactcttcatttggtcttaaggctgaggggaggaggaaagaaggggaaagtaaacattgagccttctttgattgtgttggctaagaagtacacccaagacaagaaaatttgtcgcaaatgttatgctcgtctgcacccaagggctgtaaactgtaggaagaagaagtgtggccacagcaaccaactaaggacaaagaagccgagcgaatggatctaaggctgaaaaagaagagcaaaagattcaggggggagtgttttgtctagtggagaggaacttgttatgtattcttcccaacttctgcatcttttttagtcgtttatgtttttaactgcctcagaaagtaaacttgctgaattgtttgtttaattcaagaagtaccactggtttaaaatttctctctttttctatgaagaggca

SEQ ID NO: 12010 - DNA, 576 bp, Zostera marina
cggaaatctcgttcgtcttgctcgtcggaaaagatgcagatttttgtgaagactctgactgggaagaccattactctcgaagtcgaaagcagcgatacgatcgacaatgttaaggcgaagatccaagacaaggaagggattccacctgatcagcagcgtttgatcttcgccggaaagcagctcgaagatggaagaactctcgcagattataacatccagaaagaatcaactctccatttggtgctgaggttaagaggtggaatcatcgagccttctctcatggctcttgccaggaagtacaatcaggagaagatgatctgtcgaaagtgctatgctcgtctccaccccagggcagttaattgcaggaaaaagaatgcggtcacagcaatcaactgaggccaaagaagaagatcaagtgagcaggtattggttgatccttcgtcacaagatttggatatttttctctcatttcaaaatctacttactactctcttgatttatatttagtcagtcataaatgaaagaacaaattttctactacaatttcaaatacatatattgaagaccaaaataacg

SEQ ID NO: 12011 - DNA, 573 bp, Conyza canadensis
ttgactggcaagacaatcacccttgaggtggaggcttccgataccatcgagaacgtgaaggccaagattcaggacaaggagggcattcccccggaccaacagcgcctgatcttcgccggaaagcaactcgaggacggccgcactctgtccgactacaacatccagaaggagtcaaccctccacttggtcctccgtctccgtggtggtatcattgagccttcgctgaaggcgcttgcctccaagtacaactgcgacaagatgatctgccgcaagtgctacgcacgtctgccaccgagggctgtcaactgccgcaagaagaagtgcggtcacaccaaccagctccgccccaagaagaagttgaagtaaactactcgcttctatcggcgtctggcgaagagagcaacggggtcggtggatacgaattgcaacgattgcatgcgatggatatgagggctaggtcactactacttcttccacggcacatggcatcaatggagtgcttgtcttgtctcgcatttgagactttatgaagggaaccaggcatgtagagtgaatcgattcaaattcaaaaac

SEQ ID NO: 12012 - DNA, 594 bp, Chrysanthemum coronarium
aagcgccgtttcgagagagaaaatgcagatctttgtgaaaactctgacagggaagacaatcacgctcgaagttgaatcatcagacaccatcgacaatgttaaggccaagattcaggacaaagaaggtatcccaccagatcagcagaggttgatatttgctggaaaacaacttgaagatggccgtactcttgctgactacaacatccagaaagagtcgactcttcatttggtcctaaggctgaggggaggaatggggaagacgataaagattgagccttatttgatggggttggctaggaagtccaaccaattcaaggctgtttgccgcaagtgttatgcccgtcttcccccaagggctgtgaactgcaggaaaaggaagtgtgggcacagcaaccaacttaggcccaagaagatgatcaggatggaatgagtgtttggagtgttggagaggaacttgtctcgttatttttagaacttgtcttgtttttaactacgtatgaaagtaaacttgttgaattgtttgtttgaacttgctgaattgtttgtttaattcaagaagcattcttgatttgatattgttagcctatttttgtg

SEQ ID NO: 12013 - DNA, 808 bp, Pinus pinaster
cattagaaagagtttctattggagttgatcgatctgggagacaagatgcagatcttcgtgaaaacccttactggcaaaaccataacccttgaggtcgagagcagcgatacgatcgataatgtgaaggccaagattcaggacaaggaagggattccacctgaccagcagcgtttgattttcgctggaaaacagctggaagatgggcgtactcttgctgactacaatattcagaaagagtctacgctacaccttgttttgaggcttcgtggagggattattgaaccttctttgatggctttggcaaggaagtacaaccaggacaagatgatttgcagaaagtgttatgcccgtttgcatcccagggcagtaaactgcaggaaaagaagtgcggacatagtaatcagctgaggcctaagaagaaaatcaaataaagcgtccgatttgaagcagatagtttatctgcacaaatttttgctgatttattgtcattccctttgagaagccaactggatttgaacatttatttttctaaaaaagaccatgttactatcatgtagaccgcagaatctgacccctctagccaggaaattatgttaccagttgggccagatttgaatagttgtggatgttatttccagatttgaatgtgaaattgtgttttacagagatttaatattagtacgttgccctttttttgatgatgtgatttactgcattttctaccacatgcccaattttttaccaatatttatatgtaaaactctcttgggtcgttggagtgcaaatgagaaattttattaaagactga

SEQ ID NO: 12014 - DNA, 498 bp, Pinus pinaster
tggaattaatttccgtaaaaaaatgcagatcttcgtcaagacccttacgggtaaaacaattaccctcgatgtcgaggcctctgactcaatcgaaaacgtcaaggccaagatccaagacaaggaaggtatcccacctgatcagcaaagactgatcttcgccggaaagcaactcgaggacggaagaactctttctgattacaacatccagaaggaatcaacccttcacttggtcttgagattgagaggtggtgctattgaacccaccgtcgctgctttggccagaaagtataacgctgataagatgatttgccgtaaatgctacgccagactcccattgaaggcacacaactgcagaaaaagaaagtgtggacactccaaccaacttagacccaagaagaagcttaagtaagaggcatatagaattcatggctattgtgtgttttatattttacgtgggtcatgctatattccaatgttattgctgaactgaatttaaag

SEQ ID NO: 12015 - DNA, 444 bp, Silene vulgaris
atcttcgtcaagactctcacgggtaaaaccattactctcgaagtcgaaccttcggacaccattgaaaatgtcaaggcaaaaatccaagataaggaaggaattcctcccgatcaacaacgtttgattttcgccggaaagcaattggaagatggtcgtactttatccgactacaacatccaaaaggaaagtaccttgcacttagtcttacgccttcgtggtggtaccatcgaaccaactctccgtatgttagcgcaaaagtacaactgtgacaaggtgatctgtcgcaaatgctacgctcgacttcacccacgtgctgtcaactgtcgcaaacgcaaatgcggacatacaagcaacttgcgaccaaaaaagaaactcaaataaaacgatggcattgggactcgttttcttttgtttttccgcacatgtttaaacagacaaaagcag

SEQ ID NO: 12016 - DNA, 877 bp, Picea glauca
ctaacggagttgatcgatcagggcgaaaagatgcagatattcgtgaaaaccctcacagggaaaaccataacccttgaggtcgagagcagcgatacgatcgacaatgtgaaggccaaaatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgcccgtttgcatccgagggcagtgaactgcaggaaaagaagtgcggacatagtaatcagctgaggcctaagaagaagatcaaaataaagcgtcttgagtttgaagcagatagttatctgcacaaattttgctgatttattttcattgcctttaaaaagccaattggattaaacgtttattttcttaaaaagactgtatgttacaatcatgtagactgcagaactggctctctagccagaatttatctttgtgcttttagttgggccagatttgaatagctgtagatgttatagttttgagtttgaagttgtgttttgttttttaaagagattaaatatttgtacgttgctcttttcattcaattatgtgatttactgcattttctacccgaggctcaattattttcacattcatatgtaaaactctcttgcatccgtgtagtatactgtatataacttcatctttggagtgcaaatgagaaattttaactaaaggctatcaaagttgtgcctagagaagaggcccttattgggaagctcaaaaaaaa

SEQ ID NO: 12017 - DNA, 530 bp, Eutrema parvulum
cattggtgcgcttgaagaagaaattggggaaaaatgcagatctttgtgaaaaccctaactggcaagaccatcactctcgaggtcgaaagcagcgacaccatcgataatgtcaaggccaagattcaagacaaggaaggtatccctccggatcagcagagattgatctttgccggaaagcagctcgaggatggccgtaccttggctgactacaatattcagaaagaatctacacttcatcttgtgctgaggcttaggggaggcatcattgaaccttctttaatggcattggctcgcaagtataatcaagacaagatgatctgccgcaagtgctatgctcgtctccacccaagagcagttaactgcagaaagaagaagtgtggtcacagcaaccaggtaaagtctttgccaccaatcaatttaaacatgttcggttcaattccagtagatagatgatttatacactttgttgggttgttttcttattgtttattgcagttgaggccgaagaagaagatcaagtaattgatgga

SEQ ID NO: 12018 - DNA, 606 bp, Orobanche aegyptiaca
gaccgggaaaaccataacgctcgaggtcgaatcgagcgacaccatcgacaacgttaagactaagattcaagacaaggaaggaataccaccggatcaacagcgtttgattttcgccggaaaacagcttgaagatggccggactctcgctgattataacattcagaaagagtccactttgcatttggttctgcggctaaggggtggcatccttgagccgtcgcttaaggtattggcccaggaatacaaccagcacaagacgatttgccgaaaatgttatgctcgcctgcacccccgtgctgtcaactgtaggaagaagaaatgtggacacagcaaccagttgaggccaaagaagaagtccaaatacgtatgatgacaacctatgcttactagacgtattttcagtgtttctgtggtagtgttttttaaatttccaaaacgttgttattttgttgaaacgggttaaactcgtggaccttgtttgattttgattcgggttaaacttcgtgagagttggtctcgggttaaacattgtgggagttgtttgattttacttaaatttacaatttgatattatttctgatctgttgcttgaacatcggtttgcca

SEQ ID NO: 12019 - DNA, 637 bp, Centaurea maculosa
ggaagagagagtggcaggtaaagatgcagatcttcgttaagactctgaccggcaagacgatcacgctcgacgtcgagccatcggacagcattgacaatgtcaagcagaagatccaggacaaggaaggcatcccgccagaccagcagcgcctgatctttgccggcaagcagctcgaggacggccgcacgctttcggactacaacatccagaaggagtcgaccctgcacctcgtgctccgcctgcgtggtggtatcattgagccaacgctcatggccctcgccaagaagcacaacgtcgagaagaagatctgccgtgtctgctacgcgcgtcttccgccacgtgccaccaactgccgtaagaagaagtgcggccacagcaaccagctccgcatcaagaagaagctcgctaaataagcagtgaggcccgcaggccccctcactgtgcgctccgcttcggtgcgacatcgacactctttctctgctgcttctctcgggcggttcgtgatttccatttcatccgctgcatggcgctgctccgcgtccgcgtccctggtctcgcggatacggcggcgccgctgtagtggctggaggcaatcgtaatgcaagtggaaatatgaataatggctgagagtgggctc

SEQ ID NO: 12020 - DNA, 542 bp, Sarracenia psittacina
atcggattcttcttgatggcgcttcttcagcttagccgcggatagggacttgataaaaaatattgaatttgaagaagaaatgaataatttgtaaacgaggtttcgtattcttgagaaaaattggtgtctcacatcaagatgcagattttcgtgaaaaccttgaccggtaaaacgatcacactcgaagtcgagccttcggattcgattgaaaatgtgaagcaaaagatccaagataaggaaggaattcctcctgaccagcaacgtttgatcttcgccggaaagcaattggaagatggcaggactctgtccgattacaatattcaaaaagaatcaactctacatctggtgttacgtttacgtggtggtgttatcgagcctacccttcggcagttagctgaaaagtacaattgtgagaagatgatttgtcgcaagtgttacgccagacttcacccgcgtgctacgaattgccgtaaaaagaagtgtggacacaccaataacttacgtccaaagaagaagctcaagaagtaataatatagtttcac

SEQ ID NO: 12021 - DNA, 391 bp, Flaveria ramosissima
agcatcgaatcctatcaaaatgcagattttcgtgaaaaccctgacaggaaagataatcacccttgaggtcgaatcttctgataccatcgataatgtgaaatctaagattcaggataaggaaggtattcctccagaccaacaaagattaatttttgctggcaagcaactcgaagatggacgcaccctctccgattataacatccagaaagaatctacgctccatctggttctcagattacgtggtggtgttattgaaccatccctcaaggttcttgcttccaaatttaactgtgagaagatgatttgccgaaaatgctatgctcgtctccctcctcgtgcgaccaactgcagaaagaagaaatgtggccacaccaaccagcttagaccaaag

SEQ ID NO: 12022 - DNA, 492 bp, Arachis hypogaea
ccctgtgtgccttggcagtctcagaagcagtggtatcaacgcagagtacggggggaagaagaagaagaagaagatgcagatattcgtgaaaaccttaactgggaaaaccatcactctcgaggtagagagcagtgacaccatcgacaatgtcaaaaccaaaatccaagacaaggaaggaatcccacctgatcaacagcgtctgatatttgctgggaagcagcttgaagatggaaggaccttagctgattacaacattcaaaaggagtctactctgcatcttgtgctgaggctccgtggtggtatcattgagccttctttgatggctttggctcgcaagtacaatcaagacaagatgatttgccgcaaatgctatgctcgtcttcatccaagggccgtaaactgccgacaaaaagaagtgtggccatagtaatcagttgaggccaaagaagaagatcaagtaaactatgtctgttcttgtttgtcttcttcagt

SEQ ID NO: 12023 - DNA, 426 bp, Primula obconica
ctttgaagtgtactaagcagttaccgacaccacgttgcagaataaggctgcaacatgcagatcttcgtcaagacccttacgggcaagaccatcactcttgaggtcgagccctcagattccattgagaatgtgaaggctaagattcaggataaggaaggtatccccccagaccagcagcgtctcatcttcgctggcaagcagcttgaagatggcaggacattgtctgactacaatattcagaaagaatctactcttcacttggtgctgcgtctccgtggtggtgtcattgagcccactctccgtatccttgccatgaagtacaactgtgacaagatgatctgccgcaagtgctatgcccgtcttcaccctagggcaactaactgccgcaagaagaagtgtggtcacacaaacaacctccgccccaag

SEQ ID NO: 12024 - DNA, 534 bp, Utricularia gibba
gtcgaatcgagcgatactattgataatgtcaaggctaagattcaggacaaggaaggaattccaccggatcagcagcgtttgattttcgccgggaagcagctcgaggatggaagaacacttgcggactataacatccagaaagaatctacactccatttggtgctgaggctcaggggtgggattattgagccatctcttatggctctggccaggaagtataatcaggataaaatgatctgccgcaaatgctatgcccggctgcacccaagagctgtcaactgcaggaagaagaagtgtggacatagcaaccagttacgggttaagaagaagatcaagtagagtgcgcagggaagagctgttgctgctgttggtcgtctgcactttaacattgaacggcggcgtcgtgttgtgtttcgtctctattaatcaaatgttgtgagtaacccaattgggtattggaattatttatttcatcaaacccaacaggcaacagccataacttaattatttatgcgaaaagaatcaaaatgtttc

SEQ ID NO: 12025 - DNA, 1047 bp, Brachypodium distachyon
gcgcgccaccattagagcgccggactcccaactccggcaggtagggtttcggtccttgcccagcgggtgggcgtggcgcgccgcctatataaagaccgctccctcccttccgccgccatcaccatctcctcactccagtacacgcgcgcgatccggagtcaggggctagaggctagagctcgggaaggaggggaagcagggagagccaaggcaagtagaggttcgaggtagaggagatgcagatcttcgtgaagacgctgacggggaagaccatcaccctcgaggtcgagagcagtgacaccatcgacaatgtcaaggccaagatccaggacaaggaaggcatccctccggaccagcagcgccttatctttgccgggaagcagctggatgatggccgcaccctggccgactacaacatccagaaggagtccactctccacctcgtgctgcgcctccgcgggggtagcagcataatcgaacccaacctccgggccctcgcacaaaagcacaaccaacgcaagcagatctgccgcaagtgctattcccgcttgcccctcaaggctcagaattgccgcaagaagaagtgtggccacagcaaccagctgcgggcaaagaagaagtgcaggtactgctgaagtgcaagcatcggttggatcagttgttacttgtctcagcttatcagaaatgttggagttctaagttttaactatcttactgtaatgtcttggtggatgttgagcaccgtcttttgaatacttggctatgtttggatgcatgcctaagacatgatatcttttgaatactcggctatgttcggatgcatgtttaagacatgaatgtaatatggtactcacctcaactcttttggctggagtgagcacttatctaatttctatatatgctgtttattttctaccttgcatcgccggctcaccttggtattttgtgttgcttttgctgggtcatacaccaaatccgatctggctatgagatttctagttggctttttgtcagggtcaaaactgtgatctcaaatgtccaaatcag

SEQ ID NO: 12026 - DNA, 642 bp, Cucurbita pepo
aggaggtcagtgtcgcgaaggcagagttgctaaccagagagagccttaacgacgacacgacaggatgcagatcttcgtcaaaacccttactgggaagacgattacgttggaagttgagtccagcgacaccatcgacaatgtcaaagctaagatccaggacaaggaaggtattcctccggaccagcagaggcttatcttcgctgggaagcagcttgaggatgggcgaactctcgccgactacaacatccagaaggagtcaactctgcacttggtgctcaggcttcgtggtggtattattgagccttctttgatggctttggctaggaagtacaatcaggacaagatgatctgccgcaagtgctatgcccgcctgcaccctcgtgctgtcaactgcaggaaaagagtgcggacacagcaaccagttgaggccaaagaagaagatcaagtagaccattgatttggagagaggagagctatgcaaaagtttatgttttatttattttgggtgcatttatgctcagaactatttgctttaacactcattaggagttggaattgttgtaatttttgttctgcgacattctcagttatggtatgttatgttcttgactttgtagtaccaaatcttcggtcattttattt

SEQ ID NO: 12027 - DNA, 632 bp, Brassica oleracea
cccagtccaataatatacaaaaccctagaaatgaaaggtataagaatcccttcctgtatggttacgcggccagaacacaagaagccaacaaagatgcagatcttcgtgaaaaccctgaccgggaagaccatcaccctcgaggtcgagtcctccgacaccatcgacaatgtcaaggccaagatccaagacaaagaaggtatccctccggatcagcagcgattgatcttcgctggaaaacagctcgaagatggccgtactctggctgactacaacatccagaaagaatccacccttcatcttgtgttgaggcttagaggaggaatcatcgagccttctttgatggcgttggctcgcaagtacaaccaagacaagatgatctgccgcaagtgctatgcacgtcttcacccgagggctgtgaactgcaggaagaagaagtgtggccatagcaaccagttgaggcccaagaagaagatcaagtagactctgttcaaggaactatcttgctggcttgcttgcctcttttttttctttgccttctcgagttgttttgtttcactgaatttttatgttatcttcaaagattatatcagtaaaaggatttgttgatctgcttatgctgaattaattatttg

SEQ ID NO: 12028 - DNA, 463 bp, Bupleurum chinense
gaggttgaatccagtgatactatcgacaatgttaaggctaagatccaagataaggaaggaatcccaccggatcagcagcgattgatcttcgccggcaaacagcttgaagatggccgcactcttgctgattacaacgtccagaaagagtcaacgcttcatctggttctgaggctgcgtggtgggattattgagccttctttgatggctttagctagaaaatacaaccaagaaaagatgatttgccgcaaatgttatgcccgcctgcatcctcgtgctgtcaactgcaggaagaaaaagtgtggtcacaccaaccagctgaggccaaagaagaagattaagtagacaatgtcaagtttctatctgctagttgcagccgctgtttctctgctgcgtttgttattgtgttcaatgagactcagtgagcaaaatcatcacttttcaatatttggttgttttgtctaaa

SEQ ID NO: 12029 - DNA, 576 bp, Festuca arundinacea
catgcaaatcttcgtcaagaccctcacgggtaagaccattaccctcgacgttgagccatctgactcaatcgaaaacgtcaaggctaagatccaagacaaggaaggtatcccacctgatcagcaaagacttatctttgccggaaagcaattggaagatggcagaaccctttctgactacaacatccaaaaggaatctaccctccatttggtcttgagactcagaggtggtgctattgaacccaccgtcgctgctttggccagaaaatacaacgctgataaaatgatttgccgtgtttgctatgccagactcccattaaaggcccacaactgcagaaagagaaaatgcggtcactccaacagactcagacccaagaagaagcttaaataagagtacaagcagcatattttgcaagagaaattgcatacttgtgtttttgagtttatgatatggtgtattccaatattttgtacctgaaccgagaattaataaactataacaatagcatggctcaaagagataggttatttaaaaaaaaaaaaaaaaaaaaaaaaaaaaaaaagaaaaaaaaaaaaaaa

SEQ ID NO: 12030 - DNA, 412 bp, Solanum tuberosum
gttaagactttgactggtaaaaccatcactctcgaagttgaaggatctgactccattcaacaagtcaaacaaaagatccaagacaaagaaggtattcctccagatcagcaacgtcttatctttgccggaaaacaattagaagatggtcgtactcttgctgactacaacatccaaaaagagagcacccttcacttggttctccgtctcagaggaggtgttatcgaaccatctcttgctgtcttagctcgcaaatacaactgtgagaaaaagatttgcagaaaatgctatgccagattacatccacgtgcaaccaactgcagaaagagaaagtgcggacactccaaccaattgagacttaagaagaaactcaagtaaatattgggctaatgcaacaatttttaaataaatctgt

SEQ ID NO: 12031 - DNA, 443 bp, Sarracenia psittacina
cgtgactaaaaatctggtgcacacgtttttaaaaaaagcgccatcgtcaacatgcagatttttgtaaaaacactaaccggcaagaccatcacattagaggtcgagccgtccgacactattgaaaatgtaaaggcaaagatccaggacaaggaaggcattcccccagaccaacaacgtctcatttttgccggcaaacaattggaagatggacgtaccctatccgattacaacattcaaaaggaatccaccttgcatttggcacttcgtttacgtggtggtatcattgagccgtctcttcgtattttggctcaaaagtacaattgcgacaaaatgatctgtcgcaagtgttatgctcggcttcatcctcgcgcaaccaattgccgtaagaagaagtgcggacacaccaacaatctcgcccaaagaagaagctaaagtaagcttta

SEQ ID NO: 12032 - DNA, 438 bp, Triticum aestivum
gcttcagagcgctgtagacgatatgcagattttcgtcaaaacgttgacggggaagaccatcactcttgatgtcgatggtgcggacaccattgaggctgttaaaaccaaaatccaggacaaggaaggcatcccgcccgatcagcagcgtctgattttcgctggcaaacagctcgaagatggccgcactttggctgattataacattcaaaaggaatcgactctccacttggttcttcgcttgcgtgggggtgtaatggagccctcgttgaaggctttggctatgaagtacaactgtgagaaaaagatctgccgcaagtgctacgctcgtctaccaccacgtgcacacaactgccgcaagcgcaagtgtggacatagcaatcagctccgtgataagaagaagcccaaataaatgaacggcctgcgttatatttttaagtt

SEQ ID NO: 12033 - DNA, 423 bp, Triticum aestivum
tttgaagtgtactaagcagttaccgacaccacgttgcagaataaggctgcaacatgcagatcttcgtcaagacccttacgggcaagaccatcactcttgaggtcgagccctcagattccattgagaatgtgaaggctaagattcaggataaggaaggtatccccccagaccagcagcgtctcatcttcgctggcaagcagcttgaagatggcaggacattgtctgactacaatattcagaaagaatctactcttcacttggtgctgcgtctccgtggtggtgtcattgagcccactctccgtatccttgccatgaagtacaactgtgacaagatgatctgccgcaagtgctatgcccgtcttcaccctagggcaactaactgccgcaagaagaagtgtggtcacacaaacaacctccgcccca

SEQ ID NO: 12034 - DNA, 799 bp, Triticum aestivum
gaggcgagggagcggagcatcgacgagatgcagatcttcgtgaagacgctgacggggaagaccatcaccctagaggtggagagcagcgacacggtcgacaacgtcaaggccaagatccaggacaaggaaggcatccctccggaccagcagcgcctcatcttcgcggggaagcagctggacgatggccgcaccctggccgactacaacatccagaaggagtccacgctgcaccttgtgcttcgcctccgcgggggcaccaggatcgagcccagcctcaaggaactcgctcagaagtacaaccagaagaaactgatctgccgcaagtgctattcacgcctgccgctcagggctacgaattgccgcaagaagaaatgtggccacagcaaccagctacggctaaagtcgaaaaggcgttggttctgttgaagagccacacatcagttgaatcagttatctacttgtctcagcttatcaagactgtcagaaattttaaatgtcttggtgtaatgttcctgttggatgtggagcattgtctcttttgaacagttggttatgtttcgctgcatgcttaggacatgtgatgattgtaatatggcagcttaactctttttggctggattgagcacttacctaatttctatacatgctactctgttttcaatcttgcatcgactgctgatgttggacctttgtgttgcctgatatgctagatccttgattggattactagaatgattgaatccttcccatctgtttccggctttttcatgaaataggtcatgacatgtggccttccaac

SEQ ID NO: 12035 - DNA, 454 bp, Marchantia polymorpha
gtcatacatataccatgcaaattttcgtcaagactttgactggcaaaaccatcaccttggaagttgagggaggtgacaccattgagaatgtcaagcaaaagattcaagataaggaaggaatccctccagatcaacaaagattgatcttcgctggaaagcaattagaagatggaagaactttgcaagactacaacattcaaaaggaagcaacacttcacttggtcttgagattgagaggaggagtcatcgaaccaacccttcaagtcttagcaagaaagtacaactgtgagaaaatgatttgcagaaagtgttatgctagattgccagcaagagcaacttcttgcagaaagaagaagtgcggtcactcaacctcattgagaccaaagaagaagttgaagtaagcgtaaatgccttttccccattcaaagtaaatgttcgaacattctaaaaaaca

SEQ ID NO: 12036 - DNA, 809 bp, Ananas comosus
tccgacaccattgacaatgtcaaggccaagatccaagacaaagaaggaattccgccggatcagcaacgtttgatctttgcagggaagcagcttgaggatggacgaaccctagccgactacaacatccaaaaagagtcgacgctgcatctagtgcttaggttgagaggtgggatcatcgagccgtcactcatggctctcgcgaggaagtacaaccaggacaaaatgatctgtaggaagtgctatgctcggttgcatccaagggctgtcaattgccggaagaagaaatgtggtcacagcaatcagctgaggccaaagaagaagatcaagtaaatttctcagttgtttgcttcccgtgttatggtactactctatctgaatgctgaacatgtggtttggtattttcttgtacttccatatcactggttttagttttgttggctaaacagactatatcattttggcagtgctatattttagtcctcaatgaagtagacttttcatcttttatattttccgcaaatgaaaacttttcctggaaattagtttttcaagatttgtctttctcatattgtatgaattcatgttcaccatgcatataattttatctttacgttatggcactttttgttgtccaaaatggttgaagtggaaaaagtcacttttataaaagtaattctcacgaaagtgatttttaagtttgattgtttggttgactataaagtgaaacataaaaaattataattttctagttttgattctttaaataattaaagacgtgaaaatataaataaacgatttatactcgcaat

SEQ ID NO: 12037 - DNA, 602 bp, Picea glauca
atgcagatattcgtgaaaaccctcacagggaaaaccataacccttgaggtcgaaagcagcgatacgatcgacaatgtgaaggccaaaatccaggacaaagaagggattccacctgaccaacaacggttgatcttcgctggaaaacagctggaagatggtcgtactcttgctgactacaatattcagaaagagtctacactacaccttgttttgaggcttcgtggaggaattattgaaccctcgttgatggctttggcaaggaagtacaaccaggacaagatgatttgcagaaagtgttatgccggttgcatccgaggcagtgaactgcaggaaaagaagtgcggacatagtaatctagctgaggcctaagaagaagatcaaataaagcgtcttgagtttgaagcagatagtttatctgcacaattttttgctgatttattttcattgcctttaagaagccaattggattaaacgtttattttcttaaaaaagactgtatgttacaatcatgtagactgcagaactggctctctagccagaatttatctttgtgcttccagttgggccagatttgaatagctgtagatgttattagttttgag

SEQ ID NO: 12038 - DNA, 595 bp, Volvox carteri
tagaacacaaccatgcagatcttcgtcaagaccctgacgggcaaaacaattacgctcgacgtcgagcccagcgatacgatcgacaatgtcaagaccaagatccaagacaaggagggaatccctcccgatcaacagcgcttgattttcgccggaaagcagctcgaggacggccgaaccttgtcagactacaacatccagaaggaatcgactttgcatctcgtattgcgacttcgtgggggtgtttacgatcccacccttgccttgttggccaagaaatacaactgtgagaagtccatctgccgtaagtgctatgctcgtcttccacccaaggccaccaactgcaggaagaggaagtgtggacattcctcacagcttcgccccaagaagaagctcaagtaagctatgtctgtagataggatgtgggtggttgcgaagctgtcgaggggtgttggagtatttttggttgttcagcacacttgttatccgccggaataggtgtggtgatgggtggcgttggtttgcgtgggaatacttcgtatcgtgataaccatccactcactgtgatagtaaattaaagagacgagaaatcattcat

SEQ ID NO: 12039 - DNA, 813 bp, Triticum aestivum
agagttcagagtgcagaccacccaccactgtctccctccccccttcagttccgtagagctcgcgaaggaggaagcaggaacaggcgaagcggcgggagaggaggaccgacgagatgcagatcttcgtgaagacgctgacggggaagaccatcaccctcgaggtcgagagcagcgacaccatcgacgccgtcaaggccaagatccaggacaaggaaggcatccctccggaccagcagcgcctcatcttcgcggggaagcagctggacgacggccgcaccctggccgactacaacattcagaaggagtccacgatccacctcgtgcttcgcctccgcgggggcggctgcatgatcgagcccaacctcaaggccctcgctcagaagtacaaccagggcaagctcatctgccgcaagtgctattcacgcctgcctcccaaggccaagagttgccgcaagaagaagtgtggccacagcaaccagctgcggtcaaagaagaagtgtaggtactgctgaagtgccatgaatcggctgactgcttgtttaagcttgccagaactgtcagagttttaagtatcttgatgtaatgttcctgctggatgttgagcgctgtctcttttgaaaacttggtctagggttccggtgcatgctcaagatatgattgtagtatgacagcttagcgcttttggttggagggagcatttatctaatttatctatgtgctgttcttgttgttttcgatcttgaatcaactgctggtcttgtcgttcgtgccctttgtgctgcttgctatgtcagtcattgatcgggtaatgat

SEQ ID NO: 12040 - DNA, 437 bp, Triticum aestivum
caatcaacatgcagatcttcgtaaagactcttactggaaagacgattacccttgaagtcgaaccagctgactccatcgacaacgtcaaacaaaagatccaggataaagaaggaatcccaccagatcaacaaagacttatcttcgctggaaaacaattagaagatggccgaaccctctctgattacaatatccaaaaagaatcaacacttcatttggtccttcgtctccgtggtggtgttattgaaccatctctcgttcttttagccagaaagtacaacgcagacaaaaagatttgcagagattgctatgctcgccttgacccaagagccaccaactgcagaaagaagaaatgtggacactcatctgacttgagaatcaaaaagaagggaaagaacgctttgaaataaataaagaattctgcatgttgaaaaaaaaaa

SEQ ID NO: 12041 - DNA, 489 bp, Cephalotaxus harringtonia
gaccatcaccctcgaggtcgagtcctctgacactatcgacaatgtgaagagcaagatccaggacaaggagggcattcccccggaccaacagcgcttgatcttcgccggcaagcagcttgaggacggccgcaccctctccgattacaacatccagaaggagtctaccctccacctggtcctccgcctccgtggtggtatcattgagccttcgctcaaggcccttgcctccaagtacaactgcgacaaggccatctgccgcaagtgctacgctcgtctccctccccgtgccaccaactgccgcaagaagaagtgcggtcacaccaaccagctccgccccaagaagaagctgaagtaaactactcgctctcggctggcgcgcattgttcgacagaggaagactcggacatgggagttgtttttggtggaatactacggcggactcgtatgataggtagcgggaaatgccaactctgccatgtttgaatgaaa

SEQ ID NO: 12042 - DNA, 561 bp, Chrysanthemum coronarium
accattgacaatgttaaggccaagattcaagacaaggaagggattccaccagaccagcaacgtttgatctttgctggaaaacaattggaagatggaaggactcttgctgattacaacatccaaaaggagtcaacgttgcatttggtgttgaggctacgtggagggattatcgagccttctttgatggctttggctaggaagtacaaccaggacaaaactatctgccgcaaatgttatgctcgcctccatcctcgtgctgttaactgcagaaagaagaaatgtggtcacagcaaccagttgaggcccaagaagaagatcaagtagatgatcatgtcatggtactggcttttgaaggatatgttgtaattgtaagtgtgcgctttgttgtacaccagttctgaatgtttatggagtatgttttaaaccctgaattttatgttagcacattgacatctttataagcttttgttgtgttattttaatctttctattagcggtctatattggtgaatgaagtgtaatgagtcatgacttttttcagattcagcgaattttggatca

SEQ ID NO: 12043 - DNA, 737 bp, Picea glauca
agtgtttagttccacagttgtcgtggggaaattgggaaattgttggcagcgagcaagatgcagatcttctaaagaccctgacgggcaagaccataaccttagaagttgaaagcagcgataccatcgacaatgtcaaggccaaaatccaggacaaagaagggatccctcccgaccagcaacgtctgatctttgcgggcaagcagttggaagatggccgtactctggcggattacaatattcagaaagagtctaccttgcaccttgtgctcaggctccgtgggggcattatagaaccttctttgatggcactggctaggaagtacaaccaggacaagatgatttgcagaaagtgttatgcccgtttgcatccgagggcagtgaactgcaggaaaaagaagtgtggacatagtaatcagctgaggcctaagaagaagatcaaataaagcgtcttgagtttgaagcagatagtttatctgcacaaatttttgctgatttattttcattgcctttaaaaagccaattggattaaacgtttattttcttaaaaagactgtatgttacaatcatgtagactgcagaactggctctctagccagaatttatctttgtgcttttagttgggccagatttgaatagctgtagatgttatagttttgagtttgaagttgtgttttgttttttaaagagattaaatatttgtacgttgctcttttcattcaattatgtgatttactgca

SEQ ID NO: 12044 - DNA, 394 bp, Arnica chamissonis
ccggaaaaaccataaccttagaggttgagagcagcgacaccatcgacaatgtcaaggccaagatccaggataaggaaggtatcccaccggatcagcagaggttgatctttgccggaaaacagcttgaagatggccgaactcttgctgattacaacatccagaaagaatctactcttcatttggttttgaggctgaggggaggaatcattgaaccctctttgatggcattggctaggaaatacaatcaagacaagaccatttgccgcaagtgttatgctcgcttgcacccgagggctgtaaactgcaggaagaagaagtgtggtcacagcaaccaactaaggccgaaaaaagaagaattaagtgaacagatttgtgtgggttatttgctggaaga

SEQ ID NO: 12045 - DNA, 923 bp, Hordeum vulgare
cacagccgcctccagagttcaaaccacccatcaccgtctccctccccccttcagttcggagagctcgagaaggaggaaggcgaagcggcgggagcggagggccgacgagatgcagatcttcgtgaagacgctgacggggaagaccatcaccctcgaggtcgtgagcagcgacaccatcgacaacgtcaaggccaagatccaggacaaggaaggcatccacccggaccagcagcgcctcatcttcgccgggaagcagctggacgatgaccgcaccctcgccgactacaacatccagaaggagtccacgatccatctcgtgctccgcctccgcgggggcgcctgcctgatcgagcccaacctcaaggccctcgcccagaagtacaaccagggcaagctcatctgccgcaagtgctactcacgcctgcctcctaaggccaagagttgccgcaagaagaagtgtggccacagcaaccagctgcggtcaaagaagaagtgcaggtactgatgaagtgccatgaatgatcagttcaaccggttgactacctgtttaagcttgccagaagtgtcagagttttaataagcatcttaatgtaatgttcctgctggatgctgagcgctgtctctttcgaaaacttgttttatggttccggtgcatgctcgagacatgattgtaacatgacagcttagctgttttggctggagggagcacttgtctaatttatcaatgtgctgttcttgttgttttcaatcttgcatcttctgctggtctggttattttgcgccttttgcgctgcttggtatgccggaccattgatagggcaatgatatcgtttttacgaagtaggaatgttggatgtatacaccttctagcctggttagttactcactagtacaaatgcccgtgcgttgcaccgggcaaaaaa

SEQ ID NO: 12046 - DNA, 652 bp, Glycine max
gaaattgaaaccctagaatggagagtataaatgcactgggttgcagggttagcattagttctctggaagaggagtgaagcagcagagggaggagcggcattaaaaatgcagatcttcgtgaaaaccctaacggggaagaccataaccctcgaggtcgaaagcagcgacaccattgacaatgtcaaggctaagattcaagacaaggaaggcatccctccggatcagcagcgtttgattttcgccggaaagcaacttgaagatggaaggaccttggccgattacaacatccagaaggaatcaacccttcaccttgtcctcaggcttcgtggtggcatcatcgagccttccctcatggctttggctcgcaaatacaaccaggacaagatgatttgccgcaaatgctatgctcgtctgcaccctagggctgtgaactgccgtaagaagaagtgcggtcatagtaaccagttgaggcctaagaagaagatcaagtaaattctgggtgggatattgttggtctctactttcgttttgtttgtcttagaacagtgacttgtttggtatttatcgtttctggttttgattaatgttaattgttttgagacaatagttttgaactagtcaattatatttttatgatgccattttggtctta

SEQ ID NO: 12047 - DNA, 705 bp, Oryza sativa
cacacacttgttgccacaccaccgatatcgaattagccaaaagtttgttagtaccactgccttgcgagatccacgtctctgcaagatgcagatcttcgtgaagaccctgacggggaagaccatcaccctcgaggtcgagagcagcgacaccatcgacaatgtcaaggccaagatccaggacaaggaagggatcccgccggaccagcagcggctgatcttcgccgggaagcagctggaggacggccggacgctggccgactacaacatccagaaggagtcgacgctgcacctcgtgcttcgcctccgcggcggcggccgcccgggctacccgatgatcgagcccaacctcctcgccctcgcccgcagcaagatggagaagaagatgatctgccgcaagtgctacgcgcgccttccctacaaggctaccaactgtcgcaagaagaaatgcggccacaccaacgagctgaggccaaagaagaagctggtatccaagctttctgtttgagaccacaatttgccattgctaagcttgcatgcagactcattgttctatatatggggacgtatcgcgtatcgtcatgcatagccgaataactaaattatttattatctagtaatttagtaccgtatctgtgttatttgaggtttttgttaagtctgaagcccctgctgaatgctgaactattattattattattattatta

SEQ ID NO: 12048 - DNA, 572 bp, Cyclamen graecum
accatcgacaatgtcaaggccaagatccaggacaaagaaggtattccgccggaccagcagagactgatcttcgccggaaagcagcttgaagatgggcgcactcttgccgactacaacatccagaaagagtcgactctgcatctggttctgaggcttaggggtggcattatcgagccatccttgatggctttggcaaggaagtacaaccaggacaaaatgatctgccgcaagtgctatgctcgtctgcacccacgagctgttaattgcaggaagaagaagtgtggtcacagcaaccagctaaggccgaaaaagaagattaagtagatgattaatcaaatcttcagtcttttcttattgtcttatattgccggcttgctcttgggacttctaaagttttgaaatcgctgttttggttggagactgttttccgtttcccccttattaagatgctgtaactgtttcgtaactcacatattcgtcatttgatgggagtattgcttggttctagttttgtgctgaaagtattagtattgcttggtcgggtctttcgatggtcgttttttgtgcaagtg

SEQ ID NO: 12049 - DNA, 614 bp, Jatropha curcas
tttggaaaccctaacgggaagccaaactctgaggtagagagcagcgacccattgaaatgtcaaagccagatccaggacaaggaaggaattccaccggaccagcagcgactgatcttcgctggcaagcagcttgaagatggccgaaccttggcggattacaatatccagaaagaatcgactcttcatcttgttttgaggcttaggggagggatcatagaaccttctctcatggcattggctcgcaaatacaatcaagataagatgatttgccgcaagtgctatgctcgtctgcatccaagggctgtaaattgccggaagaagaagtgcggtcatagcaatcagttgagacctaagaagaaaatcaagtaaactgtcacgcagagtgcattttggtgtttcgaactatatggatattagatttggaccttacttttcacttccttgtttgtttaagcattttagacgaggatttagcgagcctctatgtggtcaattttcatggaatgctgttaaatgactatgtttttcttgttatttttgttatcatagactgtctttatcaatgtacgacactttttggcatccaaattaaggaaaatataattttggcatct

SEQ ID NO: 12050 - DNA, 372 bp, Ostreococcus lucimarinus
atgatgatgttcgcgaacgcagtgacgggtaagaccatcaccttggaggtggagtcctcggacaccatcgacaacgtgaaggcgaagattcaagacaaggagggtatcccgccggatcagcagcgtttgatctttgcggggaagcagctcgaagacggtcgcacgctggcggattacaacatccaaaaggagtctacgctccacttggtgttgcgcttgcgtggtggtatcatcgagccgtccctcgttgtgttggcgaagaagacgaacgcggaccgggccgtgtgccgcaagtgctacgcccgccttccgccgcgtgcgacgaactgccgcaagaagaagtgcggtcacaccaaccaattgcgtcttaag

SEQ ID NO: 12051 - DNA, 491 bp, Pisum sativum
catcgacaatgtcaaggccaagattcaagacaaggaaggtattcctccggatcagcagcgtctgattttcgccggtaagcagcttgaagatggacgcaccttggccgattacaatatccagaaggaatctactcttcatcttgttctcaggcttcgtggtggaatcattgaaccttctttgatggctttggctaggaaatacaaccaagacaaaaccatttgccgcaaatgctatgctcgtcttcatcctagggctgttaactgccgcaagaagaagtgtggacacagcaatcaattgaggccaaagaagaagatcaagtagattctggttgatattgtttctcttttgctgtttgttctgagatacttttcattgttttggtttttaattctatcatgactaaagattttgtttttcttaatgttgaatgtagttggagtttaatttggtataatcattttgttatgacattatatttttctctctatgc

SEQ ID NO: 12052 - DNA, 463 bp, Secale cereale
gaagaccctcacgggtaagaccatcaccctcgatgtcgagtcgtcggactcgatcgaggccgtgaagcagaagatccaggataaggagggtatcccgcctgatcaacagcgcctgatcttcgccggcaagcagctcgaggatggccgcacgctcgccgactacaacatccagaaggagtcgacccttcaccttgtgctccgcctccgcggtggtgccatcgagccggcgctcgtcgagcttgcgcgctcgtacaacgtcgacaagaaggtttgccgcaagtgctacgcgcgcctccacccgcgtgcgaccaactgccgcaagaagaagtgcggtcacaccaaccagctccgcatgaagaagaagctcaagtaaatgcgctgcttcctcccacgatggcgacacgcgcacggtcgagcttgcggcgcgctgcgcaggccgtcgggttcttcgtcgatacaacat

SEQ ID NO: 12053 - DNA, 384 bp, Silene vulgaris
gctcctcaagaatgtctggtatgcaaattttcgttaagaccctcacgggcaaaaccatcactctggatgtggactccagtgacaccatcgaggctgtcaagcagaagatccaagacaaagagggtatcccccctgatcaacaacgtctgatcttcgctggtaagcagctcgaagacggccgaaccctcgccgactacaacatccagaaagagtctactcttcaactggtgctccgccttcgaggtggtgtcattgaagcctctcttcaagtgcttgccggcaagtacaacactgacaaggtcatctgccgcaaatgctatgcccgtctgtaccctcgtgccaagaactgccgcaagaagaagtgcggtcactccaaccaactcc

SEQ ID NO: 12054 - DNA, 591 bp, Setaria italica
ctacatacatcccaccaaaaccaaaaccgcaagttcgacgacgacaccctcggcggccaagatgcagatcttcgtgaagacgctgacggggaagacgatcaccctcgaggtggagagcagcgacaccatcgacaacgtcaaggccaagatccaggacaaggagggtatcccgccggaccaacagcgcctcatcttcgccgggaagcagctcgaggacggccgcaccctcgccgactacaacatccagaaggagtcgacgctgcacctggtgctgcgcctccgcggcggcagcaggggcgggtaccccacggggatcgagcccagcctccgcgagctcgcgcagaagtacaacgagaacaagagggtctgccgcaagtgctatgctcggcttcccctcagggctaccaactgccgcaagaagaagtgtggccacaccaacgagctgaggtcaaagaaaaggttcatgtccaagaatggcggagcttgagcttggagcgggctgtcatgcatcacattgaaatattttagtttccaatgtttagatgtcgaacgtttctttctttatgaatttatgaataaagtttagctggg

SEQ ID NO: 12055 - DNA, 682 bp, Oryza sativa
gagagagagatcgttcgacgcatatagagagagagagaggcaagatgcagatcttcgtgaagacgctgacggggaagtcgatcacgctggaggtggagagcagcgacaccatcgacaacgtcaaggccaagatccaggacaaggaaggtatccctccggaccagcagcgcctcatcttcgcggggaagcagctggaggatggccgcaccctggccgactacaacatccagaaggagtcgacgctgcacctggtgctccgcctccgcggcggcagcaggggcggctacaccatccaggagcccagcctcctgctcctggcgctcaagtacaacgagaagaagatggtctgccgcaagtgctacgcacgccttcccgccaggtctaccaactgccgcaagaagaagtgtggccacaccaaccagataaggccaaagaagaggtttatatccaagactgccaactgaataaaagagttgtcatgcatcagttgagtcgaagagtcttcctattcagttattagctcatatgttagcatcagttgagtcaaagagtcttcataaatgttagcctggctgtttatgccatttctgtttgtgagatttggtttgaagtttttactgttcaaatctctatatacgcccctacttttctgtttttgagatttggtttgaagtttttactt

SEQ ID NO: 12056 - DNA, 628 bp, Oryza sativa
gttcgacgcatatagagagagagagaggcaagatgcagatcttcgtgaagacgctgacggggaagtcgatcacgctggaggtggagagcagcgacaccatcgacaacgtcaaggccaagatccaggacaaggaaggtatccctccggaccagcagcgcctcatcttcgcggggaagcagctggaggatggccgcaccctggccgactacaacatccagaaggagtcgacgctgcacctggtgctccgcctccgcggcggcagcaggggcggctacaccatccaggagcccagcctcctgctcctggcgctcaagtacaacgagaagaagatggtctgccgcaagtgctacgcacgccttcccgccaggtctaccaactgccgcaagaagaagtgtggccacaccaaccagataaggccaaagaagaggtttatatccaagactgccaactgaataaaagagttgtcatgcatcagttgagtcgaagagtcttcctattcagttattagctcatatgttagcatcagtcgagtcaaagagtcttcataaatgttagcctggctgtttatgccatttctgtttgtgagatttggttagaagtttttactgttcaaatctctatatacgcc

SEQ ID NO: 12057 - DNA, 609 bp, Arachis hypogaea
ggcgcagagcatcaccctaaggatgcagatattcgtgaaaaccctaaccggtaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacattcagaaggagtcaacgcttcatcttgtcctcaggcttcgcggtggcatcattgagccttctctcatggctttggcccgcaagtacaatcaagacaagatgatttgccgcaagtgctatgctcgccttcacccaaggcgttaattgccgcaagagaagtgtggtcacagtaaccagttgaggccaaagaagaagatcaagtaaattctagattgtgctgttcttctcctgttgatgttggaatcggatcagtttttgatattatgttttctgttttagttaatgtcgaattgttttgagagtttattttggcaactaagaattatattgttatgatgatgacattatggtatcatttaagttacttattgtgttttgtaatgcacttagtcacttaaacgtttagc

SEQ ID NO: 12058 - DNA, 476 bp, Picea glauca
actttctatcatcaacagcaaattcgacgaagaccggcaaaatgcagatcttcgttaagaccctgacgggcaagaccatcaccctcgaggtggagtcttccgacaccattgacaatgtcaagtccaagatccaggacaaggagggcatccccccggaccaacagcgtttgatcttcgctggaaagcagctcgaggatggccgaactctctccgactataacatccagaaggagtctacccttcacttggtccttcgtctacgtggtggtatcattgagccctcgctcaaggccctggccagcaagttcaactgcgacaagatgatctgccgcaagtgctacgcccgtcttccccgccgagccaccaactgccgcaagaaaagtgcggtcacaccaaccagcttcgacccaagaagaagactcaagtagacgattcgttccttcatctcccggcgtacttggtttgggcatcatgag

SEQ ID NO: 12059 - DNA, 516 bp, Avena sativa
cagatcttcgtgaagaccctcaccgggaagaccatcaccctcgaggtcgagagcagcgataccatcgacaatgtcaaggctaagatccaggacaaggagggaatcccgccggaccagcagcgtctgatcttcgcaggcaagcagctggaggatggccgtacccttgcggattacaacatccagaaggagtccaccctccatctcgtcctcaggctccgtggaggcatcatcgagccctccctgcaggcgctcgcccgcaagtataaccaggagaagatgatctgccgcaagtgctatgcacgtctgccaccccgagggctgtcaactgccgcaagaagaagtgtcggccacagcaaccagctggacggcccaaagaagaagatacaaagaactagagtgcctctagtctagtttcagtcggaccggttgaactccattcgccggtgtcagtagtatttatgtactttattagtcgttgtcgtggtcgtcgttagtaactttagttatttgtcttat

SEQ ID NO: 12060 - DNA, 451 bp, Arachis hypogaea
aagcagtggtatcaacgcagagtacggggacggcgcagagcatcaccctaaggatgcagatattcgtgaaaaccctaaccggtaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacattcagaaggagtcaacgcttcatcttgtcctcaggcttcgcggtggcatcattgagccttctctcatggctttggcccgcaagtacaatcaagacaagatgatttgccgcaagtgctatgctcgccttcaccagggccggttaattgccgcaagaagaagtgtggtcacagtaaccagttgaggccaaagaagaagatcaagtaattctagattgtg

SEQ ID NO: 12061 - DNA, 877 bp, Brachypodium distachyon
cacagaggaggccagcagcaccatactagatcccgtcctacgagcgagcgagcgagcggctgatcaatcctgtcaagatgcagatcttcgtcaagaccctgaccggaaagaccatcacgctggaggtcgagagcagcgacacaatcgacaacatcaaggccaaaatccaggacagggaaggcatccctccggaccagcagcgcctcatcttcgcggggaagcagcttgaggacgggcgcaccctggcggactacaatatccagaaggagtcgacgctgcacctggtgcttcgcctccgcggcggaagcaggggccactacatcatcaaggagcccagcctgctgcagctcgcgctcaagtacaacgagaagaagatggtctgccgcaagtgctatgcacgccttcccttcagggctaccaactgccgcaagaagaagtgcggccacaccgaccagatcaggctgaagaagaagtttatcaaccaactgtctatgtgaagatgtatcggttggaaacacaagggggagtcgtcgtcatcgtggtccgcgcgcggccgaacaagttcttctgattccgagtctctgttttttcccttaatcatcaagttctaactagcacacatgcatggttctggatgtgggtctattgaaactctatcagtactggagtagttgttattttgtttcgaaaacccctttaccactttttaccacttcttatgaatatgaattgtgaagggatcgaccatggagttttaagggatctatggccccaactttttatgtgtcagacatgtctacagatattgtgtctgtgttcatcgatcgttgttcaccttttgggtcgtctagaaataatacggtacagtttatttccc

SEQ ID NO: 12062 - DNA, 509 bp, Conyza canadensis
aagagtcaaagatgcagatattcgtgaaaacattgaccgggaagaccatcacacttgaggttgagtccagtgacaccatcgataatgtcaaggccaagattcaagacaaggaaggcattccaccagaccaacagcgtttgatttttgccggaaagcaacttgaggatggccgtactcttgctgattacaacatccaaaaagaatcgacacttcacctggtcttgaggctaagaggaggaaagggaggatacccaaaaattgacccaaatttgcgcgaacttgcccttaagcataccgaaaataagaatatatgtcgcaagtgctatgcacgtcttcacccgagggccgtgaactgcagaaagaagaaatgtggccatagtaatgaactgaggaaaaagcacaagttggactctcatggaagcagctgaagacataagtttgtttctcttgatcgaagaggaattttttgtctgctttatcttttagaacatttgcattggtgattgttt

SEQ ID NO: 12063 - DNA, 388 bp, Vaccinium corymbosum
acaacacatcagaggatttgcagttccgtcaatatgcagatcttcgtcaagaccctcacgggcaagaccatcaccctcgaggtcgagtcctcggacaccatcgacaatgtcaagagcaagatccaggacaaggagggcattccaccggaccagcagcgtctgatctttgctggaaagcagctcgaggacggccgcacgctctcagactacaacatccaaaaggagtcgaccctccacttggtgctcagactgcgcggtggtatcattgagccatcgctcaaggccctggccagcaagtacaactgcgagaagatgatctgccgaaagtgctacgcccgtcttccaccacgagctgtcaactgccgaaaagaacagaacaaagacaaaa

SEQ ID NO: 12064 - DNA, 401 bp, Cocos nucifera
gggaagaccattaccctggaagtggaacccagcgactccatcgagaatgtcaaggccaaaattcaagacaaggagggaatcccaccagatcagcaaagattgatcttcgccggaaagcaactcgaggatggacgtactctctccgactacaacatccaaaaggagtctactctccacttggtgctccgtcttcgtggaggaatcatcgagccatctctccgtcagctcgcccagaagtacaactgcgacaagcagatctgcagaaagtgctatgctcgtctcccaccacgtgccagcaactgcagaaagaagaagtgcggacactccagcgagctccgcatcaagaagaagctgaagtaatcttcactcgttccagtccatgtgttggcaaataaatcgtt

SEQ ID NO: 12065 - DNA, 432 bp, Panax ginseng
accatcacccttgaggtcgagtcttctgacactatcgaaaatgtcaaagctaaaattcaagataaagaaggtatcccacccgatcaacaacgtttgatcttcgccggcaagcagcttgaagatggacgtactttgtcggattataacatccaaaaggaatctacattgcatttggtattacgtctgcgtggtggtgttattgagcccactcttcgtttgttggcccagaaatacaactgtgataaaatgatatgccgcaaatgttacgctcgtcttcacccaagagcaactaactgccgtaagaagaagtgtggacacactaacaacttgcgcccaaagaagaagttgaagtaaacgcattttgcttgtactccgaggaacactacgaacattttcttggttttaaattttatcattcaattgtaaaattac

SEQ ID NO: 12066 - DNA, 463 bp, Arachis hypogaea
gcagtggtatcaacgcagagtacgggggacggcgcagagcatcaccctaaggatgcagatattcgtgaaaaccctaaccggtaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacattcagaaggagtcaacgcttcatcttgtcctcaggcttcgcggtggcatcattgagccttctctcatggctttggcccgcaagtacaatcaagacaagatgatttgccgcaagtgctatgctcgccttcaccaggcgttaattgccgcaagaagaagtgtggtcacagtaaccagttgaggccaagaagaagatcaagtaattctagattgtgtctgttcttctcctgtt

SEQ ID NO: 12067 - DNA, 518 bp, Arachis hypogaea
agaattcaaaatcatatatagagaactcaaattttcacagcgccgaagaagaagaagaagaagatgcagatattcgtgaaaaccttaactgggaaaaccatcactctcgaggtagagagcagtgacaccatcgacaatgtcaaaaccaaaatccaagacaaggaaggaatcccacctgatcaacagcgtctgatatttgctgggaagcagcttgaagatggaaggaccttagctgattacaacattcaaaaggggtctactctgcatcttgtgctgaggctccgtggtggtatcattgagccttctttgatggctttggctcgcaagtacaatcaagacaagatgatttgccgcaaatgctatgctcgtcttcatccaagggcctaaactgccgcaaaaagagtgtggccatagtaatcagttgaggccaaagaagaagatcaagtaaactatgtctgttcttgtttgtctttcttcagttgttgtgcaactcctaacaagttttcattttacaattg

SEQ ID NO: 12068 - DNA, 430 bp, Arachis hypogaea
aaggatgcagatattcgtgaaaaccctaaccggcaagaccatcaccctcgaggttgagagcagcgacacaatcgacaatgtgaaagccaagattcaagacaaggaagggattccaccggatcagcagcggttgatcttcgccgggaagcagctggaagatggacgcaccttggctgactacaacatccagaaggagtcaacgcttcatcttgtcctcaggcttcgcggtggcatcattgagccttctctcatggcattggcccgcaagtacaatcaagacaagatgatttgccgcaagtgctatgctcgccttcacccaggcggttaactgccgcaagagaagtgtggtcacagtaaccagttgaggccaaagagaagatcaagtaaattctagattatgtctgttattcttacttcttgatgttggaat

SEQ ID NO: 12069 - DNA, 443 bp, Picea glauca
gcaccaaaataaaatgcaaatcttcgtcaagacattgacgggcaagacgatcacgctcgacgtggagccgtcggactctatcgagcaggtgaagtcgaagatccaggacaaggagggcatcccccccgaccagcagcgtctgatcttcgccggaaagcagctcgaagatggccgctcgctctcggactacaacatccagaaggagtcgacgttgcacttggtgctgcgccttcgcggaggtgtgattgagccgacgctcgcagcgctggccaagtcgtacaactgcgacaccaaggtgtgccgcaagtgctacgcccgccttcccgttcgcgccaccaactgccgcaagaagaagtgcggccggacgaaccagctccgcctcaagaagaagctgaagtaaacccactgtactacccccgtgacgacgacaacgtggacggacg

SEQ ID NO: 12070 - DNA, 730 bp, Brachypodium distachyon
ggcagtgcaactcaaaagtcaaaactaccatcacagaaacaacccctcccgacgagagcaaacaatcgagagctaagatgcagatcttcgtgaagacactgacggggaagacgatcacgctcgaggttgagagcagcgacaccatcgacaacgtcaaggccaagatccatgacaaggaaggtatccccccggaccagcagcgtctcatctttgcggggaagcagctggaggatggccgcaccctggccgactacaacatccagaaggagtccacgcttcacctagtactgcgcctccgtggcggcagcagaggccagtaccccaagaacctcgagcccaatctccgcatccttgctcagaaatacaatgagaacaagatggtctgccgcaagtgctatgcacgcctccccctcagagcgacccactgccgcaagaagaagtgtggccacagcaaccagctgagggaaaagaagaggtttatgtccaagtttgggtcggacagctgaatcaactttcgtggcaagcatcatatcagagtacttatcatcagagtttaagcagtcgtgtcctagctagctagttaatttaccttttcaaatactagtggtttatgcatagatgtggcgtggttatgaaatggtggtgcaagtcccctacccagtattgtacattgaaccttttcatcgatgaagaaaagataataatgctaacgaaatcttctttatctgcc

SEQ ID NO: 12071 - DNA, 896 bp, Brachypodium distachyon
atgggcttaaaatgggccgtgtcacatctggcgatgctatcggtgccgctagggttctgtccagccttcgtctccctatataacgaggtcacgtccgcggcgggcgcccatcaccatcacttacttcaccaacactcactccggtgacggagcgagcaagccattgaaggcaggatgcagatcttcgtgaagacgctgacggggaagacgatcatgctggaggtcgagagcagcgacaccatcgacaacgtcaaggccaagatccaagacaaggaaggcattccaccggaccagcagcgcctcatctttgcagggaagcagctggatgacggccgcaccctgtctgactacaacatccagaaagagtccacacttcacctggtgctacgcctcagaggtggcaggggctgctacccccgccgtatcgagcccactctcctcaagcttgcgctcaagtacaacgagagaaagatgatctgccgcaaatgctatgcacgccttccctccaggtctacaaactgccgtaagaagaagtgtggccacaccaaagatctgaggccaaagaagaagctgaattcctggcactgaagtattgtaagcctggggaagacgatcttacgtgtcaacctgtagaagtgtctcacatcagttgaatcggtagttgtctgagcatcataacttaccagagttgtcattgtgcaagtttaagcctgtcctagttaattaagtccctacctgatgttgaatcttactaatgatctgtaatcggcatatgatccacgtatggcagtggtatgcttagggaaaacactacttaattctagctggattttgaacctttgtcagttcctgcgaataccgttgctacgatagaaatgctcagtccatatgttgag

SEQ ID NO: 12072 - DNA, 792 bp, Oryza sativa
gcggcgcaccactccaccaccaccaccaccactccaccgatcggcgagagcgcggggagatcgttcgacggcggcaagatgcagatcttcgtgaagacgctgacggggaagacgatcacgctggaggtggagagcagcgacaccatcgacaacgtcaaggccaagatccaggacaaggaaggtatcccgccggaccagcagcgcctcatcttcgccgggaagcagctggatgacggccgcaccctggccgactacaacatccagaaggagtcgacgctgcacctggtgctccgcctccgcggcggcagcaggggcggctacaccatccaggagcccaccctccgggctcttgcgctcaagtacagagagaagaagaaggtctgccgcaagtgctatgcacgccttcccatcaggtctcaccactgccgcaagaagaagtgtggccacagcaaggagctgaggttgaagaagaagttcatcaactcgctttcgatagcgtgaggcactggaaagtgttcaccagctgaatcaatctcttggatctccgtgtgcgcagctaccatgttatgtccagtttagaagtactccgtagttgttaatctcttggaacttcgtatgcccagctaccatgttatgtccgtagtctagaagtagttgtggtacttagtacgcttgagagctctgggttgttgcttaaagaagttgtaaccctgcgaagctgcgactgggatgttgaaccctctatcatcactctgaatgaagaagttatcgttactagtagtaaatttttaa

SEQ ID NO: 12073 - DNA, 411 bp, Artemisia annua
tactccaacggggatagttggtattctcataagtttgtagcagacacaaaagcggcggaggcggtggtatagatcgttaaaaaaagaaagaaagatgcagatcttcgtgaaaacattgactggtaagaccatcacacttgaggttgagtccagtgataccatcgacaatgttaaggccaagattcaagacaaggaagggattccaccagaccagcaacgtttgatctttgctggaaagcaattggaagatggaaggactcttgctgattacaacatccaaaaggagtcaacgctgcatttggtgttgaggctacgtggagggatcattgagccttctttgatggctttggctaggaagtacaaccaggacaaaactatctgccgcaaatgttatgctcgcctcatcctcgt

SEQ ID NO: 12074 - DNA, 470 bp, Echinacea purpurea
caatgtcaaggccaaaatccaagacaaagaaggaattccgccggatcagcagcgtctgatttttgctggcaagcagctggaagatggccggacgctcgccgattacaatattcagaaagagtcgacgttgcatttggttttgaggcttcgtggaggaattatcgagccttccttgatggctttggctaggaagtacaaccaggacaagatgatctgccgcaaatgttatgctcgcctacacccccgtgctgttaactgtagaaagaagaaatgtgggcacagcaaccagttgaggcccaagaagaagatcaagtagacatgcgctgaatttcactccattttcaacttctttcgttggccttatattgagtttcttttgccttggtgatgtcagaatattaagatgttttggatacttgataattatcgcactgtgtttaatgtcggatgtgaaagctacctgttacctt

SEQ ID NO: 12075 - DNA, 444 bp, Secale cereale
tgcagatcttcgtcaagacccttacggcaagaccatcactcttgaggtcgagccctcagattccattgagaatgtgaaggctaagattcaggataaggaaggtatccccccagaccagcagcgtctcatcttcgctggcaagcagcttggagatggcaggacattgtctgactacaatattcagaaagaatctactcttcacttggtgctgcgtctccgtggtggtgtcattgagcccactctccgtatccttgccatgaagtacaactgtgacaagatgatctgccgcaagtgctatgcccgtcttcaccctagggcaactaactgccgcaagaagaagtgtggtcacacaaacaacctccgccccaagaagaagctgaagtagacttttattgttttatttgtgtttgggaggtgttccatctgtcatactcaatgttctat

SEQ ID NO: 12076 - DNA, 519 bp, Flaveria ramosissima
aatcggcggaagaagaaatgcagatcttcgtgaagacattgacggggaagacaatcacgctcgaggtcgaatcgagcgacacgatcgacaatgtcaaggctaagattcaggacaaagaaggaattccaccggatcagcagcgtttgatctttgccggaaaacaactcgaggatggaaggactctcgccgattacaacatccagaaagagtctacgcttcatttggtgttgaggctccgtggtggtattattgaaccatctttgatggctttagcaaggaagtataaccaggataaaaccatctgccgcaaatgttatgctcgtctccatcctcgtgctgtcaactgcaggaagaagaaatgtgggcatagcaaccagttgaggccaaagaagaagatacaagtagacgaggatgttacaatgtgtgtttttcacagttttgaatgtttttggaggatctttcgaccctctaagtttatgtttggtgattcttagtagcgattgcaatgactctttgatg

SEQ ID NO: 12077 - DNA, 807 bp, Oryza sativa
cgccaccaacaccaccgccatttccactcgctcgagagcaccagattagcggaggagataggggtccgcgactcgcgagggagaggaaagcaagcggagttgaggatgcagatcttcgtgaagacgctgacggggaagaccatcaccctcgaggtggagaacagcgacgccgtcgccaacgtcaaggccaagatccaggacaaggaaggtatcccgccggaccagcagcgcctcatcttcgccgggaagcagctggaggatggccgcacgctggccgactacaacatccagaaggagtccacgcttcacctggtgcttcgcctacgcggcggccacatctggatcgagccctcgctcagggtcctcgcctacaagcacaacatcaacaagatggtctgcaggaagtgctatgcaactctgcctcccagggctacaaactgccgcaagaagaagtgtggccacagcaatcagctgaggccaaagaaggtgaggtggtgcaggtacttcaacttctgaagagtcatctcatccatcattccatcagtatcatcagagtcaccagcgttcaagcgttatcaaagctaaagttcctactggatgccgaatctagactattactttgactacttgttactgccttgagtaataagcacttgttacctagtactttatgtgctagctgtttctttttcagccatgtcaagtttgctggatgttgaatcttgactaaaccttttggggacggttaatagcaagcatgcatagtaggtggaagtaacatggaggcataaccatcccttaatttcc

SEQ ID NO: 12078 - DNA, 820 bp, Oryza sativa
agttcgctctcgccaccaacaccaccgccatttccactcgctcgagagcaccagattagcggaggagagaggggtccgcgactcgcgagggagaggaaagcaagcggagttgaggatgcagatcttcgtgaagacgctgacggggaagaccatcaccctcgaggtggagaacagcgacgccgtcgccaacgtcaaggccaagatccaggacaaggaaggtatcccgccggaccagcagcgcctcatcttcgccgggaagcagctggaggatggccgcacgctggccgactacaacatccagaaggagtccacgcttcacctggtgcttcgcctacgcggcggccacatctggatcgagccctcgctcagggtcctcgcctacaagcacaacatcaacaagatggtctgcaggaagtgctatgcaactctgcctcccagggctacaaactgccgcaagaagaagtgtggccacagcaatcagctgaggccaaagaaggtgaggtggtgcaggtacttcaacttctgaagagtcatctcatccatcattccatcagtatcatcagagtcaccagcgttcaagcgttatcaaagctaaagttcctactggatgccgaatctagactattactttgactacttgttactgccttgagtaataagcacttgttacctagtactttatgtgctagctgtttctttttcagccatgtcaagtttgctggatgttgaatcttgactaaaccttttggggacggttaatagcaagcatgcatagtaggtggaagtaacatggaggcataaccatcccttaatttccata

SEQ ID NO: 12079 - DNA, 742 bp, Setaria italica
cggccgcctgcaggaaaatagaacgcctctctccacaccagttcatctctctgatctcccaccaccacactacccgggatcgcaaagccaccggcgaagatgcagatcttcgtgaagacgctgacggggaagacgatcacgctcgaggtcgagagcagcgacaccgtggaaaacgtcaaggccaagatccaggacaaggaaggcatcccgccggaccagcagcggctcattttcgccgggaagcagctggatgacggccgcaccctggccgactacaacatccagaaggagtccacgctgcacctggtgctccgcctccgcggcggcggcaggggcggataccccaccatgcgcgtcccgtgggacctcatcaaccttgcccgcaagcacaatgagaagaagatgatctgccgcaagtgctacgcacggcttcaccccaaggccaccaactgccgcaagaagaagtgtggccacagcaacgcgctgagggtaaagaagaagctcatgtgagccatttggaaagctcacaagcgacaatctggagtgtcatctcaaggcgccatgcatcagctgaataaattttgtcagggttttagttttgacctactttggatgttatgaaccttgtttactctttcgagaactcagtatcattgtgtggcgtggcagtggcattgttacgtggatgtttttgctggatatatgtttcttgtttttttttgtgaatttacttatgaatgaa

SEQ ID NO: 12080 - DNA, 790 bp, Oryza sativa
cacattaccgcctccatttttgcaccggccgccactaatctgcgggagagagcgttcgttcgttcgccggcgagagggagagtggcaagatgcagatcttcgtgaagacgctcaccgggaagacgatcacgctggaggtggagagcagcgacaccatcgacaacgtcaaggccaagatccaggacaaggaaggtatcccgccggaccagcagcgtctcatcttcgcggggaagcagctcgaggatggccgcaccctggccgactacaacattcagaaggagtcgacgcttcacctggtgctccgcctccgcggtggcagcaggggcggctaccccaaggggatcgagcccaacctccgcgagctcgcgcagaagtacaacgagaacaagctggtttgccgcaggtgctatgcacgccttcccctcaggtccaccaactgccgcaagaagaagtgtggccacagcaatgagataagggcaaagaagaggtttatgtccaagctttcgaagtgaaccactggaaagctccgtcgtggatcagttcaatcgaccgccttgcagcttttataccttcttattagttactttgtctcttcatggagagatgcttatgagattttgctttcaagtttctgttactggattttggacaaatctctatgaataaagttttggtataaaattttatttactgcccagctaaattcttttgggcttatgtgaacgagcatccatacttatcatgttgaaagtatgtattcttaaattaacaatggaataacaattagtat

SEQ ID NO: 12081 - DNA, 718 bp, Oryza sativa
gcctccatttttgcaccggccgccactaatctgcgggagagagcgttcgttcgttcgccggcgagagggagagtggcaagatgcagatcttcgtgaagacgctcaccgggaagacgatcacgctggaggtggagagcagcgacaccatcgacaacgtcaaggccaagatccaggacaaggaaggtatcccgccggaccagcagcgtctcatcttcgcggggaagcagctcgaggatggccgcaccctggccgactacaacattcagaaggagtcgacgcttcacctggtgctccgcctccgcggtggcagcaggggcggctaccccaaggggatcgagcccaacctccgcgagctcgcgcagaagtacaacgagaacaagctggtttgccgcaggtgctatgcacgccttcccctcaggtccaccaactgccgcaagaagaagtgtggccacagcaatgagataagggcaaagaagaggtttatgtccaagctttcgaagtgaaccactggaaagctccgtcgtggatcagttcaatcgaccgccttgcagcttttataccttcttattagttactttgtctcttcatggagagatgcttatgagattttgctttcaagtttctgttactggattttggacaaatctctatgaataaagttttggtataaaattttatttactgcccagctaaattcttttgggcttatgtgaacgag

SEQ ID NO: 12082 - DNA, 1442 bp, Solanum tuberosum
gaaaacctcaaaattcttttcttgaacttcttaatggctcttcaggctgcttctctgcttccttctactttctccatttccaaggagggcaaagctagtgcaaccttgaagaattctagtatttttggagcttctctttctgattatactaaatctgattttggttcatcttcatttaaagttaagagccaaagaagattgtccaatggtgctgtcgtaagggcaacgatggttgcttctcctggtgtcactactaactctccatcaggaaaaaaaacactaagaaaaggttgtgtaattgtcactggtgcctcatcaggattaggcttagccacagcaaaagctctgtctgaaacagggaaatggcatgttattatggcatgtagggactttttaaaagctgagaaagcagcaaaatcagttgggatgcctaaggagaattacaccatcatgcatttggacctcgcctcgcttgacagcgtacgccaattcgttgataacttcaggaggtcgggacgacctctcgacgtgttggttgctaatgctgctgtttaccaaccaactgctaaagagccttcatttactgcagaaggatttgagcttagtgttggaactaaccatcttggacattttcttctttcgagattgttgcttgatgacttgaagcaatctgattatccttcaaagagactcatcattgttggttcaattacagggaacacgaatactctggctggaaatgtacctccaaaggccaatctcggcgacttgaggggtatggcgggaggtttaaacggaattaacagctcatcgatgatcgatggaggtgactttgacggtgcaaaagcatacaaagacagcaaggtgtgcaacatgcttacgatgcaggaattccatcgtcgataccacgaggaaactggcatcacatttgcctctctttaccctggctgcattgcaacaacagggctattcagagaacatatccccttgtttaggcttcttttcccaccattccagaagtatattacaaagggatatgtctctgagactgaatctggaaagagacttgctcaggttgtgagtgatccaagcttgacaaaatcaggtgtctactggagctggaacaaagattcagcatcttttgaaaaccagttatccgaagaagcaagtgatgcagagaaagcgcgtaaagtgtgggaagtcagtgagaaactcgttggtttggcttaaattttggactaaccttagtcatcgtcgaagaaaacaggaaaatgacttcacgagtgagagtttgtaccggaatttctaggatgttgtaaagagaagtgtcattgtagttaggattggaaataaagatcactcaccttgttttgttttgtgttggaaaatgtcactaatttgcttttgaagttaaatgaaatgatggttcatgagcattgttc

SEQ ID NO: 12083 - DNA, 1481 bp, Solanum phureja
aacctctgccattatcagtagttctacagacaaaaaacctcaaaattcttttcttgaacttcttaatggctcttcaggctgcttctctgcttccttctactttctccatttccaaggagggcaaagctagtgcaaccttgaagaattctagtacttttggagcttctctttctgattatactaaatctgattttggttcatcttcatttaaagttaagagccaaagaagattgtccaatggtgctgtcgtaagggcaacgatggttgcttctcctggtgtcactactaactctccatcaggaaaaaaaacactaagaaaaggttgtgtaattgtcactggtgcctcatcaggattaggcttagccacagcaaaagctctgtctgaaacagggaaatggcatgttattatggcatgtagggactttttaaaagctgagaaagcagcaaaatcagttgggatgcctaaggagaattacaccatcatgcatttggacctcgcctcgcttgacagcgtacgccaattcgttgataacttcaggaggtcgggacgacctctcgacgtgttggttgctaatgctgctgtttaccaaccaactgctaaagagccttcatttactgcagaaggatttgagcttagtgttggaactaaccatcttggacattttcttctttcgagattgttgcttgatgacttgaagcaatctgattatccttcaaagagactcatcattgttggttcaattacagggaacacgaatactctggctggaaatgtacctccaaaggccaatctcggcgacttgaggggtatggcgggaggtttaaacggaattaacagctcatcgatgatcgatggaggtgactttgacggtgcaaaagcatacaaagacagcaaggtgtgcaacatgcttacgatgcaggaattccatcgtcgataccacgaggaaactggcatcacatttgcctctctttaccctggctgcattgcaacaacagggctattcagagaacatatccccttgtttaggcttcttttcccaccattccagaagtatattacaaagggatatgtctctgagactgaatctggaaagagacttgctcaggttgtgagtgatccaagcttgacaaaatcaggtgtctactggagctggaacaaagattcagcatcttttgaaaaccagttatccgaagaagcaagtgatgcagagaaagcgcgtaaagtgtgggaagtcagtgagaaactcgttggtttggcttaaattttggactaaccttagtcatcgtcgaagaaaacaggaaaatgacttcacgagtgagagtttgtaccggaatttctaggatgttgtaaagagaagtgtcattgtagttaggattggaaataaagatcactcaccttgttttgttttgtgttggaaaatgtcactaatttgcttttgaagttaaatgaaatgatggttcatgagcattgttcaattaaa

SEQ ID NO: 12084 - DNA, 1650 bp, Capsicum annuum
agtgtagttcaaacacttcaaagacaaaaagagttccaattcttttcttcaacttcacttcttcatggctcttcacactgctactttgcttccttctactttctccatttccaaggagggcaaagctagtgcagctttgaagaattgtagtctctttggagcttctctctcagactatactaaatttgattttggttcatcttcattcaaagtcaagaaccaaagaaggttgtcgaatggagctgttgtaagggctacgatggttgcttcgcctggtgtgactactaactctccggcaggtaaaaaaacactacgaaaaggttgtgttatcgtcaccggagcctcatcgggattaggcctagccacagcaaaagctctatcagaaacaggaaaatggcatataattatggcatgtagggactttttaaaagctgagaaagcagcaaaatcagttggtatgcctaaggagaactacaccatcatgcatttggaccttgcctcgctggacagcgtacgccaattcgtcgataacttcaggaggtcgggtcgacctctcgacgtgttggttgctaatgctgctgtgtatcaaccaactgctaaagagccttcatttactgctgagggatttgaacttagtgttggcacaaatcatcttggacattttcttctttcgagattgttgctcgatgacttgaagcaatctgattatccttcgaagagactcatcattgttggttcaattacagggaacacgaatactctagccggaaatgtacctccaaaggccaatctcggagacttgaggggtatggcgggaggtttaaacggaattaacagctcagcgatgatcgatggtggtgaatttgatggtgcaaaagcatacaaagacagcaaggtctgcaacatgcttacgatgcaagaattccatcgccgataccacgaggaaactggcatcacatttgcctctctttaccctggctgcattgcaacaacaggactattcagagaacatatacccttgtttaggctccttttcccaccattccaaaagtatattacaaagggatatgtctccgagactgaagccggaaagagacttgctcaggttgtgagcgatccaagcttaacaaaatcaggtgtatactggagctggaacaaagattcagcttcattcgagaaccagttatcagaagaagcgagcgatgcagagaaagcgcgtaaagtatgggaagtcagtgagaaactcgttggtttggcttaaatttttcgactaaccttagtcatatcgcgaatgcaaacaagaaaaatgacttcccgaatgagaatatgagtcgaaaatcacggctgctgtaaagagaactgtcaagttttagttaggatttgcaaataaagatcactcacattgtgttgtgttatcctttttgtgttgtaaattgtcactaatttgcttttgaagttaaatgaagtgatggttcatgagttttcttaagcctcaatgcgcggcgaacagtggcggatccaggatttaggggtcgtgggtgggtgaacagaaggttcaaacacacatattgacgttcaaagctttaaggttctgcctgaaaagtaaagcacccagctatcttcttggcttactggatgcttttctaaatg

SEQ ID NO: 12085 - DNA, 1634 bp, Nicotiana tabacum
ggcgggagtcaaccttcttttaatatctttagctgactttagaccaaccccttttattttcttgaacattttcatggctcttcaggctgctgctttggttccttctgctttctccatttccaaagagggcaaagctagtgcaaacttgaagaattctagtctttttggagtttcgctctctgactattctaaatctgattttggctcctcttcattcaaagtcaagagccaaagaagattgtccaatggagcagtaagggcaacaatggttgcatctccagatgtaaccactaattctccagcaggaaagaaaactttaagaaaaggatgtgtaatagtcactggagcctcttcaggattaggcctggccacagcaaaagcactatccgagaccggaaaatggcatgtgattatggcttgtagggactttttaaaagctgagaaagctgcaaaatcagttggtatgcctaaggagaattacaccatcatgcatttagaccttgcgtcgcttgacagcgttcgccagtttgtcgataacttcaggaggtccggtcgccctcttgatgtgttggttgctaatgcagctgtctatcaacctactgctaaagagccttcattcacagctgaaggatttgagattagtgttggcactaatcatcttggacatttccttctttcaagattgttgcttgacgacttgaagcaatctgattacccttcaaaaagactcataattgttggttcaattacagggaacacaaatactttggctggaaatgtacctccaaaggcgaatctcggtgacttgaggggtatggccgggggtttaaatggtattaacagttcagcgatgatcgatggtggggaatttgatggcgccaaagcgtacaaagacagcaaggtctgtaacatgctcacaatgcaggaattccatcgtcgataccacgaagaaactggcattacatttgcctctctttaccctggctgcattgcaacaacagggctattcagagaacatattcccttgtttaggctccttttccctccattccagaagtatattactaagggatttgtctctgagacagaagctggaaaacgacttgctcaggttgtaagtgatccaagcctgactaaatcaggtgtgtactggagctggaacaaagattcagcttcatttgagaaccagttgtctgaagaagctagtgatgtagagaaagcgcgtaaagtatgggaagtcagtgagaaactcgtcggtttggcttaacttttcggactataaccttaaccattgccaaggcaaacaagaaaagaagagttgatgagtgaaaatttgtatcggaatttctaggctgttgtaaagagaactgtcacctttagttaggattgaaaataaatgttattttctgatggaaaatgtcactaatttactttgaagttaaatgaagtgatggctcatgagcatattgttagttcaattatctgttttacttccctttatgtgcccagaataaagtatatttcaagtattagaactttgcagtcatatatagtaaagtgatcctactctggaaggataatttttactgggaaagagatcgcggataatgtaataacgtaaaatatttacatgg

SEQ ID NO: 12086 - DNA, 1498 bp, Nicotiana benthamiana
tgtaacaccccatcattctcactgtatatataagtgatcattttcttaccactctcacactaccagtaataccagtccaagaattattatttaattctttagctgacaatttagatagtaaaactcaattccttatattcatggctcttcaggctgctgcactacttccttctgctttctctattcccaaggagggcaaagctggtgcaattttgaaggattctaatctctttggaatttccctctcagaccatattaaatctgattttcgctcctcttcatttaaagtgaagagccaaagaaggttgtcccatggatctattagagccgagacaatggttgcaactccaggtgttaccaacgccacagtatcaggaaagaaaactttaagaaaagggtgtgtagtagttactggagcctcttcaggattaggcctagccacagcaaaagctctagctgagacaggaaaatggcatgtgattatggcatgtagagactttctaaaaactgaaagagcagcaaaatccgcaggcatgcctaaggagaactacacaataatgcacttagaccttgcgtcgctcgacagtgttcgccagtttgtcgataacttccggagatcaggtcgccctcttgatgtattggtttgcaatgcagcagtttatcaaccaactgctaaagagccttctttcactgctgatggatttgagctcagtgttgggactaaccaccttggtcatttccttctttcaagattgttgcttgatgatttgaagcagtctgattacccttcaaagagactcatcattgttggttccattacaggaaacacaaatactttggccggaaatgtgcctccaaaagcaaaccttggggacttgaggggcttggcaaggggactcgacgggctgaacagctcggccatgatcgatggtggagactttgatggtgcaaaagcatacaaagacagcaaagtttgcaatatgctcactatgcaggagttccacaggcgataccacgaggaaactggcattacatttgcctctttataccctggctgcatagcaacaacagggcttttcagggagcatatcccattgtttagactccttttccctccattccagaagtatattaccaagggattcgtctccgagacagaatctggaaagagactcgcacaggttgtaagtgatccaagccttacaaaatcaggtgtttactggagctggaacaagaactcttcttcttttgaaaatcagctgtcacaagaagccagtgatgcagagaaagcgcgtaaagtgtgggaagtcagtgagaaactcgtcggtttggcttagatttttcggactgaacttaacttttgctgaggcaaagaagaaaagagagttcatgagtgaggatttgaattgaaattctgttttgttgtagaaaaaggttgttatgttgtaaggttctgagttaggaataaaaaatatcactccaatttacttccaatatg

SEQ ID NO: 12087 - DNA, 1409 bp, Solanum phureja
cacactatcagtccaaaaatcattttttaaaatctacaatatttttagaacaaaactcaattcctaatattcatggctcttcaggctgctgcattgcttccatctactttctctattcccaaggaggggaaaactagtgcaactttgaaggattctagtctctttggaatctctctctctgaccatgttaaatctgattttggctcttcattcaaaatcaagagcggaagaaagtcatccctcggagctattagagccgagacaatggttgcatctcccggtgtaacgaatacccccgtgacaggaaagaaaaccttaagaaaaggttgtgtagtaatcactggagcctcttcaggactaggactagcaacagcaaaagctctggctgagacagggaaatggcatgtaattatggcatgtagggactttcttaaagctgaaagagcagcaaaatcagcagggatgcctaaggagaattacactataatgcatttagaccttgcatcgcttgacagcgtcagacaatttgtcgataactttaggagatcaggcaatcctcttgatgtattggtttgcaatgcagctgtttatcagcctaccgcgaaagagccttcgttcacagctgaaggatttgagcttagtgttgggactaaccatcttggtcatttccttctttcaagattgttgcttgatgacttgaagcagtctgattacccttcaaagagactcatcattgtcggttcgattacaggaaacactaacacattggctggaaatgtacctccaaaggccaacctcggggacttgaggggtttggcaagagggctcgatggacttaacagctcagccatgattgatggtggtgactttgatggtgccaaagcatacaaagacagcaaggtttgcaatatgctcactatgcaggaattccatagacgataccacgaggagactggcatcacatttgcttctctataccctggctgcatcgcgacaacagggctattcagggagcatatccccttgtttaggctccttttccctccattccagaagtttatcaccaagggattcgtctccgaggcagaatctggaaagagacttgcacaggttgtaagtgatccaagtcttacaaaatcaggtgtttattggagctggaacaagaactcttcctcttttgaaaaccagttgtcagaagaagctagtgacgttgagaaagcgcgtaaagtgtgggaagtcagtgagaaactcctcgggttggcttagattttgcagattgagttcaaccatcgccaagacgaacaagaaaagggagttgatgaaggagaacttgaatcaagagtttgttttgttgtagttaaaagttgtcactttgtaaaaattttgagttatgaataaatatcactcat

SEQ ID NO: 12088 - DNA, 1589 bp, Solanum lycopersicum
acacacactatcagtccaaaaatcattttttaaaatctccatcttacaattttttcaaaacaaaaatcattttcctaatataatcatggctcttcaagctgctgcattgcttccttctactttctctattccaaaggaggggaaaactagtgcatctttgaaggattcgagtctctttggaatttctctctctgaccatgttaaatctgattttggctcttcattcaaaatcaagagcggaagaaagtcatccctcggagctattagagccgagacaatggttgcatctcccggtgtaacgagtacccctgtgacaggaaagaaaaccttaagaaaaggttgtgtagtaatcactggagcgtcttcaggactaggactagctacagcaaaagctctggctgagacagggaaatggcatgtaattatggcatgtagagactttcttaaagctgaaagagcagcaaaatcagcagggatgcctaaggagaattatacaataatgcatttagaccttgcatcgcttgacagcgtcagacaatttgtcgataactttaggagatcaggcaatcctcttgatgtattggtttgcaatgcagctgtttatcagcctaccgcgaaagagccttcgtttacagctgaaggatttgagcttagtgttgggactaaccatcttggtcatttccttctttcgagattgttgattgatgatttgaagcagtctgattacccttcaaagagactcatcattgttggttcgattacaggaaacacaaacacattggctggaaatgtacctccaaaggccaacctcggggacttgaggggtttagcaagggggctcgatggacttaacagctcagccatgattgacggtggtgactttgatggtgccaaagcttacaaagacagcaaggtttgcaatatgctcactatgcaggaattccatagacgataccacgaagagactggcatcacatttgcctccctataccctggctgcatcgcgacaacagggctattcagggagcatatccccttgtttaggctccttttccctccattccagaagtttatcaccaaaggattcgtctccgaggcagaatctggaaagagacttgcacaggttgttagtgatccaagtcttacaaaatcaggtgtgtactggagctggaacaagaactcttcctcctttgagaaccagttgtcagaagaagctagtgacgttgagaaagcgcgtaaagtgtgggaagtcagtgagaaactcgtgggattggcttagattttttgctgattgagttcaaccatcaccaagacgaacacgaaaaaggagttgatgaaggagaatttgaatcgagtctgttttgttgtagttaaaaagttgtcacttcgtaaaatttttgagttaggaataaatatcattcatccttttagaatcgagcgcttaccaacacgccaacaattatagcgctcacaactttaagtccacccaacaagcgtcatgttcgatcaatgactcactcaacaatttccagtatgaatgatcatgtgaattatgattccgtattcactacataaaaacaaaaattagc

SEQ ID NO: 12089 - DNA, 1404 bp, Solanum tuberosum
attttttaaaatctccatcttacaatatattcatggctcttcaggttgctgcattgcttccttctactttctctattcccaaggaggggaaaactagtgcaactttgaaggattctagtctctttggaatctctctctctgaccatgttaaatctgattttggctcttcattcaaaatcaagagcggaagaaagtcatccctcggagctattagagccgagacaatgattgcatctcccggtgttacgaatgcccctgtgacaggaaagaaaaccttaagaaaaggttgtgtagtaatcactggagcctcttcaggactaggactagcaacagcaaaagctctggctgagacagggaaatggcatgtaattatggcatgtagggactttcttaaagctgaaagagcagcaaaatcagcagggatgcctaaagagaattacactataatgcatttagaccttgcatcgcttgacagcgtcagacaatttgtcgataactttaggagatcaggcaatcctcttgatgtattggtttgcaatgcagctgtttatcagcctaccgcgaaagagccttcgttcacagctgaaggatttgagcttagtgttgggactaaccatcttggtcatttccttctttcaagattgttgattgatgatttgaagcagtctgattacccttcaaagagactcatcattgttggttcgattacaggaaacactaacacattggctggaaatgtacctccaaaggccaacctcggggacttgaggggtttggcaagagggctcgatggacttaacagctcggccatgattgatggtggtgactttgatggtgccaaagcatacaaagacagcaaggtttgcaatatgctcactatgcaggaattccatagacgataccacgaagagactggcatcacatttgcctctctataccctggctgcatcgcgacaacagggctattcagagagcatatccccttgtttaggctacttttccctccattccagaagtttattaccaagggattcgtctccgaggcagaatctggaaagagacttgcacaggttgtaagtgatccaagtctaacaaaatcaggagtgtactggagctggaacaagaactcttcttcttttgagaatcagttgtcagaagaagccagtgacgttgagaaagcgcgtaaagtgtgggaagtcagtgagaaactcctcgggttggcttagattttgcggattgagttcaaccatcgccaagacgaacaagaaaagggagttgatgaaggagaatttaaatcaagagtctgttttgttgtagttaaaagttgtcactttgtaaaaattttgagttatgaataaatatcactcatcctgttttcttctgaagcaaaagtgttaccaattt

SEQ ID NO: 12090 - DNA, 1432 bp, Solanum melongena
ataagtatcccaaatccttactattctcacactatgagtccaagaatcatttttattaaaattttcatctgatatataatttagaataaaactgatcaattcctaatattcatggctcttcaagctgctgcattgcttccttctactttctttattcccaaggaggggaaaactagtgcaactttgaaggattctactctttttggaatttctctctctgaccatgtcaaatttgactttggttcttcattcaaaatcaagagtggaagaaagtcatccctcggagctattagagccgagacgatggttgcatctcccggtgtaacggatgcccctatgacaggaaagaaaaccttaagaaaagggtgtgtagtaatcactggagcctcatcaggactaggacttgccacagcaaaagctctggctgagacagggaaatggcatgtgattatggcatgtagggactttcttaaagctgaaagagcagcaaaatcagcagggattcctaaggataactatactataatgcatttagaccttgcgtcgcttgagagcgtacgccaatttgtcgataacttcaggagatcagggaatcctcttgatgtattggtttgcaatgcagctgtttatcagcctactgcaaaagagccttcatttacagctgaaggatttgagcttagtgttgggactaaccatcttggtcatttccttctttcaagattgttgcttgatgatttgaacaagtctaattacccttcaaagagactcatcattgttggttcaatcacaggaaacacaaatactttggctggaaatgtacctccaaaagccaacctcggagacttgaggggtttggcaaggggactcgatggtcttaacagctcggcgatgattgatggtggtgactttgatggtgccaaagcatacaaagacagcaaagtttgcaatatgctcactatgcaggaattccataggcgataccacgaggagactggcatcacatttgcctctctataccctggatgcatcgcgacaacagggctattcagagagcatatccccttgtttaggctccttttccctccattccagaagttcattaccaagggattcgtctccgaggctgaatcaggacagagacttgcacaggttgtaagtgatccaagtcttacaaaatcaggtgtctattggagctggaacaagaactcttcttctttcgaaaatcagttgtcagaagaagctagcgacccagagaaagcgcgtaaagtgtgggaagtcagtgaaaaactcgtcgggttggcttagattttgcagactgaccttatccatcgccaacgcgaacaggaaaagggagttgatgagagaaaatttgaatcaagattctgtttttgtaaaatttttgagttagcaataaatatcactcaccttgaat

SEQ ID NO: 12091 - DNA, 1408 bp, Castanea mollissima
ttgaggagctttgctttgcaagtgataatggctctccaggctacttctcttcttccttctgcattctccatccctaaagagggaaagtctggttcatcctccaaggactcaactctgtttggagtttcattctcagaccatctcaaagctgacttcaactcttctggattgaggtgcaagagggaattcaaccaaagggttggggcggttagagctcagacagtgactgcgactccatcggtgaccaggtctgcaccagaggggaagaaaactttaagaaagggtagtgttgtggtcactggtgcctcctctggattgggtctagccacagctaaggctctagctgaaaccggaaaatggcatgtaattatggcctgcagggatttcctcaagactgaaagagctgccaaatctgctggcattcccaaggaaaattataccataatgcacttggacctcgcttcacttgacagtgtccgccaatttgtagataacttcaagcagtcaggccggccacttgacgtgttagtctgcaatgcagctgtttatttgccaactgctaaggagcctacatttactgctgaagggtttgagcttagtgttggcactaatcaccttggtcacttccttctctcacggttgctgctcgaggatttgcagaaatctgattacccatcaagacgcctcatcatcgttggctcaattactgggaacacaaataccctggctggaaatgtacctcctaaggccaaccttggggacctgaggggacttgcagggggcttaaatgggctaaacagctcagccatgatcgatggaggaggctttgatggtgctaaggcttacaaggacagcaaagtctgcaacatgcttaccatgcaagagttccacaggcgcttccacgaggatacaggcattgtatttgcttccctttaccctggttgcattgccacaactggcttgtttagggagcacatccccttgttcagactcctcttccctccattccagaagtacatcactaagggctacgtctctgaagatgaagcagggaaaagacttgctcaggttgttagtgatccaagcttaacaaaatctggtgtttactggagctggaacaaggactcagcatcatttgagaaccagttgtctcaagaagctagtgatgcagagaaggctcggaaggtgtgggaagtcagtgagaaacttgttggattggcctaatcaagagccttgaggtcctttcaactaatctttgctgtgggagaggatgatatcagtgagactgggtccactggtgagtgtggagtttggactccaatgccatgttgttgcaactaattttctcttgtagatgtagattacttattacaagtgtcaataaaattactcaccccattgcaaagta

SEQ ID NO: 12092 - DNA, 1497 bp, Daucus carota
atccaagctctttaagttctttcttttgctcaaaaaagaaagtgaaatatcttcaagtcttgtccaagaatggctcttcaggctgcttctttccttccctcttctttctccatcaacaaagagggcaaggccaatgtttctttgaaggacactagtctttttggagttacattttctgacagtctcagaactgacttcagctctctgaggaccaggaggggttgtaggcaaatatcacagaccggagctataagatcacaagcagtggcgacgactccttctgtcaacagggcgacaggcgaaggcaagaagaccttgaggaagggaagtgtgatcattactggagcctcctcagggttgggcttggccacggccaaggcactagcggaaacaggcaaatggcatgtgattatggcctgcagggattttctcaaggccgaaagagcagctaaatcagctggcatgcctaaggagaattacacaataatgcatttggacctagcgtcgcttgatagtgttaggcagtttgtagagacgtttaggcgatcagagaggccgcttgatgtgcttgtttgcaatgcagcagtgtatttccctactgctaaggagcctacttacacggctgatggatttgaacttagtgttgggactaaccatttgggccatttcttgctttcacgattgctgctcgatgacttgaacaaatctgattacccgtcaaagagactcattattgttggttcaatcacaggcaacacaaatacattggccgggaatgtacctccaaaggccaacctgggagacttgaggggtcttgcaggtggtcttaatgggatgaacagctccgccatgatagacggtgcagaatttgatggtgcaaaagcttacaaggacagcaaggtctgcaacatgctcacaatgcaagaattccaccgtcgataccacgaggaaactggaatcacatttgcttccttgtacccaggctgcattgccacaaccggtttgtttagggagcatattcctctcttcaggacccttttcccaccattccaaaagtacatcaccaagggctatgtgtctgaagcagaatccggaaagcgattggcacaggttgtgagtgaaccaagcctgaccaaatcaggtgtctactggagctggaacaaggactctgcctcattcgaaaaccagttgtctgaagaagctagtgatgtagagaaggctcgtaaagtatgggaagtgagtgagaagcttgtttgtttggcctaaagaggatccttgtgattctttctagcagttagctgcttgagctgggaaatctgggccttctatgagtgcaaagattggttcagatactgcatttgtaggaataatttttcccttgtataactagtgtactttcttagttgataataaacactcactcggatttgacagagcaatcagtggctgtttactcgttttgagatgctaaaaaatgattccataaaagttactgat

SEQ ID NO: 12093 - DNA, 1476 bp, Daucus carota
atccaagctctttaagttctttcttttgctcaaaaaagaaagtgaaatatcttcaagtcttgtccaagaatggctcttcaggctgcttctttccttccctcttctttctccatcaacaaagagggcaaggccaatgtttctttgaaggacactagtctttttggagttacattttctgacagtctcaggactgacttcagctctctgaggaccaggaggggttgtaggcaaatatcacaggctggagctataagatcacaagcagtggcgacaactccttcagtcaacagggcgacaggcgaaggcaagaaaaccttgaggaagggaagtgtgatcattactggagcctcctcagggttgggcttggccacggccaaggcactggcggaaacaggcaaatggcatgtgattatggcctgcagggattttctcaaggccgaaagagcagctaaatcagctggcatgcctaaggagaattacacaataatgcatttggacctagcgtcgcttgatagtgttaggcagtttgtagagacgtttaggcgatcagagaggccgcttgatgtgcttgtttgcaatgcagcggtgtatttccctactgctaaggagcctacttacacagctgatggatttgaacttagtgttgggactaaccatttgggccatttcttgctttcaagattgctgctcgatgacttgaacaaatctgattacccgtcaaagagactcattattgttggttcaatcacaggcaacacaaatacattggccgggaatgtacctccaaaggccaacctgggagacttgaggggtcttgcaggtggtcttaatgggatgaacagctccgccatgatagacggtgcagaatttgatggtgcaaaagcttacaaggacagcaaggtctgcaacatgctcacaatgcaagaattccaccgtcgataccacgaggaaactgggatcacatttgcttccttgtacccaggctgcattgccacaaccggtttgtttagggagcatattcccctcttcaggaccctcttcccaccattccaaaagtacatcaccaagggctatgtgtctgaagcagaatccggaaagcgattggcacaggttgtgagtgaaccaagcctgaccaaatcaggtgtctactggagctggaacaaggactctgcctcattcgaaaaccagttgtctgaagaagctagtgatgtagagaaggctcgtaaagtatgggaagtgagtgagaagcttgtttgtttggcctaaagaggatccttgtgattctttctagcagttagctccttgagctgggaaatctgggccttctatgagtgcaaagattggttcagatactgcatttgtaggaataatttttcccttgtataactagtgtactttcttagttgataataaacactcactcggatttgacagagcaatcagtggctgtttactcgttttgagatgctaaaaaat

SEQ ID NO: 12094 - DNA, 1529 bp, Prunus persica
gagctcagcttcactctgctcaccccaccacactatcttcttcactctcttctccacttgtgagaaagttcagaaaaaagaaaacccaattcaaagtagtcaagaagctttactttgccagtgtcgatggctcttcaggctgcttctgtggtttcctctgctttctcggttcccaaagagggaaagtccagtgcatctttcaaggaatcaagcctgtttggagtgtcattctcagacaatctcaaggctgaattcagctctgttgcattaagctgcaagagagaattcaagcctgtcagagcccagacagcggccacggcatccccagcaatcaccaggggtgcatcagaggggaagaaaactctcagaaagggcagtgtggtggtcactggtgcctcctctggactgggtctagccacagccaaggctttggctgaatcagggaaatggcatgttataatggcctgcagggatttcctcaaggctgaaagagctgccaagtccgctggcatgcccaaagaaaactacacaattatgcatctagaccttgcttccctcgacagtgtgcgccaatttgtcgataacttcaggcgatcggagaggccacttgatgtgcttgtgtgcaatgctgctgtttatcagccaactgctaaggaaccttcattcactgctgaaggctttgaactcagtgttgggactaaccatctcgggcacttccttctttcgcggttgctgcttgaagatttgaacaaatctgactacccatcaaggaggctcatcattgttggctcaattacagggaacacaaacaccttggccggtaatgtgcctccaaaggccaaccttggggacttgaggggacttgcagggggcttaaacggtctaaacagttcgtccatgatcgatggtggagactttgatggtgccaaggcctacaaggacagcaaagtctgcaacatgctcacaatgcaggagttccacaggcgctaccatgaggacaccggaataacctttacttccctttacccgggttgtattgccacaaccggtctgtttagagagcacattcccttgttcagacttctgttccctccattccaaaagtacatcaccaagggctacgtctcagaagaagaagccggaaagagacttgctcaggttgtgagcgacccaagcttgacaaagtctggagtctactggagctggaacaaggattcggcttccttcgagaaccaactctcccaagaagctagtgatgcagagaaggctcgcaaggtgtgggaagtcagtgagaagcttgtgggtttggtctagttcagaatcttgatgtttttaggaggaggatgtcaccagatcaggcccattgtagagtgcagaatttgaaatcaactgctgtaatgtcatgggcaattttctcgtgtggatgactagtgttagttacaaatgtcaataaaatcactctcacctctgttgcaaagtgcagatcaccccatttcttacaattttttattttttattttttatttttt

SEQ ID NO: 12095 - DNA, 1721 bp, Quercus alba
atgggggttacttttttgtcacaaatcagccaaatcctaccgctataaatacaaacttagcactataaatacaaacttagcatagttttccaaatgcttaagctcaacttcacttttgtcaccccaaagtctatcctcttaaacttgcaagaaaagtacttgaaaacccaattgtaagtggttgaggagctttgcattgcaagtgataatggctctccaggctacttctcttcttccttctgcattctccatccctaaagagggaaagtctggttcatcctccaaggactcaactctctttggagtttcattctcagaccatctcaaagctgacttcaactcttctggattgaggtgcaagagggaattcaaccaaagggttggggcggttagagctcagacagtgactgcgactccatcagtgaccaggtctgcaccagaggggaagaaaactttaagaaagggtagtgttgtgatcactggtgcctcctctggattgggtctagccacagctaaggctctagctgaaaccggaaaatggcatgtaattatggcctgcagggatttcctcaagactgaaagagctgccaaatctgctggcattcccaaggaaaattataccataatgcacttggaccttgcctcgctcgacagtgtccgtcaatttgtagataacttcaagaggtcaggccggccacttgacgtgttagtctgcaatgctgctgtttatttgccaactgctaaggagcctacatttactgctgaagggtttgagcttagtgttggcactaaccaccttggtcacttccttctttcacggttgctgctcgaggacttacagaaatctgattacccatcaagacgcctcatcatcgttggctcaattactggtaacacaaataccctggctggaaatgtacctcctaaggccaaccttggggacctgaggggacttgcagggggcttaaatgggctaaacagctcagccatgatcgatggaggagactttgatggggctaaggcctacaaggacagcaaagtctgcaatatgcttaccatgcaagagttccacaggcgcttccacgaggatacaggcgttgtatttgcttccctttacccaggttgcattgccacaactggcttgtttagggagcacatccccttgttcaggctcctcttccctccattccagaagtacatcactaagggctacgtctctgaagatgaagcagggaaaagacttgctcaggttgtggatgatccaagcttaacgaaatctggtgtttactggagctggaacaaggactcggcatcatttgagaatcggttgtctcaagaagctagtgatgcagagaaggctcggaaggtctgggaagtcagtgagaaacttgttggattggcctaaccaagagccctgaggtcctttcaactaatctttgctgtgggagaggatgatatcagtgagactgggtccactggtgagcgtggagtttggactccaatgccatgttgttgcaactaattttctcttgtagatgtagattacttattacgagtgtcaataaagttagtcaccctgttgcaaagtacaaattacctagatgttgtgattttcttactcatcttctaatattgtacaaccactctgagggaatgtttggttcgtcatgatgttacattacaccgtaataatattactcaccccgttgcaaagtacaaaa

SEQ ID NO: 12096 - DNA, 1665 bp, Prunus mume
atactattttagtgtcttgccaagtgccaaaaccactttgtataaatacaaactggtgtttccttttcaagtacttgagctcagcttcactctgctcaccccaccacactatcttcttcactatcttctccacttgtgagaaagttcagaaaaaagaaaacccaattcaaagtagtcaagaagcattactttgccagtgtcaatggctcttcaggctgcttctgtggtttcctcggctttctcggttcccaaagagggaaagtccagtgcatctttcaaggattcaagcctgtttggagtctcattctcagacaatctaaaggctgaattcagctctgttgcattaagcttcaagagagaattcaagcctgtcagagcccagacagcggccacagcatccccagcaatcaacaagggtgcatcagaggggaagaaaactctcagaaagggcagtgtggtggtcactggtgcctcctctggactgggtcttgccacagccaaggctttggctgaatcagggaaatggcatgttataatggcctgcagggatttcctcaaggctgaaagagctgccaagtccgctggcatgcccaaagaaaactacacaattatgcatctagaccttgcttccctcgacagtgtgcgccaatttgtcgataacttcaggcgatcagagaggccacttgatgtgcttgtgtgcaatgctgctgtttatcagccaactgctaaggaaccttcattcactgctgaaggctttgaactcagtgttgggactaaccatctcgggcacttccttctttcgaggttgctgctcgaagatttgaacaaatctgactacccatcaaggaggctcattattgttggctcaattacagggaacacaaacaccttggccggtaatgtacctccaaaggccaaccttggggacttgaggggacttgcagggggcttaaacggtctaaacagctcgtccatgatcgatggtggagactttgatggtgccaaggcctacaaggacagcaaagtctgcaacatgctcacaatgcaggagttccacaggcgctaccacgaggacaccggaataacctttaattccctttacccgggttgcattgccacaaccggtctgtttagagagcacattcccttgttcagacttctgttccctccattccaaaagtacatcaccaagggctatgtctcagaagaagaagccggaaacagacttgctcaggttgtgagcgacccaagcttgacaaagtctggagtatactggagctggaacaaggattcggcttccttcgagaaccaactctccaaagaagctagtgatgcagagaaggctcgcaaggtgtgggaagtcagtgagaagcttgtgggtttggcctagttcagaagcttaatgtttttgtcaacaaatgtttgccttggaggaggaggatgtcaccagaagaggcccctacagtgcagaatttgaaatcaactgctgtaatgtcataagcaattttctcgtgtggatgactagtgttagttacaaatgtcaataaaatcactctcacctctgttgcaaagtgcagatcaccccatttcgtacaattttttattttttttattttttgcttttatatatttatcttatttacttcaaatatttacaacacaaaa

SEQ ID NO: 12097 - DNA, 1486 bp, Malus domestica
cttccactttggccactcccaccacctctcactctctcttcctcactcacttgtgaaaaagatcagaaaaaaccccaattaaaaaaaaatacagagaattaatggctcttcaggctgcttctgtggtttcttctgcattttccgttcccaaagagggaaagacaagtgcttctttcaaggattcaagtctgtttggagtctctttctcggacaatctcaaggctgagttcagttctgttgcattaagctgcaagagggaattcaagccagtgagagcccagacaacagcaacagcaagcccagcaattaacaggggaacatcagagggaaggaaaactctaagaaagggcagtgtgattgtcaccggcgcctcttccggactcggtctagccacagccaagtctttggccgaatctggaaaatggcatgtaattatggcctgcagggatttcctcaagactgaaagagctgccaagtcagctggcatgcccaaagaaaactacaccattatgcatctagacctcgcttccctcgacagtgtgcgccaatttgtcgataacttcaggcgatctgagaggccgcttgatgtgcttgtgtgtaatgctgctgtttatcagccaactgctaaggaaccctcattcactgctgagggattcgaactcagtgttgggactaaccatctcggacacttccttctttcgcggttgctgatggaagatttgaacaaatccgactacccatcaaggagactcatcattgttggctcaattaccgggaacacgaataccttagccggaaatgtacctccaaaggccaaccttggggacttgaggggacttgcaggaggcttaaacggtctaaacagctcggccatgatcgatggtggagactttgacggtgccaaggcctacaaggacagcaaagtctgcaacatgctcacaatgcaagagttccacaggcgctaccatgaggaaaccgggataacatttacttccctttaccccggctgcattgccaccactggtttgttcagggagcacattcccttgttcaggcttctgttccctccattccaaaagtacatcaccaagggctacgtctcagaagaagaagccggaaagagacttgctcaggttgtgagcgacccaagcttgacaaagtcgggagtctactggagctggaacaaggattcggcttccttcgagaaccaactgtcccaagaagctagtgatgcggagaaggctcgcaaggtgtgggaggtcagcgagaagcttgtgggtttggcctaagtatagaaacttgatgttttacctcggaggcggaggatgtcacccgagatcaggtccatttgtagagtgcagattttgaaatcaaatgctctactgtcatagacaatttttctcgtgtggatgactagtgttagtaacaaatgagaataaaatcactcacctctgttgcaaactgcagatcatatttcttgttacaa

SEQ ID NO: 12098 - DNA, 1439 bp, Cleome spinosa
agtattcttttaaaagtcctcttaagaaagaacaatggctctccaagctgcttctctggtttcctctgctttctctgtccgaaaagagggaaaatcgaatgcatcgtcgttcaaggagtctagcctttttggagtctcgcttccagaccaaatcagagctgatttcggctcttcgccattgaaatgcaagagggaatacaacgcgaggaatggagcgataagagctcaaactgctgcgacttcgagtccagccataagcaaacctgccgtggaaggcaagaaaactctgaggaaagggaacgtaatcgtgacaggagcctcatcagggttaggtctagcaacggctaaggcattggccgagaccgggaaatggcatgtgatcatggcctgcagggactttctcaaggccgagagagcagcgaaatcggcgggaatgccgaagggaagttacacggtcatgcatttagacctcgcctcgttggatagcgttaggcaatttgtcgataacttcagaaggaaggaactgcctctcgatgtattggtctgcaatgctgcagtttacttgcccacggctaaggaaccttccttctcagccgaagggttcgagctcagcgtcgggacgaaccatttaggacatttccttctctcgaggctattgctcgacgacttgaagaactccgattacccttctaaacgtctcatcatcgtcggctccatcacagggaacacgaatacattggcgggtaacgtgccgcccaaggcgaatctcggagacttgcggggattagcagggggattaaacggattaaacagctctgcaatgatagatggaggggatttcgatggggcaaaggcgtataaagacagtaaagtctgcaatatgctgacaatgcaggagttccacaggcgttaccacgaagaaacgggcataacgttcgcctcgctctaccctggttgcatcgccacgacgggtttgttcagagagcacattcctctcttcaggctcctcttccctcccttccagaagtacatcacgaaagggttcgtgtcggaagcagaatctggcaagagacttgctcaggtggtgagcgatccgagcttgaccaagtcgggagtgtattggagctggaacaaggcctcggcctcgttcgagaaccagttgtcgcaggaagcgagcgacgtcgagaaggctcggaaaatgtgggagatcagcgagaagctcgttggcttggcctagacgaggatggaatatccggaacgacaaagctagctgagaagattctttgttgttaaatttcttctttttttccccgagtgatttgagtgtttagagacttggctactgcagaatcgactgtaagaaacgtaataacttttgcggcatttggaaaatccaatttcacatctctctaatggtagaaggctccactatgttgtcc

SEQ ID NO: 12099 - DNA, 2500 bp, Brassica oleracea
gagagtaaggtaaactcatggcgtccaagattgtctcagccatagtctttgtattcaacctcgtcgcctttggtctagccgttgctgctgaacaaagacgaagcactgcaacggttgtgcaggacactgaggtgcaatacaactattgtgtgtatgattcggacagagccacagggtatggaattggagcctttttcttctcagttgctagtcaactccttatcatgctcgttagccgttgcttctgttgtggaaagcctctcaagcctggtggttcacgcgctcttgccctcgttctctttattgtcagctggatgttcttcttgatagctgagacatgcctattagctggatcagtagagaatgcataccacacaaagtataggacaatgttcatggacaatcctccagactgtcaaactcttcgcaagggagtattcgctgcgggtgcttctttcgtcttcttcaacgctattgtctctcaattctattatttcttttactcctctgctgctgaggcctcccccttgccgtactagaggactttaaattttacaaaaatatgtttttattttctatatgctatgtgatgtacactattgtcatactctggggtgttatctttttattgtgtgacagcaaaattatatgaagctgagggtaaaactatgagttttgtagattgatttgtatggatattgaattaaaatgttgtttttaccaaatcatttattcctctggatattgaaaattatccaaacatcgaattgttcataacaactagtaacatatttttgtaagttttctctttctcccatgccagaggcatggaatcccatgagcaccaatcaccatccacaagtttgcatttgttaccaataaaataaaatatcttctgacaaggaaatctaaccctcgaattctcattggatacttaatgatgacttggcagatactttctgtaaagataatgttatcttcagtgatctctgtaggggaccactcttctcctgtccgaatatcacctccttcactccttgacaagtacatatatactcacgttctctttcgcaaaatatcgacttcgacagtcttcttcttcaatcgatcttgatatctgtcttttttcctcccaaaatggcccttcaagctgcttctttggtctcctctgctttttctgtccgaaaagatggaaaactgaatgcttcttcatcatccttcaaggaatcgagtctttttggtgcctccattacagaacatggctctttctcatttagattcaagagagaacatagctcgaggaatgtgctcgcagttcgtgcccaaacagccgcaacttcaagcccctcggtcacaaaatcttcatctggcggcaagaaaacgttgaggaaaggtaccgtggtggtcacgggagcctcgtcagggttaggtttagccacggctaaagctcttgcggagacaggtaaatggcacgtgataatggcgtgcagggactttcttaaagccgagagagccgctaaatccgcagggatgcctaaagacagctacacggtgatgcatttggacttagcctcgttggacagcgtgagacagttcgttgatagcttcaggagatcggagatgcctctcgatgttttggtctgcaacgctgcggtttatttccctacagctaaagaacctacttacagtgcagaagggtttgagcttagtgttgccacgaatcacttgggacattttcttctctcgaggttgttgcttgatgacttgaagaagtctgattacccttcaaagcgtctcattatcgtcggttccattaccgggaacaccaatacattggctggtaatgttccaccgaaggcgaatctaggcgatctgagaggtttagcgggtggattgaacggattaaacagctcggcgatgattgatggtggagattttgacggtgcaaaggcttacaaagacagcaaagtgtgcaacatgttgacgatgcaagagtttcacaggcgttaccatgaagaaactggagtcacattcgcttcgctttaccctggttgcattgcctctacgggtctattcagagagcacattccgctgttccgtacactcttccctccgtttcagaagtacatcactaaaggttatgtctccgagacagagtctggcaaaagacttgctcaggtggtgagtgatccgagcttgacgaagtcaggggtttactggagctggaacaaggcttcggcgtctttcgagaacgagttatcagaagaagcaagcgatgttgagaaggctcgtaaagtgtgggagatcagtgagaagctcgttgggttggcttaatgacacttggaatctcttctttctgatgagatcatgttgtgccaaatgatgaaatacctagaggatgttctggatttttagatgtctgattctgttgaggaatttttcgttagtgtatgttgagtgtagatctgtttggcttgtagccccataataaagaaataaa

SEQ ID NO: 12100 - DNA, 1455 bp, Raphanus sativus
ggatcaacttcagtagtcttcttcttcattgctattgctatctctcactctctgttttgtccaaaaatggcccttcaagccgcttctttggtctcctctgctttctctgtccgaaaagatgtaaaactgaatgcttcttcatcatcatccttcaaggactcgagtctctttggtgcctcctttgccgatcagatcaaatccgaacatggctcttcctcgctaagattcaagaggaatgtagcgattagagctcaaaccgccgcaacttcaagcccctccatcacaaaatctccagttgacggcaagaagaccttgaggaaaggcaacgtggtggtcacgggagcttcgtcagggttaggtctagccacggccaaagccctcgccgagacggggaaatggcacgtgataatggcgtgcagggacttcctcaaagcggagagagcggccaaatccgcagggatgcctaaagacagctacacggtgatgcatctagacttggcttcgttagacagcgtgagacagttcgtcgatagcttcaggagatcggagatgcctctcgatgttttggtctgcaacgctgctgtctatttcccgacagctaaagagcctacttacagcgcagaagggtttgagcttagcgttgcgaccaatcatttgggacattttcttctctcgaggttgttgcttgatgacttgaagaagtctgattacccttcaaagcgtctcatcattgtcggatccattacagggaacacgaatacattggctggtaacgtaccaccgaaagctaacctaggcgacttgagaggtttagctggtggcttgaacggtttgaacagctcagcgatgatcgatggaggagatttcgacggtgcaaaggcttacaaagacagcaaagtgtgcaacatgttgacgatgcaagagtttcacaggcgttaccatgaagaaactggaatcacattcgcctcgctttaccctggttgcatcgcctccacaggtttattcagagagcacatcccgcttttccgtaccctcttccctccgtttcagaagtacatcaccaaaggatacgtctccgagacagagtctggcaaaagacttgctcaggtggtgagtgatccgagtttgacgaaatcaggagtgtactggagctggaacaaggcttcggcttcttttgagaaccagttgtcagaagaagcgagtgatgttgagaaggctcgtaaagtttgggagatcagtgagaagctggttggcttggcctaagacgacttcaaagttcctttctcttgatgagaccactctgttacctaccaactgatgagtcctagagggtgttcgggaatttttagattgtctgatattgtaactgcgaattttcattagtgcatgttgagtgtagctctgtttggcgaatagcccacaataatgaaataaaagttggtgtatcttaatcta

SEQ ID NO: 12101 - DNA, 1608 bp, Eutrema parvulum
ggggaccactcttcccctgtctgaatatcacctcctccactcattcggcgaatacatatatacgcacacactctctttcgcaaaacatccacttcaatagtcttcttcttcaatcgttctcgttatatctctctctcactctctgcttttttccaaaaatggccctgcaagctgcttctttggtctcctctgctttctctgtccgaaaagatggaaaatttaatacttcttcatcatccttcaaggactcgagtctatttggtgcctccattaccgaccaaatcaaatcagaacatggctcctcctcattaagagtcaagagagatcatagctcgaggaatgtagcaattcgagcccaaaccgctgcgacttcaagcccttcggtcacaaaatctacaacggacggcaaaaaaacgttgaggaaaggaaacgtggtggtcactggagcttcttcagggttaggtctagccacagctaaagctctagccgagacagggaaatggcacgtgataatggcgtgcagggacttccttaaagcggagagagccgctaaatccgcagggatgcctaaaggcagctatacggtgaagcatttagacctagcctcgttggacagcgtgagacagttcgttgataacttcaggagatcggagatgcctctcgatgttttggtctgcaacgctgcggtttatttccccacagctaaagagcctacttacagtgcagaagggtttgagcttagcgttgcgacgaatcatttgggacattttcttctctcaaggttgttgcttgatgacttgaagaaatctgattatccttcgaagcgtctcattatcgtcggatccatcaccgggaacacgaatacattggctggtaatgtaccaccgaaagctaatctcggcgacttgaggggtttagcgggcggattgaacggattgaacagctcggcgatgattgatggaggagatttcgacggtgcaaaggcttacaaagacagtaaagtctgcaatatgctgacgatgcaagagtttcacaggcgttaccatgaagacaccggagttacattcgcttcgctttaccctggttgcattgcctccacgggtttattccgagagcacattcctcttttccgtaccctgttccctccttttcagaagtacatcactaaaggatatgtctccgagacagagtctggcaaaagacttgctcaggtggtgagtgatccgagcttgacaaaatcaggggtttactggagctggaacaagtcttcggcgtctttcgagaaccagttatcagaagaagcaagcgatgttgagaaggctcgtaaagtgtgggagatcagtgagaaactcgttggcttggcctaatatgacttgaaagtctctttcaactgatgaaacctctccgttcgttaccaactgatgaaacctagagggtttcgggatttttagatgtttgattctactgtggaacttttcgttagtgtctgttgagtgtagatctgtttggcgagaagcccacaataaagaaataaaagttggctaatctttaaagctttatttttgctctgtgtttcatcgtaaaagatcagttgtacgtactctgttt

SEQ ID NO: 12102 - DNA, 1541 bp, Tripterygium wilfordii
tttcacagtggtttagtgggttttaacctataagtgaaaaatcaaaaatggctctccaagctgcttctttggttgcctcttccttctccatccccaaagagggcaagtgtggtgcagcctttaaggattcaagtctctttggattttcactctcagagcatgtcaaagctgactttacctcatctgcattgagatgcaaggggggatttaacagaagaaatggagctgtcagagcccaaacaatggctacaacaactccagcggtcaacatgagtgctcctgaaaggaagaaaaccctaagaaagggcagtgttgtgatcactggtgcctcttctggtttaggtctagccacagcaaaggctcttgctgaaagtggaaaatgggatgtgatcatggcttgcagggacttcctgaaggccgagagagccgccaaggctgctggcatgcccaaagaaaactatacgattatgcatttggatcttgcatcccttgacagcgttcgccaatttgtcgatagcttcaggcgatctgggaggccacttgatgctttggtgtgcaatgctgctgtttaccagccaactgccaatgaacctgcattcactgctgaaggatttgagctaagtgttggaactaaccatcttggtcacttcctcctttcgcggctgctgctcgaggacttgaacaaatcggattatccatcaaggcgtctcatcattgtcggctcgattacagggaacacaaacactttggctggcaatgtacctccaaaggcaaatcttggggacatgagggggcttgcaggaggcttgaatgggctaaacagctctgctatggttgatggtggaaatttcgatggtgccaaggcctacaaggacagtaaagtctgcaacatgctgacaatgcaagagttccacaggaggttccacgaggaaactggtatcacatttgcatctctttatccgggctgcattgccacgaccggcttgttccgggagcacatacccttgttcaggattcttttccctccattccagaagtacatcaccaagggctatgtctctgaagaggaatctggaaaaagacttgcacaggttgtgagtgatcctagcttgacaaaatctggagtttactggagctggaacaaggcctctgcttcatttgagaatcaattgtctcaagaagctagtgatccagagaaggctcgtaaagtatgggagatcagtgagaaacttgtcggcttggcctaatttcataaacctcaaagactaaggcaactgcatcatatgctgcgggagatattagtatcggctgaagaatcgagtcccattgtgggttagagtgctgtgtttttttgtaaaaaaagtttctgtagggtagatgagttctgaaagtttcaactttcaattgacaataagattactctcactatattggaatctcaaaagaatgacaagttcagaatttcagatgctttcttaaaccttctctatgtacctggtacttgatcatgaaaccatcatgtatcaacagaagttacaata

SEQ ID NO: 12103 - DNA, 1344 bp, Tripterygium wilfordii
cttctccatccccaaagagggcaagagttgtgcatcttttaaggattcaagtctctttggggtttcactatcagatcatgtcaaagctgactttagctcttctgcattgaggtgcaagagagaatttagcagaagaaatggtgttgttagatcccaaacagtggcaacaacaactccagcagtcaacaggagtgcacctgaagggaagaaaaccctaagaaagggcagtgttgtaatcactggcgcctcttctggtttaggtctagccacagcaaaggctcttgctgaaactggaaaatggcatgtgatcatggcctgcagggacttcttgaaggctgagagagccgccaagtctgttggcatgccaaaggaaaactacaccattatgcatctggatcttgcatcccttgacagcgttcgccaattcgtagacagcttcaggcaatcggggaggccacttgatgctttggtgtgcaatgctgctgtttaccagccaactgccaaggaacctgcatttactgctgaaggatttgaacttagtgttggaactaaccatcttggtcacttcctcctatcgcggttgctgctcgaggacttgaacaaatctgactatccatcaaggcgtctcatcattgtcggctctattacagggaacacaaacactttggctgggaatgtacctccaaaggcaaatcttggggacatgagggggcttgcaggaggcttgactgggctaaacagctctgctatgattgatggtggaaattttgatggtgccaaggcctacaaggacagtaaagtctgcaacatgctcacaatgcaagagttccacaggaggttccatgaggaaactggtatcacatttgcctctctttatccgggctgcattgccacaacaggcttgttccgggagcacatacccttgttcaggctacttttccctccattccagaaatacatcaccaagggctatgtctccgaagaggaatccggaaaaagacttgcgcaggttgtgagtgatcctagcttgacaaaatctggagtttactggagctggaacaaggactctgcttcatttgagaaccagatgtctcaagaagccagtgatccggagaaggctcgtaaagtatgggagatcagcgaaaaacttgtcgggttggcctgatttccaaacctcaaacactgcatctttgctgagggcgagattggtatcggctgaaaaatctgagtccatttgtgagcgtgtggagtttggaatagaaatgctgtgcttgttcttgtaaaagaattttctgtagggtggatgagttctgaaagtttcaattgacaataagattactcact

SEQ ID NO: 12104 - DNA, 1554 bp, Malus domestica
cctcaagcttccactttggccactcccaccacctctcactctcctcttcctcactcactcacctgtgagaaacatcagagaaaacccaactaaaaaaatctaagaattaatggctctccaggctgcttctgtggtttcttctgctttctctgtccccaaagagggaaagtcaggtgcttctttcaaggattcgagtctgtttggagtaactttctcggaaaatctcaaggcggagttcagctctgttgcattaagctgcaagagagaattcaagccagtgagagcccagacaacagcaacaagcagcccagcaatcaacaagggaacatcagaggggaagaagactctaagaaagggcagtgtgattgtcaccggcgcctcctccggacttggtctggcaacagccaagtctttagccgaatccggaaaatggcatgtaattatggcctgcagggatttcctcaagactgaaagagctgccaaggcagctggcatgcccaaggaaaactacaccattatgcatctagacctcgcttccctcgacagcgtgcgccaattcgttgataacttcaggcgttctgagaggcctcttgatgtgctcgtgtgtaatgctgctgtttatcagccaaccgctaaagaaccttcattcactgctgagggattcgaactcagtgttgggaccaaccatcttggacacttccttctttcacggttgctgctggaagatttgaacaaatccgactacccatcaaagagactcatcattgttggctcaattacagggaacacgaacaccttagctggaaatgtacctccaaaagccaacctcggggacttgaggggacttgcaggaggcttaaacggtctaaacagctcagccatgatcgacggtggagactttgacggtgccaaggcctacaaggacagcaaagtctgcaacatgctcacaatgcaagagttccacaggcgctaccatgaggaaaccgggataacatttgcttccctttacccaggctgcattgccacaaccggtttgttcagggagcacattcccttgttcaggcttctgttccctccattccaaaagtacatcaccaagggctatgtctcagaagatgaagccggaaagagacttgctcaggttgtgagcgacccaagcttgacaaagtcgggagtctactggagctggaacaagaattcggcttccttcgagaaccaactatcccaagaagctagtgatgtggagaaggctcgcaaggtgtgggaagtcagtgagaagcttgtgggtttggcctaagtatagaagcttgatgttcccgttgaccagcattttgcctcggaggaggaggatgtcacccaagatcaggtccatttgtggagtgcagaatttgaaattaaagctgtactgtcatagacaattttctcatgtggatgattagtgttagtaacaaatgagaataaaatcactcacctctgttgcaaaatgcagatcatacttcttgttacaagtttaacattttactcttatttattttaaatatttacaaaacgaaa

SEQ ID NO: 12105 - DNA, 1402 bp, Brassica napus
cttcttcttcaatcgatcttgatatctgtcttttttcctcccaaaatggcccttcaagctgcttctttggtctcctctgctttttctgtccgaaaagatggaaaactgaatgcttcttcatcatccttcaaggaatcgagtctttttggtgcctccattacagaacatggctctttctcatttagattcaagagagaacatagctcgaggaatgtgctcgcagttcgtgcccaaacagctgcaacttcaagcccctcggtcacaaaatcttcatctggcggcaagaaaacgttgaggaaaggtaccgtggtggtcacgggagcctcgtcagggttaggtttagccacggctaaagctcttgcggagacaggtaagtggcacgtgataatggcgtgcagggactttcttaaagccgagagagccgctaaatccgcagggatgcctaaagacagctacacggtgatgcatttggacttagcctcgttggacagcgtgagacagttcgttgatagcttcaggagatcggagatgcctctcgatgttttggtctgcaacgctgcggtttatttccctacagctaaagaacctacttacagtgcagaagggtttgagcttagtgttgccacgaatcacttgggacattttcttctctcgaggttgttgcttgatgacttgaagaagtctgattacccttcaaagcgtctcattatcgtcggttccattaccgggaacaccaatacattggctggtaatgttccaccgaaggcgaatctaggcgatctgagaggtttagcgggtggattgaacggattaaacagttcggtgatgattgatggtggagattttgacggtgcaaaggcttacaaagacagcaaagtgtgcaacatgttgacgatgcaagagtttcacaggcgttaccatgaagaaactggagtcacattcgcttcgctttaccctggttgcattgcctctacgggtctattcagagagcacattccgctgttccgtacactcttccctccgtttcagaagtacatcactaaaggttatgtctccgagacagagtctggcaaaagacttgctcaggtggtgagtgatccgagcttgacgaagtcaggggtttactggagctggaacaaggcttcggcgtctttcgagaacgagttatcagaagaagcaagcgatgttgagaaggctcgtaaagtgtgggagatcagtgagaagctcgttgggttggcttaatgacacttggaatctcttctttctgatgagatcatgttgtgccaaatgatgaaatacctagaggatgttctggatttttagatgtctgattctgttgagtgtagatctgtttggcttgtagccccataataaagaaataaaagttggccagcatcaatca

SEQ ID NO: 12106 - DNA, 1471 bp, Brassica napus
acataaacgcgcactcactctctcgcaaagtatccacttcggtagtcctcttcttcaatcgcttttggtatctcactctctgtttgttccaaaaatggcccttcaagctgcttctttggtctcctctgctttctctgtccgaaaagatggaaagttgaatgcttcttcagcatccttcaaggactcgagtctctttggtgcctccattaccgaacatggctcttcctcattaagattcaagagagaacttagcgtgagaaatgtagcgatcagagcccaaaccgctgcaacttcaagcccctccatcacgaaatcttcagttgacggcaagaagaccttgaggaaaggtaacgtggtggtcacgggagcctcatcagggttaggtctggccacggccaaagctcttgccgagacagggaaatggcacgtgataatggcgtgcagggacttcctcaaagccgagagagccgccaagtccgcagggatgcctaaagacagctacacggtgatgcatctagacttagcttcgttggacagcgtgagacagttcgttgataacttcaggagatcagagatgccgctagatgttttggtctgcaacgctgctgtctatttcccgacagctaaagaacctacttacagtgcagaagggtttgagctcagcgttgcgactaatcatttaggacattttcttctctcgaggttgttgcttgatgacttgaagaaatctgattacccttcaaaacgtctcatcattgtcggatccattacagggaacacaaatacattggctggtaacgtaccaccaaaagctaacctcggcgacttgaggggtttagctggtggactgaacggtttgaacagctctgcgatgattgatggaggagatttcgatggtgcaaaggcttacaaagacagcaaggtctgtaacatgttgacgatgcaagagtttcacaggcgttaccatgaagaaacaggaatcacattcgcctcgctttaccctggttgcatcgcctccactggtttattcagagagcacattccgcttttccgtacactcttccctccgtttcagaagtacatcactaaaggatacgtctccgagacagagtctggcaaaagacttgctcaggtggtgagtgatccgagcttgacgaaatcaggagtgtactggagctggaacaaggcttcggcttcttttgagaatcagttatcggaagaagcaagtgatgttgagaaggctcgtaaagtgtgggagatcagtgagaagctcgttggcttggcctaatagggcatgaaagcctctttctcttgatgagacctctctgttaccctaccaactggtgaatcctagagggtgttcgggatttttagattgtctgatattgtactgcgaatttttcattagtgcatgttgagtgtagatctgtttggcgtgtagcccagaataatgaaataaaaggtggtgtat

SEQ ID NO: 12107 - DNA, 1486 bp, Brassica napus
gtagtcttctacttcaatcgcttttggtatcccactctctgtttgttccaaaaatggcccttcaagctgcttctttggtctcctctgctttctctgtccgaaaagatggaaaactgagtgcttcttcagcatacttcaaggactcgagtctctttggtgcctccattaccgaacatggttcttcctcattaagattcaagagagaacttagcgtgagaaatgtagcgataagagcccaaaccgctgcaacttccagcccatccatcacaaaatcttcagttgacggcaagaagaccttgaggaaaggtaacgtggtggtcacgggagcttcgtcagggttaggtctggccacggccaaagctcttgccgagacagggaaatggcacgtgataatggcgtgcagggacttcctcaaagccgaaagagccgccaagtccgcagggatgcctaaagacagctacacggtgatgcatctagacttagcttcgttagacagcgtgagacagttcgttgataacttcaggagatcggagatgcctctcgatgttttggtctgcaacgctgctgtctatttcccgacggctaaagagcctacttacagtgcagaagggtttgagctcagcgttgcgactaatcatttgggacactttcttctctcgaggttgttgcttgatgacttgaagaaatctgattacccttcaaagcgtctcatcattgtcggatccattacagggaacacgaatacattggctggtaatgtaccacctaaagctaacctcggagacttgagaggtttagccggtggattgaacggtttgaacagttcggcgatgattgatggaggagatttcgacggtgcaaaggcttacaaagacagcaaagtgtgcaacatgttgacgatgcaagagtttcacagacgttaccatgaagaaacaggaatcacattcgcctcgctttaccctggttgcatcgcgtctactggtttattcagagagcacattcctcttttccgtaccctcttccctccgtttcagaagtacatcactaaaggatatgtgtccgagacagagtctggcaaaagacttgctcaggtggtgagtgatccgagcttgacgaaatcaggagtgtactggagctggaacaaggcttcggcttctttcgagaatcagttatcggaagaggcaagcgatgttgagaaggctcgtaaagtgtgggagatcagtgagaagctcgttggcttggcctaatagggcatgaaagcctctttctcttgatgagacctctctgttacctaccaactgatgaatcctagagggtgttcgggatttttagattgtttgatattgtactgcgaatttttcaatagtgcatgttgagtgtagatctgtttgggcgagtagcccacaataatgaaataaaagttggtctatctttagtataaaaaaaaaaaaaaaaaaactcgagactaattctctccctgcagccc

SEQ ID NO: 12108 - DNA, 1580 bp, Vigna unguiculata
gattcaattgagtggaacattccaaaacaacagacccaatttataactttctctctctcaagttcaaatggctctccaggctgtttctttggtttctgcttctttctctgtcgccaaagaggggaagcttggcatgtctctgaggaacaccacaatatttggtctttcattggcagacgctctcaaagcggacttcagctctctctcattttcatgcaaaagggaactccagcaaaaattttgccctttaagggtccaatcagtggcaacaactccaggagtcacaaaagcttcaccagaaggcaagaaaactttgaggaaaggcagtgttattatcactggggcttcctctggattgggcttggccactgctaaggcattggctgagacaggaaagtggcatgtgataatggcttgcagggatttcctcaaagctgaaagggctgcaaaagctgctggcattcctaaggaaaactacactgttatgcatttggaccttgcctcccttgatagtgttaggcaatttgtggacaacttcaggcaatcgggcaggccactggatgtgcttgtttgcaatgctgcagtttacttgccaactgcaagtgaacctacatacactgctgatggctttgaactcagtgttggaacaaaccatttggggcatttcctgctttcgcgcctattgcttgaggacttgaacatatctgattacccttctaagaggttgatcattgttggctcaatcacaggaaacaccaacaccttggctggaaatgtgccacccaaggctaaccttggtgacttgaggggactagctggaggcttgaatggactaaacacttcagccatgatagatggaggatcctttgatggagccaaggcgtacaaggacagcaaagtctgcaatatgcttaccatgcaagaattccacagaagataccatgaagaaactggaatcacatttgcttccctttacccgggttgcattgccacgacaggcttgttcagagaacacattcccttattcagacttctcttccctccattccaaaagttcataaccaagggctttgtctccgaagatgaatcgggaaagaggcttgcacaggttgtgagtgatccaagcctaacaaaatcaggtgtctactggagctggaacaaggcctctgcttcatttgaaaatcaattgtcacaagaggccagtgatgcagataaggctcgcaaggtttgggagatcagtgagaaacttgttggtttggcttaaatggcatcttggcagcttccagtatcctcttgattgtgaggaatttgtcatggggttcaataacatctcacaagagtttagacccttttctgatgcgtttctctgatgctttttttagcagctaactcctcttgtcttgatgactactctcgatgaatccttcaaatgtttcaaagtgcacatgaagttaggaaatttgattccacagctgtctcataattggattctttattgtttttcaaatgattgttattcaaataacttcaaaatcagagaaatcaaattaaccaataagaatcttattcattccaagcat

SEQ ID NO: 12109 - DNA, 1606 bp, Eutrema halophilum
ggggaccagtcttcccttgtccgaatatcacctcctccactcgttcgcgagtacatatacgcacacactctctctcgcaaaatatccacttcggtagtcttctacttcaatcgcttttgctatctctcactctctgttgttttctttttccaaaaatggcacttcaagctgcttcgttggtctcctctgctttctctgtccgaaaagatgcaaaattgaatgcttcttcatcatccttcaaggactcgagtctttttggtgtctccattactgaccaaatcaaatccgaacatggctcgtcctcattaagattcaagagagaacacagcttgaggaatgtagcaattcgagcccaaaccgctgcgacttcaagtccctcggtcacaaaatcttccgcggatggcaagaaaacgttgaggaaaggaaacgtggtggtcacgggagcctcatctgggttaggtctagccacagctaaagctcttgccgagacagggaaatggcacgtgataatggcgtgcagagacttccttaaagcagagagagccgctaaatccgcagggatgcctaaagacagctacacggtgatgcatttagacttggcctctttggacagcgtgagacagttcgttgataacttcaggagatcggagatgcctctcgatgttctggtctgcaacgctgcggtttacttcccgacagctaaagagcctacttacagtgcagaagggtttgagcttagcgttgctacgaatcatttgggacattttcttctctctaggttgttgcttgatgacttgaagaaatctgattacccttcaaagcgtctcattatcgtcggatccatcactgggaacacaaatacattggctggtaatgtaccaccaaaggcgaatctcggggatttgagaggtttagctggcggattgaacggtttaaacagctcggcgatgattgatggaggagatttcgacggtgcaaaggcttacaaagacagtaaagtctgcaatatgctgacgatgcaagagtttcacaggcgttaccatgaagaaactggagtaacatttgcctcgctttaccctggttgcatcgcttccacgggtttgttcagagagcacattcctcttttccgtaccctcttccctccatttcagaagtatatcactaaaggatatgtctccgagacagagtctggcaaaagacttgctcaggtggtgagtgatccgagcttgacgaaatcaggggtttactggagctggaacaaggcttcggcatcttttgagaaccagttatcagaagaagcaagcgatgttgccaaggctcgtaaagtgtgggagatcagtgagaagctcgttggcttggcctaaaatatgatttgaaatctctttcttcttctgatgagacctctatgtaccaagtgatgaaacatagaggatattcgggatttttagatgtctgactctattgcggagtttttcgttagtgtctgttgagtgtagatctgcttggctagtagccagcccacaacaaaagaaataaaagttggcaaatcttaagccttaaatctgctctgtgtttcaccaaaagagaccagttatatactctgttt

SEQ ID NO: 12110 - DNA, 1428 bp, Brassica oleracea
acatttactctttaacctaacgtgacaatggcccttcaagctgcttctttggtctcctctgctttctctgtccgaaaagacggaaaatcaaatgcttcatcatcattcaaagagtctagtctttttggtgcatcactttcagaccaaattaaatctgattttgtctctttctccttgagatgcaagagggaacaaagcttgaggaccacaggagcaaggattcgagctcaaacaatcgttacttcaaccccatccgtcacaagatctaccttcgaccgcaagaaaacccttagaaaaggaaacgtggtcgtcactggagcttcatcagggctaggtttagcaacggcaaaggcattagccgagacaggtaaatggcacgtgataatggcgtgcagagacttcctcaaggccgagagagcggctaaatccgcggggatgcctaaggacagctacaccgtaatgcatttggacttagcatcgttggacagcgtgaggcagttcgttgataacttcaggcgagccgagatgcctctcgatgtgttggtctgcaacgccgctatttatcagccaacggctaataaacctactttcactgctgaagggtttgaacttagcgttgggacgaaccatttagggcactttcttctctcaagattattgattgatgacttgaagaactctgattatccatcaaaacgtctcatcattgttggatcaataactggaaacactaatacattggctggtaacgtacctcccaaggcgaatcttggcgatttaaggggactagctagtggattaaacgggctaaacagctcggcgatgatagatggaggagatttcaatggtgcaaaggcttacaaagacagtaaagtatgcaacatgttgacgatgcaagagtttcataggcgttttcatgaagaaactggcatcactttcgcttccctctaccctggttgtatcgctactacaggtttgttcagagagcatattcctctcttccgttcactcttccctcttttccagaaatacatcaccaaaggttacgtctccgaggctgaggctggcaaaagacttgctcaggtggtaggtgatccgaacttgacgaagtctggagtgtattggagctggaacaagacctcggcttcattcgagaatcagttgtctcaagaagccagcgatgttgagaaggctcgtagggtttgggaagttagcgagaagctcgtgggcttggcctaaaacttgatttgagtctactcctgtctttgaagcttagtcacaccaagagaaacaaacaaaagaggaaacatcgatgatcgaataagccttgaccaactttgagtttgtgttgtttgtgttggctaattctattttgttgacaaaccaaataaatcccttttaaaaaataaatttgataaataaaagttg

SEQ ID NO: 12111 - DNA, 1444 bp, Euonymus alatus
catttcacattggttttgtgggttttactctgcaagtgaaaaatggctctccaagcagcttcaattgttgctccttccttctccatccccacagagagcaagagttgtgcatcttttaaggattcaagtctctttggggtttcaatatcagtatcagatcatgtcaaagctgactttagctcttctgcattgaggtccaagagagaatttagcagaagaaacggagttgttagagcccaaacagtggcaacaacaactccagcagtcaacaggagtgcacctgaagggaagaaaaccctaagaaagggcaatgttgtaatcactggtgcctcttctggtttaggtctagccacagcaaaggctcttgctgaaactggaaaattgcatgtaatcatggcctgcagggacttcttgaaggccgagagagcagccaaggctgctggtatgcccaaggaaaactacaccattatgcatctggatcttgcatcccttgacagtgttcgccagtttgttgaaagcttcaggcgatcggggaggccacttgatgctttggtgtgcaatgctgctgtttaccagccaactgccaaggaacctgcatttactgctgaaggatttgaacttagtgttggaactaaccatcttggtcacttccttctttcacgattgctgctcgaggacttgaacaaatccgactatccatcaagacgtctcatcattgtcggctccattacaggcaacacaaacactttggctgggaatgtacctccaaaggcaaatctcggggacatgagggggcttgcaggaggtttgaatgggctaaacagctctgctatggttgatggtggaaattttgatggtgccaaggcctacaaggacagtaaagtctgcaacatgctcacaatgcaagagttccacaggaggttccatgaggaaactggtatcacatttgcctcactttatccaggctgcattgccacgactggcttgttcagagagcacatacccttgttcagggttcttttccctccgttccagaagtacatcaccaagggctacgtctcggaagaggaagccgggaaaagacttgctcaggttgtgagtgatcctagcctgacaaaatctggagtttactggagctggaacaaggattccgcttcatttgagaacaagatgtcgcaagaagctagtgatccagagaaggctcgtaaagtatgggagatcagtgagaaacttgtcgggttggcctgatttcgaaacctcaactacttgtggaggcaactgcatctttgctgcggacgagactggtatcggctaaaaaatctagtccatttgtgagtgtggagtttggaatagaaatgctttgctatgcttctttttgtaaaaaataaataaattctgtagggttgatgagttctgaagtttgaatcgacaataagattacttg

SEQ ID NO: 12112 - DNA, 1599 bp, Petroselinum crispum
ttttatcttttatctaaaagcagacaattatacaaacagttccaaatcaaccagcattcaaccaggccaccacttttcatatataaatacatatgcacaaacatcacttaaaactatccaagtcctttacatttgctgtaaaaagaagtgaaatatcttagaaacatttttaagaatggctcttcaggcagcttcttttcttccctcttctttctccatcaacaaagagggcaagaccaatgtttctttgaaggacactagtctttttggagtttcattcaatgacagtctcaaaactgacttcagctctttgaggaccaagaggggttgtggtcaaatatcacaggctggagctataagatctcaagcagtggttacaactccttcggttaaccggggaacaggcgaaggaaagaaaacctcaaggaagggaagtgtgatcattacgggagcctcttcagggttgggtttggccacagccaaggcactggcagaaacaggcaaatggcatgtgattatggcctgcagggattttctcaaggcagaaagagcagccaaatcagctggcataccaaaggagaattatacgataatgcatttggaccttgcctctcttgacagtgttaggcaatttgtggaaacctttaggcgatcagagaggccacttgatgtgcttgtttgcaatgcagcagtgtatttcccaactgccaaggaacctacatacacagctgatggatttgaacttagtgttgggactaaccatttgggccatttcttgctttcaagattgctgcttgatgacttgaacaagtctgattatccatcaaggagacttattatcgttggttcaatcacaggcaacacaaacacattggctgggaatgtacctccaaaggccaacctaggggacctgaggggtctttcaggaggtctgaatgggatgaacagctctgccatgatagatggtgcgtcatttgatggcgcaaaagcttacaaggacagcaaagtctgcaacatgctcacaatgcaagaattccaccgccgttaccatgaggatactgggatcacatttgcttccctgtacccaggctgcattgccacaactggtttgttcagggagcatattccattgttcaggacccttttcccaccattccagaaatatgtcaccaagggctatgtgtctgaagcagaatccggaaagcgattggcacaggttgtaagtgaaccaagcttgaccaagtcaggtgtctactggagctggaaccaagactctgcttcattcgaaaaccagttgtctgaagaagctagtgatgtcgagaaggctcgtaaggtatgggaagtgagtgagaaacttgttggtttggcctaaataggatccttgagattcttttctgcaggcagcccggtgagtgaggtgagaaacatgggccttctatgagtgggcaaagttcagttcagacttcagatactgaatgtaggaataatttttctcttgtaaaactagtgtgcttctgatttagttgataataaacactcactcagcattcagtagtttatacttgttttgaaatgctacaaactggcatgaaaactcac

SEQ ID NO: 12113 - DNA, 1733 bp, Fragaria vesca
ggtacttgaactcagcttcacttgatatcttcttcacttgtgagataagagaacccagttccagtgtggtcaaaggagcttgttttggttagtgataatggctcttcgtgctgcttctgtggtttcctctgctttctctgctcccaaggagggaaagccgtgtgcttctttcaaggattcaaccctgtttggagtctcattctctgaaaatctcaaggctgatttcagctctgttgcactaagctgcaagagagagttcaagccagtgagggctcaaacagcagccacagcatccccagcaatcaacaagtccacttcagatgggaagaagactctgagaaaaggcagtgtagtgatcactggtgcctcctctggacttggtctagccacagccaaggcattggccgaaaccgggaaatggcatgtgattatggcatgcagggatttccttaaggctgaaagagctgccaaggcagctgggatgccgaaagagaactacactatcatgcatctagaccttgcttctctagacagcgttcggcaatttgttgacaacttcagaagatcggaacgcccccttgatgttctggtctgcaatgctgctgtgtatttaccgactgctaaggagcctacttacactgctgatggatttgaacttagtgttggaactaaccatcttggacatttccttcttgcgcggttgatgcttgaggatttgaacaaatccgattacccttcaaagagactcatcattgttggctcaattacagggaacacaaacactttggctggaaatgtacctccaaaggccaaccttggggatttgaggggacttgcagggggtgtaaatggggtcaacagctcggccatgattgatggtggagactttgacggtgccaaggcttacaaggacagcaaagtctgcaacatgctcacaatgcaagagttccacaggcgctatcacgaggagactgggatcacattcgcttccctttaccccggttgcattgccacaactggcttgttcagggagcacattcccttgttcaggctcctgttccctccattccagaagtacatcaccaagggttatgtctctgaagaagaatccggaaagagacttgctcaggttgtaagcgacccaagcttgacaaagtcaggagtctactggagctggaacaagacctctgcttcatttgagaaccaactgtctgaagaagccagtgatgcagacaaggctcgcaagctgtgggaagtcagtgagaagcttgtcggtttggcttaaataagaagtctgatgctcttgtcaagcaacattttctttggaggatgatgtcaccagagaattgatcagttctatttgtagagtgcagagttagaatgctctgctgttgtaagcagtttttctcgtgtggttgactagtgttagttaaaaaatcaataaaatcactcgcctcttttgcaaagtgcagatcaacctgtcaaatatctttatttatctacttcttgttcaatatttacaagacagaacaaggttcaggcatgtactaatttattacatgggaagtagtttaaagttcataaccaggaaaccgagcttcagatgggtcagtcatgtccagaaagagatgagccattcctccaacaccttcaaataaggaataggggcgatcacctccatgcatccttccttctgatatgagtctgggtgctctatcatataaaaagcaagc

SEQ ID NO: 12114 - DNA, 1505 bp, Arabidopsis lyrata
atccacttcgatagttttcttcagcaatcgcttttgctacctctctctctgttcgagtaccaacaatggcccttcaagctgcttctttggtctcctctgctttctctgttcgcaaagatgcgaagttgaatgcttcttcatcgtctttcaaggactctagtctatttggtgcctccattgcagaacaaatcaaatccgaacatggatcttcctcgttaagattcaagagagaacatagcttaaggagtctagcaattcgagcccaaaccgctgcgacttcaagccctacggttacaaaatccgtggacggcaagaaaacgttgaggaaaggaaatgtggtggtcactggagcctcgtctggattaggtctagccacggctaaagctctagccgagacaggtaaatggcacgtgataatggcgtgcagagacttccttaaagcggagagagccgctaaatccgcaggaatgcctaaagacagctacacagtgatgcatttagacttagcctcgttggacagcgtgagacagttcgttgataacttcaggagaacagagatgcctctcgatgttttggtctgcaatgctgcagtttatttcccgacagctaaagagcctacttacagtgctgaagggtttgagcttagtgttgcgacgaatcatttgggacattttcttctcgcaaggttgttgcttgatgacttgaagaaatctgattacccttcaaagcgtctcatcatcgtcgggtccattaccgggaacacgaacacattggcgggtaatgtaccaccgaaggcgaatctcggtgatttgaggggtttagccggcggattaaacggtttaaacagctcggctatgattgatggaggagatttcgacggtgcaaaggcttacaaagacagtaaagtctgcaatatgttgacgatgcaagagtttcacaggcgttaccatgaagaaactggagtcactttcgcttcgctttaccccggttgcatcgcctccacgggtttattccgagatcacattccgctcttccgtgccctcttccctccctttcagaagtacattactaaaggatatgtctccgagacagagtcaggcaaaagacttgctcaggtggtgagtgatccgagcttgacgaaatcaggggtttattggagctggaacaatgcttcagcttcttttgagaaccagttatcagaagaagcaagtgacgttgagaaggctcgtaaagtgtgggagattagtgagaagctcgtgggcttggcctaataaacttgaaatctgttaatttgatgagacctctccgtaccaatcgacgaaacctagtgaattttcgggatttttctagatgtctgattctgttgcgaagtttttcttccttagtgtctgttgagtgtagattgcttggcgagtagcccacaataaagaaataaaatcggtgaatctttagctatatttactctgtttttcatcgaaacagatcagttatatactctgtttttt

SEQ ID NO: 12115 - DNA, 1659 bp, Brassica rapa
gggaccactactcctctcctgtccgaatatcacctcctccttcactccttggcaagtacatatatactcacactctctctcgcaaaatatccacttcgatagtcttcttattcaatcgatcttgatatctctctgtttttttcttttccaaaaatggcccttcaagttgctcttttggtctcctctgctttctctgtccaaaaagatggaaaagtgaacgcttcttcatcatccttcaaggactcgagtctctttggtgcctccattaccgaacatggctcttcctcattaagattcaagagagaacatagctcgaggagtgtattagcagttcgtgcccaaaccgctgcaacttcaagcccctcggtcacaaaatcttcatctggcggcaagaaaacgttgaggaaaggtaacgtggtggtcacgggagcctcgtcagggttaggtttagccacggctaaagctctggccgagacaggtaaatggcacgtgataatggcgtgcagagacttccttaaggccgagagagccgctaaatcagcagggatgcctaaagacagctacacggtgatgcatttggacttggcctcgttggacagcgtgagacagttcgttgatagcttcaggagatcagagatgcctctcgatgttttggtctgcaacgctgcggtttatttcccgacagctaaagagcctacttacagtgcagaagggtttgagcttagtgttgccacgaatcatttgggacattttcttctctcgaggttgttgcttgatgacttgaagaagtctgattacccttcaaagcgtctcattatcgtcggatccattaccgggaacacgaatacattggctggtaacgttccaccgaaggcgaatctaggcgatctgagaggtttagctggcggattgaacggcttaaacagctcggcgatgattgatggaggagattttgacggtgcaaaggcttacaaagacagcaaagtgtgcaacatgttgacgatgcaagagttgcacaggcgttaccatgaagaaactggagtcacattcgcttcgctttaccctggttgcattgcctccacgggtctattcagagagcacattccgcttttccgtacactgttccctccgtttcagaagtacatcaccaaaggatatgtctccgagacagagtctggcaaaagacttgctcaggtggtgagtgatccgagcttgacgaagtcaggggtgtactggagctggaacaaggcttcggcgtctttcgagaacgagttatcagaagaagcaagcgatgttgagaaggctcgtaaagtgtgggagatcagtgagaagctcgttgggttggcttaaatgacacttggaatctcttctttctgatgagatcacgttgtgccaagtgatgaaaactctagaggatgttctggatttttagatgtctgattctgttgaggaatttttcgttagtgtatgttgagtgtagatctgtttggcttgtagcccataataaagaaataaaagttggctagcaacaatcatacaccaacatctttgtgcatcaaaatttaattaactcctatgtctggtttaaaaaaaaaaaagattcaggctctaacgaactgcattccaagaatccataccatcagtactatcttcacatgt

SEQ ID NO: 12116 - DNA, 1408 bp, Brassica rapa
acaaacattacatttactctttaacctaacgtgacaatggcccttcaagctgcttctttggtctcctctgctttctctgtccgaaaagacggaaaatcaaatgcttcatcatcattcaaagagtctagtctttttggtgcatcactttcagaccaaattaaatctgattttgtctctttctccttgagatgcaagagggaacaaagcttgaggaccacaggagcaaggattcgagctcaaacaatcgttacttcaaccccatccgtcacaagatctaccttcgaccgcaagaaaacccttagaaaaggaaacgtggtcgtcactggagcttcatcagggctaggtttagcaacggcaaaggcattagccgagacaggtaaatggcacgtgataatggcgtgcagagacttcctcaaggccgagagagcggctaaatccgcggggatgcctaaggacagctacaccgtaatgcatttggacttagcatcgttggacagcgtgaggcagttcgttgataacttcaggcgagccgagatgcctctcgatgtgttggtctgcaacgccgctatttatcagccaacggctaacaaaccgactttcactgctgaagggtttgaacttagcgttgggacgaaccatttagggcactttcttctctcaagattattgattgatgacttgaagaactctgattatccatcaaaacgtctcatcattgttggatcaataactggaaacactaatacattggctggtaacgtacctcctaaggcgaatcttggcgatttaaggggactagctagtggattaaacgggctaaacagctcggcgatgatagatggaggagatttcaatggtgcaaaggcttacaaagacagtaaagtatgcaacatgttgacgatgcaagagtttcataggcgttttcatgaagaaactggcatcactttcgcttccctctaccctggttgtatcgctactacaggtttgttcagagagcatattcctctcttccgttcactcttccctcttttccagaaatacatcaccaaaggttacgtctccgaggctgaggctggcaaaagacttgctcaggtggtaggtgatccgaacttgacgaagtctggagtgtactggagctggaacaagacctcggcttcattcgagaatcagttgtctcaagaagccagcgatgttgagaaggctcgtagggtttgggaagttagcgagaagctcgtgggctcggcctaaaacttgatttgagtctactcctgtctttgaggcttagtcaccaagagaaacaaacaaaagaggaaaaatcgatgatcgaataaaccttgaccaactttgagtttgtgttgtgtgtgttggctaattctattttgttgacaaaccaaataaatccgttttt

SEQ ID NO: 12117 - DNA, 1247 bp, Centaurea maculosa
caacaatctttcttagatatttacagaaaacccccttcacattttcacctccaatggctctccaagctacttcatcctctttctccatccacaaagaggggaaaaccaatgcatctttgaaggattccagcttatttggagcatcattatcatctcatcttaaagttgacctcaaatcatcactatcaagaaacatgacggaatttagccgaaggggtgcactcaaaatcaaagccgtagctactacaacaccgtccgtgaaccaagcctcaactgatgcaaagaaaaccctacgaaagggcacggttgtcatcacgggggcgtcctcgggtttgggcctagccacggcaaaagcgctagcggaaacgggaaagtggcacgtgatcatggcttgtcgggactttctaaaggcggaaagatcagccaaatcggttggaatgccaaaggagaactatacggttatgcatttggacctcgcgtcgtttgacagcgtgaggcagtttgtcgccaatttcaagcaatcgggtcagccgctcgacgtgttggtttgcaacgcggccgtttattttccgaccgcaaaggagcccacgtatacggctgatgggttcgagctcagtgttgggactaaccatcttggccacttcctgcttgcaagattgttgcttgatgacttgaagcagtctgattacccatcaaaaagactaattattgttggctcaattacaggcaacacgaacacgttggccgggaacgtacctccgaaggctaacctcggggacatgaggggtctagctggtggactaaacgggctcaacagctcggccatgatcgacggaggagatttcgatggtgccaaggcatacaaagatagcaaggtttgcaacatgctcatgatgcaagaattccaccgacgttaccacgaagagaccggcattacgttcgcttccctgtacccaggttgtattgcgactacaggcttgttccgggagcatattccgcttttcagacttctcttccctccgttccaaaagttcatcaccaagggctacgtctccgaagaggaatctggcaaaagactcgctcaggttgtgagtgatccaagcttgacaaaatcaggagtttactggagctggaacaacaactcggcttcgtttgagaatcagttgtcggaagaagctagcgatgtcaccaaggctcgtaaaatctgggagataagcgagaaacttgttgggttggcttaatcatga

SEQ ID NO: 12118 - DNA, 1363 bp, Centaurea maculosa
tctttcttagatatttactcaaaaccctcttcacattttcacctccaatggctctccaagcaacttcatcttgtttctccatccacaaagaggggaaaaccaatgcatctttgaaggattccagcttgtttggagcatcattatcatctcatcttaaagttgacctcaaatcatcactatcaagaaacatgacggaatttagcggaaggggtgcactcaaaatcaaagccgtagctactacaacaccttccgtgaaccaagcctcgaccgacgcgaagaaaaccctacgaaagggcacggtcgtcatcacgggggcgtcctcgggtttgggtctagccacggcaaaagcgctagcggaaacaggaaagtggcatgtgataatggcttgtcgggactttctaaaggcggaaagatcggccaaatcggttggaatgccaaaggagaactataccgttatgcatttggaccttgcgtcgtttgacagcgtgaggcagtttgtcgccaatttcaagcaatcgggtcagccgctcgacgtgttggtttgcaacgcggcagtttattttccgaccgcaaaggagcccacgtatacggccgatgggttcgagctcagtgttgggactaaccatcttggtcacttcctgcttgcaagattgttgcttgatgacttgaagcagtctgattacccatcaaaaagactcattattgttggctcaattacaggcaacacgaacacgttggccgggaacgtacctccgaaggctaacctcggggacatgaggggtctagctggtggactaaacgggctcaacagctcagccatgatcgacggaggagatttcgatggtgccaaggcatacaaagatagcaaggtttgcaacatgctcatgatgcaagaattccaccgacgttaccatgaagagaccggcattacgttcgcttccctgtacccgggttgtatcgcgactacgggcttgtttcgggagcatattcctcttttcagactcctcttccctccgttccaaaagttcatcaccaagggcttcgtctctgaggaggaatccggcaaaagactcgctcaggttgtgagtgatccaagcttgacaaaatcaggagtttactggagctggaacaacaactcagcttcgttcgagaaccagttgtccgaagaagctagcgatgtcgtcaaggctcgtaaagtctgggagataagcgagaaacttgtcgggttggcttaatcacgatagatctctattcggtttgatccatctcggtgaggatgtgagtgtaggacatgagcacgggcagttttttcattgtaaatttaggtcgggttcgacaataaaatcactccgaatttacttgc

SEQ ID NO: 12119 - DNA, 1502 bp, Arabidopsis thaliana
atccactacgatagttttcttcagcaatcacactctctctttgttcgagtaccaacaatggcccttcaagctgcttctttggtctcctctgctttctctgttcgcaaagatgcgaagttgaatgcttcttcatcatctttcaaggactcgagtctttttggtgcctccattaccgaccaaatcaaatccgaacatggatcttcctcgttaagattcaagagagaacagagcttaaggaatctagcaattcgagcccaaaccgctgcgacttcaagccctacagttacaaaatccgtggacggcaagaaaacgttgaggaaaggaaatgtggtggtcactggagcctcgtctgggttaggtctagccacggctaaagctctagctgagacagggaaatggaacgtgataatggcgtgcagagacttccttaaagccgagagagctgctaaatccgtagggatgcctaaagacagctacacagtgatgcatttagacttagcctcgttggacagcgtgagacagtttgttgataatttcaggagaacagagacgcctctcgatgttttggtctgcaatgctgcggtttatttcccgacagctaaagagcctacttacagtgctgaagggtttgagcttagtgttgcgacgaaccatttgggacattttcttctcgcaaggttgttgcttgatgacttgaagaaatctgattacccttcaaagcgtctcatcatcgtcggatccattaccgggaacacgaatacattggcgggtaatgtaccaccgaaggcgaatctcggtgatttgaggggtttagccggcggattaaacggtttaaacagctcagctatgattgatggaggagatttcgacggtgcaaaggcttacaaagacagtaaagtctgcaatatgttgacaatgcaagagtttcacaggcgtttccatgaagaaactggagtcactttcgcttcgctttaccccggttgcatcgcctccacaggtttattccgagagcacattcctctcttccgtgccctcttccctccctttcagaagtacatcactaaaggatatgtctccgaaacagagtcaggcaaaagacttgctcaggtggtgagtgatccaagcttgacgaaatcaggggtttattggagctggaacaatgcttcggcttcttttgagaaccagttatcagaagaagcaagtgacgttgagaaggctcgtaaagtgtgggagatcagtgagaagctcgtgggcttggcctaataaacttgaagtctgttaaatttgatgacacctctcggtaccaatcgaagaaatctagtgaatttccgggatttttagatatctgattctgttgcgaagtttttttatccttattagtgtctgttgagtgtagattgcttggcgagtagcccacaataaagaaataaaaatggcgaatctttagctttatttactctgtttttcatcgaaacagattcagtaatatatactctgttttt

SEQ ID NO: 12120 - DNA, 1415 bp, Arabidopsis lyrata
aacatcacattacactcttaagtcttaaaagaaacaatggcccttcaagctgcttctttggtctcctctgctttctctgtcccaaaagatggaaaattaaatgcttcatcatcatcattcaaagagtcgagtctgtttggtgtttcactctcggagcatagcaaagctgactttgtctcttcttcattgagatgcaagagggaacaaagcttgaggaataataaagcaattattcgagctcaagcaatcgcgacttcaacaccatcggtcacaaaatcgtccttagaccgcaagaaaacccttagaaaaggaaacgtggttgtcacgggagcttcttcagggttagggttagcaacggcaaaggcattagccgagacaggtaaatggcacgtgataatggcgtgcagagacttcctcaaggctgagagagccgctcaatccgctggcatgcctaaggacagctacactgtgatgcatttggacttagcgtctttggacagcgtgaggcagttcgttgataacttcaggcgagccgagatgcctctcgatgtgttggtctgcaatgctgcggtttatcagccaacagctaatcaacctactttcactgctgaagggtttgagcttagcgttgggataaaccatttgggccactttcttctttcaagattgttgattgatgacttaaagaactccgattatccatcaaaacgtctcatcattgttggatccataaccggaaatactaatacattggcgggtaatgtacctccgaaggcgaatcttggtgatttgaggggattagcaggtgggttgaacgggctaaacagctcggcgatgatagatggaggagatttcgttggggcaaaggcgtataaagatagcaaagtctgcaacatgttgacaatgcaagagtttcataggcgtttccatgaagacaccggcataacttttgcttccctgtaccccggttgtatcgcgacaactggtttgttcagagaacatattcctctcttccgtaccctcttccctcctttccagaagtacatcacaaaaggttacgtctccgagacagaggctgggaaaagacttgctcaggtggtgggtgacccaagcttgacgaagtcgggagtgtattggagctggaacaagacctcggcttcatttgagaatcagctgtctcaagaagctagcgatgtcgagaaggctcgtagagtttgggaagtcagcgagaagctcgtaggcttggcctaaaaattgatatgagactcttcctctgtgttttaacctttggttttgcttaagatgataaataaacaaaagaggagacattgataaatcttgtaccaaatcaaatttgactttgtagttgtgttttggctaattctatctgtgatgaaataaataattccactttt

SEQ ID NO: 12121 - DNA, 1457 bp, Arabidopsis thaliana
cattcacattacactctttaagtcttaaacgaaacaatggcccttcaagctgcttctttggtctcctctgctttctctgtccgcaaagatggaaaattaaatgcttcagcatcatcatcattcaaagagtctagtctgttcggtgtttcactttcggagcaaagcaaagctgactttgtctcttcctcattgagatgcaagagggaacagagcttgaggaataataaagcgattattcgagctcaagcaatcgcgacttcaactccatcagtcacaaaatcttccttagaccgcaagaaaacacttagaaaaggaaacgtggttgtcacgggagcttcttcagggctaggtttagcaacggcaaaggcattagccgagacaggtaaatggcacgtgataatggcgtgcagagacttcctcaaggctgagagagccgctcaatctgcagggatgcctaaggacagctacactgtgatgcatttggacttggcgtctttggacagcgtgaggcagtttgttgataacttcaggcgagctgagatgcctctcgatgtgttggtctgcaatgccgcagtctatcagccaacggctaatcaacctactttcactgctgaagggtttgagcttagcgttgggataaaccatttgggccactttcttctttcaagattgttgattgatgacttgaagaactccgattatccatcaaaacgtctcatcattgttggatccataaccggaaacactaatacattggctggtaatgtacctccaaaggctaatcttggtgatttgaggggactagcaggcgggttgaacgggctaaacagctcggcgatgatagatggaggagattttgttggcgcaaaggcgtataaagatagcaaagtctgcaacatgttgacaatgcaggagtttcataggcgtttccatgaagacaccggcataacttttgcttccctttaccccggttgtattgcaacgactggtttgttcagagagcatattcctcttttccgtaccctcttccctcctttccagaagtacatcacaaaaggttacgtctccgagtcagaggctgggaaaagacttgctcaggtggtggctgatccaagcttgacgaagtcgggagtgtattggagctggaacaagacctcggcttcatttgagaatcagctgtctcaagaagctagcgatgtcgagaaggctcgtagagtttgggaagtcagcgagaagctcgtaggcttggcctaaaatttgatatgagatttttcctcggtgtttcaacctttggtttggcttaagatgagaaacaaacaaaaaaggagacattaataaagcctgtaacaactttgatttagtagttgtgttttggctgattctatctgtaatgaaacaaataattccacttttcaagttttttttgtcaaagaacatgaaacagagattgtaaacta

SEQ ID NO: 12122 - DNA, 1391 bp, Cleome gynandra
acacttcccgaacagataatttaaacagtctcttaaaacaatggctcttcaagctgcgtctctggtttcatcggctttctctgtcagaaaagaggcaaaatcgaatgcatcgtcattcaaggattctactctttttggtgtttcactttcagaccaaatcagagctgatttcggctcttgcccattgaaatgcaagagggaatacaacgcgaggaatggtgcgatacgagctcaaaccgcagcgacatcaagtccagcgatcatcaaatctgctgtagatgggaagaaaactctgagaaaagggaatgtagtggtgacaggagcctcgtcagggttaggtctagcaacggctaaggcattagccgagagtggtaaatggcatgtaatcatggcgtgtagggactttctcaaggctgagagagctgcaaaatccgcaggaatgcctaaaggaagttacaccgtcatgcatttagacctagcttcgttagatagcgtaaggcaattcgtcgataactttagaaggaaggagatgccactcgatgtcttggtctgtaacgcagctgtttacttacccacggctaaggaacccaccttcacagctgaagggtttgagcttagcgttgggacgaaccatttgggacatttccttctctccaggttgttactcgatgacttgaagaattctgattacccttctaagcgtctcatcatcgtcggctccatcacaggaaataccaacactttggcgggtaacgttcctcctaaggcgaatctcggggatttaagaggactagcaggcggattaaacggtctaaacagctcagcaatgatagatggaggagattttgatggggcaaaggcatataaagacagcaaagtatgcaacatgctgacaatgcaggagttccataggcgttaccatgaagaaacaggtgtaacgtttgcttcgctttatcccggttgcatcgccacaacgggcttgttcagggagcatatttctctcttcaggctccttttccctcccttccaaaagtacataacaaaaggatatgtctccgaggcagatgctggcaaaagacttgctcaggtggtgagtgatccgagcttgacgaaatcaggagtgtattggagttggaacaaaaattcggcttcgttcgagaaccagttgtcgcaagaagctagcgatgttgagaaggctcgtaaagtgtgggagattagtgagaagcttgttggcttggcctaatatatatcagtctaacctattcttcactttactcccacttcttgctgtgaaattttttcctagtgttgaattgagtgtcagattcgcccatcaaaacaaataaactttgcagcatttggattgacgtctctaatgatacacgtttcta

SEQ ID NO: 12123 - DNA, 5289 bp, Setaria italica
catcgccctgcctccccccgcacaccaggtcaccagcttgtatattccttcctccctacgctttccgttgctccaccaggccgcggaccgccccgcgccgccccctttccacctgttcgcgtgcgcatcagctcgcagccagccacccgctgatcgataacctcctctatcgctcgctcgctcgctcgcagctccgatcgagtgatcgcgagctcccatgagccgttcctgccgtcggccgacgacgacgacgagctgatcgaattcgccggcagccggggatcggcgaccagatggggacgccggtgaacatcatcgtcggctcgcacgtgtggttggaggaccccggcgaggcctgggtcgacggcgtcgtcaccgagatcaaaggccgcgacgccaccatcgccaccaccaatggcaaaacggttgtggcaagccttggtagcatataccccaaggacacggaggcgccgccttcgggagtggacgacatgacgaagctggcgtacctccacgagccaggggtcctgcacaacctctcctgccggtacggtctcaacgagatatacacgtacaccgggaacatcttgattgcggtgaaccctttccagaggctgcctcatctgtatgacgtgcacatgatggagcagtacaagggcgccacctttggggagctcagcccccatctcttcgccattgcagacgcctgttacagggcgctgatcaatgatcacgggagccagtccatcttggtgagtggcgagagtggtgctggtaagacggagacgacgaagatgctcatgaggtatcttgcattcatgggaggaaggtccggcacggaggggcgtactgttgagcaacaggttctagagtctaacccagtactagaagcatttggtaacgcaaagacagtgaagaacaataactcaagtcgcttcggtaagtttgttgaaatccaattcgacaagtatgggaagatatctggggctgctgttcgcacatatctcctcgaacgatcgcgagtatgtcaggtctctgatcctgagaggaactaccattgcttttacatgctttgtaacgcgccccctgaggatgtaaaaaggttcaaggtaggagacccaagatcattccattacttgaaccaaacaaactgctacgaagtagcaaatgtggatgatgcaagagaatacattgaaaccagaaatgctatggatatcgttggcattgatcaagaggaacaggatgcaatcttcagagtagtagctgcaatccttcacctaggaaatattgaattctccaaaggaaaggaaattgactcatccaagttgagagacgataaatcagtccatcacttgaaaacagttgcagaactgctaatgtgtaacgagaaggcccttgaagattccctttgccagcgagttattgtaacacctgatggaaatatcacgaaaccccttgatccagattctgctgcactaagtcgtgatgctttagcaaagacggtatactcaagactgtttgactggattgtagacaagatcaataactctattggtcaggatccagatgcgaccgatataataggcgtgcttgatatctatggattcgagagcttcaagattaacagtttcgagcaactatgcatcaatttgacaaacgagaagttgcagcagcacttcaatcagcatgtgtttaagatggagcaagaggaatacacaagggaagaaatagactggagctatgttgaatttgtagacaatcaggatgtgctggacctgcttgagaagaaacctggaggaataattgctctcctggatgaggcatgcatgtttccaaagtccacacatgaaacatttgcccagaagatgtaccaaacatacaaggcacataagcgcttcagcaagcccaaacttgctcgcaccgcctttacaatcaaccactatgcaggagatgtcacatatcaagcagatcagttcctagataagaacaaagactatgtggtagctgaacatcaagctctactaaattcttcaaggtgccattttgttgcaaatctctttcctccattacctgaggagacttctaaacagtccaaattctcttcaatcggtactcgctttaagcaacaactgcaatccctcatggaaacactgagtacaacagaacctcactacattagatgtgtgaagcctaatactgtactgaaaccaggcatctttgagaacttcaacgtcttgaatcaattgagatgtgggggtgttctggaagcaatccggatcagctgtgctggctatccaacaaagaggacatttgatgagttcattgatcggtttggaatgcttgcaccagagcttgtggacagctctgatgagaaggccgcttgtgcagccatatgtgatagaatgggtttgaaaggatatcagatagggaaaacaaaggtattcttaagagctggtcagatggcagagctggatgctcgaagagcagaagtattggcaaatgctgcgcgactaatccagaggcgtataaagacacatcttatgcgaaaggaattcgtcaacttacgaaaagcctcaattaaatctcagaagttctggagagcaagactagctagaaagctttttgagtatatgagaagagatgctgcttcaattaggatacaaaagcatgcacgtacccattctgccagaaaagcgtaccttcaagtatatgaatcagctatagtaatacagacaggattacgagcaatggcagctcgcaatgaacacaggttccgaagagagaccaaggcttccataattatccagactcgatggcgccaacacaaagcttatgttgcttataagcagcaaaagagagcttcgttgattcttcagtgcttgtggagggcacgtattgcaagaaaggaacttcggaaactgagaatggaagcgagagagactggtgcactcaaagaagctaaagacaagcttgaaaagagagtagaagaacttacatggcggttagatgttgagaagcgtttgaggactgaccttgaagaagccaagggccaagaaattggaaagttgcaatctgcattgcaagaaatgcaagaaaagattgaggaagcccatgcagcaatattgaaggagaaagaagccgcgaagttagcaattgaacaggcaccaccaaagatagtagaagtgccagttgtggatactgcagaagttgagcagttgacaagtaaaaataaagaacttgaggatgaagtaagtacatttaaacagaaggctgaagatcttgaagagaagcttcttgagttgcaaaaacgatctgatgaattgtcacaggagacactagaacgagaatccaaggttaatcaacttcaagagatgattgaaaggcttgaaacaagtttatccagtatggaatctgaaaaccaagttctacgacaacaatctttggttgttgcatcagcagatgaggataaatcaaaacagatagaaagactggaaagcaagattgccattttggagtcagagatccagttgctccgcagtaattctgtgcttgctgttcaggccatagtcactcctgaaatgaatcaaacatccgtaatggagaacctcgttcacaaggaaattgataacagacaccagcttgaagaagttaaaatagccaatgagcaggtggctgttcctcctgtaaagaatctaagcaaacaaaaatcactgacggatcggcagcaagaaaatcatgatgccctgattaaaagtctggtaggagacaggagatttgatgacaaaaaaccagctgccgcatgcattgtctacaaatcactcctacactggcattcatttgaagcagagaagactaatatatttgatcgaatcatccaaacaattaggtcatcagttgagggtgctgaaagttctggagagctagcttattggttgtcgacaacatcaactctcctctgcttattacaaaataccctcaaagctagcagttcattaagaaaaggatcgaatcacagccggactgcaacaggcagcctgttcagtagaatggtgcagagtgcccggatatcatcgtcaggattaggtgtaactagtggatacagtggaatggtaggaaggcctgacactgcatcaatggtagaggcaaaatatccagcaattcggttcaagcaacagttaacagcatatgttgagaagatatatgggacaatcagagataacctgaagaaggaaataagtccattcttgactctgtgcatacaggctccaagagctaatcgcatgagaccatctcggggatcactaaaaagtatacactctaatgcactatcaagacaggcatcaagtgtacattggcaaagcattgttaagtgcctggatcatacactggaaataatgaaaaataaccatgtacctccaatgataatcaagaaaacatttagtcaagtatatgcatatttgaatgtgcaactcttcaacagtttgctacttcgtcgggaatgctgctcttttagcaatggggagttcttaaaggctggcttacaggaactggagcagtggtgctctagaacaactgaagagtatgcaggggcatcttgggatgaactgcaacacattaggcaggcagttggtttcctggttctgcatcagaagtcacacaaaaacctggaggaaatcatgaatgagctttgccctgttctgagcataactcaaatatatcgcatagcaacaatgttctgggatgacaaatatggtgcacaaggtctatcccaagaggttattggaaagatgagaacgatgacgacagatgactcgataactactccaaatagttctttcttgctagatgacgactcgagcatacctatatccttggatgatatagcacgactgatgcttgacatcgacccttcagatgtggagccaccgccactactgaggcagaactcgcagtttcacttccttctgcagcagcatacggactaatttctacaaacaaagacataccggtacagctatttgtaaagttgctaaggactgaagattcttttataggagtgcacagattgagttgcaattttttcttccctttaaaatttttgggtgggaatgtttacaggaaagagaaatataggatttttgttcaggaaaaaagaaagagaaatataggatatcctgatacagttctttccattgttttgattgtttggaacagacattgtaattatttgaggaagtgtataaatggaaacatatatatttgtacccaaccacattcaacgcaaacata

SEQ ID NO: 12124 - DNA, 5295 bp, Panicum virgatum
cggcctccttttcccagcaaaagggagagccgaaccagctcacacccggcgaccgccaccccactccgcatcgccctgcctcccctctgctctgcacaccagcttgtatattccttcctccctacgctttccgttgttccgccaggccgcggaccgccccctttccacctgttcgcgtgcgcattcgctcgtcggccagccacccgctgatcataacctcctccctctccctcgctcgcagctccgatcgagtgatcgagctccctcccatgcgcggttcgtgccgtcggccgacgacgacgaggagctgaatcagcaggcagccggatcggccgccagatggggacgccggtgaacatcatcgtcggctcgcacgtgtggctggaggaccccggcgaagcctgggtcgacggcgtcgtcaccgagatcaaaggccgcgacgccaccatcgccaccaccaatggcaaaacggttgtggcgagccttggtagcatataccccaaggacacggaggcgccgccttcgggagtggacgacatgacgaagctggcgtacctccacgagccaggggtcctgcacaacctctcttgccggtacggcctcaacgagatatacacctacaccgggaacatcttgattgcggtgaaccctttccagaggctgcctcatctctatgacgtgcacatgatggagcagtacaagggcgccacctttggggagctcagcccccatctcttcgctatcgcagatgcctgttacagggcgctgatcaatgatcacgggagccagtccatattggtgagtggtgagagtggtgctggtaagacggagacgacgaagatgctcatgaggtatcttgcattcatgggaggaaggtccggtacggaggggcgtactgttgagcaacaggttctagagtctaacccagtacttgaagcatttggcaatgcgaagacagtaaagaacaataactcaagtcgttttggtaagtttgttgaaattcaattcgacaagtatgggaagatatctggggctgctgttcgcacgtatctccttgaacgatcacgagtatgtcaggtctctgatcctgagaggaactaccattgcttttacatgctttgtaacgcaccccctgaggatgtaaagagatttaaggtgggagacccaagatcattccattacttgaaccaaacgaactgctatgaagtagcaaatgtggacgatgcaagagaatacatagaaaccagaaatgcaatggatattgttggcattgatcaagatgaacaggatgcaatcttcagagtagtagcagcaattcttcacttagggaatattgacttctccaaagggaaggaaattgattcatccaagttgagagatgataaatcagtccatcacctgaaaacagtcgcagaactgcttatgtgtgacgagaaggcccttgaagactccctttgtcagcgagtcattgtaacacctgatggaaatatcacgaaacccctcgatccagattctgctgcattaagtcgtgatgccttagcaaagacagtatattcaagactgtttgactggattgtagacaagatcaataattcaattggtcaggatccagatgcgaccaatataataggcgtgcttgatatctatggattcgagagcttcaagattaacagttttgagcagctatgtatcaatttgacaaacgagaagttgcaacagcacttcaaccagcatgtgtttaagatggagcaagaggaatacacaagggaggaaatagactggagctatgttgaatttgtagacaatcaggatgtgctggacctgattgagaagaaacctggaggaataattgctcttctggatgaggcatgtatgtttccaaagtccactcatgaaacatttgcccaaaagatgtaccaaacatacaaggcacataagcgcttcagcaagcccaaacttgctcgcactgcctttacaatcaaccactatgcaggagatgtcacatatcaagcagatcagttccttgataagaacaaagactatgtggtagctgaacaccaagctctactaaattcttcaaggtgcccttttgttgcaaatctctttcctccattacctgaggagacttctaaacagtccaaattctcttcaatcggtactcgctttaagcaacaacttcaatccctcatggaaacactgagtacaacagaacctcactacattagatgtgtgaagcctaatactgtactaaaaccaggcatctttgagaatttcaacgtcttgaatcaattgagatgtgggggtgttctggaagcaatcaggatcagctgtgctggctatccaacaaagaggacatttgatgagttcattgatcggtttgggatgcttgcaccagagcttgtggacagctctgatgagaaggccgcctgtgcagcaatatgtgatagaatgggtttgaaaggatatcagatagggaaaacaaaggtattcttaagagctggtcagatggcagagttggatgctcgaagagcagaagtattggccaatgctgcgcgactaatccagaggcgtataaagacatatcttatgcgaaaggaatttgtcaacttacgaaaagcctcagttcaatctcagaagttctggagagcacgactagctagaaagctttttgagtatatgagaagagatgctgcttcaattaggatacaaaagcatgcacgaggccattctgccagaaaagcataccgtcaagtatatgaatcagctatagtaatacagacaggaatacgggcaatggcagctcgcaatgaacacaggttccgaagagagaccaaggcttccataattatccagactcgatggcgccaacacaaagcttatgttgcttataagcagcaaaagagagcttcattgattcttcagtgcttgtggagggcacgcatcgcaagaaaggaacttcggaaactgagaatggaagcaagagagaccggcgcactcaaagaagctaaagacaagcttgaaaagagagcagaagaacttacatggcggttagatgttgaaaagcgtttgaggactgaccttgaagaagccaagggccaagaaattggaaagttgcaatctgcattgcaagaaatgcaagaaaagattgaggaagcccatgcagcagtattaaaggagaaagaagccgcgaagttagcaattgaacaggcaccaccaaagatagtagaagtgccagttgtggacactgaaaaagttgaacaattgacaagtaaaaataaagaacttgaggatgaactaagtacatttagacagaaggctgaagatctagaaaataagcttcttgagatgcaaaaacggtctgacgaattgtcacaggagacacaagaacaagaatccaaagttaatcaacttcaagagatgattgaaaggcttgaaacaagtttatccaatatggaatctgaaaaccaggttctacgacaacaatctttggtcgttgcaacagcagatgaggataaatcaaaacagatagagagactggaaagcaagattgccatcttagagtcggagatccagttgctccgcagtaattcagcgcctgctgttcaggccgtggtcacccctgaaatgtatcagacatcagtaatggagaacctcattcatatggaagttgacaatggacaccagcttgaagaagctaaaatagtcaatgaacaggtggttgttcctcctgtaaagaatctaagcaaacaaaaatcactgacagatcgacagcaagaaaatcatgatgtcctgattaaaagtcttgtagaagacaggagatttgatgccaaaaaatcagctgcagcatgcattgtctacaaatcactcctgcgctggcgttcatttgaagcagagaagactaacatatttgatcgaatcatccaaacaattaggtcatcagttgagggtgctgaaagttctggagagctagcttattggttgtcaactacatcaactctcctctacttattacaaaataccctcaaagctagcagttcatcaagtaaaggatcgaatcgcagccggactgcaacaggcagcctgtttagtagaatggtgcagagtgcccggacatcatcatcaggattaggcataactagtggatacggtggaatggtaggaaggcctgacactgcatcaatggtagaagcaaagtatccagcacttcggttcaagcaacagttaacagcatacgttgagaagatatatgggataattagagataacctgaagaaagaaataagcccattcttgactctatgcatacaggctccaagagctaatcgcgtgagaccatctcggggttcactaaaaagtatacactctaatgcactatcaaggcaagcatcaagtgtacattggcaaagcatagttaagtgcctggaaaatacactggaaacaatgaaaaataaccatgtacctccgatgataatcaagaaaacatttagtcaagtatatgcatacttgaatgtgcaactcttcaacagtttgctacttcgtcgggaatgctgctcttttagcaatggggaattcttgaaggctggcttacaagaactggagcaatggtactctagaacaactgaagagtatgcaggggcatcttgggatgaactgcaacacataaggcaggcagttgggttcctggtgctgcatcagaagtcacacaaaaccctggaggaaatcacaaatgagctttgccctgttttgagcataactcaaatctatcgcatagcaacaatgttctgggacgacaaatatggtgcacaaggtctatctcaagaggtcattggaaagatgagaatgatgacaacagatgattcgataactactccaaatagttctttcctgctagatgatgattcaagcatacctatatccttggacgatatagcacatctgatgcttgacatcgacccattagatgtggaaccgccagcactactgaggcaaaactcgcagttccacttccttctgcagcagcacacagactgatttctacaaacaaagacaaatcggtacagctatttgtaaagttgctaaggactgaatgatttttttataggagtgcacagattgagttgcgttttccttttttttcatttcaaaattttgggtgggaatgtttacaggaaagaggaacataggagatcctgatgcaattcttttcattgttttgattgtttggaaacagaaaaaaaatactgtaattgtttgagaaagtgtataaatgaaagtatatatatttgtaccaaatca

SEQ ID NO: 12125 - DNA, 7952 bp, Brachypodium distachyon
atgcacgaagaggatggggcggtttcggtgatgcgttcttacctctgctcgtcgtggtcttggttgaacgaagaggaggtcagctgtatgcagaaccagagccttcttatctgaacttctgaaggcagcagctgcattccgggttggctcgaacaaggaggagatggaccgtcaccaggtttaattggcccagtgacaatgtgtgggcttttccaaatctcatttaatcaaggcctcgtccggttacagatttccccacatgtattgaaaggatttaatttcccttcatccctctcaaatctcaatcccttccggtgtgggatgaattgttccgtagtgtattcaaactagttataatttaggtttgcggaagagatttagtgatttcataaagagaaaaagaccgtatttaacgtaagagacggttatatcttctttccttattagctggactagaagttatacatagacaaagtgttgatacggacggttaaaagacaccatgtaaaaatatcatgcgttggatttttggtatctcgacaaaaaaactccacaatggaatgcgagttgatgcaaacaagggacgtttcaacaaatgaaaatagtgggaaaagtgcagtcccgaggattgctcatgcacgtcaattctccttttcaggaataaacaattttagaagacatactagcacgttgtgaagagcatgaagagtgttcttctgttcatactgaaacgtcgtgagctggcttgtgtattttatttggaggtgacctatcatcaaatttgagttttgatctgaaattgcaaaaaatgtgaatgactggaaatcgacccagatttttgaaaacctagaaaaaattacatttgaatgctacgaaccaaattaaaatacacttagaacaaaatcacaaaatgcttattttaagaaactatttttttatttctaactgaatttttgggctctttttttcttcgaaaaattctaaattgtttgtactggctagctgtgcttaccacatttaccggggccaatgattttcgataacttttttttaggtcaaactagtccagttttggagtttaggatcagaaactaaaccggtcaacagtagagtgccaaatttggacaattcttcaactgattacgaatagtactactccgtaccgtacattgttagaacaactacagccaacacatcggccaaatatttaacacgcacgattatggttgattccgatcgagctaatcaaactggtacaggagtactactgaaaacctggtgtctcggtcgagttctattgtccttttctcaaaattggcagcagagcgccggcggaaacgtgccggtgacgacggccaaccgtgcaacggccgaaaggccaaagatcattttcatcgatccatctttatggggtgtcccttttgtttcgccaccgtccaaggaaaaaagagtgggctgggccaccgcgggacgagatgtcgtcatgtcgagttcacgccgggggccacgcgacagttctatgctctgtcttaaaaaaagacattcaaaaaacgatcatacacttgcacctacgcgtcgggggccacgcgacagttctatgctctgtcttaaaaaaagacattcaaaaaacgatcgtacacttgcacctacgaagacaccggtcaaatcttagaataaacccacgtaaatgtgagcacccacgtaaaggtggtctggttccaccgtaaggaaccagaccacctgctcagctcacatttgctatgtcttctgacaaagacttcagtctcgaaattattattagccaggcatttagtgtgtgtttgtgatgaaataggttcttttttctttgggatttttttttgcaatgcagtaagttaacgggatttcagtggaaaatctatgagaaacgatgaatgtttaagggaacgtacgctgacctgttacaaacaggttctcaatcccaaaataaagaaaagacaagttcttagataaaatatgtgacatacacacaaatggagcatcactatttgaaatttatgataacatttttgtgtgccgaatctcaacaaagtatttttattatcgttcgatttttttctgggaagaagatgcaaaggaacccaataccccggtggcacgcactaaatgcatgactaataataattttgagaccgacaaacaacatgaagagtacatcacaattaaacactagtgttcttcgtttatataaaaaaagacacttgtcttctccgatgacagcgaggatgtttcctgacaaggctatgaagatttttctcttcatgttgtttttcggtgtcggggcggcatgtttgccactctattttaaattataaaaccttctagttttgttccgagtcaatgttttttttttctaaccaaacttacagaaaaatgtattaataactacaatatcaataagtatactatcaatatatatatatatatatgttatttaatagaactaatctagtgctatagatgttggtaggtttttctataaatttaatcatttttttacttgcttgtgtggaggctgagtccacccatagttttaagccagtttaccctattaacctgtggattttaattttttaactctatactagttcttatttcaatgcatctcaccctctcttatggaaaaaataaatcctagtacggagtaccaaaataaaaataaaaataggatacaaaaataggacgatttccaaacctgccatcctgtcgttgtacttggcatgaatggaccattttctttcttctccttttcgctctttcggtggagccgccagcagcgcagagcacccatggaaaaatcgatggccggagctagctgctggtggtgtctcgcggggtgggcgtagcgattccggcctttcccaacaaaaaggaagacttgaaccagctcacatccccgcgaccgccaccccactccgtccctcgctccgctcccaccaccttgtatattcttccttttctcctttccttccttcctctgctttccttccatctcctcctactagcctcctgccatcccatcgcatcgctagctagcttgcccccgcctgccctttccagttgtcagcgtgcgcattcgcaacaaccgcgctcgagttcagctaagtttagctcgggaggtccccgtgtttgcatgagcaggaatcaatccctcgccagcggctgcgatcgcgcggagtttgagtccacccgtggactgaatcggtcaaatggggactccggtgaacatcatcgtcgggtcgcaggtgtggctggaggatcccgacgacgcgtgggtcgacggcgaggtcaccgggatcaagggcggagacgtcaccgtcgccaccaccaatggcaaaacggttgtggctagccttgcgagtatacaccccaaagacacggaagcgcccccggcaggagtcgatgacatgacgaagctggcctaccttcatgaaccaggggtcttgcataaccttgcttgtcggtacggccttaacgagatatacacatacaccgggaacatcttgattgcagtcaaccctttccagaggctgcctcatctctatgatgtgcacatgatggagcagtacaaaggcgccaccttcggggagctcagcccccatctctttgcgattgcagattcttgttacagggcaatgatcaatgaacatggaagccagtcaatcttggtaagtggtgagagtggtgctggtaagacggagacaacgaagatgctcatgaggtaccttgcattcatgggaggaaggtctggaacagagggacgaaccgttgagcaacaagtattagagtctaatccagtactggaagcatttggcaacgcaaagacggtgaagaacaacaactcaagccgtttcggtaagtttgttgaaatccaattcgacaagtacggaaagatatctggtgcagctgttcgcacatacctccttgaacgatcacgagtatgccaggtctctgatcctgaacggaactaccattgcttttacatgctatgttctgcaccaccggaggatgtgaaaaggtttaaggtgggagacccaagatcatttcattacctgaaccaaacaaactgctatgaagtagctaatgtggatgatgcaagagaatacctagaaacgagaaatgctatggatatagttggcatttgtgaagaagagcaggatgcaatctttagagtagtagcggcaatacttcatctaggaaacattaatttctccaaaggggaagaaattgattcgtcaaggttgagggatgagaaatcagtctaccacctgaaaacagtggcagaactgctaatgtgcgatgagaagtacctcgaagactctctttgtaagcgtgttattgtaacacctgatggaaatatcacaaaacctctcgatccagactctgctttacagagtcgtgatgccttagcaaagacggtgtattcacgacttttcgactggatagtggataagattaataactctattggtcaagatcctgatgcaatcagcataataggggtcctggatatatatggatttgagagtttcaagatcaacagttttgagcaactatgcatcaacatgacaaatgaaaagttgcagcagcactttaatcagcacgtattcaagatggagcaagaagaatacacaagggacgaaatagactggagctatgtggaattcgtggacaatcaggatgtgctggacctgattgagaagaaacctggagggataattgcactactggatgaggcatgcatgtttccgaagtccactcatgagacatttgcacaaaagatgtatcaaacatacaaagcacataagcgcttcagcaagcccaaacttgcaaggactgcatttacaatcaaccactatgcaggagatgtcacataccaagctgaccagtttcttgacaagaacaaagactatgtggtggctgaacatcaagctctactaaattactcaaggtgcccttttgtagcaaacctctttcctccattacctgaggaaagttctaaacagtccaaattctcttccatcggcactcgctttaagcaacaactacaagccttgatggaaacactgagtacgacagagccacactacattagatgtgtgaagcctaatactgtactgaaacctggcatcttcgagaactacaatgtcttgaatcaactgagatgtggtggtgttttggaagcaatcaggatcagttgtgctggctatccgacaaagagaacatttgatgagttcattgatcgatttggagtgcttgcaccggagcttgtggacagttctgatgagaaggcagcttgcgcagcaatatgtgatagaatgggattgaagggatatcagatagggaaaacaaaggtattcctaagagctggtcagatggcagagctggatgctagaagagcagaagtattggccaatgccgttcgacttatccagaggcgtataagaacacatcttatgcgaaaggaattcaccaacttaagaaaagcttccattcaaactcagaagttctggagagcacgactagctcgaaagctttttgagcacatgagaagagtggctgctgcaattacgatacagaagcacacacgtactcgttctgcctggaaagcatatctacaaatctacagatcatcaataacaatacagacaggattacgtgcaatggctgctcgcaatgagcacagattcagaagacagaccaaagctgccataatcatccagactcgatggcgccagcacaaagcttatgttgcttacaaacagcaaaaaaaagcttctttgattctccagtgctcgtggagggcacgtgtggcaagaaaggaacttagaaagctcaaaatggaagcaagagacaatggtgcactgaaagaagcaaaagacaagctggaaaagagagttgaggaactcacctggagattagacgttgagaagcatttgaggattgaccttgagatatccaagggtcaagaaattgtaaagttacaatctgcgttgcaagaaatgcgagaaaagcttgaggaagcccatacagcaataataaaggagaaagaggatgcaaagctagcaattgagcaggcaccaccaaagatagtagaggtgccagtggtggataatgaaaaagttgagttgctgacaagtcaaaacgaggaacttgagggcaaatttggtatgtttaaaaagaaagctgatgatcttgagaacaagcttattgagattcaaaaacagtttgacgaattgtcacgggagacacaagagcgagactccaaaattaatcaacttgaagagatgatttctaggcttgaaacaaatttatccagcatggaatctgaaaaccatgttctgcgtcaacaatcgttgcttgcatcagcagatgatgataaatcaagacaaatagagagtctggaaagcaagattgccaacttggagtcagagaatcaattgctccgcaacaattctgcactagctgttcaggcagcagtcactcctgaagtgattcagccatcagttattgaggttctcgaaaatggacagcagcttggagaacttaaaatcttcaatgagcaggtggttgttccccctgtaaagaatttaagcaaacagaaatcgctcacggaccggcagcaagaaaatcatgatgtacttatcaaaagcctggctgaagacaggagatatgacaaccgtagaccagctgcagcatgtatcgtctataaatcactcctgcactggcactcattcgaagcagagaagactaacatatttgaccgtatcatccatacaattaggtcatctattgagagtgctgaaggttctggagaactggcttattggttgtcgacaacatcgaccctcctttaccttctacaaaatacccttaaaactagcagttcatcaactaaaggatcaaaccgcagcaggacctcaaccggcaacttattcaatagaatgatgcaaaatgctcgatcatcatcgtcaggattaggcatttcaagcggttacagtggaatgataggaaggactgacattgcatcaatggtagaggctaagtatcccgctgttcgtttcaagcagcagttaacagcatatgtggagaagatatatggcatgatgagagatagcctgaagaaggaaataagtacaatattgattatgtgcatacaggctccgagagctgttcgtgtgagatcatctagaggatcattgaaaagcatacactctagtgcactatcaaggcaagtatcaaatgtgcattggcaaaacattgttatgtgcctgaataatacattggaaacaatgaacagcaattatgtacctccaatgataatcaggaaaacattcagtcaagtgttcgcatttatgaacgtccaactctttaacagcttgctactccgccgtgaatgctgctcctttagcaatggcgaattcttgaaggccggcttacaggaactggagcagtggtgctctagaacaactgaagagtttgcaggaacatcttgggatgaaatgaaacacataaggcaggcagttgggttcctggttttgcatcagaagtcgcacaaaaccttggatgaaatcacggatgagctatgccccgttctgagcatcacccaaatatgtcgtataggaacaatgttctgggatgacaaatatggtgcacaaggtctatctcaagaggtaattggaaatatgagaacattgacgaccgatgactcggtagctactccaaatagttctttcttgctagatgacgattcaagcataccgatatccttggatgatatctcacggctgatgcttgacatcaacccgtctgacgtggagccgccaccgctgctgaggcagaactctcaatttcactttcttctgcaacaatgtacataatgattgcattgtatatacaggaaatacagaaag

SEQ ID NO: 12126 - DNA, 5324 bp, Sorghum bicolor
cccccccccccccccccccccccccccccacccccccctcctccatctaggctccagcaaaaagggagaggcgaaccagctcagagccggcgaccgccaccccactccgcacgtactacgccgctcgctcctgtgctgtgcaccagcttgtatattccttctcccctacgctttccgtggttccattccattccattccatcaggccgcagaccgcccccgcgccgcccctttccacctgttcgcgtgcgcattcgcgcagccagccagccaccggctcatcgttgatccatcgatatcctcctcctcctcctctctccctcgcgcgctcgcagttccgatccactgatcgagctcctatgcgcggttagctcctgccggcggtggccaacgacgacgagccacgagctgatcgatacaagtccgccgccggatcggccaccagatggggactccggtgaacatcatcgtcggctcgcacgtgtggcttgaggaccccggcgaggcctgggtcgacggcgtcgtcaccgacatcaaaggcggcaacgccaccatcgccaccaccaatggcaaaacggtcgtggcgagccttgacagcatataccccaaggacacggaggcgccgccgtcaggagtggacgacatgaccaagctggcgtacctccacgagccgggcgtcctgcacaacctctcctgccgatacggccttaacgagatatacacgtacaccgggaacatcttgatcgcggtgaaccctttccagcggctgcctcacctctacgacgtgcacatgatggagcagtacaagggtgccagctttggggagctcagcccacatctcttcgcgatcgcggacgcctgctacagggcgttgatcaatgatcaggggagtcaggcaatcttggtgagtggcgagagtggtgccggcaagacggagacgaccaagatgctcatgaggtatcttgcattcatgggaggaaggtccggtaccgagggacggactgttgagcagcaggttctagagtctaatccagtacttgaagcatttggtaacgcaaagacagtgaagaacaataactcaagtcgattcggtaagtttgttgaaatccagttcgacaagtatgggaagatatcaggggctgctgtacgcacatacctccttgagcgatcacgagtatgtcaggtctctgatcctgagaggaactaccattgcttttacatgctttgttccgcaccccctgaggatgtaaagaggtttaaggtgggagaccctagacaattccattacttgaaccaaacaaactgctatgaagtagctaatgtggatgatgcaagagaatacttagaaacaagaaatgctatggatattgttggcatcgatcaagaggaacaggatgcaatcttcagagtagtagcagcaatccttcacctaggaaacattaacttctccaaagggcaggaaattgactcatccaagttgagagatgataaatcagtctatcacctgaaaacagttgcagaactgctaatgtgtgatgagaaggcccttgaagactccctttgccagcgtgttattgtgacacctgatgggaatatcacgaaaccccttgatccagattctgcagcattaagtcgtgatgccttagcaaagacagtatattcacgactgtttgactggattgtcgacaagatcaataactcaattggccaggatccagatgcgaccaatataataggtgtgcttgatatctatggatttgagagcttcaagattaacagtttcgagcaactatgcatcaacttgacaaacgagaagttgcagcagcatttcaatcagcatgtatttaagatggagcaagaagaatacacaagggaggaaatagactggagctatgttgaatttgtagacaatcaggatgtgctggacctgattgaaaagaaacctggaggaataattgcactcctggatgaggcatgcatgtttccaaagtctacacatgaaacatttgctcaaaagatgtaccaaacatataaggcacataagcgcttcagcaagcccaaacttgctcggacagcctttacaatcaaccactacgcaggagatgtgacatatcaagcggatcacttccttgataagaacaaagactatgtggtagctgaacaccaagctctactaaattcttcaaggtgcccttttgttgcaaacctctttcctccattacctgaggaaacttctaaacagtccaaattctcttcaatcggtactcgctttaagcaacaactgcaatccctcatggaaacactgaatacaacagaacctcactacatcagatgtgtcaagcctaatgctgtactgaaacctggcattttcgagaaccacaatgtcttgaatcagttgagatgtgggggtgtcctggaagcaattcggattagctgtgctggttatccaacgaagaggacattcgatgagttcattgatcggtttggaatgcttgcaccggagcttgttgacagtgatgagaaggccgcttgtgcagcgatatgtgatagaatgggtttgaaaggatatcagatagggaaaactaaggtattcctaagagctggccagatggcagagctggatgctcgaagagcagaaattttggccaatgccgcgcgactaatccagaggcatataaaggcacatcttatgcgaaaggaattcattaacttacgaaaagcctcagttcaatctcagaagttctggagagcacgactagctagaaagctttttgagtatatgaggagagacgctgcttcaattaggatacaaaagcacgtgcgtacccattctgccaggaaagcgtacctacaagtatatgaatcagctatagtaatacagacaggattacgagcaatggcagctcgcaatgaacacagattccgaagagagaccaaggcatccataattatccagactcgatggcgccaacacagagcttatgttgcttacaagcagcaaaagagagctgctttgattcttcagtgcttgtggagggcacgcattgcaagaaaggagcttcggaaactgaaaatggaagcaagagagactggcgcactcaaagaagcaaaagacaagctagaaaagagagtagaagaactcacatggcggttagatgtcgagaagcgtttgaggactgaccttgaagaagccaagggccacgaaattgaaaagctacaatctgcactgcaaaaattgcaagaaaatctcgaggaagcccatgcagcaatagtaaaggagaaagaagctgcgaagttagcgattgaacaggcaccaccaaagatagtagaagtgccagttgtcgacaatgcaaaacttgaggagttgacaactcaaaataaagaacttgaggatgaactaactacgtttaaacagaaggctgaggatcttgaaaataagcttcttgagttgcagaaacagtctgatgaactgtcacaggagacacaagaacaagcgtccaaagttactcaacttcaagagctgatcgaaaggcttgaagcaagtttatccaatatggaatctgaaaaccaggttctacgacaacaatcactggttgttacatcagctgatgaagataaatccaaacagatagagagattggaaagcaagattgccaccttggagtcagagatcgagttgctccgctgtaattctgcactagctgttcaggcagtggtcactcctgaaatgaatcagacaacagtaatcgaggaacttgacaatggacatcagcttgaagaagttaaaacggtcaatgagcaggtggttattcctcctgtaaagaatctaagcaaacaaaaatcactgacagatcgacagcaagaaaaccacgatgccctgattaaaagtctggtagaagacaggagatttgatgacaaaaaatctgctgcagcatgcattgtctacaaatcactcctacactggcattcatttgaagcagagaagactaacatatttgatcgtatcatccaaacaattaggtcatcagttgagggagcagaaagttctggagagcttgcctattggttgtcgacaacatcaactctcctctacttattacaaaacactctcaaagctagtagttcattaagtaaaggaacaaatcgcagccggaccacaacaggcagtctgttcagtagaatggtgcagagtgctcgggcatcatcaggattaggcatacctagtggatacagtggaatggtgagaaggcctaacactgcatcaatggtagaggcacaatatccagcacttcggttcaagcaacagttgacagcatatgtcgagaagatatatgggataatcagagataacctgaagaaggaaatcagtccattcttgactatgtgcatacaggctccaagggctaaccgtgtgagaccatctcggggatcactaaaaagcattcactctaatgggctagctaggcaagcatcaagtctacattggcaaaacattgttaagtgcctggatcatacactggaaacgatgaaaaataattatgtacctccggtgataatcaggaaaacatttagccaagtatttgcatatttgaatgtgcaactcctcaacagtttgctacttcgtcgggaatgctgctcttttagcaatggggagttcttaaaggctggtttacaagacctggagcagtggtgctctacaataactgaagagtatgtagggacatcatgggatgaactgcaacacattaggcaggcagtcgggttcctggttttgcatcagaagtcacacaaaaccctggaggaaatcacaaatgatctttgccctgttttgagcataactcaaatatatcgcatagcaacgatgttctgggacgacaagtatggtgcacaaggtttatctcaagaggtgattggaaagatgagaacgatgacaacagacgactcaataactactccaaatagttctttcttgctagatgacgactcaagcataccaatatcattggatgatatagctcgactgatgggtgacattgatccgtccgatgtggaaccgcccccactactaaggcagaattctcagtttcattttcttctgcagcagcacacagactgactgatatctacagatataaagagtaaaacggtacagttacttgtgaagttacagagaactgaagattttttataggagtgcacagattgagttgtggttttttcttccatttttttataactttgggtgggaaaatgcctacaaagaaagagaaatataggatatatcctgatatcattcttttgattgattgattgattgaaacagag

SEQ ID NO: 12127 - DNA, 5060 bp, Echinochloa colona
ccgcctcagctcccccctctcctctgcacaccacaccacaccagcttgtatattccttcttccctacgctttccgttgttccattccgtcgggccgccccctttccagacatagatttgaacagccaccctcctcctcctcctttccagacatagattcgcccgcagccagccaccctcctcctctctttctctgtgttccgatcgagctcccatgcgcggttgctgcagttggccgacgacgaggacgagctgaatccgcccgccggatcggccaccagatggggacgccggtgaatatcatcgtcggctcgcacgtgtggttggaggaccccggcgaagcctgggtcgacggcgtcgtcgccgagatcaaaggcggcaacgccaccatcgccaccaccaatggcaaaacggttgtggcgagccttggcagcatataccccaaggacacggaggcgccgccgtcaggagtggacgacatgacgaagctggcgtacctccacgagccaggggtcctgtacaacctctcctgccggtacggccttaacgagatatacacgtacaccgggaacatcttgattgccgtgaaccctttccagaggctgcctcatctgtatgacgtgcacatgatggagcagtacaagggcgccacatttggggagctcagcccccatctcttcgccatcgcagatgcctgttacagggcgctgatcaatgatcacgggagccaatccatcttggtgagtggagagagtggtgctggtaagacggagacgacgaagatgctcatgaggtatcttgcattcatggggggaaggtccggtacggaggggcgtactgttgagcaacaggttcttgagtccaacccagtactggaagcgtttggtaacgcaaagacagtaaagaacaataactcaagtcgcttcggtaagtttgttgaaatccaattcgacaagtatgggaagatatctggggctgccgttcgcacatacctccttgaacgatcgcgagtatgtcaggtttctgatcctgagaggaactaccattgcttttacatgctttgtaacgcaccccctgaggatgtaaaaaggttcaaggtgggagacccaagatcattccattacttgaaccaaacaaactgttatgaagtagcaaatgtggatgatgcaagggaatacatagaaaccagaaatgctatggatatcgttggcattgatcaagaggaacaggatgcaatcttcagagtagtagcggcaatccttcacctagggaatattgaattctccaaagggaaggaaattgattcatccaagttgagagatgagaaatcagtctaccacctgaaaacagttgcagaactgctaatgtgtgacgagaaggcccttgaagactctctttgccagcgagttattgtgacacctgatggaaatatcacgaaaccccttgatccagattctgctgcattaagtcgtgatgccttagcaaagacagtatattcacgactgtttgactggattgtagacaagatcaataactcaattggtcaggatccagacgcaaccaatataataggcgtgcttgatatctatggatttgagagcttcaagattaacagttttgagcaattatgcatcaatttgacaaacgagaagttgcagcagcacttcaaccagcacgtgtttaagatggagcaagaggaatacacaagggaggaaatagactggagctatgttgaatttgtagacaatcaggatgtgctggacctgattgagaagaaacctggaggaataattgcactcctggacgaggcatgcatgtttccaaagtccacacatgaaacgtttgcccaaaagatgtaccaaacatacaaggcacataagcggttcagcaagcccaaacttgcccgcaccgcctttacaatcaaccactatgcaggagatgtcacatatcaagcagatcatttccttgataagaacaaagactatgtggtagctgaacatcaagctctactgaattcttcaaggtgccattttgttgcaaatctctttcctccattacctgaggagacctctaaacagtccaaattctcttcaatcggtactcgctttaagcaacaactgcaatccctcatggaaacgctgagcacaacagaacctcactacattagatgtgtgaagcctaacgctgtactgaaaccaggcatatttgagaacttcaacgtcttgaatcagttgagatgtgggggtgttctggaagcaatccggatcagctgtgctggctacccaacaaagaggacatttgatgagttcgttgatcggtttggaatgcttgcgccggagcttgtggacagctctgatgagaaggccgcctgtgcagcaatatgtgataggatgggtttgaaaggatatcagatagggaaaacaaaggtattcctaagagctggtcagatggcagagttggatgctcgaagagcagaagtattggccagagctgcgcgactaatccagaggcgtataaagacgcatcttatgcgaaaggaatttgtcaacttacgaaaagcctcagttcactctcagaagttctggagagcaagactagctagaaagctttttgagtatatgagaagagatgctgcttcaattcggatacaaaagcatgcacgtacccattctgccagaaaagcgtaccttcaagtgtatgaatcagctatagtaatacagacagggttacgagcaatggctgctcgcaatgaacacagattcctaagagagaccaaggcttccataattatccagactcaatggcgccaaaacaaagcttatgttgcttacaagcagcaaaagagagcttcattgattcttcagtgcttgtggagggcacgtattgcaagaaaggaacttcggaaactgagaatggaagcaagagagaccggcgcactcaaagaagcgaaagacaagcttgaaaagagagtagaagaacttacatggcggttagatgtagagaagcgtttgaggactgaccttgaagaagccaaggggcaagaaattgaaaagttgcaatctgcattgcaaggaatgcaagaaaagatagaagcagctcatgaagcaatagaaaaggagaaagaagctgcaaagttagcaattgaacaggcaccaccaaagatagtagaggtgccagttgtggacactgcaaaagttgagcagttgacaagtaaaaataaagaacttgaggatgaactaagtgcatttaaacagaaggctgaagatcttgaaaataagctccttgagttgcagaataaggctgatgaattgtcacaggagacacaggaaagagaatccaaaactaatcaacttcaagaaatgattgaaaggcttgaaacaagtttaaccagtatggaatctgaaaaccaggttctacgacaacaatcattggttgttgcatcagcagatgaggataaatcaaaacaaatagagagactggaaagcaagattgccaccttggagtcagagatccagttgctccgcagtaattctgtggtagctgttcaggccatagtcactcctgaaatgaatcagacatcagtaatggagaatatcactcataaggaaattgacaatggacaccagcttgaagaagtcaaagtagtcaatgagcaggtggttgttcctcctgtaaagaatctaagcaaacaaaaatcactgacagatcgtcagcaagaaaatcatgatgccctgattaaaagtttggtagaggacaggagatttgacgacaaaaaatcagctgcagcatgcattgtctacaaatcactcctgcactggcattcattcgaagcagagaggactaacatatttgatcgaatcatccaaacaattaggtcatcagttgagggtgctgaaagtcccggagagctagcttattggttgtcgacaacatcaactctcctctacttgttacaaaacaccctcaaagctagcagttcatcaagtaaaggatcaaatcacagccggaccacaagaggcagtctgttcagtagaatggtgcagagtgcccggacatcatcatcatcaggattaggcattactagtggatacagtggaatggtaggaaggcctgacaccgcatcaatggtagaggcaaaatatccagcactgcggttcaagcaacagttaacagcatatgtcgagaagatatatgcgataataagagataacctgaagaaggaaataagtccattgttgactatgtgcatacaggctgcaagagctaatcgtgtgagaccatctcggggatcactaaaaagtatacactctaatgcactatcaaggcaagcatcaagtgtacattggcaaagcattgttaagtgcttggatcatacactggaaacaatgaaaaacaactatgtgcccccgatgataatccggaaagcatttagtcaagtatttgcatatttgaatgtgcaactcttcaacagtttgctacttcgtcgggaatgctgctcttttagcaatggggagttcttaaaggctggcttacaagaactggagcagtggtgctctaaaacaactgaagagtacgcaggggcatcttgggatgaactgcaacacattaggcaggcagctgggttcctggttttgcatcagaagtcacacaaaaacctggaagaaatcatgaatgagctttgccctgttttgagcataactcaaatatatcgcatagcaacgatgttctgggacgacaaatatggtgcacaaggtctatcccaagaggtcattggaaagatgagaacgatgacaacagacggctcgataactgctccaaatagttctttcctgctagatgatgattcaagcatacctatatccttggatgatatagcacgactgatgcttgacatcgacccatcggaagtggagccgccgccactactgaggcagaactcgcagtttcacttccttctacagcagcacacggactgatttagacaaacaaagacaaactggtacagctatttgtaaagttgccaaggactgaaattttttataggagtgcacagattgagtt

SEQ ID NO: 12128 - DNA, 5150 bp, Secale cereale
cctctattgttagttttgtttgtattgatcccgtgctcgcatgagcggagattcgccgccgtcggcgatcgagctgagctgagctgagctgagttcgtgtccgtggactgaagtcgccaagatggggactccggtcaacatcatcgtcggctcgcaggtgtggctggaggatcccgacgaggcctgggtcgacggcgaggtcaccgggatcaagggcgccgacgtcaccgtcgccaccaccaatggcaaaacggttgtggccagcctcgcgagcatataccccaaagacacggaggcgcccccggcaggagtggacgacatgaccaagctcgcctacctccatgaaccgggagtcctgcacaaccttgcctgccggtacggccttaacgagatatacacgtacaccgggaacatcttgattgccgtcaaccctttccagaggctgccccatctctacgacgtgcacatgatggagcagtacaaaggcgccaccttcggggagctcagccctcatcttttcgcgattgcagattcttgttacagggcaatgattaatgagcatggaagccagtcaatattggtgagcggtgagagtggcgctggtaagacagagacgacgaagatgctcatgaggtaccttgccttcatgggaggaaggtctggaaccgagggacgaaccgttgagcaacaagttctagagtctaacccagtactggaagcatttggtaatgcgaagacggtgaagaacaacaactcaagtcgtttcggtaaatttgttgaaatccaattcgacaaatacgggaagatatctggtgcggctgttcgcacatacctccttgaacggtcacgagtatgccaggtctctgatcctgaaaggaattaccattgcttttacatgctatgttctgcaccgccggaggacgtaaaaaggtttaaggtgggagatccgcgatcatttcattacctgaaccaaacaagctgctatgaagtagctaatgtggatgacgcaagagaatacctagaaacaagaaatgcaatggatatagttggaatttctcaagaagaacaggatgcaatcttcagagtagtagcggcaatccttcatctaggaaacattaatttctccaaagggaaagaaattgattcatcaaggttgagggatgagaaatcaatcaatcacctgaaaatagtggcagaactgctaatgtgtgacgagaagttgcttgaagactctctttgtcagcgcgttattgtaacacctgatggaaatatcacaaaacccctcgatccagattctgctctacagagtcgtgatgccttggcaaagacagtgtattcacgactattcgactggattgtggataagatcaataactcgattggtcaagatcctgatgcaataagtataataggagtgctggatatatatggatttgagagtttcaaggtcaacagttttgagcaactgtgcatcaacatgacaaatgagaaattgcaacagcacttcaatcagcacgtattcaagatggagcaagaagagtatacaagggatgaaatagactggagctatgtggaatttgtggacaatcaggatgtgctggacctgattgagaagaaacctggaggaataattgccctcctggatgaggcatgcatgtttccgaagtccactcacgagacatttgcacaaaagatgtatcaaacatacaaatcacataagcgctttagcaagcccaaacttgccaggactgccttcacaatcaaccactacgcaggagatgtcacataccaatccgattattttcttgacaagaacaaagattatgtggtcgctgaacatcaagctctactaaattcgtcaaggtgctcttttgttgcaaatctctttcctccattaccagaggaaagttctaaacagtccaaattctcttccatcggtactcgctttaagcaacaactccaagccctgatggaaacattgagtacaacagaaccacactacattagatgtgtgaagcctaatactgtactgaaacctggcatcttcgagaacgacaatgtcttgaatcaattgagatgtgggggtgttttggaagcaatccggatcagttgtgctggctatccgacgaagagaacatttgatgagttcattgatcgattcggagtgcttgcaccagagcttgtggacagttctgacgagaagacagcttgcgcagcaatatgtgataaaatgggattgaagggataccagatagggaaaacaaaggtattcctaagagctggccagatggcagagctggatgctagaagagcagaagtattggccaatgctgtgcgacttatccagaggcgtataagaacacatcttatgcgaaaggatttcatcagcttaaaaaaggcttccattcaaactcagaagttctggagagcacgactagctagaaagctttttgagcacatgagaagagtcgctgctgcaattacaatacagaagcacacccgtactcattctgcctggaaagcgtatctacaaatatacagatcatcaataacaatacagacaggattacgcgcaatggctgctcgtaaggagcacaggttcagaagagagaccaaagcgaccatcatcatccagactcaatggcgccgacacaaagcctatgttgcttacaaacagcaaaaaagagcatctctgattctccagtgctcatggaggggacgtgttgcaaggaaggaacttcggaagctcaaaatggaagcaagagataatggtgcacttaaagaagcaaaagacaagctggaaaagagagttgaggaactcacatggagattagatgttgagaagcatttgagggttgaccttgaggtagccaagggtcaagaaattacgaagttacaatctgcgttgcaagaaatgcaagaaaagctcgaggaagcccatgcagcaattataaatgagaaagaagctgcaaagttagcaattgaacaggcaccacctaagatagtagaggtgccagtggtggataacgcaaaagttgagttgttgacaagtcaaaatgaggaacttgagactgagctcggtacgtttagaacgaaggctgaagatcttgagaagaagctttttgagattcaaaaacagtctgacgaattgtcacttgaggcacaagaacgggactccaaaattaatgagctccaagagatgattgctaggcttgaaacaaatttatccaacatggaatctgaaaaccacgttctacgccaacaatcgttacttgcatcagcagatgatgataataagacaaaacaaatagagagtctggaaagcaagattgccatcttggagtcagagaatcagttgctccgcagcaatcctgcaccagctgttcaagcagttgtcactcctgaagtgattgagccagctgttgtaaaggttctcgagaatggacatcagcatgaagaacctaaaatggaggaggtggttgttcccccaataaagaatttaagcaaacaacagtcactgacggaccgacagcaagaaaatcatgatgtccttataaaaagcctggctgaagacaggagatatgacaacagaagaccagctgcagcatgtattgtctacaaatcactccttcactggcactcatttgaagcagaaaagacaaacatatttgaccgtatcatccatacaattaggtcgtctgttgagaatgctgaaagttctggagaactagcttattggttgtcgacaacatcaaccctcctctaccttttacaaaatacccttaaagctagcagttcatcgactaaagtaccaaatcgcagcaggaccgcaacaggcaacctattcaatagaatggtgcagaatgctcggtcatcatcatcaggattaggtatttcaaacggatacagtggaatggtaggaagagctgacactgcatcaaggatagaggctaagtatccagctgtacgtttcaagcaacagttaacagcatatgtcgagaagatatatggcatgatgagagatagcctgaaaagggaaataagtgcaatattgactctctgcatacaggctccaagagctggccgtgtgaaagcatctcgaggatcactgaaaagtatacactctagtgcactatcaaggcaagcatcaagtgtgcattggcaaaacatcattaagtgcctgaatcatacactggaaacgatgaacagtaattatgtacctccaatgataattaggaaaacattcagccaagtatttgcatttatgaacgttcaactcttcaacagtttgctacttcggcgtgaatgctgctcctttagcaatggagaattcttgaaggctggtttacaggaactggagcagtggtgctctaggacaactgaagagtatgcaggaacatcttgggatgaactgcaacacataaggcaggcagttgggttcctggttttgcatcagaagtcgcacaaaaccttggacgaaatcactgatgagctttgccccgttctgagcatcagccaaatatatcgcatcggaacgatgttctgggacgataaatatggagcacaaggtctatcccaagaggtaactggaaacatgagaacaatgacgaccgatgactcgataactactccaaacagttctttcttgttagacgacgattcaagcataccgatatccttggacgatatagcccaactgatgcttgacatcaacccgactgacgtggagccgccgcctctactgaggcagaactcgcagtttcactttcttctgcaacagcatacagactgatttacattacgtatataaaggaaaatatagacaggtacagttttgtgaagttcctgggcagtgaagattttttattttttaaaataggagtgcatagtttggggtttggtttgtttcggtctccagcttgcaattttgggttgggtcggtggaaagtatattttgagaaagggaaatatagaagagtttgatagcattcttttgattggtattgatggtgtgaaagaggaaacattgtaattcttttgtggaagtacatatgttagaaaatttaaaaaaaaaaaaaaaacaaaaaaaaaaaaactaaaagaagaatagtacaacggacgacaacgaagggaagtaaggagaccccccc

SEQ ID NO: 12129 - DNA, 5087 bp, Secale cereale
tgcgtgctccagctcgcgggatcttgctgctgcggctgtattatttagtttgtttgattgatcccgtgctcgcatgagcggagattcgccgccgtcggcgatcgagctgagctgagctgagttcgtcgtccgtggactgaagttgccaagatggggactccggtcaacatcatcgtcggctcgcaggtgtggctggaggatcccgacgaggcctgggtcgacggcgaggtcaccgggatcaagggcgccgacgtcaccgtcgccaccaccaatggcaaaacggttgtggccagcctcgcgagcatataccccaaagacacggaggcgcccccggcaggagttgacgacatgaccaagctcgcctacctccatgaaccgggagtcctgcacaaccttgcctgccggtacggccttaacgagatatacacatacaccgggaacatcttgattgccgtcaaccctttccagaggctgccccatctctacgacgtgcacatgatggagcagtacaaaggcgccaccttcggggagctcagcccccatcttttcgcgattgcagattcttgttacagggcaatgattaatgagcatggaagccagtcgatactggtgagtggtgagagtggtgctggtaagacagagacgacaaagatgctcatgaggtaccttgccttcatgggaggaaggtccggaaccgagggacgaaccgttgagcaacaagttctagagtctaacccagtactggaagcatttggtaatgcgaagacggtgaagaataacaactccagtcgttttggtaaatttgttgaaatccaattcgacaaatacgggaagatatctggtgcggctgttcgcacatacctccttgaacggtcacgagtatgccaggtctctgatcctgaacggaattaccattgcttttacatgctatgttcggcaccaccggaggacgtaaaaaggtttaaggtgggagatccgcgatcatttcattacctgaaccaaacaagctgctatgaagtagctaatgtggatgacgcaagagaatacctagaaacaagaaatgcaatggatatagttggaatttctcaagaagaacaggatgcaatcttcagagtagtagcggcaatccttcatctaggaaacattaatttctccaaagggaaagaaattgattcatcaaggctgagggatgagaaatcaatcaatcacctgaaaatagtggcagaactgctaatgtgtgacgagaagttgcttgaagactctctttgtcagcgcgttattgtaacacctgatggaaatatcacaaaacccctcgatccagattctgctctacagagtcgtgatgccttggcaaagacagtgtattcacgactattcgactggattgtggataagatcaataactcgattggtcaagatcctgatgcaataagtataataggagtgctggatatatatggatttgagagtttcaaggtcaacagttttgagcaactgtgcatcaacatgacaaatgagaaattgcagcagcacttcaatcagcacgtattcaagatggagcaagaagagtatacaagggatgaaatagactggagctatgtggaatttgtggacaatcaggatgtgctggacctgattgagaagaaacctggaggaataattgccctcctggatgaggcatgcatgtttccgaagtccactcacgagacatttgcacaaaagatgtatcaaacttacaaatcacataagcgctttagcaagcccaaacttgccaggactgccttcacaatcaaccactacgcaggagatgtcacataccaatccgactattttcttgacaagaacaaagattatgtggtcgctgaacatcaagctctactaaattcgtcaaggtgctcttttgttgcaaatctctttcctccattaccagaggaaagttctaaacagtccaaattctcttccatcggtactcgctttaagcaacaactccaagccctgatggaaacattgagtacaacagaaccacactacattagatgtgtgaagcctaatactgtactgaaacctggcatcttcgagaacgacaatgtcttgaatcaattgagatgtgggggtgttttggaagcaatccggatcagttgtgctggctatccgacgaagagaacatttgatgagttcattgatcgattcggagtgcttgcaccagagcttgtggacagttctgacgagaagacagcttgcgcagcaatatgtgataaaatgggattgaagggataccagatagggaaaacaaaggtattcctaagagctggccagatggcagagctggatgctagaagagcagaagtattggccaatgctgtgcgacttatccagaggcgtataagaacgcatcttatgcgaaaggatttcatcagcttaaaaaaggcttccattcaaactcagaagttctggagagcacgactagctagaaagctttttgagcacatgagaagagtcgctgctgcaattacaatacagaagcacacccgtactcattctgcctggaaagcttatctacaaatatacagatcatcaataacaatacagacaggattacgcgcaatggctgctcgtaaggagcacaggttcagaagagagaccaaagcgaccatcatcatccagactcgatggcgccaacacaaagcctatgttgcttacaaacagcaaaaaagagcttctctgattctccagtgctcatggaggggacgtgttgcaaggaaggaacttcggaagctcaaaatggaagcaagagataatggtgcacttaaagaagcaaaagacaagctggaaaagagagttgaggaactcacatggagattagatgttgagaagcatttgagggttgaccttgaggtagccaagggtcaagaaattacgaagttgcaatctgcgttgcaagaaatgcaagaaaagctcgaggaagcccatgcagcaattataaatgagaaagaagctgcaaagttagcaattgaacaggcaccacctaagatagtagaggtgccagtggtggataacgcaaaagttgagttgttgacaagtcaaaacgaggaacttgagactgagctcggtacgtttagagcgaaggctgaagatcttgagaagaagctttttgagattcaaaaacagtctgacgaattgtcaattgaggcacaagaacgggagtccaaaattaatgagctccaagagatgattgctaggcttgaaacaaatttatccaacatggaatctgaaaaccacgttctgcgccaacaatcgttacttgcatcagcagatgatgataataagacaaaacaaatagagagtctggaaagcaagattgccatcttggagtcagagaatcagttgctccgcagcaatcctgcaccagctgttcaagcagttgtcattcctgaagtgattgagccagctgttgtgaaggttctcgagaatggacaccagcatggagaacctaaaatggaggaggtggttgttcccccaataaagaatttaagcaaacaacagtcgctaacggaccgacagcaagaaaatcatgatgtccttatcaaaagcctggctgaagacaggagatatgacaacagaagaccagctgcagcatgtattgtctacaaatcactccttcactggcactcatttgaagcagaaaagacaaacatatttgaccgtatcatccatacaattaggtcatctgttgagaatgctgaaagttctggagagctagcttattggttgtcgacaacatcaaccctcctctaccttttacaaaatacccttaaagctagcagttcatcgactaaagtaccaaatcgcagcaggaatgcaacaggcaacctattcaatagaatggtgcagaatgctcgatcatcatcatcaggattaggtatttcaaacggatacagtggaatggtaggaagagctgacactgcatcaaggatagaggctaagtatccagctgtacgtttcaagcaacagttaacagcatatgtcgagaagatatatggcatgatgagagatagcctgaaaagggaaataagtgcaatattgactctctgcatacaggctccaagagctggccgtgtgaaagcatctcgaggatcactgaaaagtatacactctagtgcactatcaaggcaagcatcaagtgtgcattggcaaaacatcattaagtgcctgaatcatacactggaaacgatgaacagtaattatgtacctccaatgataattaggaaaacattcagccaagtatttgcatttatgaacgttcaactcttcaacagtttgctacttcggcgtgaatgctgctcctttagcaatggagaattcttgaaggctggtttacaggaactggagcagtggtgctctagaacaactgaagagtatgcaggaacatcttgggatgaactgcaacacataaggcaggcagttgggttcctggtgttgcatcagaagtcgcacaaaaccttggacgaaatcactgatgagctttgccccgttctgagcatcagccaaatatatcgcatcggaacgatgttctgggacgataaatatggagcacaaggtctatcccaagaggtaattggaaacatgagaacaatgacgaccgatgactcgataactactccaaacagttctttcttgttagacgacgattcaagcataccaatatccttggacgatatagcgcaactgatgcttgacatcaacccgactgacgtggagccgccgcctctactgaggcagaactcgcagtttcactttcttctgcaacagcatacagactgatttacattacgtatataaaggaaaatatagacaggtacagttttgtgaagttcctgggcagtgaagatttcttatttttttaaataggagtgcatagtttggggtttggtttgtttcggtctccagcttgcaattttgggtcgggtctggtggaaagtatattttgggaaagggaaatatagaagagtttgatagcattcttttgattggtattgatggtgtgaaagaggaaacattgtaattcttttgtggaagtacatatgttg

SEQ ID NO: 12130 - DNA, 4967 bp, Panicum virgatum
gggacaccggtgaacatcatcgtcggctcgcacgtgtggctggaggaccccagcgaagcctgggtcgacggcgtcgtcaccgagatcaaaggccgcgacgccaccatcgccaccaccaatggcaaaacggttgtggcgagccttgggagcatataccccaaggacacggaggcgccgccttcgggagtggacgacatgacgaagctggcgtacctccacgagccaggggtcctgcacaacctctcttgccggtacggccttaacgagatatacacctacaccgggaacatcttgattgcggtgaaccctttccagagactgcctcatctgtatgacgttcacatgatggagcagtacaagggcgccacctttggggagctcagcccccatctctttgcgatcgcagatgcctgttacagggcgctgatcaatgatcacgggagccagtccatcttggtgagtggtgagagtggtgctggtaagacggaaacgacgaagatgctcatgaggtaccttgcattcatgggaggaaggtctggtacggaggggcgtactgttgagcaacaggttctagagtctaacccagtactggaagcatttggtaatgcgaagacagtaaagaacaataactcaagtcgctttggaaagtttgttgaaattcaattcgacaagtatgggaagatatctggggctgctgttcgcacatatctccttgaacgatcacgagtatgtcaggtctctgatcctgagaggaactaccattgcttttacatgctttgtaacgcaccccctgaggatgtaaaaagatttaaggtgggagacccaagatcattccattacttaaaccaaacgaactgctatgaagtagcaaatgtggatgatgcaagagaatacatagaaaccagaaatgcaatggatattgttggcattgatcaagatgaacaggatgcaatcttcagagtagtagcggcaatccttcacttagggaatattgacttctccaaagggaaggaaattgattcatccaagttgagagatgataaatcagtccatcacctgaaaacagtcgcagaactgcttatgtgtgacgagaaggcccttgaagactccctttgccagcgagtcattgtaacacctgatggaaatatcacgaaacccctcgatccagattctgctgcattaagccgtgatgccttagcaaagacggtatattcaagattgtttgactggattgtagacaagatcaataactcaattggtcaggatccagacgcgaccaatataataggtgtgcttgatatctatggattcgagagcttcaagattaacagttttgagcagctatgtatcaatttgacaaacgagaagttgcagcagcacttcaaccagcatgtgtttaagatggagcaagaggaatacacaagggaggaaatagactggagctatgttgaatttgtagacaatcaggatgtgctggacctgattgagaagaaacctggaggaataattgctcttctggatgaggcatgcatgtttccaaagtccacgcatgaaacatttgcccaaaagatgtaccaaacatacaaggcacataagcgcttcagcaagcccaaacttgctcgcaccgcctttacaatcaaccactacgcaggagatgtcacatatcaagcagatcagttccttgataaaaacaaagactatgtggtagctgaacaccaagctctactaaattcttcaaggtgcccttttgttgcaaatctctttcctccattacctgaggagacttctaaacagtccaaattctcttcaatcggtgctcgctttaagcaacaacttcaatccctcatggaaacactgagtacaacagaacctcactacattagatgtgtgaagcctaatactgtactgaaaccaggcatctttgagaatttcaacgtcttgaatcaattgagatgtgggggtgttctggaagcaatcaggatcagctgtgctggctatccaacaaagaggacatttgatgagttcattgatcggtttggaatgcttgcaccagagcttgtggacagctctgatgagaaggccgcctgtgcagcaatatgtgatagaatgggtttgaaaggatatcagatagggaaaacaaaggtattcttaagagctggtcagatggcagagttggatgctcgaagagcagaagtattggccaatgctgcgcgactaatccagaggcgtataaagacacatcttatgcgaaaggaatttgtcaacttacgaaaagcctcagttcaatctcagaagttctggagagcacgactagctagaaagctttttgagtatatgagaagagatgctgcttcaattaggatacaaaagcatgcacgtagccattctgccagaaaagtgtaccgtcaagtatatgaatcagctatagtaatacagacaggactacgggcaatggcagctcgcaatgaacacaggttccgaagagagaccaaggcttccataattatccagactcgatggcgccaacacaaagcttatgttgcttataagcagcaaaagagagcttcattgattcttcagtgcttgtggagggcacgtgtcgcaagaaaggaacttcggaaactgagaatggaagcaagagagactggcgcactcaaagaagctaaagacaagcttgaaaagagagtagaagaacttacatggcggttagatgttgaaaagcgtttgaggactgaccttgaagaagccaagggccaagaaattggaaagttgcaatctgctttgcaagaaatgcaagaaaagattgaggaagcccatgcagcagtggtaaaggagaaagaagccgcgaagttagcaattgaacaggcaccaccaaagatagtagaagtgccagttgtggacactgaaaaagttgagcagttgacaagtaaaaataaagaacttgaggatgaactaagtacatttagacagaaggctgaagatcttgaaaataagcttcttgagatgcaaaaacggtctgatgaattgtcacaggagacacaagaacgagaatccaaagttaatcaacttcaagagatgatcgaaaggctagaaacaagtttatccaatatggaatctgaaaaccaggttctacggcaacaatctttggtcgttgcaacagcagatgaggataaatcaaaacagatagagagactggaaagcaagattgccatcttggagtcggagatccagttgctccacagtaattcggcgcttgctgttcaggccgtggtcacccctgcaatgaatcagacatcagtaatggaggaaattgacaatggacaccagcttgaagaagctaaaatagtcaatgagcatgtggttgttcctcctgtaaagaatctaagcaaacaaaaatcactgacggatcgacaacaagaaaatcatgatgccctgattaaaagtctggtagaagacaggagatttgatgacaaaaaatcagctgcagcatgcattgtctacaaatcactcctgcactggcgttcatttgaagcagagaagactaacatatttgatcgaatcatccaaacaattaggtcatcagttgagggtgctgaaagttctggagagctagcttattggttgtcaactacatcaactctcctctacttattacaaaataccctcaaagctagtagttcatcgagtaaaggatcgaatcgcagccggactgcaacaggcagcctgtttagtagaatggtgctgagtgcccggacatcatcatcaggattaggcataactagtggatatggtggaatggtaggaaggcctgacactgcatcaatggtagaagcaaagtatccagcacttcggttcaagcaacagttaacagcatacgttgagaagatatatgggataattagagataacctgaagaaagaaataagcccattcttgactctatgcatacaggctccaagagctaatcgtgtgagaccatctcgtggttcactaaaaagtatacactctaatgcactatcaaggcaagcatcaagtgtacattggcaaagcatagttaagtgcctggataatacactggaaacaatgaaaaataaccatgtacctccgatgataataaagaaaacatttagtcaagtatatgcatacttgaatgtgcaactcttcaatagtttgctacttcgtcgggaatgctgctcatttagcaatggggaattcttaaaggctggcttacaagaactggagcaatggtgctctagaacaactgaagagtatgcaggggcatcttgggatgaactgcaacacataaggcaggcagttgggtccctggttctgcatcagaagtcacacaaaaccctggaggaaatcacgaatgagctttgccctattttgagcataactcaaatatatcgcatagcaacaatgttctgggacgacaaatatggtgcacaaggtctatctcaagaggtcattggaaagatgagaacgatgacaacagatgacacgataactactccaaatagttctttcctgctagatgatgattcaagcatacctatatccttggacgatatagcacatctgatgcttgacatcgacccaatagatgtggaaccgccgccactactgaggcaaaactcgcagtttcacttccttctgcagcagcacacagactgatttctacaaagaaagacaaattggtacagctatttgtaaagttgctaaggactgaatgatttttttataggagtgcacatattgagttgcgttttcttttttttttcatttcaaaattttgggtgggaatgtttacaggaaagaggaatataggagatcctgatgcaaattcttttcattgttttgattgtttggaaacagaaaaaatactgtaattatttgagaaagtgtataaatgaaagtatatatatttgcaccaaatcacattcaatgcaaacatattcctgatctgc

SEQ ID NO: 12131 - DNA, 4620 bp, Secale cereale
ggcgcccccggcaggagtggacgacatgaccaagctcgcctacctccatgaaccgggagtcctgcacaaccttgcctgccggtacggccttaacgagatatacacatacaccgggaacatcttgattgccgtcaaccctttccagaggctgccccatctctacgacgtgcacatgatggagcagtacaaaggcgccaccttcggggagctcagcccccatcttttcgcgattgcagattcttgttacagggcaatgattaatgagcatggaagccagtcgatactggtgagtggtgagagtggtgctggtaagacagagacgacaaagatgctcatgaggtaccttgccttcatgggaggaaggtctggaaccgagggacgaaccgtcgagcaacaagttctagagtctaacccagtactggaagcatttggtaatgcgaagacggtgaagaacaacaactcaagtcgttttggtaagtttgttgaaatccaattcgacaaatacgggaagatatctggtgcggccgttcgcacttacctccttgagcggtcacgagtatgccaggtctctgatcctgaacggaattaccattgcttttacatgctatgttcggcaccaccggaggacgtaaaaaggtttaaggtgggagatccgcgatcatttcattacctgaaccaaacaagctgctatgaagtagctaatgtggatgacgcaagagaatacctagaaacaagaaatgcaatggatatagttggaatttctcaagaagaacaggatgcaatcttcagagtagtggcggcaatccttcatctaggaaacattaatttctccaaagggaaagaaattgattcatcaaggctgagggatgagaaatcaatcaatcacctgaaaatagtggcagaactgctaatgtgtgacgagaagttgcttgaagactctctttgtcagcgcgttattgtaacacctgatggaaatatcacaaaacccctcgatccagattctgctctacagagtcgtgatgccttggcaaagacagtgtattcacgactattcgactggattgtggataagatcaataactcgattggtcaagatcctgatgcaataagtataataggagtgctggatatatatggatttgagagtttcaagttttgagcaactgtgcatcaacatgacaaatgagaaattgcagcagcacttcaatcagcacgtattcaagatggagcaagaagagtatacaagggatgaaatagactggagctatgtggaatttgtggacaatcaggatgtgctggacctgattgagaagaaacctggaggaataattgccctcctggatgaggcatgcatgtttccgaagtccactcacgagacatttgcacaaaagatgtatcaaacatacaaatcacataagcgctttagcaagcccaaacttgccaggactgccttcacaatcaaccactacgcaggagatgtcacataccaatccgattattttcttgacaagaacaaagattatgtggtcgctgaacatcaagctctactaaattcgtcaaggtgctcatttgttgcaaatctctttcctccattaccagaggaaagttctaaacagtccaaattctcttccatcggtactcgctttaagcaacaactccaagccctgatggaaacattgagtacaacagaaccacactatattagatgtgtgaagcctaatactgtactgaaacctggcatcttcgagaacgacaatgtcttgaatcaattgagatgtgggggtgttttggaagcaatccggatcagttgtgctggctatccgacgaagagaacatttgatgagttcattgatcgattcggagtgcttgcaccagagcttgtggacagttctgacgagaagacagcttgcgcagcaatatgtgataaaatgggattgaagggataccagatagggaaaacaaaggtattcctaagagctggccagatggcagagctggatgctagaagagcagaagtattggccaatgctgtgcgacttatccagaggcgtataagaacacatcttatgcgaaaggatttcatcagcttaaaaaaggcttccattcaaactcagaagttctggagagcacgactagctagaaagctttttgagcacatgagaagagtcgctgctgcaattacaatacagaagcacacccgtactcattctgcctggaaagcttatctacaaatatacagatcatcaataacaatacagacaggattacgtgcaatggctgctcgtaaggagcacaggttcagaagagagaccaaagcgaccatcatcatccagactcaatggcgccaacacaaagcctatgttgcttacaaacagcaaaaaagagcatctctgattctccagtgctcatggaggggacgtgttgcaaggaaggaacttcggaagctcaaaatggaagcaagagataatggtgcacttaaagaagcaaaagacaagctggaaaagagagttgaggaactcacatggagattagatgttgagaagcatttgagggttgaccttgaggtagccaagggtcaagaaattacgaagttacaatctgagttgcaagaaatgcaagaaaagctcgaggaagcccatgcagcaattataaatgagaaagaagctgcaaagttagcaattgaacaggcaccacctaagatagtagaggtgccagtggtggataacacaaaagttgagttattgacaagtcaaaatgaggaacttgaggctgagctcggtacgtttagaacgaaggctgaagatcttgagaagaagctttttgagattcaaaaacagtctgacgaattgtcacgtgaggcacaagaacgggactcgaaaattaatcaacttcaagacatgatcgctaggcttgaaacaaatttatccaacatggaatctgaaaaccacgttctacgccaacaatcgttacttgcatcagcagatgatgataataagacaaaacaaatagagagtctggaaagcaagattgccatcttggagtcagagaatcagttgctccgcagcaatcctgcaccagctgttcaagcagttgtcactcctgaagtgattgagccagctgttgtaaaggttctcgagaatggacatcagcatggagaacctaaaatgattagtgaggaggtggttgttcccccaataaagaatttaagcaaacaacagtcactgacggaccgacagcaagaaaatcatgatgtccttataaaaagcctggctgaagacaggagatatgacaacagaagaccagctgcagcatgtattgtctacaaatcactccttcactggcactcatttgaagcagagaggacaaacatatttgaccgtatcatctatacaattaggtcatctgtggagaatgctgaaaattctggagagctagcttattggttgtcgacaacatcaaccctcctctaccttctacaaaatacccttaaagctagcagttcatcgactaaagtaccaaatcgcagcaggaccgcaacaggcaacctattcaatagaatggtgcagaatgctcgatcatcatcatcaggattaggtatttcaaacggatacagtggaatggtaggaagagctgacactgcatcaaggatagaggctaagtatccagctgtacgtttcaagcaacagttaacagcatatgtcgagaagatatatggcatgatgagagatagcctgaaaagggaataagtgcaatattgactctctgcatacaggctccaagagctggccgtgtgaaagcatctcgaggatcactgaaaagtatacactctagtgcactatcaaggcaagcatcaagtgtgcattggcaaaacattattaagtgcctgaatcatacactggaaacgatgaacagtaattatgtacctccaatgataattaggaaaacattcagccaagtatttgcatttatgaacgttcaactcttcaacagtttgctacttcggcgtgaatgctgctcctttagcaatggagaattcttgaaggctggtttacaggaactggagcagtggtgctctaggacaactgaagagtatgcaggaacatcttgggatgaactgcaacacataaggcaggcagttgggttcctggtgttgcatcagaagtcgcacaaaaccttggacgaaatcactgatgagctttgccccgttctgagcatcagccaaatatatcgcatcggaacgatgttctgggacgataaatatggagcacaaggtctatcccaagaggtaattggaaacatgagaacaatgacgaccgatgactcgataactactccaaacagttctttcttgttagacgacgactcaagcataccgatatccttggacgatatagcgcgactgatgcttgacatcaacccgactgacgtggagccaccgcctctactgaggcagaactcgcagtttcactttcttctgcaacagcatacagactgatttacattacgtatataaaggaaaatatagacaggtacagttttgtgaagttcctgggcagtgaagattttttattttttaaaataggagtgcatagtttggggtttggtttgtttcgtctccag

SEQ ID NO: 12132 - DNA, 5201 bp, Triticum aestivum
attggggggtctgtcgcatcgcttgcttctcctccctttccagttgtagtgtactactctcgcgtgcgcattccagcaacaactccagctcgcgggatcttgctagctgccggtgtattatttaggttgtttgatcccgtgctcgcatgaggggagattcgccggcgccggcgatcgagctgagctgagttcgtcgtccgtggactgaatctgtcaacatggggactccggtcaacatcatcgtcggctcgcaggtgtggctgaggatcccgacgaggcctgggtcgacggcgaggtcaccgggatcaagggcgccgacgtcaccgtcgccaccaccaacggcaaaacggttgtggccagcctcgcgagcatataccccaaagacacggaagcgcccccagcaggagtggacgacatgacgaagctcgcttacctccatgaaccgggagtcctgcataaccttgcctgccggtacagccttaacgagatatacacgtacaccgggaacatcttgattgcagtcaatcctttccagaggctgccccatctctacgacgtgcacatgatggagcagtacaaaggcgccaccttcggggagctcagcccccatcttttcgcgattgcagattcttgttacagggcaatgatcaatgaacatggaagccagtcaatattggtgagcggtgagagtggcgctggtaagacagagacgacgaagatgctcatgaggtaccttgcattcatgggaggaaggtctggaactgagggacgaaccgttgagcaacaagttctagagtctaacccagtactggaagcatttggtaatgcgaagacggtgaagaacaacaactcaagtcgtttcggtaagtttgttgaaatccaattcgacaaatacgggaagatatctggtgcggccgttcgcacatacctccttgaacgatcacgagtatgccaggtctctgatcctgaacggaattaccattgcttttacatgctatgctctgcaccgccggaggacgtaaaaaggtttaaggtgggaaacccacgatcatttcattacctgaaccaaacaagctgctatgaagtagctaatgtggacgacgcaagagaatacctagaaacaagaaatgcaatggatatagttggaatttctcaagaagagcaggatgcaattttcagagtagtagcggcaatccttcatctaggaaacattaatttctccaaagggaaagaaattgattcatcaaggttgagggatgagaaatcaatcaatcacctgaaaatagtggcagaactgctaatgtgtgacgagaagttgcttgaagactctctttgtcagcgtgttattgtaacacctgatggaaatatcacaaaacccctcgatccagattctgctctacagagtcgtgatgccttggcaaagacagtgtattcacgactattcgactggattgtggataagatcaataactcgattggtcaagatcctgatgcaataagtataataggagtgctggatatctatggatttgagagtttcaaggtcaacagttttgagcaactgtgcatcaacatgacaaatgagaaattgcagcagcacttcaatcagcacgtattcaagatggagcaagaagagtatacaagggatgaaatagactggagctatgtggaatttgtggacaatcaggatgtgctggacctgattgagaagaaacctggaggaataattgccctcctggatgaggcatgcatgtttccgaagtccactcacgagacatttgcacaaaagatgtatcaaacgtacaaatcacataagcgctttagtaagcctaaacttgccaggactgccttcacaatcaaccactacgcaggagatgtcacataccaagccgattattttcttgacaagaacaaagattatgtggtcgctgaacatcaagctctactaaattcgtcaaggtgctcttttgttgcaaatctctttcctccattaccagaggaaagttctaaacagtccaaattctcttccatcggtactcgctttaagcaacaactccaagccctgatggaaacattgagcacgacagaaccacactacattagatgtgtgaagcctaatactgtactgaaacctggcatcttcgagaacgacaatgtcttgaatcaattgagatgtgggggtgttttggaagcaatccggatcagttgtgctggctatccgacgaagagaacatttgatgagttcattgatcgattcggagtgcttgcaccagagcttgtggacagttctgacgagaagacagcttgcgcagcaatatgtgataaaatgggattgaagggataccagatagggaaaacaaaggtattcctaagagctggccagatggcagagctggatgctagaagagcagaagtattggccaatgctgtgcgacttatccagaggcgtataagaacgcatcttatgcgaaaggaattcgtcagcttaaaaaaggcttccattcaaactcaaaagttctggagagcacgactagctagaaagctttttgagcacatgagaagagtcgctgctgcaattacaatacagaagcacacccgtactcattctgcctggaaagcttacctgcaaatatacagatcatcaataacaatacagacaggattacgtgcaatggctgctcgtaaggagcacaggttcagaagagagaccaaagcgaccatcatcatccagactcgatggcgccaacacaaagcctatgttgcttacaaactgcaaaaaagagcttctctaattctccagtgctcgtggaggggacgtgttgcaaggaaggaacttcggaagctcaaaatggaagcaagagataatggtgcacttaaagaagcaaaagacaagctggaaaagagagttgaggaactcacatggagattagatgttgagaagcatttgagggttgaccttgaggtagccaagggtcaagaaattacgaagttacaatctgcattgcaagaaatgcaagaaaagcttgaggaagcccatgcagcaattataaatgagaaagaagctgcaaagttagcaattgaacaggcaccacctaagatagtagaggtgccagtggtggataacgcaaaagttgagttgttgacaagtcaaaacgaggaacttgagactgagctcggtacgtttagaacgaaggctgaagatcttgagaagaagctttttgagattcaaaaacagtctgacgaattgtcacgtgaggcacaagaacgggactccaaaattaatgaactccaagagatgattgctaggcttgagacaaatttatctaacatggaatctgaaaaccacgttctacgccagcaatcgttgcttgcatcagcagatgatgataataagacaaaacaaatagagagtctggaaagcaagattgccatcttggagtcagagaatcaggtgctctgcagcaatcctgcaccagctgttcaagcagtagtcaatcctgaagtgattcagccatcagttatgaagaactcccatcaggttctcgagaatggacaccagcttggagaacctaaaatggaggaggtggttgttcctccaataaagaatttaagcaaacaacagtcactgacggaccgacagcaagaaaatcatgatatccttatcaaaagcctggctgaagacaggagatatgacaacagaagaccagctgcagcatgtattgtctacaaatcactccttcactggcactcatttgaagcagaaaagacaaacatatttgaccgtatcatccatacaattaggtcatctgttgagaatgctgaaagttctggagaactagcttattggttgtcgacaacatcaaccctcctctaccttttacaaaatactcttaaagctagcagttcatcgactaaagtaccaaatcgcagcaggactgcaacaggcaacctattcaatagaatggtgcagaatgctcgatcgtcatcatcgggattaggtatttcaaacggatacagtggaatggtaggaagggctgacactacatcaatgatagaggctaagtatccagctgtacgtttcaagcaacagttaacagcatatgtcgagaagatatatggcacgatgagagatagcctgaaaagggaaataagtgcaatactgactctctgcatacaggctccaagagctggtcgtgtaagagcatctcgaggatcattgaaaagtatacactctagtgcactatcaaggcaagcatcaagtgtgcattggcaaaacattgttaagtgcctgaatcatacactggaaacgatgaacaataattatgtacctccaatgataattaggaaaacattcagtcaagtatttgcatttatgaacgttcaactcttcaacagtttgctacttcggcgtgaatgctgctcctttagcaatggagaattcttgaaggctggtttacaggaactggagcagtggtgctctagaacaaccgaagagtatgcaggaacatcttgggatgaactgcaacacataaggcaggcagttgggttcctggttttgcatcagaaatcgcacaagacactggaggaaatcactgatgagctttgccccgttctgagcatcagccaaatatatcgcatcggaacgatgttctgggatgataaatacggcgcacaaggtctatcccaagaggtaattggaaacatgagaacaatgacgacagatgactcgataactactccgaacagttctttcttactagatgacgactcaagcataccgatatccttggacgatatagcgcgactgatgctcgacatcaacccgactgacgtggagccgccaccactactgcggcagaactcccagttccactttcttctgcaacagcatacagactgattacattacgtatataaaggaaaatacagacaggtaccagtttttgtgaagttcctgggcagtgaagattttttttttttaaataggagtgcatagtttggggtttggtttgtttcggtctccagcttgcaattttgggttgggtcttgtggaaagtatattttgagaaagggaaatatagaagagtttgatagcattcttttgattggtattgatagtgtgaaagaggaaacattgtaattcttttgtgaaagtacatatgttgattacccgactgatgaattcaatgacaacactttct

SEQ ID NO: 12133 - DNA, 4471 bp, Secale cereale
tacaccgggaacatcttgattgccgtcaaccctttccagaggctgccccatctctatgacgtgcacatgatggtgcagtacaaaggtgccaccttcggggagctcagccctcatcttttcgcgattgcagattcttgttacagggcaatgattaatgagcatggaagccagtcaatattggtgagcggtgagagtggcgctggtaagacagagacgacgaagatgctcatgaggtaccttgccttcatgggaggaaggtctggaaccgagggacgaaccgttgagcaacaagttctagagtctaacccagtactggaagcatttggtaatgcgaagacggtgaagaacaacaactccagtcgttttggtaagtttgttgaaatccaattcgacaaatacgggaagatatctggtgcggccgttcgcacttacctccttgagcggtcacgagtatgccaggtctctgatcctgaacggaattaccattgcttttacatgctatgttcggcaccaccggaggacgtaaaaaggtttaaggtgggagatccgcgatcatttcattacctgaaccaaacaagctgctatgaagtagctaatgtggatgacgcaagagaatacctagaaacaagaaatgcaatggatatagttggaatttctcaagaagaacaggatgcaatcttcagagtagtagcggcaatccttcatctaggaaacattaatttctccaaagggaaagaaattgattcatcaaggttgagggatgagaaatcaatcaatcacctgaaaatagtggcagaactgctaatgtgtgacgagaagttgcttgaagactctctttgtcagcgcgttattgtaacacctgatggaaatatcacaaaacccctcgatccagattctgctctacagagtcgtgatgccttggcaaagacagtgtattcacgactattcgactggattgtggataagatcaataactcgattggtcaagatcctgatgcaataagtataataggagtgctggatatatatggatttgagagtttcaaggtcaacagttttgagcaactgtgcatcaacatgacaaatgagaaattgcaacagcacttcaatcagcacgtattcaagatggagcaagaagagtatacaagggatgaaatagactggagctatgtggaatttgtggacaatcaggatgtgctggacctgattgagaagaaacctggaggaataattgccctcctggatgaggcatgcatgtttccgaagtccactcacgagacatttgcacaaaagatgtatcaaacatacaaatcacataagcgctttagcaagcccaaacttgccaggactgccttcacaatcaaccactacgcaggagatgtcacataccgaatccgattatttcttgtactaagaacaaagattatgtagtcgctgaacatcaagctctactaaattcgtcaaggtgctcttttgttgtcaaatctctttcctccattaccagagaaagttctaaactagttccttaaattttctttcttccatcggtactcgctttaaagcaacaaactccaagccctgatggaaacatttgagtacaacagaaccacactacattagatgtgtgaagcctaatactgtactgaaacctggcatcttcgagaacgacaatgtcttgaatcaattgagatgtgggggtgttttggaagcaatccggatcagttgtgctggctatccgacgaagagaacatttgatgagttcattgatcgattcggagtgcttgcaccagagcttgtggacagttctgacgagaagacagcttgcgcagcaatatgtgataaaatgggattgaagggataccagatagggaaaacaaaggtattcctaagagctggccagatggcagagctggatgctagaagagcagaagtattggccaatgctgtgcgacttatccagaggcgtataagaacgcatcttatgcgaaaggatttcatcagcttaaaaaaggcttccattcaaacccagaagttctggagagcacgactagctagaaagctttttgagcacatgagaagagtcgctgctgcaattacaatacagaagcacacccgtactcattctgcctggaaagcgtatctacaaatatacagatcatcaataacaatacagacaggattacgtgcaatggctgctcgtaaggagcacaggttcagaagagagaccaaagcgaccatcatcatccagactcgatggcgccaacacaaagcctatgttgcttacaaacagcaaaaaagagcttctctgattctccagtgctcatggaggggacgtgttgcaaggaaggaacttcggaagctcaaaatggaagcaagagataatggtgcacttaaagaagcaaaagacaagctggaaaagagagttgaggaactcacatggagattagatgttgagaagcatttgagggttgaccttgaggtagccaagggtcaagaaattacgaagttacaatccgcgttgcaagaaatgcaagaaaagctcgaggaagcccatgcagcaattataaatgagaaagaagctgcaaagttagcaattgaacaggcaccacctaagatagtagaggtgccagtggtggataacgcaaaagttgagctgttgacaagtcaaaacgaggaacttgaggctgagctcggtacgtttagaacgaaggctgaagatcttgagaagaagctttttgagattcaaaaacagtctgacgaattgtcacgtgaggcacaagaacgggactcgaaaattaaccaacttcaagacatgatcgccaggcttgaaacaaatttatccaacatggaatctgaaaaccacgttctacgccaacaatcgttacttgcatcagcagatgatgataataagacaaaacaaatagagagtctggaaagcaagattgccatcttggagtcagagaatcagttgctccgcagcaatcctgcaccagctgttcaagcagttgtcattcctgaagtgattgagccagctgttgtgaaggttctcgagaatggacatcagcatggagaacctaaaatggaggaggtggttgttccccactaaagaatttaagcaaacaacagtcactgacggaccgacagcaagaaaatacatgatgtccttataaaaagacctggctgaagacaggagatatgacaacagaagaccagctgcagcatgtattgtctacaaatcactccttcactggcactcatttgaagcagaaaagacaaacatatttgaccgtatcatccatacaattaggtcgtctgttgagaatgctgaaagttctggagaactagcttattggttgtcgacaacatcaaccctcctctaccttttacaaaatacccttaaagctagcagttcatcgactaaagtaccaaatcgcagcaggaccgcaacaggcaacctattcaatagaatggtgcagaatgctcggtcatcatcatcaggattaggtatttcaaacggatacagtggaatggtaggaagagctgacactgcatcaaggatagaggctaagtatccagctgtacgtttcaagcaacagttaacagcatatgtcgagaagatatatggcatgatgagagatagcctgaaaagggaaataagtgcaatattgactctctgcatacaggctccaagagctggccgtgtgaaagcatctcgaggatcactgaaaagtatacactctagtgcactatcaaggcaagcatcaagtgtgcattggcaaaacatcattaagtgcctgaatcatacactggaaacgatgaacagtaattatgtacctccaatgataattaggaaaacattcagccaagtatttgcatttatgaacgttcaactcttcaacagtttgctacttcggcgtgaatgctgctcctttagcaatggagaattcttgaaggctggtttacaagaactggagcagtggtgctctagaacaactgaagagtatgcaggaacatcttgggatgaactgcaacacataaggcaggcagttgggttcctggtgttgcatcagaagtcgcacaaaaccttggacgaaatcactgatgagctttgccccgttctgagcatcagccaaatatatcgcatcggaacgatgttctgggacgataaatatggagcacaaggtctatcccaagaggtaattggaaacatgagaacaatgacgaccgatgactcgataactactccaaacagttctttcttgttagacgacgactcaagcataccgatatccttggatgatatagcgcgactgatgcttgacatcaacccgactgacgttgagccgccgcctctactgagacagaactcgcagtttcactttcttctgcaacagcatacagactgatttacattacgtatataaaggaaaatatagacaggtacagtttgtgaagttcctgggcagtgaag

SEQ ID NO: 12134 - DNA, 2448 bp, Triticum aestivum
gccaagatggcgacctatgagcccaagaacatcctcataactggtgctgcgggtttcattgcatcccatgtggcgaaccgtctaattaggagctatcctcactacaagattgtcgtcctcgacaagattgactactgctccaacctgaaaaatctcaacccttcccggccatcgccaaatttcaagtttgtcaagggcgacattgcaagtgctgacctggtgaactatcttctcatcactgagtcgattgacaccatcatgcactttgctgcccagactcatgtggataattcgtttggcaattcctttgagttcacaaagaacaacatatatggcacccacgttctccttgaggcgtgcaaggttactggccagatcagaagatttattcacgtcagtactgatgaggtgtacggagaaactgatgaggatgctgtggttggtaaccatgaggcctcgcagttgcttccgacaaatccatattcagctaccaaagctggggctgaaatgcttgtgatggcttatgggaggtcttatggtcttcctgtgattacaacccgaggcaacaatgtgtatggaccaaatcagttccctgagaagctcatcccaaaatttatccttttggccatgaaaggcttgccccttccaattcatggtgatggctctaatgtcaggagctacctgtactgcgaggatgttgctgaagcttttgaggtagttcttcacaaaggagaggttggacatgtgtataatattggtactgtgaaggagaggagggtaattgatgtggccagtgacatatgcaagctatttggcttggacaccgaaaaggtcatcaggtttgtcgagaacaggcccttcaatgaccagaggtacttcctggatgatcagaaactgaagaagttaggatgggcagagcgcactacatgggaagagggtttgaagaaaacaattgaatggtacaccagcaatcctgattactggggagatgttgccggtgcattgctccctcatccaaggatgttgatgacgcctggagttgaaaggcataactggactgaggaaatcaaatctcttgcttcttcgccagctgaagccaaggaatgtagtacagtacctgctgcagccacatccaagagcaccagcagtgtccctcaaaaggccacctacaagttcttaatatatggtaagactggatggattggtggtctacttgggaagatatgtgagaagcaaggcataccttatgaatatggtaaaggccgcctgcaagagcgctctcagctcttgcaggacattagaaacgtgaagccgactcatgttttcaatgctgctggtgtcactggaaggccaaatgttgactggtgtgagacccacaaacaggacactatccgcaccaatgttgtaggcaccttgaatcttgctgatgtttgtcgtgagcaggggttgctcatgattaattatgctacaggttgcatatttgagtataatgctgaacaccctgaagggtctggaattggttttaaagaggaggacacacccaactttgtaggttcattttattccaaaaccaaagccatggtggaagagttattgaaggactatgataatgtctgtactcttagagtcaggatgcccatatcatcagacctgagcaatcctcgtaacttcatcacaaaaatagcccgctatgacaaggtggtgaacattcccaacagtatgacaattttggatgaattgttgcctatctctgttgagatggcgaagcgggattgtaggggcatatggaatttcaccaacccgggggttgtcagtcacaacgagattctggagatgtacaaggaatacatcaacccagacttcaagtggaccaacttcacgctcgaagagcaggccaaggttatagttgcacccagaagcaacaacgaaatggacgcgtcaaagctgaagtccgagttccctgagctactgtccattaaggaatctttgatcaagaatgtctttgagccaaacaggaaggtttctactaattgaagattcatgtgacacaggtctgctagaagctatttccaattagctaatatatttcatggtggcagctgtggtcaattccattgtggtatagcaggcatacatatttacgattttttgttacgcattacgtttcacttgagaacagatcttaaaatctatgtagtggtggatatgtttgttggcctggttatctatgtgaacagatcttaaaatcttgtttctatttatcaggtgcctttcatgtgcatgatgctgcgcttgtgcatcctgtttacgtgttgtttttcttggttttcatatctgaagtttgtattggcagactcgacttatatgtgtagttttgttggttcatatttgaagttcgcatcagcttccaaaaacatgtgcattcagaagcccagagggtttgtcagt

SEQ ID NO: 12135 - DNA, 2672 bp, Secale cereale
cgaggatgggacgcgcggaccacgcggcgaaacggtcaggatcctcttctccctcctctccagtctcttttaagccccccatccgcccgtactcgtcggcgccgtgcagttgagtgctcgctgctccctcctcccccccgcgaagattctccttcgacccctcccgatctccaaggcgccgtcgccgtcgccgagcgccagatctcctccacgcgctcgcggcgcgccctcgccgcctgcgcgatctgcccggccaagatggcgacctatgagcccaagaacatcctcataactggtgctgcgggtttcattgcatcccatgtggcgaaccgcctaattaggagctatcctcactacaagattgtcgtcctcgacaagattgactactgctccaacctgaaaaatctcaacccttcccggccatcgccaaatttcaagtttgtcaagggcgacatcgcaagtgctgatctggtgaactatcttctcatcactgagtcgattgacaccatcatgcactttgctgcccagactcatgtggataattcgtttggcaattcctttgagttcacaaagaacaacatatatggtacccacgttctccttgaggcatgcaaggttactggccagatcagaagatttattcacgtcagtactgatgaggtgtatggagaaaccgatgaggatgctgtggttggtaaccatgaggcctcgcagttgcttccgacaaatccatattcagctacaaaagctggggctgaaatgcttgtgatggcttatgggaggtcttatggtcttcctgtgatcacaacccgaggcaacaatgtgtatggaccaaatcagttccctgagaagctcatcccaaaatttattcttttggccatgaaaggcttgccccttccaattcatggtgatggctctaatgtcaggagctacctgtactgcgaggatgttgctgaagcttttgaggtagttctgcacaaaggagaggttggacatgtgtataatattggtactgtgaaggagaggagggtaattgatgtggccagtgacatatgcaagctatttggcttggacaccgaaaaggtcatcaggtttgtcgagaacaggcccttcaatgaccagaggtacttcctggatgatcagaaactgaagaagttaggatgggcagagcgcacgacatgggaagagggtttgaagaaaacaattgaatggtacaccagcaatcctgattactggggagatgttgccggtgcattgctccctcatccaaggatgttgatgacgcctggagttgaaaggcataactggactgatgaaatcaaatctcttgcttcttcgccagctgaagccaaggaatgtagcacagtacctgctgcagccacatccaagagcaccagcagtgcccctcaaaaggccacctacaagttcttaatatatggtaagactggatggattggtggtctacttgggaagatatgtgagaagcaaggcataccttatgaatatggtaaagggcgcctgcaagagcgctcacagctcttgcaggacattagaaacgtgaagccgacccatgttttcaatgctgctggtgtcactggaaggccaaatgttgactggtgtgagacccacaaacaggacactatccgcaccaatgttgtaggcaccttgaatcttgctgatgtttgtcgtgagcagggattgctcatgattaattatgctacaggttgtatatttgagtataatgctgaacaccctgaagggtctggaattggctttaaagaggaggacacgcccaactttgtaggttcattttattccaaaaccaaagccatggtggaagagttattgaaggactatgataatgtctgtactcttagagtcaggatgcccatatcatcagacctgagcaatcctcgtaacttcatcacaaaaatagctcgctatgacaaggtggtgaacattcccaacagtatgacaattttggatgaactcttgcctatctctgttgagatggcgaagcgggattgtaggggcatatggaatttcaccaacccgggggttgtcagtcacaacgagattctggagatgtacaaggaatacatcaacccggacttcaagtggaccaacttcacgctcgaagagcaggccaaggttatagttgcgccaagaagcaacaacgaaatggacgcgtcaaagctgaagtccgagttccctgagctactgtccattaaggaatctttgatcaagaatgtctttgagccaaacaggaaggtttctactaattgaggattcatgtgacacaggtctgctataagctatttctaattagctaatatattgcacggtggcagctgtggtcaaatttattgtggtatagcaggcatacatatttacgattttttggtacgccttatgtttcacttgagtattatcagatgttctatgtagtggtggatatgtttgttggcctggttatctatgagaacagatcttaaaaatcttgtttctatttatcaggcgcctttcatgtgcatgatgctgcgcttgtgcattctgtttacgtgattgtttttcttggttttcatatctgaagtttgtattggcagactcgacttatatgtgctagtttttgttggttcattatttgtaagtttgactttactaaaacgttt

SEQ ID NO: 12136 - DNA, 2430 bp, Hordeum vulgare
catgtttggatattaatttgcaggccaagatggcgacctatgagcccaagaacatcctcataactggtgctgcgggtttcattgcatcccatgtggcaaaccggctaattaggagctatcctcactacaagattgttgtccttgacaagattgactactgctccaacctgaaaaatctcaacccttcccggccatcaccaaatttcaagtttgtcaagggtgacattgcaagtgctgatctggtgaactaccttctcatcactgagtccattgacaccatcatgcactttgctgcccagactcatgtggataattcgttcggcaattcatttgagttcacaaagaacaatatatatggtacccatgttctccttgaggcatgcaaggttactggccagatcagaagatttattcacgtcagtactgatgaggtgtacggagaaactgatgaggatgctgtggttggtaaccatgaggcctcgcagttgcttccgacaaatccatattcagctacgaaagcaggggctgaaatgcttgtgatggcttatgggaggtcttatggtcttcctgtgattacgactcgaggcaacaatgtgtatgggccaaatcagttccctgagaagctcatcccaaaatttattcttttggccatgaaaggcctgccccttccaattcatggtgatggctctaatgtcaggagctatctgtactgtgaggatgttgctgaagcttttgaggtagttcttcacaaaggagaggttggacacgtgtataatatcggtactgtgaaggagaggagggtaattgatgtggcgagtgacatatgcaagctatttggcttggacaccgaaaaggtcatcaggttcgtcgagaacaggcccttcaatgaccagaggtacttcctggatgatcagaaactgaagaagttgggatgggcagagcgcacaacatgggaagagggtttgaagaaaacaattgaatggtacacaagtaatcctgagtactggggcgatgttgccggtgcattgctccctcatccaaggatgttgatgacgcctggagttgaaaggcataactggactgaggaaatcaaatctcttgcttcttcgccagctgaagccaaggaatgtaacacagtagctgctgcagccacttccaatagcaccagcagtgcccctcagaaggccacctacaaatttttaatatatggtaagactggatggattggtggtctactcgggaagatatgtgagaagcaaagcataccttatgaatatggtaaagggcgcctacaagagcgctctcagctcctgcaggacattcgaaacgtgaagccgactcatgttttcaatgctgctggtgtcactggaaggccaaatgttgactggtgtgagacccacaaacaggacactatccgcaccaatgttgtaggcaccttgaatcttgctgatgtttgtcgtgagcaggggttgctcatgattaattatgctactggttgcatatttgagtataatgctgaacaccctgaagggtctggaattggttttaaagaggaggacacgcccaactttgtaggttcattttactccaaaaccaaagccatggtggaagagttattgaaggactatgataatgtctgtactcttagagtcaggatgcccatatcatcagacctaagcaatcctcggaacttcatcacaaaaatagcccgctatgacaaggtggtgaacattcctaacagtatgacaattttagatgaactcttgcctatctctgtagagatggcaaagcgggattgtaggggcatatggaatttcaccaaccctggggttgtcagtcataacgagattctggagatgtacaaggaatacatcaacccggacttcaagtggaccaacttcacgctcgaagagcaggccaaggttatagttgcaccaagaagcaacaacgaaatggacgcgtcaaagctgaagtcagagttccctgagctactgtccattaaggaatctttgatcaagaatgtctttgagccaaacaggaaggtttctactaattgaagattcatgtgacacaggtctgctagaagctatttctaattagctaatatatttcacggtggcagctgtggccaattctattgtggtatagcagcaggcatacatatttacgattttttgttacgcattatgtttcacttgagtattaccagatgttctatgtagtggtggatatgttcattggcctggttatctattgagaacagatcttaaaatcttttccatttatgaggtgccattcatgtacgtggtgttgcgctttgtgcatgctgtttacgtgttgtttttcttggttttcatatctgaagtctgtattggcggactcaacttatatgtgtagttttgttggtccatatttgaagtttgcatcccc

SEQ ID NO: 12137 - DNA, 2725 bp, Hordeum vulgare
aatttgcaggccaagatggcgacctatgagcccaagaacatcctcataactggtgctgcgggtttcattgcatcccatgtggcaaaccggctaattaggagctatcctcactacaagattgttgtccttgacaagattgactactgctccaacctgaaaaatctcaacccttcccggccatcaccaaatttcaagtttgtcaagggtgacattgcaagtgctgatctggtgaactaccttctcatcactgagtccattgacaccatcatgcactttgctgcccagactcatgtggataattcgttcggcaattcatttgagttcacaaagaacaatatatatggtacccatgttctccttgaggcatgcaaggttactggccagatcagaagatttattcacgtcagtactgatgaggtgtacggagaaactgatgaggatgctgtggttggtaaccatgaggcctcgcagttgcttccgacaaatccatattcagctacgaaagcaggggctgaaatgcttgtgatggcttatgggaggtcttatggtcttcctgtgattacgactcgaggcaacaatgtgtatgggccaaatcagttccctgagaagctcatcccaaaatttattcttttggccatgaaaggcctgccccttccaattcatggtgatggctctaatgtcaggagctatctgtactgtgaggatgttgctgaagcttttgaggtagttcttcacaaaggagaggttggacacgtgtataatatcggtactgtgaaggagaggagggtaattgatgtggcgagtgacatatgcaagctatttggcttggacaccgaaaaggtcatcaggttcgtcgagaacaggcccttcaatgaccagaggtacttcctggatgatcagaaactgaagaagttgggatgggcagagcgcacaacatgggaagagggtttgaagaaaacaattgaatggtacacaagtaatcctgagtactggggcgatgttgccggtgcattgctccctcatccaaggatgttgatgacgcctggagttgaaaggcataactggactgaggaaatcaaatctcttgcttcttcgccagctgaagccaaggaatgtaacacagtagctgctgcagccacttccaatagcaccagcagtgcccctcagaaggccacctacaaatttttaatatatggtaagactggatggattggtggtctactcgggaagatatgtgagaagcaaagcataccttatgaatatggtaaagggcgcctacaagagcgctctcagctcctgcaggacattcgaaacgtgaagccgactcatgttttcaatgctgctggtgtcactggaaggccaaatgttgactggtgtgagacccacaaacaggacactatccgcaccaatgttgtaggcaccttgaatcttgctgatgtttgtcgtgagcaggggttgctcatgattaattatgctactggttgcatatttgagtataatgctgaacaccctgaagggtctggaattggttttaaagaggaggacacgcccaactttgtaggttcattttactccaaaaccaaagccatggtggaagagttattgaaggactatgataatgtctgtactcttagagtcaggatgcccatatcatcagacctaagcaatcctcggaacttcatcacaaaaatagcccgctatgacaaggtggtgaacattcctaacagtatgacaattttagatgaactcttgcctatctctgtagagatggcaaagcgggattgtaggggcatatggaatttcaccaaccctggggttgtcagtcataacgagattctggagatgtacaaggaatacatcaacccggacttcaagtggaccaacttcacgctcgaagagcaggccaaggttatagttgcaccaagaagcaacaacgaaatggacgcgtcaaagctgaagtcagagttccctgagctactgtccattaaggaatctttgatcaagaatgtctttgagccaaacaggaaggtttctactaattgaagattcatgtgacacaggtctgctagaagctatttctaattagctaatatatttcacggtggcagctgtggccaattctattgtggtatagcagcaggcatacatatttacgattttttgttacgcattatgtttcacttgagtattaccagatgttctatgtagtggtggatatgttcattggcctggttatctattgagaacagatcttaaaatcttttccatttatgaggtgccattcatgtacgtggtgttgcgctttgtgcatgctgtttacgtgttgtttttcttggttttcatatctgaagtctgtattggcggactcaacttatatgtgtagttttgttggtccatatttgaagtttgcatccccaaaacatgtgcattcagaagccaagagggtttgtcagttgatgcgccctgatcaaccgtaagctcccgtcgactgtcaacgcgacgtgttgagtaccgcacgctgaaatatttgcttgcaacagattagtctttggtgcaggttgcgggccttgccagagcttgccttgtctcttgctccacaaacataataatcataccgactgtttccagagtttaaggtttccatagttctgttcctgttttctgtaatcttgttctctggcttcccctttctgggtttgaaacttttcttgctccgttggatacc

SEQ ID NO: 12138 - DNA, 2684 bp, Setaria italica
ctcccgatctcctccccgcccccgccctctcgatccatcccgttgctcgtcgcggcaggcggcatcatcgcccgccccggccgcgttcgcttcgtcccccgccgcagccgcccaccgcaccgggacgcgcgtgcgggcatcgccgccagcgcgcgaccgtcccttcggctccgacacaggctcgctccccggctcggctcggttcggttctgccgccaccgcggggctcacggatctcggcgacccgcttctcgttagaaatcagcagacaaagatggcgacctacgagcccaagaacatcctcataaccggcgctgctggtttcattgcatcgcatgtggcaaaccgcctggttaggaactacccacactacaagattgttgtcctcgacaagcttgactactgctccaacctaaagaacctcaacccttcgcggccttcaccaaatttcaagtttgtcaagggtgacattgcaagtgctgatctggtgaactaccttctgatcacagagtcgattgacaccatcatgcactttgctgctcagacacatgtggataattcttttggcaattcctttgagttcacaaagaacaacatatatggtacccacgtccttcttgaggcttgcaaggttactggtcagatcagaaggtttattcatgtcagtactgatgaggtgtatggagaaaccgaagaggatgctgtggttggcaaccatgaggcctcacagctgcttccaacaaatccatattcggcaacaaaagctggggctgaaatgcttgtgatggcttatggtaggtcttatggtcttcctgtgattaccactcgggggaacaatgtgtatgggccaaaccagttccctgagaaactcattcccaaattcattcttttggccatgagaggtctgccccttccaattcatggagatggttccaatgtcaggagctacctctactgtgaggatgtggctgaagcttttgaggtggttcttcacaaaggggaggttggacatgtgtataatattggtactgtgaaggagaggagggtgattgatgtggccaaggacatatgcaagctctttggcttggatactgagaaagtcatcaggtttgttgagaacaggcccttcaatgaccagaggtacttcttggatgatcagaagctgaagaaattggggtgggcagagcgcacaccatgggaagagggcttgaagaaaacaattgagtggtacacaaccaatcctgattactggggagatgtcactggtgctttgctccctcatccaaggatgttgatgactcctggtgttgatgaaagacataactggactgaggaaatcaagtctctggcttcatcaccagtggaggctagcacaacagctcctgcagccagtacccagagcaccaccgatgcccctcaaaagccttcctacaagttcttaatctatggtaggactggatggattggtggactccttgggaagatttgtgagaagcaagggataccatatgagtacgggaaaggacgcttggaggagcgttctcagcttttggaggacattagaaatgtgaaaccaactcatgttttcaatgctgctggagtcactgggagaccaaatgttgactggtgtgagacgcacaaacaggacactatccgcaccaatgttgtaggcaccttgaatcttgctgatgtttgtcgtgagcagggtttgctcatgattaattatgctacaggctgtatatttgagtatgatgctaagcaccctgaagggtctggaatcggctttaaagaggaagacacacccaactttacaggctccttttattccaaaactaaagcaatggttgaagagctattgaaggactatgataatgtctgtactcttagggtgaggatgcctatatcatcagacctaggcaaccctcgtaacttcatcacaaagatagctcgttacgacaaggtggtgaacattcccaacagcatgacgattttggatgagcttctgcctatctccatcgagatggcgaagcgggactgcaggggcatatggaacttcaccaaccctggcgttgtcagccacaacgagattctggagatgtacaaaaagtacatcaatcctgacttcaagtggaccaacttcacactagaagagcaggccaaggtcatagttgcacctaggagcaacaacgagatggacgcatcgaaactgaaggctgagttccctgagctgctatccatcaaggattctttgatcaagtatgtcttcgagccaaacaggaaggtccctactaactgaggatttagggtacgtgggtgttgaggttctttatattggttattgtttgacactaaaatagttaatgttgcctggtggttcgtggttgtggtcgattcttctgggggcgaggcgatggcaggcatacctctttttttctgtcattctgttccgctacgcatcatgtttttttacagaacacgtagatatccttagatgttctatatagtgggcagtggctgatatgctgagacgtggttatcgatgaacactttggtttaacttattccattatatgttaactgtcagagagcagttattgtacatggtcttgtgcattctagttctttgttgcacttcaccaacttgtccttggtcacttggtgggttgatggaggttgtcagcgcc

SEQ ID NO: 12139 - DNA, 2500 bp, Oryza sativa
ctccccctcccgcatcacagccattcgccacttcaccaccaccaccgccataatccgtctcgccccgatccagccggctcgtcaccgacgcgacgccgccgcggccccccagatcccgtcgtgcgcgcgcgcgatctgctctcgcaggcgaagatggcggcttacgagcccaagaacattcttataaccggcgctgctggtttcatcgcatcacatgtggcgaaccgcctagtcaggaactatccgcactacaagattgttgtcctcgacaagctcgattactgttccagcctgagcaatctcaacccttcacgtccatcgccgaatttcaagtttgtcaagggtgacattgcaagtgctgatctggtgaactaccttctcacaactgagtcaattgacactatcatgcactttgctgctcagactcatgtggataattcatttggcaattcctttgagtttacaaagaacaatatttatggtacccatgtccttcttgaggcctgcaaggttactggtcagattagaagatttattcatgtgagtactgacgaggtgtacggagaaactgatgaggatgctgtggttggcaaccatgaggcctcacagctgcttccaacaaacccatattcagctacaaaagctggggctgagatgcttgtgatggcttatggaagatcttatggccttcctgtgattacaactcggggcaacaatgtatatgggccaaatcagttccctgagaagctcattcccaaatttattcttttggcaatgagaggcttgccccttcccattcacggtgatggctcaaatgtcagaagctatctgtattgtgaggatgttgctgaagcttttgaggtggttcttcacaaaggagaggttgggcatgtgtacaatattggtactgtgaaggaaaggagggtgattgatgtggccaaggacatatgcaagctctttggcttggacaccgagaaggtcatcagatttgttgagaacaggcctttcaacgaccagagatacttcttggatgatcagaagctgaagaaattgggatgggcagagcgcacactatgggaagaggggttgaagaaaacaattgaatggtacactaacaatcctgattactggggagatgtcgcaggtgccttgctccctcatccaaggatgttgatgacacctggagttgaaaggcataactggactgatgagatcaaatctctttccacttcaccagatgaagctaaggaatctagcactgcggttcctgcagccactgccaaaagcaccagcagtgcccctcaaaaggcctcatacaagttcttgatatatggtaggactggatggattggtggtctacttggtaagatatgtgagaagcaagggattccatatgagtatgggaaaggacgcctggaagagcgctctcagctcttgcaggacattagaaatgtgaagccaactcatgttttcaatgctgctggtgtcactgggaggccaaatgttgactggtgcgagacccataaacaggatactatccgcaccaatgttgttggcaccttgaaccttgctgatgtttgtcgtgagcagggcttgctcatgattaattatgctacaggttgcatatttgagtatgatgctaagcaccccgaaggatcaggaattggttttaaagaggaagataagcccaactttactggttcatattattccaaaactaaagctatggttgaagagctgttgcaagaatatgacaacgtctgtacgcttcgagtcaggatgcccatatcatcagatttgagcaacccccgtaacttcatcacaaagatagctcgttatgacaaggtggtaaacatccccaacagtatgacaattttggatgagcttttgcccatctccattgagatggcgaagcgggactgcaggggcatatggaacttcaccaatcctggggttgtcagccacaacgagatcctggagatgtacaagaaatacctcaaccccgacttcaagtggaccaacttcactcttgaggaacaggccaaggttatagttgcaccaagaagtaacaacgaaatggatgcatcgaagttgaagtccgagttccccgagctactgtccatcaaggattctttggttaagtatgtttttgagccaaacaggaaggttcctgctaactgaagatttacgggcgcgggcgggagttatggaggttacgagcgcgggcgggagttatggaggttattgcacggatgcagttgtgaccatacttttttttgtagtttttggttatatctggtgttttgttaagatacatgtaggtgaactacataccgttcgatacttaacctatttatttatatattcatagcaattcgtgtgcacggcatgtgcatattattttttttgctttggtttgtgcggtggttcagaatgtatctcacctctacgttgtactctttgaactacttactctatctaaaaaagggcaattcttaca

SEQ ID NO: 12140 - DNA, 2506 bp, Oryza sativa
ctccccctcccgcatcacagccattcgccacttcaccaccaccaccgccataatccgtctcgccccgatccagccggctcgtcaccgacgcgacgccgccgcggccccccagatcccgtcgtgcgcgcgcgcgatctgctctcgcaggcgaagatggcggcttacgagcccaagaacattcttataaccggcgctgctggtttcatcgcatcacatgtggcgaaccgcctagtcaggaactatccgcactacaagattgttgtcctcgacaagctcgattactgttccagcctgagcaatctcaacccttcacgtccgtcgccgaatttcaagtttgtcaagggtgacattgcaagtgctgatctggtgaactaccttctcacaactgagtcaattgacactatcatgcactttgctgctcagactcatgtggataattcatttggcaattcctttgagtttacaaagaacaatatttatggtacccacgtccttcttgaggcctgcaaggttactggtcagattagaagatttattcatgtgagtactgacgaggtgtacggagaaactgatgaggatgctgtggttggcaaccatgaggcctcacagctgcttccaacaaacccatattcagctacaaaagctggggctgagatgcttgtgatggcttatggaagatcttatggccttcctgtgattacaactcggggcaacaatgtatatgggccaaatcagttccctgagaagctcattcccaaatttattcttttggcaatgagaggcttgccccttcccattcacggtgatggctcaaatgtcagaagctatctgtattgtgaggatgttgctgaagcttttgaggtggttcttcacaaaggagaggttgggcatgtgtacaatattggtactgtgaaggaaaggagggtgattgatgtggccaaggacatatgcaagctctttggcttggacaccgagaaggtcatcagatttgttgagaacaggcctttcaacgaccagagatacttcttggatgatcagaagctgaagaaattgggatgggcagagcgcacactatgggaagaggggttgaagaaaacaattgaatggtacactaacaatcctgattactggggagatgtcgcaggtgccttgctccctcatccaaggatgttgatgacacctggagttgaaaggcataactggactgatgagatcaaatctctttccacttcaccagatgaagctaaggaatctagcactgcggttcctgcagccactgccaaaagcaccagcagtgcccctcaaaaggcctcatacaagttcttgatatatggtaggactggatggattggtggtctacttggtaagatatgtgagaagcaagggattccatatgagtatgggaaaggacgcctggaagagcgctctcagctcttgcaggacattagaaatgtgaagccaactcatgttttcaatgctgctggtgtcactgggaggccaaatgttgactggtgcgagacccataaacaggatactatccgcaccaatgttgttggcaccttgaaccttgctgatgtttgtcgtgagcagggcttgctcatgattaattatgctacaggttgcatatttgagtatgatgctaagcaccccgaaggatcaggaattggttttaaagaggaagataagcccaactttactggttcatattattccaaaactaaagctatggttgaagagctgttgcaagaatatgacaacgtctgtacgcttcgagtcaggatgcccatatcatcagatttgagcaacccccgtaacttcatcacaaagatagctcgttatgacaaggtggtaaacatccccaacagtatgacaattttggatgagcttttgcccatctccattgagatggcgaagcgggactgcaggggcatatggaacttcaccaatcctggggttgtcagccacaacgagatcctggagatgtacaagaaatacctcaaccccgacttcaagtggaccaacttcactcttgaggaacaggccaaggttatagttgctccaagaagtaacaacgaaatggatgcatcgaagttgaagtccgagttccccgagctactgtccatcaaggattctttggttaagtatgtttttgagccaaacaggaaggttcctgctaactgaagatttacgggcgcgggcgggagttatggaggttacgagcgcgggcgggagttatggaggttattgcacggatgcagttgtgaccatacttttttttgtagtttttggttatatctggtgttttgttaagatacatgtaggtgaactacataccgttcgatacttaacctatttatttatatattcatagcaattcgtgtgcacggcatgtgcatattattttttttgctttggtttgtgcggtggttcagaatgtatctcacctctacgttgtactctttgaactacttactctatctaaaaaagggcaattcttacatattaa

SEQ ID NO: 12141 - DNA, 2492 bp, Pennisetum glaucum
gccgcccaccgcaccgggacgcgcgtgcgggcatcgccgccagcgcgcgcccgtccccttcggctccgacgcagcctcggctcggttcgtttcgtttctgccgccaccgcgcggtgctcacggatctcggcgacccgcttgtcgtctagaaaaatagcagacaaagatggcgacctatgagcccaagaacatcctcataaccggcgctgctggtttcattgcatcgcatgtcgccaaccgcctggttaggaactacccgcactacaagattgttgtcctcgacaagcttgactactgctccaacctaaagaacctcaacccttcgcggccttcaccaaatttcaagtttgtcaagggtgacattgcaagtgctgatctggtgaactaccttctgatcacagagtcaattgacaccatcatgcattttgccgctcagactcatgtggataattcctttggcaattcatttgagttcacaaagaacaatatatatggtacccatgtcctgcttgaggcttgcaaggttactggtcagatcaggaggtttattcatgtcagtactgacgaggtgtatggagaaactgatgaggatgctgttgttggtaaccatgaggcctcacagttgcttccgacaaatccatattcagctacaaaagctggggctgagatgcttgtgatggcatatggaaggtcttatggtcttcctgttattaccactaggggcaacaatgtgtatgggccaaatcagttccctgagaaactcattcccaaattcattcttttggccatgagaggcctgccccttccaattcatggagatggttccaatgtcaggagctacctctactgtgaggatgtggctgaagcttttgaggtggttcttcacaaaggggaggttggacatgtgtataatattggtactgtgaaggagaggagggtgattgatgtggccaaggacatatgcaagctctttggcttggatactgagaaagtcatcaggtttgttgagaacagacccttcaatgaccagaggtatttcttggatgatcagaagctgaagagattgggatgggcagagcgcacaccatgggaagagggcctgaagaaaacaattgagtggtacaccactaatcctgattactggggggatgtcactggtgcgctcctccctcatccaaggatgttgatgactcctggtgttgatgaaagacataactggactgaggaaatcaagtctctggcttctttgccagtggaggctagcacaacagctcctgcaaccagtacccagaacatcaccggtgcccctcaaaagccttcctacaagttcttaatttatggtaggactggatggattggtggacttcttgggaagatttgtgagaagcaagggataccgtatgagtatgggaaaggacgcctggaggagcgttctcagcttttggatgacgttagaaatgtgaagccaactcatgttttcaatgctgctggagtcactgggagaccaaatgttgactggtgtgagacccacaaacaggacactatccgcaccaatgttgtcggcaccttgaatcttgctgatgtttgtcgtgagcagggtttgctcatgattaattatgctacaggctgtatctttgagtatgatgctaagcatcctgaagggtctggaatcggctttaaagaggaagacacccccaactttacgggctccttttattccaaaactaaagcaatggtggaagagctattgaaggactatgataatgtgtgtactcttagggtcaggatgcctatatcatcagatctaagcaaccctcgtaacttcatcacaaagatagctcgttacgacaaggtggtgaacattcccaacagcatgacgattttggatgagcttctgcctatctccatcgagatggcaaagcgggactgcaggggcatatggaacttcaccaaccctggggttgtcagccacaacgagattctggagatgtacaaaaagtacatcaatcctgaattcaagtggaccaacttcacacttgaagagcaggccaaggtcatagttgcgcctcggagcaacaacgagatggacgcatcaaaattgaaggctgagttccctgagctgctttccatcaaggattctttgatcaagaatgtctttgagccaaacaggaaggtccctgctaactgaggatttaggttacgtgggcattgagggttctttatattggttattattgttcgacactaaattagcgaatgttgcctgatggttcggagttgtggtcgacgattcttctggtcttctggggcaatggcaggcatactttttttctgtcattctgtttcgcatcacgcatgtttttacaaaacacgtagatagccttagatattctatatagtgggcagtggctgatacgctgagacgtggttattgatgaacacttttgtttaacttattattccattatatattaaactgtcagtgagcagtt

SEQ ID NO: 12142 - DNA, 2960 bp, Panicum virgatum
ccgcctacctacccccgtcacgctccgtcagtccgttgctgagccgtggcctgtggggcttgggcgctggcgacggggacgagatgctctgcagtctactcagtcaccgacgcgtggacccgacgggcgtttgggcccacgtgcagtgacggtgtcgccctccagtcgggagctgattccggcgacggggacaccgcggccgcgagtccaccaccgccaggcgccagcaagagcagcgtgcgctggacgaaacagacggcgtgtccccgcggcgaggcgagtctggagccaggactagactactagcgcggcccgcttttaagcgagccagccccgcccccctccctccctcctcccgatctccaccctccacgcccacgcttcgccccgctgctcgtcgcggcaggcgtcatctcatcaccgccaccggccgtggtccccgcccgcccgcccgcgctcgccagccgcctcgtcccccgacgaggcgcgcgcgaccgcccccttcggctccgcgacaggctcttctccccccggctcggctcggttcggttctgccgccaccgcggcgctcccggatctcggcgaccgcttctcgtccactgattagcagacaaagatggcgacctacgagcccaagaacattctcataactggcgctgctggtttcattgcatcacatgtggcaaaccgcctggttaggaactatccacactacaagattgttgtcctcgacaagcttgactactgctccagcctaaagaacctcaacccttcacggccttcaccaaatttcaagtttgtcaagggtgacattgcaagtgctgatctggtcaactaccttctgatcacagagtcgattgacaccatcatgcattttgctgctcagactcatgtggataattccttcggcaattcatttgagttcacaaagaacaatatatatggtacccacgtcctgctggaggcttgcaaggttactggtcagatcaggaggtttattcatgtcagtactgatgaggtgtatggagaaactgatgaggatgctgtggttggtaaccacgaggcatcacaactgcttccaacaaatccttattcagctacaaaagctggggctgaaatgcttgtgatggcatatggaaggtcttatggtcttcctgtgattaccactcggggtaacaatgtgtatgggccaaatcagttccctgagaagctcattcccaaattcattcttttggccatgagaggtctacctcttcctattcatggagatggttccaatgtcaggagctacctgtactgtgaggatgtggctgaagcttttgaggtggttcttcacaaaggagaggttggacatgtgtataacattggtactgtgaaggagaggagggtgattgatgtggccaaggacatatgcaggctctttggcttggatactgagaaagtcatcaggtttgttgagaacaggcccttcaatgaccagaggtacttcttggatgatcagaagctgaagagattgggatgggcagagcgcacaccatgggaagagggattgaagaaaacaattgagtggtataccaccaatcctgattactggggagatgtcagtggtgcactgctccctcatccaaggatgctgatgactcctggtgttgatgaaagacataactggactgaggaaatcaagtctatatcttcttcaccagtggaagctagcacaacagctcctgcaaccaatacccaaagcaccaccgatgcccctcaaaagcatccctacaagttcttaatatatggtaggactggatggattggtggcctccttgggaagatttgtgagaaacaagggataccatatgagtatgggaaaggacgcttggaggagcgttctcagcttttggaggacattagaaatgtgaagccgactcatgttttcaatgctgctggagtcactgggagaccgaatgttgactggtgcgagacccacaaacaagacactatccgcaccaatgttgtaggcaccttgaatcttgcagatgtttgtcgtgagcagggtttgctcatgatcaactatgctacaggctgtatatttgagtacgatgctaagcaccctgaagggtctggaatcggctttaaagaggaagacacacccaactttacaggttccttttattccaaaactaaagcgatggtggaagaactattgaaggactatgataatgtctgtactcttagggtaaggatgcctatatcatcagacctaagcaaccctcgtaacttcatcacaaagatagctcgttacgacaaggtggtgaacattcccaacagcatgacaattttggatgagcttctgcctatctccatcgagatggcgaagcgggactgcaggggcatatggaacttcaccaaccctggtgttgtcagccacaacgagattctggagatgtacaaaaagtacatcaatcctgaattcaagtggaccaacttcaccctggaagagcaggccaaggtcatagttgcacctaggagcaacaatgagatggacgcatcgaaattgaaggctgagttccctgagctgctatccatcaaggattctttgatcaagaatgtctttgagccaaacaggaaggtcccttctagctgaggatttataggcggttgttgaggtcctttgtatttgttatcgttggacactaaattagctaaatgttgaatggtggttcgtagttgtggtcggttctttttggacagtggcaggcatacctcctctccttatcgttctgttggatcatgtttttacagaacaggtagatatttcttagatgttctatataatggctaataagctgaggcgtggttatcgagatacatgtaggttgtcatcccctagcatagcagcatcttcagtgattatcctcgctacgataatcttgtgttttgtctaccactgcatggtgattgctcga

SEQ ID NO: 12143 - DNA, 3742 bp, Panicum virgatum
gagtccatccaaaaaggaaagaaaaagttaattttgaaaaatatctctagaatcaccgctgagatccgcgtcgtgcgagagacgcgccggaggcgccgcctacctacccccgtcacgccccgtccgtccgcagctgagctgtggcgctgtcgacgggggggcaccgcggccgcgagtcgagtccaccaccgccagcaagagcagccagcttacgctggacgaaacagacgccgtgtccacgcggcctctggagccaggactactagcgcggcccgcatttaagcgagccagccccggtcccctccctccctcgccccccgatctcctccctccacgcgcccacgcttcgccccgctgctcgtcgcggcaggcgtcgtctcatcaccgccaccgcccgcgccgcctcgtccccccgcacgggacgcgcgtgcgcgcatcgccgcggcgcgcgcgaccgcccccttcggctccgcgacaggcttttgctcccccaggtcggctcggctcggctcggttcggttccgccgccaccgcggcgctcccggatctcggcgaccgcttctcgtccagggattagcagacaaagatggcgacctacgagcccaagaacattctcataaccggtgctgctggtttcattgcatcgcatgtggcaaaccgcctggttaggagctatccacactacaagattgttgtcctcgacaagcttgactactgctccaacctaaagaacctcaacccttcgcggccttcaccaaatttcaagtttgtcaagggtgacattgcaagtgctgatctggtcaactaccttctgatcacagagtcaattgacaccatcatgcattttgctgctcagactcatgtggataattcctttggcaattcatttgagttcacaaagaacaatatatatggtacccacgtcctgctggaggcttgcaaggttactggtcagatcaggaggtttattcatgtcagtactgatgaggtgtatggagaaactgatgaggatgctgtggttggtaaccacgaggcctcacaactgcttccaacaaatccttattcagctacaaaagctggggctgaaatgcttgtgatggcatatggaaggtcttatggtcttcctgtgattaccactcgtggtaacaatgtgtatgggccaaatcagttccctgagaaactcattcccaaattcattcttttggccatgagaggtctgcctcttcctattcatggagatggttccaatgtcaggagctacctgtactgtgaggatgtggctgaagcttttgaggtggttcttcacaaaggagaggttggacatgtgtataacattggtactgtgaaggagaggagggtgattgatgtggccaaggacatatgcaggctctttggcttggatactgagaaagtcatcaggtttgttgacaacaggcccttcaatgaccagaggtacttcttggatgatcagaagctgaagagattgggatgggcagagcgcacaccatgggaagagggattgaagaaaacaatcgagtggtataccaccaatcccgattactggggagatgtttctggtgcgctgctccctcatccaaggatgctgatgactcctggtgttgatgaaagacataactggactgaggaaaccaagtatctatcttcttcaccattggaagctagcacaacagctcctgcaaccagtacccaaagcaccaccgatgcccctcaaaagcatccctacaagttcttgatatatggtaggactggatggattggtggcctccttgggaagatttgtgagaaacaagggataccatatgagtatgggaaaggacgcttggaggagcgttctcagcttttggaggacattagaaatgtgaggccaactcatgttttcaatgctgctggagtcactgggagaccgaatgttgactggtgcgagacccacaaacaagacactatccgcaccaatgttgtaggcaccttgaatcttgcagatgtttgtcgtgagcagggtttgctcatgatcaactatgctacaggctgtatatttgagtacgatgctaagcaccctgaagggtctggaatcggctttaaagaggaagacacacccaactttgcaggttccttttattccaaaactaaagcaatggtggaagaactattgaaggactatgataatgtctgtactcttagggtaaggatgcctatatcatcagacctaagcaaccctcgtaacttcatcacaaagatagctcgttacgacaaggtggtgaacattcccaacagcatgacaattttggatgagcttctgcctatctccatcgagatggcgaagcgggactgcaggggcatatggaacttcaccaaccctggtgttgtcagccacaacgagattctggagatgtacaaaaagtacatcaatcccgacttcaagtggaccaacttcacacttgaagagcaggccaaggtcatagttgcacctaggagcaacaatgagatggacgcatcgaaattgaaggctgagttccctgagctgctatccatcaaggattcgttgatcaagtacgtctttgagccaaacaggaaggtcccttctaactgaggatttatacggggttgttgaggtcctttgtattggttattgttggacacaaaattagttaatgttgcatggtggttcgtagttgtggtcaattctttagggagaatggcaggcgtacctcctttctttgtcattctgttgttacggatcatgtttttacagaacacgtagaacactatgagttagcttattcccttatatattacgtaactgtcaagagcagtcgttgtacatgttctggtttgtggtgcattctttgcactttgcgcctctggtttttgtttgggggttcttggtggatataaggttgtcagcccccctgcacagcagcaccttcggtgattatcctcgctacgttaattttgtttttttttgtttgggggttcttggtggatataaggttgtcagcccccctgcacagcagcaccttcggtgattatcctcgctacgttaattttgtgttttgtctatcactgtatggtggattgctggatgtttctatttggaaaagccattctgcgatcgctggatgatcaattggttattgctggtgctttacttattgatacgataagatagttacatcgttcactaatgcatttaaaatggagaatcgctggacggtcaattggttattgctgggccttgtgacatgtgagacctttcacctttggttggccgcttgccgtaaaagcaaatcggcagcttgtcggaggttcggcagagttcaattctaccatgatgggcctgcctaatggcgtatcattattaattacctcttgtttactgaaaatgtatcttgcgcagtccgaaaatcacatgggccagcctaaaggcgtatcaccgcttgtttactgaaaatgtatcttgcccagtccgataatcatgattaatggttatataatagtagccgctggaataaccttttctcgtgcgttcgttttcctgtttaagttagacctgttgttccgtagtctagttcagaaaggcaccctcgccgatcaaacctccagacaaagttaaccggaacttaccctgtccaacaaaacctccagaaaacagagtttaaccagaactaaaactgtgcgaattacttcatcacagcaccacagaaacacatcaattcaaccgaca

SEQ ID NO: 12144 - DNA, 3660 bp, Setaria italica
cttccgttccaagcaacaagctccgtcagttactagagcaagcccaataaacttgtcttacagacaagccagatcatcagtagaccaaccttgcatacaacaattagtctttttcacaaatttcaagaaacattttttattatgatgggacccaccaataacatatcttgggcgcgcttggtactcttgcaggaggctcgcctcgcctctttgcccggccagcttgctcggctggcaaggagatccttgccgatgcaggagagtcaaaatcaactctcatgtgtgggcaaggttcgcttgcttgtgtgggctgctcgagccaccgtcgaatcgacaccatagctgctgcaacaagcttcgccgtcgtcaaatcgagacgcacaccaaatcaagctccgtcgtcgttgaatcaaactctgcatgtaccgaatcgacctccgccaccgtcgatttgacctcagccgttgtcgattcgacctccgccactgttggattgacctccaccatggtcggatcgagctccgacgctgctggatggagctgcaggggaggcaaggcaagtagcagcaaggaaagcaaacgctcccttcggagcttgccttgctttgcctggcgaggcgagcggcggcaagggttccaagcacaccacttatcttttcgtcgaagggtgctccaccatccagctgcgtctttcccgagctcaccaccgatgaagtgtcccacaaatcgacaaactggacgcctggtagtcacgtagatgggcgaatcgctcggcgtcgccggccacgaccagcttcttctctttcctctattctctctcacccacgtcggagtttgctgtacctgctcttttacgttcccacgcgcgtcgtatttatatcggtggcgagagcgtggagtggagtccatccaaaagaaaacgaacaaaagaaaaatctctagagacgctgctgagatccgcatcccatccgcgtcgtgcgacgcgccgcatacctaccaactcccccgtcagccgtcacgctcacgccccacgtccgcgtccgcccatagctgaactgggcctgccttgcgccgtgcaccgctgcgggccgcggccgcgactccgtccgccagcaagagcacactagagcagggagggagcaggcagcaaggcgtgtgctggcgcgtccacgcggcgaagcggtcggtcatcaggatctcctctgacgacctgctttttagtcgccagcccgggcccctccctctcgaatctcctccccgctctcgcttcgcaccgcgccgtcgcggcagaggaggcatcatcaatcgcccgtccgtgatctccgccgcagcgccccgcgcgagcgcgcgaccgtgccttcggctccgcgacaggcttgcttgcttcccccggctcggctcggttcgcttctgccggcaccgcggcctccccggatctcggccaccgctcctcgtcagagaattaggagacaaggatggcgacttatgagcccaagaacattctcataaccggcgctgctggtttcattgcatcgcatgtagccaaccgcctgattaggaactacccgcactacaagattgttgtcctcgacaagctcgactactgctctagcctaaaaaacctcaacccttcacggtcttcaccaaatttgaagtttgtcaagggtgacattgcaagtgctgatctggtaaactaccttctgatcacagagtcgattgacaccatcatgcactttgctgctcagacacatgtggataattcttttggcaattcctttgagttcacaaagaacaacatatatggtacccacgtccttcttgaggcttgcaaggttactggtcagatcagaaggtttattcatgtcagtactgatgaggtgtatggagaaaccgaagaggatgctgtggttggcaaccatgaggcctcacagctgcttccaacaaatccatattcggcaacaaaagctggggctgaaatgcttgtgatggcttatggtaggtcttatggtcttcctgtgattaccactcgggggaacaatgtgtatgggccaaaccagttccctgagaaactcattcccaaattcattcttttggccatgagaggtctgcctcttccaatccatggagatggttccaatgtcaggagttacctgtactgtgaggatgtagctgaagcttttgaagtggttcttcacaaaggagaggttggacatgtgtataatattggtactgtgaaggagaggagggtgattgatgtggccaaggacatatgcaagttatttggtttggatactgagaaagtcatcaggtttgttgagaacaggcccttcaacgaccagaggtactttttggatgatcagaagctaaagagattgggatgggcagagcgcacaccttgggaagagggtttgaagaaaacaattgaatggtacaccaccaatcctgattactggggagatgtagctggtgctttgctccctcatccaaggatgctgatgactcctggagttgaaaggcataactggactgaggaaatcaagtctctgttttcttcaccagctgaagttagcactacagctcctgcagccagtaccaaaagcaccactaatgccccccaaagtccttcctacaagttcttaatctatggtaggactgggtggattggtggcctccttggaaagatttgtgagaagcaaggaataccatatgagtacgggaaaggacgcttggaggagcgctctcagctgttggaggacattagaaatgtgaagccgactcacgttttaaatgctgctggggtcactgggagaccaaatgttgactggtgcgagacccacaaacaggacacaatccggaccaatgttgtgggcaccttgaatcttgctgatgtttgttgtgagcagggtttgctcatgattaattatgctacaggctgtatatttgagtatgatgctaagcaccctgaagggtctggtattggctttaaagaggaagacacacccaactttagaggttctttctattctaaaactaaagcaatggtggaagagctattgaaggagtatgataatgtgtgtactcttagagtcaggatgcctatatcatcagatctaagcaaccctcgtaacttcatcacaaagatagctcgttacgacaaggtggtgaacattcccaacagcatgacaattttggatgagcttctgcctttctccatcgagatggcgaagcgggattgcaggggcatatggaacttcaccaaccctggcgtcgtcagccacaatgagattctggagatgtacaggaaatacatcaatcctgacttcaagtggaccaacttcacacttgaagagcaggccaaggttatagttgctcccagaagtaacaatgagatggacgcatcgaaattgaaggttgagttccctgagctgctgtccatcaaggattctttgataaagtacgtctttgagccaaacaggaaggttcctgctaattgaggatttagggtaggaggtgttgaggtcatttgtcacgcatcgtgttttacacgtatagatgttctttacagtggccgatgtgccgagacctggttatcgatgagatcatggacgcttcaaactgacttatttcatcattatacaaaatgtcaagtgcagctctttt

SEQ ID NO: 12145 - DNA, 2776 bp, Saccharum officinarum
actgctgctccggcgctgcagtacccgggggacgcccgcgtgcgcgcttcccatcccgcccccctcccgactcttcgtcgcggcgggcatcaccgttgcccaaccgtgatttccgtccttcaccgccgcgccccgcacgtgacgcgcatcgccgcgagcgcggaagcgtccacccgctcggcgacaggcttgcgcaccggctcggctcgtgtcggttctgccgccaccgcgggccgcggcgctcccggatctcggtgaccgcttctcgtcagagaattagcagacaaagatggcgacttatgagcccaagaacattctcataactggcgctgctggtttcattgcatcacatgtcgccaaccgcctggttaggaactatccccaatacaagattgttgtccttgacaagattgactactgctccaacctaaagaacctcaatccttcacggtcttcaccaaatttcaagtttgtcaagggtgatattgcaagtgctgacctggtgaattaccttctgatcaccgagtcaattgacaccatcatgcactttgctgctcagacacatgttgataattcttttggcaattcatttgagttcacaaagaacaatatatatggcacccatgttcttcttgaggcttgcaaggttactggtcagatcaggaggtttattcatgtcagtactgacgaggtgtacggtgaaactgacgaagatgctgtggttggtaaccatgaggcctcacagttgcttccaacaaatccgtattcagctacaaaagctggggctgaaatgcttgtgatggcatacggaaggtcttatggtcttcctgtgattaccactcggggcaacaatgtgtatgggccaaatcagttccctgagaaactcatccccaaattcattcttttggccatgagaggtctgcctcttccaattcatggagatggttccaatgtcaggagctacctgtactgtgaggatgtggctgaagcttttgaggttgttcttcacaaaggggaggttggacatgtgtataatattggtactgtgaaggaaaggagggtgattgatgtggccaaagacatgtgcaggctctttggcttggatactgagaaagtaatcaggtttgttgagaacagacccttcaatgaccagaggtacttcctggatgatcagaagctgaagagactgggatgggcagagcgtacaccatgggaagagggcttgaagaagacaattgagtggtacaccaccaatcctgattactggggagatgttactggtgctttgctccctcacccaaggatgttgatgactcctggagttgaaaggcataactggactgaggaaatcaaatctctgacttcttcaccagctgaagctagcacaacagctcctgcaaccagtaccaaaaggaccactgatgcccctcaaaagcctttgtacaaattcttaatctatggcaggactggatggattggtggcctccttgggaagatttgtgacaagcaagggattccatatgagtatgggaaaggacgcttggaggagcgctctcagctgttggaggacattagaaatgtgaagccaactcatgtcttcaatgctgccggagtcactgggagaccgaatgttgactggtgcgagacccataaacaggacactatccgcaccaatgttgtaggcacattgaatcttgctgatgtctgtcgcgagcagggtttgctcgtgattaattatgctacaggctgtatatttgagtatgatgctaagcaccctgaagggtctggtattggctttaaagaggaagacacgcccaactttacgggttccttttattctaaaacgaaagcaatggtggaagagctgttgaaggagtatgataatgtctgtactcttagggtcaggatgcctatatcgtcagatctaagcaaccctcgtaacttcatcacaaagatagctcgttacgacaaggtggtgaacattcccaacagcatgacaattttggatgagcttctgcctatctccattgagatggcgaaacgggactgcaggggcatatggaacttcaccaaccctggcgttgtcagccacaatgagattctagagatgtacaagaaatacatcaatcctgatttcaagtggaccaacttcacactcgaagagcaggccaaggtcatagtcgcacctagaagcaacaacgagatggacgcgtcgaaattgaaggctgagttccctcagctgctgtccatcaaggactctttgatcaagtatgtctttgagccaaacaggaaggttcctgttaattgaggatttaggtcacggggatgtggaggttatttgtattggttgttattggacactaaattagctaatgttgcatggtggtccgtactagttgtgttcgattcttttgggacaatagcaagcatacctttttctcgtcgttgttatatactcctctgtcccttaacatgtgtctgtagaaaaccatgtttccctcacaaacacgcttctcgggcgacacttaaaaggggcgacacttaaaagggacggagggagtacgcaacctgtttgtacaaacaggtacatatttagatgttctatatagtggctgatatgccgagacactgttgtcgatgaacactacgaatgtacttaatacattatatattaactaccaagagcagttgtacatggtcttgtaaattctattcctttgttgcagtttgttccttttttttttgttctgggtgtttctatgccaaactagttcca

SEQ ID NO: 12146 - DNA, 2814 bp, Zea mays
cgcactctcctcccccgctctcgacttcccacatcccctgcggccccgccccccgactcttctcgtcgcggcgcgcccaatcggctcggtggcaggctagtgcaccggctcggctcgggtccggttctaccgccaacgcgggccgcggcgctcccggatctcggtctagtcagagagttagcagacaaagatggcgacttatgagcccaagaacattctcataactggtgctgctggtttcattgcatcgcatgtcgccaaccgtctggtcaggaactatccccaatacaagatcgttgtccttgacaagattgactactgctccaacctaaagaacctcaatccttcacggtcttcaccaaatttcaaatttgtcaagggtgatattgcaagtgctgacctggtgaattaccttctgatcaccgagtcaattgacaccatcatgcactttgctgctcagacgcatgttgataattcttttggcaattcatttgagttcacaaaaaacaatatatatggcacccatgttcttcttgaggcttgcaaggttactggtcagatcaggaggtttattcatgtcagtaccgacgaggtatatggtgaaactgatgaagatgctgtggttggtaaccatgaggcctcacagctgcttccaacaaatccatattcagctacaaaggctggggctgaaatgcttgtgatggcatacggaaggtcttatggtcttcctgtgattaccactcgtggcaacaatgtgtatgggccaaatcaatttcctgagaaactcattcccaaattcattcttttggccatgcaaggtctgcctcttccaattcatggagatggctccaacgtcaggagctacctgtactgtgaggatgtggccgaagcttttgaggtggtccttcacaaaggagaagttggacatgtgtataatattggtactgtgaaggagaggagggtgattgatgtggccaaggacatatgcaagctctttggcttggatactgagaaagtcatcaggtttgttgaaaacaggccattcaatgaccagaggtacttcttagatgatcagaagctaaagagattgggatgggcagagcgcacaccatgggaagagggtttgaagaagacgatggagtggtacaccaccaatcctgattactggggagatgtcactggtgcgctgcttcctcatccaaggatgttgatgactcctggagttgaaaggcataactgggctgaagaaatcaagtctctggcttcttcgccagctgaagctagtacaatagctccagcaaccagtaccaaaagcatctctgatgcccctcagaagccttcctacaggtttttaatctatggtaggactggatggattggtggcctccttggaaagatttgtgaaaagcaagggataccatatgagtatgggaaaggacgcttggaggagcgctctcagctgttggaggacattagaaatgtgaagccaactcatgttttcaatgctgccggagtcactgggagaccaaatgttgactggtgcgagacccataaacaggacactatccgcaccaatgttgtaggcactttgaatctagctgatgtctgtcgcaagcagggtctgctcatgattaattatgctacaggctgtatatttgagtatgatgctaagcaccctgaagggtctggtattggctttaaagaggaagacacgcccaactttattggttccttttattccaaaacaaaagcaatggtggaagagctattgaaggagtatgataatgtctgtactcttagggtcaggatgcctatatcatcagatctaagcaacccccgtaatttcatcacaaagatagctcgttacgacaaggtggtgaacattcccaacagcatgacaatcttggatgagcttctgcctatctccattgagatggcgaaacgggactgcaggggcatatggaacttcaccaaccctggcgctgtaagccacaacgagattctagagatgtacaagaaatacatcaatcctgatttcaagtggaccaacttcacactcgaagagcaggccaaggtgatagtcgcgcctagaagcaacaacgagatggacacgtcgaaactgaaggctgagttccctcagcttctgtccatcaaggattctttgatcaagtacgtctttgagcccaacaggaaggttcctgttaattgaggatttacgttgcgtggatgcggaggttatttgtgttggttattggactctaaattagctaatgttgcaccgtggtgcgtactagttgtgttcgattcttttgggacaatagcaagcatacctctttctggtcgtctattatacacgcaatctacaaacaggtagatatttagatgttcttttagtggctgatacgaaggcttggcctggtgaagtggtgagagctttcttgctgagccactaggtcatgctttcgaagcagtctctccgtgtttatggtatagtggctgatatgctgagacacggttatcgatgaacactacgaattgtcttaatatattatatatattaactaccaagagcagttgtacatggtcttgtaaatttttatcccttcgttgcagttggctccaattttcctgttcttgttttttctatgccattttcctgttcttgttgtttctatgccaaacgtagcatcaaattttcagttggttttgtgttgctcgtcaatcctcaatggtgtatgctgcagtgttgatggtgcaattggtttctgttgatattgtagttcctgatacgcagaaggttgtgtatctttcaac

SEQ ID NO: 12147 - DNA, 2670 bp, Sorghum bicolor
ccgggtcagggtggctcgcacttggcagcccacatttataagtcaccagaccccgcctcacgatcttggactctcttccccgctctcgctcgcttctcattccccacccctcgcgactcttcgtcgcggcgagcatcaccgttgcttcagttcctgctgctgcctaactgtgattttcgtccttcaccgccgttgcccgcacgtgacacgcatcgcggcaagcgctgaaccgtccaccggctcggcaacagccaacaacaggcttgcgttgcgcaccgactcggctcgtgtcggttctgtcgccaccgcgcgcgggccacggcgctccgggatctcggtgaccgcttctcgtcagagaactatcagacaaggatggcgacttacgagcccaagaacattctcatcaccggtgctgctggttttattgcatcgcatgtcgccaaccgcctggttaggaactacccgcactacaagattgttgtcctcgacaagcttgactactgctccagcctaaagaacctcaacccctcgcgggcttcaccaaatttgaagtttgtcaagggtgacattgcaagtgctgatctggtgaactaccttctggtcacagaatcgattgacaccatcatgcactttgctgctcagactcatgtggataattcatttggcaattcatttgagttcacaaaaaacaatatatatggtacacacgtccttcttgaggcttgcaaggttactggacagatcaggaggtttattcatgtcagtactgatgaggtctatggagaaactgatgaagatgctgtggttggtaaccatgaggcctcacagttgcttccaacaaatccatattcagctacaaaagctggggctgaaatgcttgtgatggcatatggcaggtcgtacggtcttcctgtgattaccactcgtggcaacaatgtgtatggaccaaatcagttccctgagaaactcatccccaaattcattcttttggccatgagaggtctgcctcttccaattcatggagacggttccaatgtcaggagctacctgtactgtgaggatgtggctgaagcttttgaggttgttcttcacaaaggggaggttggacatgtgtataatattggtacagtgaaggagaggagggtgattgatgtggccaaagacatttgcaggctctttggcttggatactgagaaagtaataaggtttgttgagaacagacccttcaatgaccagaggtacttcctggatgatcagaagctgaagagactgggatgggcagagcgcacaccatgggaagagggcttgaagaagacaattgagtggtacaccaccaatcctgattactggggagatgttactggtgctttgctccctcacccaaggatgttgatgactcctggagttgaaaggcataactggactgaggaaatcaaatctcttacttcttcaccagctgaagctagcacaacagctcctgcaaccagtaccaaaagaaccactgatgcccctcaaaagcctttgtacaagttcttaatttatggcaggactggatggattggtggcctccttgggaagatttgtgaaaagcaagggattctatatgagtatgggaaaggacgcttggaggagcgctctcagctgttggaggacattagaaatgtgaagccaactcatgtcttcaatgctgccggagtcactgggagaccaaatgttgactggtgcgagacccataaacaggacactgtccgcaccaatgttgtaggcacattgaatcttgctgacgtctgtcgtgagcagggtttgctcatggttaattatgctacaggctgtatatttgagtatgatgctaagcaccctgaagggtctggtattggctttaaagaggaagacacacccaactttacgggttccttttattctaaaacgaaagcaatggtggaagagctgttgaaggagtatgataatgtctgtactcttagggtcaggatgcctatatcatcagatctaagcaaccctcgtaacttcatcacaaagatagctcgctatgacaaggtggtgaacattcccaacagcatgacaattttggatgagcttctgcctatctccattgagatggcgaaacaggactgcagggggatatggaacttcaccaaccctggcgttgtcagccacaatgagattctagagatgtacaagaaatacatcaatcctgatttcaagtggaccaacttcacactcgaagagcaggccaaggtcatagtcgcacctagaagcaacaacgagatggacgcgtccaaactaaaggctgagttccctcagctgctgtccatcaaggattctttgatcaagtatgtctttgagcctaacaggaaggttccgtctatttgaggatttaggatatatgggacattgaggtatcggttactattagacattaaattagctatataaaggtgtggtacgtagttgtggtcgatacttctggaacattgacaggcattatctcttgtttgtcaattttcttatgggtcgaactttaacagaacacgtatatatatatccttactgttctatatagtggatgatacgctgagatgtggttatcgatggacacgataagtacttgtgttgtgcattctacttctttgttgcactgtgctttctttt

SEQ ID NO: 12148 - DNA, 3053 bp, Sorghum bicolor
ctgagctggtgcctggcttggcagcggacagccgggcaccgcctccgcgactccgcgtctccgccaggccgaggcgccagcaagagtatagaaagcacgcggcgaagcggccagggagtcagcaccaggaactccgcggccccgccccgcgtttagtcgccagcacggcccatccctctcgatctcctccccgtcgcggcaggaggcatcgtgatcgtccggccgtggttcccgcaccctccgacaccgcccgcggacgtccttcgcctccgcgacaggcttgcgccccggctcggctctgcctccactgcggccttcctggatctcggccaccgctcctcgccagagaactatcagacaaggatggcgacttacgagcccaagaacattcttatcaccggtgctgctggttttattgcatcgcatgtcgccaaccgcctggttaggaactatccgcactacaagattgttgtcctcgacaagcttgactactgctccagcctaaagaacctcaacccctcgcgggcctcacaaaatttgaagtttgtcaagggtgacattgcaagtgctgatctggtgaaccaccttctggtcacagagtcgattgacaccatcatgcactttgctgctcagactcatgtagataattcatttggcaattcatttgagttcacgaaaaacaatatatatggtacacacgtccttcttgaggcttgcaaggttactggtcagatcaggaggtttattcatgtcagtactgacgaggtctatggagaaactgatgaagatgctgtggttggtaatcatgaggcctcacagttgcttccaacaaatccgtattcagctacaaaagctggagctgaaatgcttgtgatggcatacggaaggtcttatggtcttcctgtgattaccactcggggcaacaatgtgtatgggccaaatcagttccctgagaaactcatccccaaattcattcttttggccatgagaggtctgcctcttccaattcatggagatggttccaatgtcaggagctacctgtactgtgaggatgtggctgaagcttttgaggtggttcttcacaaaggggaggttggacatgtgtataatattggtactgtgaaggagaggagggtgattgatgtggccaaagacatttgcaggctctttgacttggatactgagaaagtaatcaggtttgttgagaacagacccttcaatgaccagaggtacttcctggatgatcagaagctgaagagactgggatgggcagagcgcacaccatgggaagagggcttgaagaagacaattgagtggtacaccaccaatcctgattactggggagacgttactggtgctttgctccctcacccaaggatgttgatgactcctggagttgaaaggcataactggactgaggagatcaaatctcttacttcttcaccagctgaagctagcacaacagctcctgcaaccagtaccaaaagagccactgatgctcctcaaaagcctttgttcaagttcttaatctatggcaggactggatggattggtggcctccttgggaagatttgtgaaaagcaagggattccatatgagtatgggaaaggacgcttggaggagcgctctcagctgttggaggacattagaaatgtgaagccaactcatgtcttcaatgctgccggagtcactgggagaccaaatgttgactggtgcgagacccataaacaggacactatccgcaccaatgtcgtaggaacattgaatcttgctgacatctgtcgtgagcagggtttgctcatggttaattatgctacaggctgtatatttgagtatgatgctaagcaccctgaagggtctggtattggctttaaagaggaagacacacccaactttacgggttccttttattctaaaacgaaagcaatggtggaagagctgttgaaggagtatgataatgtctgtactcttagggtcaggatgcctatatcatcagatctaagcaaccctcgtaacttcatcacaaagatagctcgttatgacaaggtggtgaacattcccaacagcatgacaattttggatgagcttctgcctatctccattgagatggcaaaacgggactgcaggggcatatggaacttcaccaatcctggcgttgtcagccacaatgagattctagagatgtacaagaaatacatcaatcctgatttcaagtggaccaacttcacactcgaagagcaggccaaggtcatagtcgcacgtagaagcaacaacgagatggacgcgtcaaaactgaaggctgagttccctcagctgctgtccatcaaggattctttgatcaagtatgtctttgagcctaacaggaaggttccggctatttgaggatttaggatacaaagggacattgaggtattgggttactattagacattaaattagctatataatgttgggtgtgttacgtagttgtggtcgatactcctggaacattgacaggcatacctcttgtttttcaattttgttatgcatcgaattttaacagaacacgtagatccttaatgttctatatagtggatgatatgctgagatgtggttatcgatgaacacgataagtcattctgtcgtgcattctatttctctgttgcactgtgtgctttcttttctttccttttttcttcagaagtttgtttatagtgtcagtacgccaaaattaaatcatcttcgtttcgatctgttctgtgttaccgatcatctgcccctctcctcggtcacgaagtttccctgtggtgtcaaccacatacacaagtattatacgaaacaggccgttaccaactaacggtaaacgaaacaggagtgtcacgaagtttccctgtgtgtgtcgacctgcatctgcccctcttgatggagccaaagcagatctggctccaggcttttgccagtgtaagccacagatggagccgtggagcagatctgactccaagcttttgagcagcgttacgcaggtgatgtgaaccacgtagcaaagaatgatccaacgcttccattccaagcaa

SEQ ID NO: 12149 - DNA, 4910 bp, Zea mays
agcccgggcaccgcgtccgcgactccgcgtctccgcctgcaactgcaaagagtatagaaggcacgcggcgaagcggccaggagttcctcctcgccccgcgttgagttgccagcacggcccctccctctcgttctcctcgactcctccccgtcgcggcagccagccagcaggcatcgtgatcgtctgccctggttcccgccctcgctccatcccccggcacccccgcacgggacgcgcgtgtggacgttcttcgcctccgcgacaggcttgcgccccggctcggctcgggtctgcctccactgcggccttcctggatctcggccgccgctcctccatattataacatatcacagaactatcagacaaggatggcgacttacgagcccaagaacattctcatcaccggtgctgctggttttattgcatcgcatgtcaccaactgtctggttaggaactacccgcactacaagattgttgtcctcgacaagctcgattactgctccagcctaaagaacctcaacccctcacgggcttcaccaaatttgaagtttgtcaagggtgacattgcaagtgctgatctggtgaaccaccttctggtcacagagtcgattgacaccatcatgcactttgctgctcagactcatgtagataattcatttggcaattcatttgagttcacaaaaaacaatatatatggtacccacgtccttcttgaggcttgcaaggtcactggccagatcaggaggtttattcatgtcagtactgatgaggtctatggagaaactgatgaagatgctgtggttggtaatcatgaggcctcacagctgcttccaacaaatccgtattcagctacaaaagctggggctgaaatgcttgtgatggcatatggaagatcttatggtcttcctgtgataaccactcggggcaacaacgtgtatgggccaaatcagttccctgagaaacttattcccaaattcattcttttggccatgagaggtctgcctcttccaattcatggagatggttccaatgtcaggagctacctatattgtgaggatgtggctgaagcttttgaggttgttcttcacaaaggggaggttggacatgtgtataatattggtactgtgaaggagaggagggtgattgatgtggccaaagacatttgcaggctctttggcttggatactgagaaagtaatcaggtttgttgagaacaggcccttcaatgaccagaggtacttcttggatgatcagaagcttaagagactgggatgggcagagcgcacaccatgggaagagggcttgaagaagacaatcgagtggtacaccaccaatcctgattactggggagatgtcactggtgctttgctccctcacccaaggatgttgatgattcctggagttgaaaggcataactggactgaggatatcaaatctctgacttcttcaccagctgaagctagcacaacagctcctgcaaccagtgccaaaaggaccactgctgcccctcaaaagcctttgtacaagttcttaatctatggcaggactggatggattggtggcctccttgggaagatttgtgacaagcaagggataccatatgaatatgggaaaggacgcttggaggagcgctctcagctgttggaggacattagaaatgtgaagccaactcaagtttttaatgctgccggagtcactgggagaccaaatgttgattggtgtgagacccataaacaggacaccatccgcaccaatgttgtaggcatattgaatcttgctgatgtctgtcgcgagcagggtctgctaatgattaattatgctacaggttgtatatttgagtatgatgccaagcaccccgaagggtctggtattggctttaaagaggaagacacacccaactttacgggttccttttattccaaaacaaaagcaatggtggaagagctgttgaaggagtatgataatgtctgtactcttagggtcaggatgcctatatcatcagatctaaacaatcctcgtaacttcatcacaaagatagctcgttacgacaaggtggtgaacattcccaacagcatgacaattttggatgagcttctgcccatctccattgagatggcaaaacgggactgcaggggcatatggaacttcaccaaccctggcgttgtcagccacaatgagattctggagatgtacaagaaatacatcaatcctgattttaagtggaccaacttcacactcgaagagcaatccaaggtcatagtcgcacctagaagcaacaatgagatggatgcgtcgaaattgaaggccgagttctctcaactgatgtccatcaaggattctttgatcaaatatgtctttgagcctaacaggaaggttccagctaattgaggatttaggataagaagggcatcgaggtattagttactattaaacattaaattagctataatgtttgtcaatttttttatgcatcgtattttaacagaacacgtagatgtccttatgttctatatagtggatgatgtgttgagatgtggttatggacaacacaataagtcgttctgttgtgcattttaattatttgttgcaatgtgctttcttttctttctctttttcttctgaaatttgtttatggtgtttgtatgccaaaatcaaataatctccgtttagatatgttctgtgttaccaatgaatcccccggattttatgcagcaggttgctggattgttgttggggatattgttcatccagatcccactgaagatagccagcgcccagcgtagccacatgttcaatcatcatccccgtcgttgatatggttctcagttgctgaattgtttgcttaaggcatgtttgtttgagtcctaccatttggaattttgtctcaaaatctgggttttgactttcagctgttttcttccctattggcttttataatactctctctatcccaaaatataatgcttaagacctctaattttttacctatataaatcatagacaagaaaataatttatctagaagtgcaactatggataggtgttaaaagtcgtctagagaaggggtgaatagacgaaaactaaaaattataaactttgaacacgcgcttcacccggggttagagttcgaaataaataataataaattatggagtgcagaagatagtttttcttgctatgagttgctcaatcaatgcggataactttgagagccaactcaaaaggttgtgagcaagagaactttagaaagagaggagagggaagaaacaaatcgagtgatgaagatcaacacaaatgaacatggtgatttgtttcccgaggttcggttccaaagaacctactccccgttgaggaggccacataggccgggtctatttcaaccctttctctctcaatcgatcacttagaccggtcgagtgcttcttcttaatcacacgggtcactaagaccctacaaggatcaccacacaattaagtgtctcttgcttgctttacaaatcacttagaaagtttagagagagataaagaaagcatgattaaaagtcaagcaacaagagcaataaaaaaagacacaaaatcatgctctctcaagtcactaatcactagcctttccgaagcagatcaaaaaatcaaggagtttgaaaagaaacaagagacagatgcgaagcgtattgctgatttagaatatgcactgtctattcaggtggatttgcacagatctgaagtgcaaggattggataagaatctcgatgaagtaattgaaaatttcaatgtagaacaaacaaaacgtgagatatctgatatggaacgattgagggtgcagaaaaatgttgaggagcttcgtcaggctaaagagaaatgctataaggttgctatggaatgttgtaataatttgaaaaatagttttgctaaggttggcgcattctcttcggagcagaactttatctgtggtgatcctgatggggttatccagtggattagcggcgaagccaaagcttttgaggagatcctcggtgatagaggagacttctgcgccttcgccagcgcccgcggagctgtatcggtccttgagaaggttggttgcgaacatgccaaggttgtggttcagccaggattcccgctctcagccaacgacattaggaacccttcggccgaagctgccgcactaagtggaaagttttattctgaagtctggttgagaggtggccgagagatagctgacgaagctatcagaaagaacgagaaagagcctcatcatgccttggaagaggccagaaaaactaaagaaggtgctgaacctgcaaaacttataggtatatctatcgtgtcttagcttcgtacatttttttagctttggaactaacagacacttgtattatggtgcatctgagctctctccccctccggggccatataaccctgaagtcgatctatctctgaaggaggcgtttgacgtaattagaatagctaacgaagatgttgacgaagctattaacatgttgctaaacgaagctgctaacaaagttttaaaagaagatgactagagcttgtctattgagacttaaggatttttgtatacaacttcttttttgtaagaaacaattatctactatttatacatttaatgatgtaatatatttctttgtgaggcgtgaaatcttcgtacgtaccgtttttgagccacaggcgaaaaaacaccttcacttcttttcacgcttcataaaggaaaaaaatcccccttctttgacgaagcaactctgaaggtctcaccgtaaatgttgcataggaatattgttgttgaaggtataaaccccgtataaaaacagctctgtcaaaggcatgggtcttgtattcttgatacgttctttcgtgactctttgccaaaaatagacttaacctcatggttagccggt

SEQ ID NO: 12150 - DNA, 2425 bp, Panax ginseng
aagcagtggtatcaacgcagagtacatgggggacagaggacgctcagctctcctcacttctcgctgtggtggtctctttgttatcattcattatttccttgtttgagccatttctgtctctccttcattacaaagggctctgtttttctctctccctttgctttccttgattgatcgatcctgttccggacccggatcaaatttaaactgctttggtatggctaactatacccccaagaatatcctcataaccggggctgctggatttatcgcatctcatgttgctaatcgtctcattcggagctaccctgactacaagattgttgtgcttgataagcttgattactgttcaaatcttaagaacctgaacccctctcgatcatctcccaactttaagtttgtcaagggggatattggcagtgccgatcttgtcaactaccttctcatcactgagtcgattgacacaataatgcactttgctgcccagacccatgttgacaattcctttggcaacagttttgagttcaccaagaacaacatttatggcacccatgtgcttttagaggcctgcaaagtgaccggccagatcagaaggttcatccatgtaagtactgatgaggtctatggggagacggaagaggatgctgttgtgggaaatcacgaagcttcgcaactcctccctacaaatccatattcagccacaaaagctggggctgaaatgcttgttatggcttatggtaggtcatatggtttgcctgtgataactactcgaggaaataatgtatatggccccaatcagtttcctgaaaagttaattccaaagttcatccttttagccatgagaggaaagcaacttcctatccatggggatggtgccaatgtgcggagttatctctattgtgaggacgttgctgaagcttttgaggtcattcttcacaagggagaagttggtcatgtttacaatattgggacaaagaaggagaggagagtgattgatgttgccaaagatatctgtaaacttatgtcaatggatcctgaaacaaacattaattttgtggagaacaggccatttaatgatcagaggtacttcttagatgatcagaagttgaaaaacttgggctggtctgagcggactacgtgggaagagggattgaagaagactatggattggtacactagcaaccctgattggtggggagatgtctctggagcattgcttcctcatcctagaatgctgatgatgcctggtggaattgagagacactttgatgggtctgctaattgtgactctgaatcttctcataaagcagataaatctactcagtcccaagtggtggtttcgaactccaaaagcagcagctctcctcagaaaccatccttcaagtttttgatttatggtaggactgggtggattggtggtctacttggaaaactaagtgaaaagcaaggaattccatacgagtatggaaagggacgtctagaagatcgctcacaacttttggccgatattcagactgttaagcccacacatgtttttaatgctgctggtgtgactggcagacccaatgttgattggtgtgaatctcataagacagaaacaattcgtaccaatgttgctggtacgctaaatttagctgatgtttgcagagaccagggactcctgatgataaatttcgctactggatgcatatttgagtatgatgctgcacatccagaaggttccggaattgggttcaaagaagaagacacacccaattttcacggttctttctattcgaagaccaaggccatggttgaagaactactgaaagaatatgacaatgtttgcacactcagagttcggatgcctatatcttccgacctcagcaacccacgcaacttcatcactaaaatcagccgttataataaggtggttaatatccccaacagtatgaccatcttggatgagcttctacctatttcaattgagatggcaaagcggaacttgagaggcatatggaactttaccaaccctggagttgttagccataacgagattctggagatgtacaagaagtatattgatccagccttccaatgggctaacttcactctggaagagcaagccaaggtgatcgtagcggctcgaagcaataatgagatggacgcgtccaagttgaagaaagaattccccgagttgctatcaatcaaagagtcgttgatcaagtacgtctttgaaccaaacaaaaaagcttagtaggcattctagagtagtaaatttgagccttcctctgcattatcagttaggctatatgatctttaattacctttgtaatgctagtcatgtcattagtcattcttagcttcagttcattattcttgtcattatatatctatcttgaatgtttattagagtggttctgctcttgctagaggctttacaaaa

SEQ ID NO: 12151 - DNA, 2280 bp, Elaeis guineensis
tacgcggggaacccccaagaaagagagcggaaaggatccaattcgcactctctccggactcgattccccggctactccctctcgcctcgagttcccatcatttatcggccccctgtcctcggagaaatcctccccgtcttctccggcgatctcttctctcaccccattgatataggaaaagaaaagaggacagatggcaacatataagcccaagaacatcctcatcactggggcgggtggcttcattgcatcgcatgtcgccaactgcctcatccgaaactaccctgagtacaagattgtggttctcgacaagcttgactactgctcaaacctgaaaaaccttaatccatcccgctcctctcccaatttcaagtttgtcaagggcgacattggcagtgccgaccttgtcaactatctcctcatcactgagtccattgataccatcatgcactttgccgcccagacccatgtcgacaattcctttggcaactcatttgagttcaccaagaacaatatatatggcacccacgttctccttgaggcttgcaaggtcactggtcagatcaggaggtttatccatgttagtactgatgaggtttatggagagactgatgaggatgctgtggttggaaatcatgaggcatctcagctccttccaaccaacccatattcagcgacaaaagctggagctgagatgcttgttatggcttatggaaggtcatatggtctgccagtgataactacccgaggaaacaatgtctatgggccaaatcaatttcctgagaagctcattccaaaattaatccttttggctatgagagggctgccacttccaattcatggtgatggttctaacgttagaagctatctatattgtgaggatgttgctgaggcttttgaagttattcttcacaaaggagaggttgggcatgtttataatatcgggactaagaaagagaggagagtgattgatgtagcaaaggatatctgtaaacttttctctttggacccggatacggttatcaagtttgtagagaacaggcccttcaatgatcagaggtactttttggatgatgagaaactgaagaacttgggttggtcagagaggaccacttgggaagaagggctgaagaagacaatggagtggtacacaagcaaccctgattggtggggagatgtgtctggtgctcttgtgcctcatccaaggatgctgatgatgcccgggattgaaagatgtattgatgggtctgaagaggtgaagggcatggtttctcagttcaccaataatcagagcaggatggtcgttcctgtctcaaagggtattagtggctctcctcggaagcattctttgaaattcttgatctatggtaggactggatggattggaggccttctaggaaagatctgcgagaagcaagggataccatttgagtatggaagagggcgtttggaagagcgctctcagctcattctggatattcagaatgtaaagccaactcatgttttcaatgctgctggtgtgacaggcagaccaaatgttgactggtgtgaatctcacaagacggagacaattcgcaccaatgttgtgggcactttgaccctagcagatgtttgcagggagaacggcttgttattgatgaattatgctactgggtgtatattcgagtatgatgctggacaccctgaagggtcaggtattggattcaaggaggaagataaaccaaacttcactggctctttctactcgaagactaaggcgatggttgaagagcttttgaaggaatatgaaaatgtctgtactcttagagtcagaatgccaatatcttctgacctcagcaatcctcgcaacttcattacaaagataactcgttacaataaagtggtcaacattccaaacagcatgacaatcttagatgagcttctacccatatcagttgagatggccaaaagaaattgcaggggcatatggaacttcactaatcctggtgttgtgagccataatgagattctggagatgtacaaaaagtatatcgaccctagctttacatgggccaactttactctggaagaacaggccaaagtcattgttgcacctcgaagcaacaatgagatggatgcttcaaaattgaagagtgagtttccagagttgctatccatcaaggagtctcttattaagtatgtttttgaaccctaacaggaaggtccttgctgattgagatgccagctgaagctcccagttactctagatttcgttatcataaagtaggaccttaatcttca

SEQ ID NO: 12152 - DNA, 2516 bp, Panax ginseng
acttctcgctgtggtggtctctttgttatcattcattatttccttgtttgagccatttctgtctctccttcattacaaagggctctgtttttctctctccctttgctttccttgattgatcgatcctgttccggacccggatcaaatttaaactgctttggtatggctaactatacccccaagaatatcctcataaccggggctgctggatttatcgcatctcatgttgctaatcgtctcattcggagctaccctgactacaagattgttgtgcttgataagcttgattactgttcaaatcttaagaacctgaacccctctcgatcatctcccaactttaagtttgtcaagggggatattggcagtgccgatcttgtcaactaccttctcatcactgagtcgattgacacaataatgcactttgctgcccagacccatgttgacaattcctttggcaacagttttgagttcaccaagaacaacatttatggcacccatgtgcttttagaggcctgcaaagtgaccggccagatcagaaggttcatccatgtaagtactgatgaggtctatggggagacagaagaggatgctgttgtgggaaatcacgaagcttcgcaactcctccctacaaatccatattcagccacaaaagctggggctgaaatgcttgttatggcttatggtaggtcatatggtttgcctgtgataactactcgaggaaataatgtatatggccccaatcagtttcctgaaaagttaattccaaagttcatccttttagccatgagagggaagcaacttcctatccatggggatggtgccaatgtgcggagttatctctattgtgaggatgttgctgaagcttttgaggtcattcttcacaagggagaagttggtcatgtttacaatattgggacaaagaaggagaggagagtgattgatgttgccaaagatatatgtaaacttatctcaattgatcctgaaacaaacattaattttgtggagaacaggccatttaatgatcagaggtacttcttagatgatcagaagttgaaaaacttgggctggtctgagcggactacgtgggaagagggattgaagaagactatggattggtacactagcaaccctgattggtggggagatgtctccggagcattgcttcctcatcctagaatgctgatgatgcctggtggaattgagagacactttgatgggtctgctaattgtgactctgaatcttctcataaagcagataaatatactcagtcccaagtggtggtttcgaactccaaaagcagcagctctcctcagaaaccatccttcaagtttttgatttatggtaggactgggtggattggtggtctacttggaaaactaagtgaaaagcaaggaattccatacgagtatggaaagggacgtcttgaagatcgctcacaacttttggccgatattcagactgttaagccctcacatgtttttaatgctgctggtgtgactggcagacccaatgttgattggtgtgaatctcataagacagaaacaattcgtaccaatgttgctggtacgctaaatttagctgatgtttgcagagaccagggactcctgatgataaattttgctactggatgcatatttgagtatgatgctgaacatccagaaggttctggaattgggttcaaagaagaagacacacccaattttcatggttctttctattcgaagaccaaggccatggttgaagaactactgaaagaatatgacaatgtttgcacactcagagttcggatgcctatatcttccgacctcagcaacccacgcaacttcatcactaaaatcagccgttataataaggtggttaatattcccaacagtatgaccatcttggatgagcttctacctatttcaattgagatggcaaagcggaacttgagaggcatatggaactttaccaaccctggagttgttagccataacgagattctggagatgtacaagaagtatattgatccagccttccaatgggctaacttcactctggaagagcaagccaaggtgatcgtagcggctcgaagcaataatgagatggacgcgtccaagttgaacaaagaattccctgagttgctatcaatcaaagagtcgttgatcaagtacgtctttgaaccaaacaaaaaagcttagtagtaaatttcagccttcctctgcattatcagttaggctatatgatctttgattacctttgtaatgctagtcatgtcattagtcattcttagcttcacttcattattcttgtcctattttgaatgtttattagagtagttctgctctgctagaggctttttcacccattacaatcaattatcagtcgggcattctctctagacgaatgttctattcaagctagcaggctttctaacatttttattctattatagttattatagtgaatttgtttgctaataattctccaaactgcaaatattccctcatctcattaataatagagactggtttac

SEQ ID NO: 12153 - DNA, 2512 bp, Solanum phureja
aagtagagatttgcttacatttctttattttattaaattttctttggtatgtgaatccataaatagagaaaaacacgttcctttgatccttcttgtctgattctctctctataaaggccgaagcactcggcgattttgtactctttttttttccttctctctcagttggggtggatcctgatcgggatttgaatcaaagctgcttcaagatgtcaacatacacccctaagaatatactcattactggagctgccggatttattgcatgtcatgtagccaacaggcttgttcggagctaccctgattacaagattgttgtccttgacaaacttgactattgttcaaatttgaagaaccttattccttcccgatcttcccctaatttcaagtttgttaagggagacattgctagtgcagatctcgttaactaccttctcataactgagtccattgacactataatgcactttgctgctcagacccatgttgataactcctttggtaatagctttgagttcactaagaataacatctatggtacccatgtactattagaggcctgcaaagttactggtcagatcaaaaggtttatccatgtgagtacagatgaggtctatggggagactgatgaggatgctgttgtaggaaaccacgaagcctcacaactccttcccactaacccatattcagccacaaaagctggggctgaaatgcttgttatggcttatggtagatcatatgggttacctgttataaccactagagggaacaatgtctatggtcctaaccaatttcctgagaaactaatccctaagtttatacttttagccatgaggggaaagcctcttcctattcatggtgatggttgtaatgttcgtagttatctctattgtgaggatgttgctgaggcttttgaagttgttctacacaagggagaggtcggtcacgtttataacattggaactacaaaagagagaagagtgattgatgttgcccaagatatatgcaaactctttaacatagattcagagaaagttattcagtttgtggagaacaggccatttaatgaccaaaggtactttctggatgatcagaagttgaagaacttgggttggtctgagacgaccatgtgggaagagggtctgaaaaagactattgaatggtataagaataaccctgattggtggggggatgtctctggagcattgcttccccatcctagaatgctgatgatgcctggtgatatagaaagaaatttggatggagctgagaaatatgattctggatctaccgaattctcagggaagtccaatgaaaccaaaacggcagctccagcttcaaagaccagcaatgtgcctcagaaatccccttttaagttcttgatctatggtaggactgggtggattggcggtgtgctagggaaattgtgtgagaaacagggaattccttatgagtatggcaggggacgtttggaagatcgctcaaagcttttggcagacattaattctgtcaagcccacacatgtattcaatgctgctggtgtcactggtagacccaatgttgattggtgtgagagtcataaaccagaaacaattcgcacaaatgttgctggtactctaaacttggcagatgtttgcagagagaatggcctcctgatggtgaactttgccactggctgcatatttgagtatgatgctgcacatccagaaggttctggtattgggttcaaagaggaagacacacccaatttcgctggttctttctattcaaagaccaaggccatggtcgaagatctgttgaaaaattatgacaatgtttgcacactcagagttcgcatgccaatatcttcagatctcagcaaccctcgcaatttcattaccaagatcagccgctacaataaggtggtcaatattcctaacagtatgaccatattggatgagcttcttccgatttcaattgagatggcaaagcgtaacctcagaggcatatggaatttcacaaaccctggtgttgtgagccataatgagatattggaaatgtacaagaaatatatcgatccagcatttacttatgccaacttcacagtggaagagcaggccaaggtaatcgttgcagctcgcagtaacaatgagatggatgcatcaaagttgaagaaagagttccctgagttgctatcaatcaaagagtcactgatcaagaatgtttttgaaccaaacaagaaaacctctgcataaaaagactgtgtcctcaagaattttgtatgctattttagctattattcattgttagttcctcgaattctctaaattttttagatcatcattagtgattagctgttgttccttgttatttttgtatgaattcataatatttgtgccttctttgtggaagatttggaattttggataggcttgttttccctgtatctgtggttaaatgagtatgttaaaaggtctggtgtaatttgttgaatttgatatatgaaagtatgaactttttcttgctcaatctc

SEQ ID NO: 12154 - DNA, 2449 bp, Solanum lycopersicum
atttggcaagtgaatccataaatagagaaaaacacgcttattgtctgattctctctctataaaggccgaagcactcggcgattttgtactctttttttcttcttcttctctctcagttggggtggatcctgatcgggatttgaatcaaagctgtttcaagatgtcaacatacaccccaaagaatatactcattactggagctgccggatttattgcatgtcatgtagccaacaggcttgttcggagctaccctgattacaagattgttgtccttgacaaacttgactattgttcaagtttgaagaacctcattccttcccgatcttcccctaatttcaagtttgttaagggagacattgctagtgcagatcttgttaactaccttctcattactgagtccattgacactataatgcactttgctgctcagacccatgttgataactcctttggtaatagctttgagttcactaagaataacatctatggtacccatgtactattagaggcctgcaaagtgactggtcagatcagaaggtttatccatgtgagtacggatgaggtttatggggagactgatgaggatgctgttgtaggaaaccacgaagcctcacaactccttcccactaacccatattcagccacaaaagctggggctgaaatgcttgttatggcttatggtagatcatatgggttacctgttataaccactagaggtaacaatgtctatggtcctaaccaatttcctgagaaactaatccctaagtttatacttttagccatgaggggaaagcctcttcctattcacggggatggttgtaatgttcgtagttatctctactgtgaggatgttgctgaggcttttgaatgtgttctacacaagggagaggtcggtcacgtttataacattggaactacaaaagagagaagagtgattgatgttgcccaagatatatgcaaactctttgacatagattcagacaaagttattcagtttgtggagaacaggccgtttaatgaccaaaggtactttctggatgatcagaagttgaagaacttgggttggtctgagacgaccaggtgggaagagggtctgaaaaagactattgaatggtataagaataaccctgattggtggggggatgtctcgggagcattgcttccccatcctagaatgctgatgatgcctggtgatatagaaagaaatttggatggagctgagaaatatgattctggatctaccgaattctcagggaagtccaacgaaaccaaaacggcagctccagcttcaaagaccagcaatgtgcctcagaaatccccttttaagttcttgatctatggtaggactgggtggattggcggtgtgctagggaaattgtgtgagaaacagggtattccttatgagtatggcaagggacgtttggaagatcgctcaaagcttttggcagacattaattctgtcaagcccacacatgtattcaatgctgctggtgtcactggcagacccaacgttgattggtgtgagagtcacaaaccagaaacaattcgtacaaatgttgctggtactctaaacttggcagatgtttgcagagagaatggactcctgatggtgaactttgccactggctgcatatttgagtatgatgctgcacatccagaaggttctggtattgggttcaaagaggaagacacacccaattttgctggttctttctattcaaagaccaaggccatggttgaagatctgttgaaaaattatgacaacgtttgcacactgagagttcgcatgccaatatcttcagatctcagcaaccctcgcaatttcattaccaagatcagccgctataataaggtggtcaatattcctaacagtatgaccatattggatgagcttcttccgatttcaattgagatggcaaagcgtaatctcagaggcatatggaatttcacaaacccgggtgttgtgagccataatgagatattggaaatgtacaagaaatatatcgatccagcatttacttatgccaacttcacggtggaagagcaggccaaggtaatcgttgcagctcgcagtaacaatgagatggatgcatcaaagttgaagaaagagttccccgagttgctatcaattaaagagtcgctgatcaagtatgtttttgaaccaaacaagaaaacctctgcataaaaaggctgtgttctcaggaattgtgtatgctattttagctattatttcattattagttcctcgaattcgctagatattcattagtgatttagctgttgttccttgttatttttgtatgaattcataatctgtgccttctttggggaagatttggaatattggataggctgtgttccctgtatctgttgttaaatgagtttgttaaaggtcttgtgtgatttgttgactttgatatatggatgtatgaactttttcttgctcaac

SEQ ID NO: 12155 - DNA, 2594 bp, Musa acuminata
caagattcccaccgtgtcctcctcaaatctctccattactttatcttcggatccatctgttgcgagttgctaccggatcctgacattggattgccgctacagcgatcgctctgttcttctgcaaaagagtagatggcggcgtacaatccgaagaacatcctcattaccggggcggcaggcttcatcgcgtctcatgtcgccaaccgcctcgtccggaactaccccgagtacaagatcgtcgtcctcgacaagctcgattactgttccaacctgaagaacctcaacccctcgcgctcctctcccaacttcaagttcgtcaagggcgacatcgggagcgccgacctcgtcaactacctcctcatcaccgagtcgatcgacaccatcatgcattttgcagcgcagacccatgtcgacaattcttttggtaactcctttgagttcaccaagaacaacatctatggcactcatgtcctcctcgaggcctgcaaggtcactgggcagatcagaaggttcatccatgttagcactgatgaggtctatggggagaccgacgaggatgctgtggtcggaaaccatgaggcatctcagctcctgccgaccaacccgtactccgcaacgaaagctggggctgagatgcttgttatggcctacgggaggtcatatggcttgcccgtgataacaacccgtggaaacaacgtctacgggccgaatcagttccccgagaaactgattccaaaattcatccttttggccatgagaggtcacccacttccgattcatggtgatggctctaatgttagaagctatctgtactgtgaggatgtggcggaggcattcgaggttgttcttcacagaggagaagtcgggcatgtttataacattggaacgaagaaagaaaggagagtgatcgatgtggcaaaggatgtctgcaagcttttctcactggaagcagatagggtcattgaatttgtggagaatcggcctttcaatgaccagaggtactttttggatgatcagaagctgaagaacataggatggtcggagaggaccacatgggaggagggactcaagaagacgatggagtggtacacgagcaatccggactggtggggagatgtttcaggtgctctgttgcctcatccacggatgctgatgatgcccggtattgaaagacatgtcgatggagctgaagaaaccaaggtcacagtttctcagtcggcaaacactaacagtcagaaaaggatggttgttcccactccaagaacctcttcaaagaaaccacatttgaagttcttgatatatggtaaaactggatggatcgggggccttctcggcatgatatgcgaaaagcagggtataccgtatgaatacggaagagggcgactggaagaacgttcccaactcatactggatattcaaaatgtgaagccatctcatgttttcaatgctgcaggtgtaaccggcaggcctaatgttgattggtgtgagtcacataagcaggagacaattcgcacgaatgttgtgggaaccttgacgctagcagatgtttgcagggagcatgggctgctactgatgaattatgccacaggttgtatatttgaatatgacactgaacacctggaggggtcaggcattggtttcaaggaggaagacaaaccaaattttaccggttcattctattcgaagactaaagcaatggttgaagagcttctgaaagaatatgaaaatgtctgcaccctcagagtcaggatgccaatatcttctgatcttagcaacccgcgcaatttcatcacaaaaatcacgcgttacaacaaggttgtgaacattccaaatagcatgacggttttggacgaacttctgcccatatcgatcgagatggcaaagaggaattgcaggggcatatggaacttcaccaatcctggtgccgtgagccacaacgagatcctagagatgtacaagagctacatcgaccccagcttcaagtgggttaattttacactggaagagcaggccaaagtcatagtcgcacctcgaagcaacaacgagatggatgccacaaagttgaagcgtgagtttcctgagttgctttcaatcaaagattcgcttatcaagtatgtctttgagccgaacaagaaggtcctttctaactgagaagcttactcaaggtcacggttgaagtagacttttgtactaagcagtagcaccttaaattccacttaattattaatactagctggtatcgagagattgactatctaggcgggtggcatctatttgtttcaattttattagttactcttcatgttcttgtttcggtgcgctttgcaagaggccaattagtcactcaaggtcggaatgcatccatttgttgttttacacaaaacacgttctggttatcatgtattttctcattattctttcagaatattccaatgtccttatcggctatcgccgtaatctcgtgtcatggacttgacttcctgattaacggtttatgtaaagtgaattttatataattttagacatttcgatatgtaattgattcattaaactctgtatttgtgatggttttgcgcaatcgcaatatgtaagcg

SEQ ID NO: 12156 - DNA, 2404 bp, Ambrosia trifida
acataataataatataaaatatttcaacaaaccttgacatgtatatatatatatatcgatcaaggcgttggttcattgagtctctcgtaattcttctcaataataataatcaccttctttctggtctctccctctctctcatcccgatccatatcataattacaatttatatccagtatggctacttacgagccaaagaacatcctgattactggagctgcaggctttattgcctctcatgttgctaaccggctgatcagaaactaccctgattacaagattgttgtgcttgacaagcttgactattgttccaatctcaagaacctgaacccatccagatcatctcccaacttcaagtttgtcaagggggatattgggagcgctgacctcgtcaactatcttctgatcactgagtcgatcgataccattatgcactttgctgcacagactcatgtcgataactcgttcggtaacagttttgagttcacaaagaacaacatctatggaacgcatgtgcttctagaagcctgcaaagtcactggtcagattagaaggtttattcacgtgagcacagatgaggtgtatggagaaactgaagaggatgctgttgttggtaaccatgaagcttcacagcttcttcctacgaacccgtattcagctacaaaagctggtgcagaaatgcttgttatggcttacggtaggtcgtatgggttgcccgtgattaccactagaggaaacaatgtttatggtcctaatcaattcccggaaaaactaatcccgaagttcattctcctggcaatgagaggacagccgctaccgattcatggtgatgggtcgaatgtaaggagttatctctactgtgaagatgttgctgaggcttttgaagtaattcttcacaagggggaagttggtcatgtttataacattgggaccaaaaaggaaaggagagtgatcgatgttgcgaaagacatgtgcaagctctttaatatggatcctgattcaagcatcaagtttgtggagaacagaccgtttaatgatcagaggtatttcttagacgatgagaagttgaagagcttgggttggtctgaaaggaccttatgggaagagggtctgaaaaagaccatcgagtggtataccagcaacccgaactggtggggagatgtctctggagcacttctgcctcatccgagaatgttaatgatgccaggtggcgttgacagacttgttgacgggcctgaaaatgctgaatttgattcagctggtgtggcgattaatacttctcagattggagtccagattcctagctcgaaagccagtggcgtttctgctaagaaaccggctttaaagtttctcatttacgggaaaacaggctggatcggtggattacttgggaagttatgtgagaaacaacagattcaatacgagtatggaagaggtcgtttggaagaccgttcacaactgttgactgatattcaaacgagcaaacctactcatgttttcaatgctgctggtgtcacgggcagaccaaatgttgattggtgtgagtctcacaagacagaaaccattcgtaccaatgtctcgggcacactcaatctagctgatgtctgtagagaacatggactgttgatgatcaattttgctactggatgcatctttgagtatgatgctaaacatccggaaggttccggaatcggttttaaggaagaagatacgcccaatttcaccgggtcattctattcgaaaaccaaagctatggtggaggagcttttgaaagaatacgataatgtgtgcacactaagagtccgaatgccaatatcatccgatctcaacaacccacgtaacttcataaccaagattgcgcgttacgataaagttgtaaacatacccaacagcatgacaatcttggacgagcttttaccaatctcaatcgagatggcaaagcgtaatctgaggggaatatggaacttcacaaacccaggggtggtaagccacaatgagattctcgaaatgtacaagaagtacataaacccggaattcaagtgggaaaatttcacactggaagaacaagcaaaagtgattgtggccccacgaagcaacaacgagttggatgcatcaaagttgaagaaagagttcccagagctgctatcaatcaaggagtcgttgatcaagtacgtatttgaacccaacaaaaaacagtaaaacaataacgatgatatgatgattctttatagaatttgtagaactcaagattcacttgtgtttggttacttgctagtttggtttggattatacatctgtaatgtttaaagtcaccgactcaatcacattcgttctagcgttcgttacacagaaattatagaaggcgaggccgatcctctaggcatattttatattcaaaaaagaa

SEQ ID NO: 12157 - DNA, 2483 bp, Arabidopsis lyrata
gtcgtcgtcttttgtgttcgttctcatcttgtattttggcactggcgacaagactcgttttttgaattttgattcttcttctccgcttctttcgcttcttcctcagcttcttcaccgtcaaaagctcttcacattttctccgaattttccagttatcttcccaaaattctcttgctaaccttgaagatctgagaattcaaagcgtttaaccatggcttcgtacactcccaagaacattctcatcaccggagctgctggtttcattgcatcacatgtcgccaacagactcatacgaagctatcctcattacaacatcgttgtgcttgacaaacttgattactgttcaaatctcaagaatctcaacccctctaaacagtctccgaatttcaagtttgtcaaaggtgatatcgctagtgctgacttggtgaatcatcttctcatcactgaaggtatcgacaccatcatgcatttcgctgctcagactcacgtcgacaattccttcggtaacagtttcgagtttactaagaataatatctatggaactcatgtgcttcttgaggcttgtaaagttactggtcagattaggaggtttattcatgtcagtactgatgaggtttatggtgaaactgatgaggatgctcttgttggtaaccatgaggcttctcagctacttccgacgaatccttactctgccacgaaagctggtgcggagatgcttgttatggcttatggtaggtcttatgggttgcctgttattaccacacgtgggaataacgtctatggaccgaatcagtttcctgagaagttgattcctaagttcattttgctggcaatgagagggcaagttcttcccattcatggagatgggtcaaatgtcaggagctacctgtactgtgaagatgttgctgaggcttttgaagttattctgcacaagggagaagttggccatgtttacaatattgggacgaagaaggagaggagagtcaatgatgttgccagagatatctgcaaactcttcagcatggaccctgaggcgaacatcaagtttgtcgagaacagaccttttaacgatcaaaggtactttcttgatgatcagaagctcaaaaagttgggatggtcagagaggaccacgtgggaagaagggttgaagaaaactatggaatggtacacacagaacccggagtggtggggtgatgtttctggagcattgcttcctcatccaaggatgttgatgatgcctggcgggcgacactttgatggctcggaggacaattctttggcagctactttatcagagaaaccaagtcaaacccatatggttgttccaagcccaaggagcagcggcacacctcaaaagccttcactgaaattcttgatatatggaaagaccggatggatcggtggtctgcttggaaagatctgtgaaaagcaaggaattgcttacgagtacgggaaaggtcggttggaggatcgatcatctcttctgcaggatattcagagcgttaagccaacccatgttttcaattccgctggtgtgactgggagacccaatgttgactggtgtgagtctcacaagaccgagactatccgtgccaatgtagctggcacattgactctagctgatgtctgcagagagcatggactcctgatgatgaatttcgctactggttgtatatttgaatatgacgacaagcatccagaaggttcaggaattggcttcaaggaggaagacacccccaacttcactggctctttctactcaaaaaccaaagccatggtcgaggagctgctaaaagagtatgacaacgtatgcacattgagggtaaggatgccgatctcctcagatctaaacaacccgcgcaacttcatcaccaagatctccaggtacaacaaagtggtgaacatcccaaacagcatgactgtgttggacgagcttttaccaatctccgtcgagatggcaaaaagaaacttgaaaggaatctggaacttcacaaacccaggtgtggtgagccacaacgagatcctagagatgtacagagactacatcaaccctgaattcaaatgggcgaacttcacattagaggagcaagctaaagtcattgtggcaccaagaagcaacaacgagatggatgcttccaagctcaagaaagagttccctgagctactctctattaaggagtctctgattaagtatgcattcgagccaaacaagaaaacctgaagagagaaagattgtgattcgtcattagattaatcacctttaatatcagtttcgtttatttgtttggttatttgttttattaccccttgtttcattagatttgcttaggggtgtatttgtagttcaaatattatatgtaataagagcttgagttattgattatctatttgtgttcttgttcacaattttgtcataagttgctctactcttattttataagaatcaaaccactaaaagagtctggtaatggctgctttttgtt

SEQ ID NO: 12158 - DNA, 2360 bp, Flaveria ramosissima
atcgattgaggcgtcggttgccactccgtaaggaatttcgtgatctcttcttcatcacctttctggtcgagatctgctattcatacgcaatctgctcttcataacaattcgatttcacattttatatctggtatggctaattacacgccgaagaacatccttatcacgggggctgctggcttcattgcctctcatgttgctaatcggctagtcagaagctaccctgattacaagattgttgtgcttgacaagcttgattattgttcaaatcttaagaatctcaacccttcgaggtcatctcccaacttcaagtttgtgaagggtgacattggtagtgctgatctagtcaactacctcctgatcactgaatctattgataccataatgcactttgctgcacagacccatgttgataactcatttggcaacagctttgagttcacaaagaacaacatctatggtactcatgtgcttctagaggcctgcaaagtcactggccagattagaaggttcatccatgtgagcacagatgaggtctatggtgaaacagaggaggatgctgttgtgggtaaccatgaagcttcacaacttcttcctacaaacccatattcagccacaaaagctggtgcagaaatgcttgtcatggcttatggtaggtcttacgggctgcctgtgattaccacaagaggaaacaatgtttatggcccaaatcagttcccggagaaactaatccccaagttcattctcttagctatgagaggacaaccacttccaattcacggtgatggttctaatgtaaggagctacctgtactgtgaagacgttgctgaagcatttgaagtaattcttcacaaaggagaagttggtcatgtttacaacatagggaccaaaagagagagaagagttattgatgtcgcaaaagatatgtgcaagcttttcaatatggatcccgattcaagcatcaagtttgtggaaaacagacctttcaatgatcaaagatatttcttagatgatgagaaattgaagagcttgggctggtctgaaaggaccgtatgggaagaaggtttgaaaaagaccatcgagtggtacaccagtaaccctaattggtggggagatgtctctggagcacttctcccgcatccaagaatgttaatgatgccaggtggtgttgatagacacattgatggaccagaaaatgctgaatttgactcagctaatttggcaatcaatacttctcagattggtgttcaggttcctagttcaaaaacaagtagcatttcttctaagaaaccaactctgaagttcctgatctatgggaaaacgggttggatcggtggtttacttgggaaattatgtgaaaagcaacaaattcaatacgagtatggaaaaggtcgtttggaagatcgttcacaacttttggctgatattcaaaccattaagcctactcatgttttcaatgctgctggtgttactggcagaccaaatgttgactggtgtgaatctcataaaacagaaaccattcgtaccaatgtttcgggcacactcaatttagcagatgtctgcagagaacatgggctcctaatgatcaattttgcaactggatgcatttttgaatatgatgctaagcatccagaaggttctggaatcggtttcaaggaagaagacacgcccaatttcactggttccttctattccaagaccaaagccatggtggaggagcttttgaaagaatatgataatgtttgcacccttcgagttcgaatgccaatatcatcagatctcaacaacccacgcaactttatcacgaaaatagctcgttataataaagttgtgaacataccaaacagcatgacgattttggatgaacttttacccatttcaatcgagatggcaaagaggaatctaacgggaatctggaactttacaaatccaggggtggtaagtcacaatgagattcttgaaatgtacaagaagtacatcaacccagaattcaagtgggtaaacttcacactggaggaacaagcgaaagtgatagtggccccacgaagcaataacgagttggatgcatcaaagttgaagaacgagttccctgagttgctatcgatcaaggagtcattgatcaagtacgtattcgaaccaaacaaaaaacattaataaccttcgattctttattagaatttgtaaactgaagattcacctgtgtttggttacttactccgcctcatcatgtacggtttgggattatacatctgtaatgtttaaagtctttcacttcctagcagcatatcatcagtcatcacatcacactcagattatatgttagattcatcctgttttgtcagagctacacttggttgaat

SEQ ID NO: 12159 - DNA, 2220 bp, Flaveria ramosissima
tcatgttgaggtgaaccatactcatgtatatatacacacacatctgcgtgtattgttcatcgattgaggcgtcggttgccactccgtgagaaatatcgtgatctcttcttcatcacctttctggtcgagatctgctatattattatacgcaatctgctcttcataccaattcgatttcacattttatatccggtatggctaattacacgccgaagaacatccttatcacgggggctgctggcttcattgcctctcatgttgctaatcggctagtcagaagctaccctgattacaagattgttgtgcttgacaagcttgattattgttcaaatcttaagaatctcaatccttcgaggtcatctcccaacttcaagtttgtgaagggtgacattggtagtgctgatctagtcaactacctcctgatcaccgaatctattgataccataatgcactttgctgcacagacccatgttgataactcatttggcaacagctttgagttcacaaaaaacaacatctatggtactcatgtgcttctagaggcctgcaaagtcactggccagattagaaggttcatccatgtgagcacagatgaagtctatggtgaaacagaggaggatgctgttgtgggtaaccatgaagcttcacaacttcttcctacaaacccatattcagccacaaaagctggtgcagaaatgcttgtcatggcttatggtaggtcttacgggctgcctgtgattaccacaagaggaaacaatgtttatggcccaaatcagttcccggagaaactaatccctaagttcattctcttagctatgagaggacaaccacttccaattcacggtgatggttctaatgtaaggagttacctgtactgtgaagatgttgctgaagcttttgaagtaattcttcacaaaggagaagttggtcatgtttacaacatagggaccaaaagagagagaagagttattgatgtcgcaaaagatatgtgcaagctttttaatatggatcccgattcaagcatcaagtttgtggaaaacagacctttcaatgatcaaagatatttcttagatgatgagaaattgaagagcttgggctggtctgaaaggaccgtatgggaagaaggtttgaaaaagaccatcgagtggtacaccagtaaccctaattggtggggagatgtctctggagcacttctcccgcatccaagaatgttaatgatgccaggtggtgttgatagacacattgatggaccagaaaatgctgaatttgactcagctaatttggcaatcaatacttctcagattggtgttcaggttcctagttcaaaaacaagtagcatttcttctaagaaaccaactctgaagttcctgatctatgggaaaacgggttggatcggtggtttacttgggaaattatgtgaaaaacaacaaattcaatacgagtatggaaaaggtcgtttggaagaccgttcacaacttttggctgatatccaaaccattaaacctactcatgttttcaatgctgctggtgttactggcagaccaaatgtggactggtgtgaatctcataaaacagaaaccattcgtaccaatgtttcgggcacactcaatttagcagatgtctgcagagaacacgggctcttaatgatcaattttgcaactggatgcatttttgaatatgatgccaaacatccagaaggttctggaatcggtttcaaggaagaagacacgcccaatttcactgggtcattttattcgaagaccaaagccatggtggaggagcttttgaaagaatatgataatgtttgcacccttcgagttcgaatgccaatatcatcagatctcaacaacccacgcaactttatcacaaaaatagctcgttataataaagttgtgaacataccaaacagcatgacgattttggatgaacttttacccatttcgatcgagatggcaaagaggaatctaacgggaatctggaactttacaaatccaggggtggtaagtcacaatgagattcttgaaatgtacaagaagtacatcaacccagaattcaagtgggtaaacttcacactggaggaacaagcgaaggtgatagtggccccacgaagcaataatgagttggatgcatcaaagttgaagaacgagttccctgagttgctatcgatcaaggagtcattgatcaagtacgtattcgaaccaaacaaaaaacattaataac

SEQ ID NO: 12160 - DNA, 2538 bp, Helianthus annuus
gcggggagtctcaaaccacataattcctcaacaaaccttacacatgtatatatatctgcgtgtatatatcgatcgaggcgtcggttccttgagactcgcgtgaaatttcgtgatttcttctcaataatcacctttctggtccagatctttctctctctcatacgcgtaatctgctaattgatcccgatccggatcacaatttatttccggtatggctacttacgagccaaagaacatccttatcactggagctgcaggcttcattgcctctcatgttgctaaccggctgatcagaaactaccctgattacaagatcgttgtgcttgacaagcttgactattgttccaatctgaagaatcttaacccgtccagatcatcccccaacttcaagtttgtgaagggggatatcgggagcgccgacctcgtcaactaccttctgatcaccgagtcgatcgataccatcatgcactttgctgcacagactcacgtcgataactcgtttggcaacagttttgagttcacaaagaataacatctatggaacgcatgtgcttctagaagcctgcaaagtcaccggccagattagaaggtttattcacgtgagtacggatgaggtgtatggagaaacagaggaggatgccgttgttggtaaccatgaagcttcgcaacttcttcctacgaacccgtattcagccacaaaagctggtgcggaaatgcttgttatggcttacggtaggtcatacgggttgcccgtgatcaccactagaggaaacaatgtttatggcccaaaccagtttccggaaaaactaatcccgaagttcattctcctggcgatgagaggacaaccgcttccgattcacggtgacggttctaacgtaaggagttacctctattgcgaagacgttgctgaggcttttgaagtaattcttcacaagggggaagttggtcatgtttacaacatcgggaccaaaaaggaaaggagagtgattgatgttgcaaaagatatgtgtaagcttttcaatatggatccagattcaagcattaagtttgtggagaacaggccgtttaacgatcagcggtatttcttagacgacgagaagttgaagagcttgggttggtccgaaaggaccatatgggaagagggtctgaaaaagaccatcgagtggtacacgagtaacccgaactggtggggagatgtctctggagcacttctgcctcatccaagaatgttaatgatgccaggtggcgttgacagactcgttgacgggccggaaaatgctgattttgattcagctgatgtggcgatcaatacttctcagatcggagtccagatccctagctcgaaagccagtggcattgctcctaagaaaccggctttgaagtttctcatttatgggaaaacagggtggatcggtggtttacttgggaagttatgtgaaaagcaacagattcaatacgagtatggaaaaggtcgtttggaagaccgttcgcaacttttggctgatattcaaactattaaacctactcatgttttcaatgctgctggcgtcactggcagaccaaatgttgactggtgtgaatctcacaagacggaaactattcgtaccaatgtgtcgggcacactcaatctagctgacgtatgtagagaacatggactcttgatgattaactttgctactggatgcatctttgagtatgatgctaaacacccggaaggttccggaatcggttttaaggaagaagatacgccaaatttcactgggtccttctattcaaaaaccaaagctatggtggaggagcttttgaaagagtatgacaatgtgtgcacgcttagagtccgaatgccgatttcatccgatctcaacaacccacgcaacttcatcaccaagattgctcgttacgataaagttgtgaacatacccaacagcatgacaatcttggatgagcttttaccgatttcaatggagatggcaaagaggaatctgaggggaatctggaactttacgaatcccggggtggtaagccacaacgagattcttgaaatgtacaaggagtacataaacccagaattcaagtgggtaaatttcactctggaagaacaagcaaaagtgattgtggccgcacgaagcaataacgagttggatgcatcaaagttgaagaaagagttccccgagctgctatcgattaaggagtcgttgatcaagtacgtattcgaaccgaacaagcaacagtgaaaatgatatgatgattctttatagaatttgtagaactcaagattcacttgtgtttggttacttgctagtttggttttggattatacatctgtaatgtttaaagtcatattcgttctagtgtttgtttccaagtatcatcatacagagattataggaggcgaggttgattctctaggcgtattttatattcatcattttgtctacagttggtttgttcaacagttggtcggttttcgatatcttctcttcagttccattagaaaccgcacgcaggcttgtaatattggattctctatgatatttgt

SEQ ID NO: 12161 - DNA, 2252 bp, Helianthus annuus
cggcgtcggttgctactccgtgactctcgcgactaatttcgtgatttcttcttcatcacctttctggtccagatctctgtttcctgattaacatcttatatccggtatggctaattacacaccaaagaacatccttatcacaggggctgcaggcttcatcgcttctcacgtcgctaaccggctaatcagaagctaccccgattacaagattgtcgtgctcgacaagctagattactgttcaaatctcaagaacctgaacccatccagatcatctccaaacttcaaattcgtgaagggcgacatcggtagtgctgatctagttaactacctcctgatcaccgaatctatcgataccattatgcactttgctgcacaaactcacgtcgataactcattcggcaacagcttcgagttcacaaaaaacaacatctacggcacccatgtgcttctagaagcctgcaaagtcaccggccagatcagaaggtttattcatgtgagtaccgacgaggtttacggtgaaaccgacgaggatgcggttgtcggtaaccacgaagcgtcacaacttcttccgacaaacccatattctgccacaaaagccggtgcggaaatgcttgttatggcttacgctaggtcttacgggctgcctgtgatcaccacgagaggaaacaacgtttacggcccgaaccagttcccggagaaactgatcccgaagtttatcctcttagctatgagaggacaaccgcttccgattcacggtgacggttctaacgttagaagctacctttactgcgaagacgttgccgaagcgtttgaagtaattcttcacaaaggagaagtcggtcatgtttacaacatagggacgaaaagagaaagacgcgttatcgatgtcgcaaaggatatgtgcaagcttttcaacatggatcctgattcaagcatcaagtttgtcgaaaaccgaccatttaacgatcaacgttatttcttggacgacgagaaattgaagagcttgggttggtccgaacggactatatgggaagaaggtttgaaaaagacgatcgagtggtacacgagtaaccctaactggtggggcgatgtttccggagcacttcttccgcatccgagaatgttaatgatgccaggtggcgttgacagactcgttgacggaccggaaaatgctgaattcgattcatctaatttggcgatcaatacctcacagatcggcgtacaggttcccagttcgaaaactagcgtttcatctaagaaacccgctttgaagttcctgatttacgggaaaacgggttggatcggtgggttactcgggaaattatgcgaaaaacaacagattcaatacgagtatggaaaaggtcgtttggaagaccgttcgcaacttttggctgatattcaaacgattaagccaactcatgttttcaatgctgctggtgttactggcagaccgaatgttgattggtgtgaatcgcacaaaacggaaaccattcgtaccaatgtttcgggcacgcttaatttagcagatgtgtgtagagaacacgggctcttaatgatcaatttcgcaaccggatgcattttcgagtacgatgctaaacatcccgaaggttctggaatcgggtttaaggaagaagacacacccaatttcatcgggtcgttttattcgaagaccaaagctatggtggaggagcttttgaaagaatatgataacgtctgcactctacgagttcgaatgccgatatcatcagatctgaacaacccgcgcaattttatcaccaaaatagcgcgttacaataaagttgtgaacataccaaacagcatgacgatactggatgagcttttaccgatatcaatcgagatggcaaagaggaatctacggggaatctggaactttacaaatcccggggtggtgagtcacaatgagattctcgaaatgtacaagaagtatataaacccggagttcaagtgggtgaatttcacgctggaagaacaagcgaaagtgatagtggccccacgaagcaataacgagttggatgcgtcgaagttgaaaaaggagttccctgagttgatgtcgattaaggagtcgttgatcaagtacgtgtttgaaccgaacaaaaagcattgataatgtttgattcttttttagagtttgtaaaactgaagaggcagttatgtttggttggttgctcatttgtcctactgtatgttttggattatacatctgtaatgtttaaagtcagtctgtggtgtca

SEQ ID NO: 12162 - DNA, 2373 bp, Nicotiana benthamiana
gtctgaatctcaaatctctctttctataaccgaagcaaacgacgtagtttgtcccctcatttggggtggatcctgatctgaatttggactaaagctgcaacaaaatgtcgacatacacccctaagaatatactcattactggagctgccggatttattgcatgtcatgtagccaacaggctagttcggagctaccctgactacaagatcgttgtgcttgacaaacttgattattgttcaaatttgaagaaccttattccttcccgatcttcccctaatttcaagtttgttaagggggacattgccagtgcagatcttgttaactaccttctcatcactgagtccattgacactataatgcactttgctgctcagactcatgttgataattccttcggtaatagctttgagttcactaagaacaacatctacggtactcacgtactattagaagcctgcaaagttactggtcagatcagaaggtttattcatgtcagtacagatgaggtttatggtgagactgatgaggatgctgttgtcggaaaccatgaagcctcacaactccttcccactaacccatattcggccacaaaagctggggctgaaatgcttgttatggcttacggtagatcatacggtttacctgttataaccactagggggaacaatgtatatggtcctaaccaattccccgagaaactaatcccgaaatttatacttttagccatgagggggaagactcttcctattcatggagatggttgtaacgttcgtagttatctttactgtgaggatgttgctgaggcttttgaagtcattctacacaagggggaggtaggtcatgtttataacattggaactacaaaagagagaagagtgattgatgttgccaaagatatatgcaaactctttaacatggatccagacaaaagcattgagtttgttgagaacagaccatttaacgaccagaggtactttctggatgatcagaagttgaaagagttgggttggtcagagaggaccttgtgggaagagggtctgaaaaagactattgaatggtataccaaaaaccccgattggtggggggatgtctctggagcattgcttccgcatcctagaatgctgatgatgcccggtggaatagaaagacatttggatggagccgagaaatatgattcaggatcttctgaattctcagcaaagtccaatgaaaccaaaacggtagctccagctccaaagagcagcgaaatgcctcagaaatccccttttaagtttttgatctatggtaggaccgggtggattggtggtttgctagggaaattgtgtgagaaacaggggattccttatgagtatggcaagggacgattggaggatcgttcaaagcttttggcagacattaatgctctcaagccgacacatgtattcaatgctgctggtgttactggtagacccaatgttgattggtgtgagagtcataaaccagaaacaattcgtacaaatgttgccggcactcttaacttggcagatgtttgcagagagcacggtctcctgatgatgaatttcgccactggttgcatatttgagtatgatgctaagcacccagagggttccggtattgggttcaaggaggaagatacgcccaatttcgctggttccttctattcaaagaccaaggccatggttgaagagctgttgaaagaatatgacaacgtttgcacactcagagtccgcatgccaatatcttcagatctcaacaaccctcgcaatttcattaccaagattagcggttacaataaagtggtcaatattcctaacagtatgaccatactagacgaacttcttccaatttcaatcgagatggcaaagcgtaacctcaaggacatatggaatttcacaaaccccggcgttgtgagccataatgagatcttggaaatgtacaagaaatatatcgatccagcatttacttgggccaacttcacagtggaagagcaggccaaggtaattgttgcagctcgcagtaacaacgagatggatgcatcaaagttgaagaaagagttccctgagttgctaccgatcaaagagtcgctgatcaagtatgtgtttgaaccaaacaagaaaacctctgcataaaaaagctgttgatctcaaggattttgtatgctattttagccattattcatttttggtacccagaattctcttattgttttagattattgttagtgagtagagtttccttggtcgttattccttgttttttttttttgtatgaattcataatatttgtgctatgtatgcggaagatttggataggctgctgctcccctgtatctgtcgttgaatctgatatatggaattttgaattttttctagc

SEQ ID NO: 12163 - DNA, 2158 bp, Daucus carota
aattttggtttgagatggctaattatacgcccaagaatatcctgattacgggagctgctggcttcattgcttcccatgtggctaatcgtcttgttcggagctaccctgagtacaagatcgttgtgctcgataagcttgattactgctctaatcttaagaatcttaatccctctcggactgctcccaactttaagtttgtcaagggagatattggaagtgctgatctcgtcaactatcttttgatcactgagtcgattgatactattatgcactttgctgctcagacccatgttgataactcttttggtaacagttttgagtttaccaaaaacaacatttatggtactcatgtgcttttagaagcctgcaaagtgactggacagatcaggcggttcatccatgttagcacggatgaggtctatggggagacagatgaggatgctgttgtgggtaatcatgaagcttcacaactccttcccacgaatccttattctgccactaaagctggggctgagatgcttgtcatggcttacggcaggtcatatggattacctgttattacaactcggggtaataatgtgtatggtcctaatcagtttccagaaaaattgatcccaaagttcatccttttagccatgaggggaatgcaacttcctattcatggggatggtgccaatgtacggagttatctctactgtgaggatgttgctgaggcctttgaggttgtccttcacaagggagaagttggacatgtttacaatatagggacaaagaaggagaggagagttactgatgttgcccaagacatctgtaaacttttctccatggatcctcaatctaacattaaatatgtggagaacaggccattcaatgatcagaggtactttctagatgatcagaagttgaaaaacttgggctgggctgagcgcactacatgggaagaagggctaaaaaagactatggactggtacactagcaaccctgattggtggggagatgtatctggagcattgcttcctcatccaagaatgctgatgatgcctggtggaattgagagacactttgacggatctgaaaaccgtgacgctgaatcaactcgtttcgtcgataaatctgccccatcacaggtttcttcctcagatcccaaaagcacagtccctcagaaattagctcttaagtttttaatttatggtaggactgggtggattggtggtctgctcggaaaattatgtgaaaaacaaggtattccgtatgaatatggaagggggcgcctagagtatcgatcacagctagtgtctgatctccagatagttaaacccacacatgtttttaatgctgctggtgtgactggtagacccaatgtcgattggtgcgagtcccacaaaacagaaaccattcgtacaaatgtcacgggtacactgacactagctgatgtatgcagagagcaaggacttctgatgattaattttgctactggatgcatattcgagtatgatgctgcacaccctgaaggttctggcattggattcaaagaagaggacacacccaactttcatgggtcattttattcaaagaccaaggccatggttgaagaactcttgaaagagtatgacaatgtctgcacgctccgagttcggatgcccatatcatcagacctcagcaacccccgcaacttcatcacaaagattagtcgttataataaggtggttaatattcccaacagtatgacagtcttggatgagctacttcctatctcaatcgaaatggctaagcggaacctcagaggcatatggaactttaccaatcctggagttgtgagccataatgaaattctggagatgtacaagaattacattgatccatcttttaaatgggcaaacttcacactggaagagcaagctaaggtgatcgtagcagctcgaagcaataacgagatggatgggtctaagctgaagaccgagttccctgagttgttatcaatcaaagaatcattgatcaagtatgtttttgaacccaacaagaaaacctagttgcttggacactataggatagtaaacttaaggctactaatacagtctcgattgccttgctattatttattcataggttgaggtcattatcaatgtcatctatgtattaatttgtgcggattcaggtg

SEQ ID NO: 12164 - DNA, 2447 bp, Musa acuminata
ctctctctctctctctctccctctccctcctctctctctctctcagcttcatattcttgtccgtgcaaggaagcttccaattctccgctctgttcttctgcaaagagtttgttgtgtggatggcgacatacgagcccaagaacatcctcattaccggggcggcaggtttcatcgcctcccatgtcgcgaaccgcctcgtccggaactaccccaagtacaagatcgtggtcctcgacaagcttgactactgctccaacctgaagaacctcaacccctcgcgttcctcccccaacttcaggttcgtgaagggcgacatcggcagcgccgacctcgtcaactacctcctgatcaccgagtccatcgacaccatcatgcatttcgccgcccagacccatgtcgacaactctttcggcaactccttcgagttcaccacgaacaacatctatggcactcacgtcctcctcgaggcctgcaaggtcactggtcaagtcagaaggttcatccatgttagcaccgatgaggtctacggggagaccgatgaggatgccgtggtgggcaaccatgaggcgtctcagctgctgccgaccaacccgtactctgcaaccaaagctggggctgagatgcttgttatggcctatggaaggtcatatggcttgcctgtgattacaacccgtggaaacaacgtgtatggccccaaccagttcccggaaaagctgattccaaagtttatccttttggctatgagagggcagcctctgccgattcatggtgatggctctaatgttcgaagctatctgtactgcgaggatgttgcagaggcttacgaggttgtccttcacaaaggagaagttgggcatgtttataacattgggacaaagaaagaaaggagggtgattgatgtggcagtggatatctgtaagcttttctcattagatacggacaccgtcatcaagtttgtggagaacaggcccttcaatgaccagaggtacttcttggatgatcagaagcttaagaaccttggatggtcagagaagaccatatgggaggagggactgaagaagacgatggaatggtacatgaacaaccccgactggtggggggatgtttcaggtgcgctgttacctcatccacggatgttgatgatgcccggtatcgaaaggcatatcgatggatctgaagaaaccaaggacatggtttatcaggaaatgagcactagtaatcagaacgggatggtggttccttcaataaggacctccctgaagaaaccacatttgaagttcttgatatatggtagaactggatggattgggggccttctcggcaagttatgcgagaagcaggatataccgtatgagtatggaagagggcgtttggaagaacgttcccaactcatacgggatattcagaatgtgaagccatctcatgtttttaatgccgctggtgtcaccggtaggcctaatgttgactggtgtgaatctcacaagcaggagacgattcgcacaaatgtcgtgggaactttgactcttgcagatgtttgtagggagaacggcctgttgctgatgaattatgctactggttgtatttttgagtatgatgctcgacaccctgaaggatcaggcatcggatacaaggaggaagacaaaccaaactttaccggttccttctattcgaagactaaagcaatggttgaagagctgctcaaagaatttgacaatgtctgcactcttagagttagaatgccaatatcttctgatctgagcaatcctcgcaacttcatcacaaaaatcagtcgctacaacaaagtcgtgaacataccaaatagcatgacagttttagatgaacttctgcccatatcaattgagatggcaaaaagaagctgcaggggcatatggaacttcaccaatcctggcgtggtgagccacaacgagatcctagagatgtacaagagctacattgaccccagctttaaatggactaactttacattggaggaacaggccaaagtcatagttgcacctcgaagcaacaatgagatggatgcttcaaagttgaagagagagtttccagagttgctgtcgataaaagattctatcatcaagtatgtctttgagccaaacaaaaaggtcctttctaactgagaagcttatcggtgatcgcattcggtctagacttctgtattaaagcagtagagccccaaattttccacttaattactgatgttggccagtattatggcagcaagactatcatcagatctgctcggtggtggcgtctagaagactctttttctacaagggaggaaactgcttgtttcaatttgattaggtagtttcttttgcttttcttgtttagggtctttacaagagaccaacattatttgtcttctcaaattggtttcttgtccaattttgtgtggcatgtactcattaacattctatcaatgcgat

SEQ ID NO: 12165 - DNA, 2045 bp, Echinochloa colona
tcaagggtgacattgcaagtgctgatctggtgaactaccttctgatcacagagtcaattgacaccatcatgcactttgctgctcagacacatgtggataattcctttggcaattcatttgagttcacaaagaacaatatatatggtacccacgtccttcttgaggcttgcaaggttactggtcagatcaggaggtttattcatgtcagcactgacgaggtgtatggagaaactgatgaggatgctgtggttggcaaccatgaggcctcccagttgcttccaacaaatccatactcagctacaaaagctggggcagaaatgcttgtgatggcatatggaaggtcttatggtcttcctgtgattaccactcgaggcaacaatgtgtatgggccaaatcagttccctgagaaacttatccccaaattcattcttttggccatgagaggtctgcctcttccaattcatggagatggttccaatgtcaggagctacctgtactgtgaggatgtggctgaagcttttgaggtggttcttcacaaaggagaggttggacatgtgtataatattggcactgtgaaggagaggagggtgattgacgtggccaaggacatatgcaggctctttggcttggatactgagaaagtcattaggtttgttgagaacaggcccttcaatgaccagaggtactttttggatgatcagaagctgaagagattgggatgggcagaacgcactccatgggaagagggcttgaagaaaacaattgagtggtacaccaccaatcctgattactggggagatgttactggtgcgctgctccctcatccaaggatgttgatgactcctggtgttgatgaaagacataactggactgaggaaatcaagtctctgtcttcttcaccaatggaggctagcattacagctcctgcaaccagtacccagaacaccactgatacccctcaaaagcctccctacaagttcttaatatatggtaggactggttggattggtggcctccttgggaagatctgtgagaagcaagggatatcatatgagtatgggaaaggacgcctggaggagcgttctcagcttttggaggacattagaaatgtgaagccaactcatgttttcaatgcagctggagtcactgggagaccaaatgttgactggtgtgagacccacaaacaggacactatccgcaccaatgttgtaggcaccttgaatcttgctgatgtttgccgtgagcagggtttgctcatgattaattatgctacaggctgtatatttgagtatgatgctaagcaccctgaagggtctggaattggctttaaagaggaagacacccccaactttacaggttccttttattccaagactaaagcaatggtggaagagctattgaaggactatgacaatgtctgtactcttagggtcaggatgcctatttcatcggatctaagcaaccctcgtaacttcatcacaaagatagctcggtacgacaaggtggtgaacattcccaacagcatgacaattttggatgagcttctgcctatctccattgagatggcgaagcgggactgccggggcatatggaacttcaccaaccctggcgttgtcagccacaacgagattctggagatgtacaaaaagtacatcaatcccgacttcaagtggaccaacttcacactcgaagagcaggccaaagttatagttgcgcctaggagcaacaatgagatggatgcatcgaaattgaaggccgagttccctgagctgctatccatcaaggattctttgatcaagtatgtcttcgagccaaacaggaaggtccctgccaactgaggttttagggtgcattagtgttgaggttctttacattggttattgttggacactaaattagccaatattgcatggtggttcgtagttgtggtcgattcttttgggacaatagcaggcatacctcttttcttttgtcgttctgttacgcatcacggctttacaaaacacgtagatatccttagatgttctatatagtgtggctgatac

SEQ ID NO: 12166 - DNA, 2545 bp, Ambrosia trifida
ccacataataataatataaaatatttcaacaaaccttgacatgtatatatatatatcgatcaaggcgtcggttctttgagtctctcgtaattcttctcaataataatattcacctttctggtcggtctttctttctctctctctcatcccgatccatatcacaattacaatttatatccagtatggctacatacgagccaaagaacatccttatcactggagctgccggcttcattgcctctcatgttgctaaccggctgatcagaaactaccctgattacaagattgttgtgcttgacaagcttgactattgttccaatctcaagaacctgaacccgtccagatcgtctcccaacttcaagtttgtcaagggggatattgggagcgctgacctcgtcaactatctgctgatcactgagtcgattgataccattatgcactttgctgcacagactcatgtcgataactcgtttggtaacagtttcgagttcacaaagaataacatctatggaacgcatgtgcttctagaagcctgcaaagtcactggtcagattagaaggtttattcacgtgagcacagatgaggtgtatggagaaactgaagaggatgctgttgttggtaaccatgaagcttcacagcttcttcctacgaacccgtattcagctacaaaagctggtgcggaaatgcttgttatggcttacggtaggtcgtatgggttgcccgtgattaccactagaggaaacaatgtttatggtccgaatcagttcccggaaaaactaatcccgaagttcattctcctggcaatgagaggacagccactaccgattcatggtgatggttcgaatgtaaggagttatctctactgtgaagatgttgctgaggcttttgaagtaattcttcacaagggggaagttggtcatgtttataacattgggaccaaaaaggaaaggagagtgatcgatgttgcgaaagatatgtgcaaactctttaatatggatcctgattcaagcatcaagtttgtggagaacagaccgtttaatgatcagaggtatttcttagacgatgagaagttgaagagcttgggttggtctgaaaggaccttatgggaagagggtctgaaaaagaccatcgagtggtataccagcaacccgaactggtggggagatgtctctggagcacttctgcctcatccgagaatgttaatgatgccaggtggcgttgacagacttgttgacgggcctgaaaatgctgaatttgattcagctggtgtggcgattaatacttctcagatcggagtccagattcctagctcaaaaaccagtggtgtttctgctaagaaaccggctttgaagtttctcatttacgggaaaacaggctggatcggtggtttacttgggaagttatgtgagaaacaacagattcaatacgagtatggaagaggtcgtttggaagaccgttcacaacttttggctgatattcaatcgatcaaacctactcatgttttcaatgctgctggtgtcacgggcagaccaaatgttgattggtgtgaatctcacaagacagaaaccattcgtaccaatgtctcgggcacactcaatctagctgatgtctgtagagaacatggactgttgatgatcaattttgctactggatgcatctttgagtatgatgctaaacatccggaaggttccggaatcggttttaaggaagaagatacacccaatttcaccgggttcattcatttcaaaaccaaagctatggtggaggagcttttgaaagaatacgataacgtgtgcacccttagagtccgaatgcctatatcatcggatctcaacaacccacgcaacttcatcaccaagattgcacgttacgataaagttgtaaacatacccaacagcatgacaatcttggacgagcttttaccaatttcaatcgagatggcaaagcgtaatctgaggggaatatggaacttcacaaacccaggggtggtaagccacaacgagattctcgaaatgtacaagaagtacataaatccggaattcaagtgggaaaatttcacactggaagaacaagcaaaagtgatcgtggccccacgaagcaacaacgagttggatgcatcaaagttgaagaaagagttcccagagctgctatcaatcaaggagtcgttgatcaagtacgtatttgaacccaacaaaaaacagtaaaacaataacgatgatatgatgattctttatagaatttgtagaactcaagattcacatgtgtttggttacttgctagtttggtttggattatacatctgtaatgtttaaagtcacccgagtcagtcacattcgttctagcgtttgtttcctagcgtcgttacacagaaattatagaaggcgaggccgatcctctaggcgttattttatattcatcattttgtctacagatagtttgttcaacagtcgtttacaaatattttccttaggtttcgttagaaaccgcatgcggcatacaggcttgtactattggattatctatgatatttgttatttctttacca

SEQ ID NO: 12167 - DNA, 2206 bp, Daucus carota
tgagagttgctcttgcctcctcctcctccctcattatcttctcctctgctttcaaagtcttttctgcgtctcccttcattcctacattcattcctaattttggtttgagatggctaattatacgcccaagaatatcctgattacgggagctgctggcttcattgcttctcatgtggctaatcgtcttgttcggagctaccctgagtacaagatcgttgtgcttgataagcttgattactgctccaatcttaagaatcttaatccctctcgtactgctcccaactttaagtttgtcaagggagatattggaagtgctgatctcgtcaactatcttttgatcactgagtcgattgatactattatgcactttgctgctcagacccatgttgataactcttttggtaacagttttgagtttaccaaaaacaacatttatggtactcatgtgcttttagaagcctgcaaagtgactggacagatcaggcggttcatccatgttagcacggatgaggtctatggggagacagatgaggatgctgttgtgggtaatcacgaagcttcacaactccttccgacgaatccttattctgccactaaagctggggctgagatgcttgtcatggcttacggcaggtcatatggtttacctgttattacaacccggggtaataatgtctatggtcctaatcagtttccagaaaagttgatcccaaagttcatccttttagccatgaggggaatgcaacttcctattcatggggatggtgccaatgtgcgcagttatctctactgcgaggatgttgctgaggcctttgaggttgttcttcacaagggagaagttggccatgtttataatattgggacaaagaaggaaaggagagttactgatgttgccaaagacatctgtaaacttttttctgtggacccagaaacaaatattaactatgtagagaacaggccattcaatgatcagaggtatttcctagatgatcagaagttgaaaaacttgggctgggctgagcgcactacatgggaagaagggctaaaaaagactatggactggtacactagcaaccctgattggtggggagatgtatctggagcattgcttcctcatccaagaatgctgatgatgcctggtggaattgagagacactttgacggatctgaaaaccgtgacgctgaatcaacccgtttcgtggataaatctgccccatcacaggtttcttcctcagatcccaaaagcacagtccctcagaaattagctcttaagtttttaatttatggtaggactgggtggattggtggtctgctcggaaaattatgtgaaaaacaaggtattccatatgaatatggaagggggcgcctagagtatcgatcacagctagtgtctgatctccagatagttaaacccacacatgttttcaatgctgctggtgtgactggtagacccaatgtcgattggtgcgagtcccacaaaacagaaaccattcgtacaaatgtcacgggtacactgacactagctgatgtatgcagagagcaaggacttctgatgattaattttgctactggatgcatattcgagtatgatgctgcacaccctgaaggttctggcattggattcaaagaagaggacacacccaactttcatgggtcattttattcaaagacgaaggccatggttgaagaactcttgaaagagtatgacaatgtctgcacgctccgagttcggatgcccatatcatcagacctcagcaacccccgcaacttcatcacaaagattagtcgttataataaggtggttaatattcccaacagcatgacagtcttggatgagttgctacctatctcaatcgagatggccaagaggaaccttaaaggtatatggaacttcaccaaccctggagtcgtaagccacaatgagattttggagatgtacaagcaatatatcgacccatcttttaaatactcaaacttcacactagaggagcaagccaaagtaattgtagcagctagaagcaataatgagatggatggggcgaagttgaaggccgagttccctgagttgctgtcaatcaaggaatcattgatcaagtatgtttttgaacccaacaaaaaagtttagctgctggttgagcactgtagaatagtaaacttcaggcgacctctacagtcttgatttaccatactattattaccttgagcc

SEQ ID NO: 12168 - DNA, 2153 bp, Chrysanthemum coronarium
ttaacaataacacacaataacacatttctcgtgatctgatcataataataacaaactttctggtctgatctcgtttctctttattcaattctacgtccgggatggctacttacacgccaaagaacatcttaatcacgggggctgctggcttcattgcctcacatgtcgctaatcgcctcatcagaagctaccctgattacaagattgttgtcctcgacaagcttgattattgttccaatcttaagaaccttaacccctctagatcatcgcctaactttaagtttgttaagggtgatatcgggagtgctgatctagtcaactaccttctgatcactgagtctattgatacgattatgcactttgctgcacagactcatgtagataactcatttggcaacagttttgagttcacgaagaataacatctatggtactcatgtgcttctcgaggcgtgtaaggtcactggtcagattagaaggtttattcatgtgagtacggatgaggtttatggggaaaccgaggaggatgctattgttggtaaccatgaagcttcgcaacttcttcctacaaacccgtattcagccacaaaagctggtgcggaaatgcttgttatggcttatggtagatcatacgggttgcctgtgatcacgactagaggaaacaatgtttatggcccaaaccagttccctgaaaaactaatcccgaagtttattcttttggctatgcaaggaaagccacttccgattcacggtgatggttctaatgtaaggagttacctctactgtgaggacgttgctgaggcgtttgaagtgattcttcacaagggtgaagtcggtcatgtttacaacatcgggacgaaaagggagaggagagttattgatgttgccaaagatatgtgcaagcttttcaacatggatgctgatgcaagcatcaagtttgttgaaaaccgaccctttaatgatcagaggtactttttggatgacgagaagttaaagagcttgggttggtctgagagaacaagatgggaagagggtctgaagaagaccatcgagtggtacacaagcaatcctaattggtggggcgatgtctctggagcgctgcttcctcatccaaggatgttgatgatgcctggtggagttgatcgacttgctgatggacccgatcactctgaatttgatgcagctgatccagcaatcaacactgcacagattggagtgcaagttccctcaaagaccagtagcaacgctcctaaaaaaccagcactgaagttcctcatctatggtaagacagggtggatcggtggtttacttgggaaactgtgtgagaaacaagggattcaatacgagtatggaaaaggtcgtttggaagaccgctctcagcttttgtctgatattcagactattaaacctactcatgttttcaatgctgctggtgtcactggcagacctaatgtcgattggtgtgaatctcacaagacggaaactattcgtgtcaatgtgtgtggcacattgaacctagctgatgtctgcagagaacaaggtctcttaatgatcaatttcgctactggatgcatttttgagtatgatgctaaacaccctgagggttctggtatcggttttaaggaagaagacacgcccaacttcaccgggtcgttttattcaaagaccaaagctatggttgaggagctcttgaaagaatatgacaatgtctgcacacttcgagtccgaatgccaatatcatcagacctcaacaacccacgaaacttcatcactaagattgctcgttacaataaagttgtgaacatacccaacagcatgacaatcttggatgagcttttaccaatttcaatcgaaatggcaaagagaaacctaaagggaatctggaacttcacaaatcctggggttgtaagccacaacgagattcttgaaatgtacaaaaagtacataaacccggaattcaaatggcagaacttcacactggaagaacaagcgttagtgatagtggcgccacgaagcaataacgaattagatgcatcaaagttgaagaaagagttccctgagttgctttcaatcaaggagtcgttgatcaagtacgtattcgaacccaacaaaaaacagtaataatgattcttttttagcatttgtaaactccag

SEQ ID NO: 12169 - DNA, 2912 bp, Glycine max
tttattttgtttggaaatcgtcatcatcaccatttgatttgtagggccataatttttctgctttgattttcaaacttcctcaccattttccattttttcttcttcttctctagttgttttttttcctgagaaaaaaattgagctctttttggctaagcctccaagcagatccaactaaggaaatgtaaaattttcaaattttttttatcagtatccactttttagaccttcccctcatgttctagatttgaagatattgtcattacctcactcttgtttgtgccaagatctgttctgttccgttccccccttttttctttttttagatcttggtcttctccatgaggtggctttctgtatccatggattgaggcactggccaagaacaaggttggcttggaggagcttaggctcaagaggatggtggtctcgaatgagagcctgagctactctttcggtctatccaacggtttcgcgaagaagcccatgctctcaatgacggtggtggagtcgagagacttcctcatcccgctctctgaatccatcgcgttccacagactccctttcttcgagaccatcgcggtcatcaccaaggccaagggagctaacctcttttgctggaaccaccgccgtggattcctctgcttagccaggcagaagcacatttgcatctttcgacacgacgaagttgcctgacatggcttcgtacaccccaaagaatatcctcattactggggcggctggatttattgcgtctcatgttgccaaccggcttgtccggagctaccctgactacaaaattgttgtgcttgacaaacttgattattgttctagtctgaagaacctccttccttcaaaatcatctcctaacttcaaatttgtgaagggggatattggtagtgctgatcttgtcaactaccttctcatcaccgaatccattgacactataatgcatttcgctgcccaaacccatgttgacaactcgtttggtaatagctttgagttcaccaagaacaacatatacggaactcatgtcctattagaagcctgcaaggttactggccagatcagaaggttcattcatgtgagcactgatgaggtctatggagagacggaagaggatgctgttgttggaaaccatgaggcctctcaacttcttcccactaacccgtactctgctacaaaagctggggctgaaatgcttgtcatggcttatggtaggtcatatgggctacctgttattacaactcgtggaaacaatgtttatgggcccaatcagtttcctgagaagttaattccaaagttcatcctcctggctatgcagggaaagaatcttccaattcatggggatggttcaaatgtgaggagttatttatattgtgaagatgttgctgaggcttttgaagttgtcctgcacaagggtgaggttggccatgtttacaatatcgggacaaagaaggaaaggagagttgtcgatgtagccaaagatatatgcagacttttctcaatggacccagaaacttgtataaaatttgtagagaacagaccatttaacgaccagagatactttcttgatgatcaaaagctgaaggacttgggttggtctgagaggaccacttgggaagaaggcttgaagaaaaccatggattggtatatcaataaccctgattggtggggtgatgttactggggcattgcttcctcatcctaggatgctgatgatgcctggtgggttggagaggcatttcgagggatctgaagagggaaaacctgcatcttttggctcaagtaataccaggatagtggttccatcatccaagaacaccagctctcaacagaaacatccttttatgttcttgatctatggtagaacagggtggattgggggtttgctggggaaattgtgtgaaaagcaaggaattccgtatgaatatggaaagggtcgcctagaggaccgctcctcactcttggctgatcttcagaatgtgaagcctacacatgtttttaatgctgcaggagtgaccggcagacccaatgttgattggtgtgaatcccataaaacagaaaccatccgcaccaatgttgctggtaccttaacaatggctgatgtctgcagagagcatgggatcttgatgataaattatgctactgggtgcatattcgagtacaatgcaacacatcccgagggctctggcattggttttaaggaggaagacaagcccaatttcattggctctttctattccaaaactaaagctatggttgaggagctcttgagagactatgacaatgtatgcacactcagggttcgcatgccaatttcgtcagacctgagcaacccgcgcaacttcataacaaagatttctcgttataacaaagtggtcaacattccaaacagtatgactattttggatgaacttctgcctatctcaattgagatggcaaagaggaacttgaagggaatctggaacttcacaaatccaggggttgtgagccacaatgagatccttgagatgtacagggattacattgacccaaacttcaagtggtctaacttcacccttgaagagcaagcaaaggtgattgttgctcctcgaagcaacaatgagatggacgcatcaaaattgaagacagaattcccagaattgctttccatcaaggaatcactcatcaaatatgtctttgagccaaacaagaaaacataagcaggtttatgttattcagacaaggcagttatgtgttcaggctatatagaccagtgaaattggattttctaaactaagttattgtaaaaaaaaaaaaactgatgaaagggaagaacatcattagatattgttgataaattccattactattagtacaccaaatgtggcaaatatgttctgctcatatgttatccattgacctttctca

SEQ ID NO: 12170 - DNA, 2841 bp, Glycine max
atttttctttacaactaaattattgtgtcccttaattataatttttagtttgttaatcatgattttaatggtgtagttatagtatcctttactttaatatttttttgaggttatattttttctttaatgtaaactttagaaaactttaaaaatcatacaattataagaggggggtgggggtaattgagtgaggagcaaggggcatttgcgtcatttgagggatcccccggttccccttaactgtctctgttgatacaaatagacgcgtacatatgtacgatttcgcagctctaccctcttctcgttaacacacacagaagtgaaagtaacaccgaatcttccaccttttccttcttccattgttgtctcaaaactctctcttttcttcttctttgtttcttgtttgcttcaattttaagttgcctgatatggcttcatataccccaaagaatatccttattactggggctgctggatttattgcgtctcatgttgccaaccggcttgtccggagctaccctgactacaaaattgtcgtgcttgacaaacttgattattgttctaatctaaagaatctccttccttcaaaatcatcccccaacttcaagtttgtgaagggggatattggtagtgctgatcttgttaactaccttctcatcactgagtccattgacactataatgcactttgctgcccaaacccatgttgacaactcgtttggaaatagctttgagttcaccaagaacaacatatatggaacccatgtcctattagaagcctgcaaggtaactggccagatcagaaggttcattcatgtgagcaccgatgaggtctatggagagacggaagaggatgctgttgttggaaaccatgaggcttctcaacttcttcccacaaacccatactctgccacaaaagctggggctgaaatgcttgtcatggcttatggtaggtcatatgggttacctgttattacaactcgtggaaacaatgtttatgggcccaaccagtttcctgagaagttgattccaaagttcatcctcctggctatgcagggaaagaatcttccaattcatggggatggttcaaatgtgaggagttatttatattgtgaagatgttgcagaggcttttgaagttgtccttcacaagggagaggttggtcatgtttacaatatcgggacaaagaaggaaaggagagttatcgatgtagccaaagatatatgcagacttttctctatggacccagaaatttgtataaaatttgtagagaacagaccatttaatgaccagagatactttcttgatgatcaaaagctgaaggacttgggttggtctgagaggaccacttgggaagaaggcttgaagaaaaccatggattggtatattaataaccctgattggtggggtgatgtcactggggcattgcttcctcatcctaggatgctgatgatgcctggcgggttggataggcattttgagggatctgaagaggaaaaacctgcatcttttggctcaagtaataccaggatggtggttccaccgtccaagaacaccagctctcaacataaacatccttttaagttcttgatctatggtagaacagggtggattgggggtttgcttgggaaattgtgtgaaaagcaaggaattccatacgaatatggaaagggtcgcctagaggaccgctcctcactcatggctgatcttcagaatgtgaagccgacacatgtttttaatgctgcaggagtgactggcagacccaatgttgattggtgtgaatcccataaaacagaaaccatccgcaccaatgttgttggcaccttaacaatggctgatgtctgcagagagcatgggatcttgatggttaattatgctactgggtgcatatttgagtataatgcaacacatcctgaaggctctggcattggttttaaggaggaagacaagcccaatttcattggctctttctattccaaaactaaagctatggttgaggagctcttgagagaatatgacaatgtatgcacactcagggttcgcatgccaatttcatctgacctgagcaacccacgcaacttcataacgaagatttctcgttataacaaagtagtcaacattccaaacagtatgactattttggatgaacttctgcctatctcaattgagatggcaaagaggaacttgaggggaatctggaacttcacaaatccaggggttgtgagccacaatgagatccttgagatgtacagggattacattgaccccaacttcaagtgggctaacttcacccttgaagagcaagcgaaggtgatcgttgctcctcgaagcaacaacgagatggatgcatccaaattgaagacggaattcccagaattgctttccatcaaggaatcactcatcaaatatgtctttgagccaaacaagaaaacataagcagctttatgttatttagacaaggctgttatgtgttcaggctatatagatcactgactcattatttcactattagctcctttcagttactgtgtagagtgtggctagtattacaattgggttaggtatgttccctaagtcttcaactctgcagttttattcatgtgtcctctggtaatggcaatggtagctttagatagatgtcttgttatctacaagcttctgatgggcaacttttgcaccgtgcaagggctgtattcttttattgctcatctagaatgaaaatttaaaataatttgttaccatattgagatgtacttggatatttatctgtaatatagaatgaaatctttgaaaagagaaattatgttatttttaaactaataaaatgataatgttaatttca

SEQ ID NO: 12171 - DNA, 2399 bp, Glycine max
gcagctccaccatttccctctgcttactaacacgtagagacacacacacacaccatttccctcttccatcttttccttctaccattgttgtctcaaaactctctctttttcatcttctttgttttgggtttccttccattttaagttgcctgacatggcttcatataccccaaagaatatcctcattactggggcggctggatttattgcgtctcatgttgccaaccggcttgtccggagctaccctgactacaaaattgttgtgcttgacaaacttgattattgttctagtctgaagaacctccttccttcaaaatcatctcctaacttcaaatttgtgaagggggatattggtagtgctgatcttgtcaactaccttctcatcaccgaatccattgacactataatgcatttcgctgcccaaacccatgttgacaactcgtttggtaatagctttgagttcaccaagaacaacatatacggaactcatgtcctattagaagcctgcaaggttactggccagatcagaaggttcattcatgtgagcactgatgaggtctatggagagacggaagaggatgctgttgttggaaaccatgaggcctctcaacttcttcccactaacccgtactctgctacaaaagctggggctgaaatgcttgtcatggcttatggtaggtcatatgggctacctgttattacaactcgtggaaacaatgtttatgggcccaatcagtttcctgagaagttaattccaaagttcatcctcctggctatgcagggaaagaatcttccaattcatggggatggttcaaatgtgaggagttatttatattgtgaagatgttgctgaggcttttgaagttgtcctgcacaagggtgaggttggccatgtttacaatatcgggacaaagaaggaaaggagagttgtcgatgtagccaaagatatatgcagacttttctcaatggacccagaaacttgtataaaatttgtagagaacagaccatttaacgaccagagatactttcttgatgatcaaaagctgaaggacttgggttggtctgagaggaccacttgggaagaaggcttgaagaaaaccatggattggtatatcaataaccctgattggtggggtgatgttactggggcattgcttcctcatcctaggatgctgatgatgcctggtgggttggagaggcatttcgagggatctgaagagggaaaacctgcatcttttggctcaagtaataccaggatagtggttccatcatccaagaacaccagctctcaacagaaacatccttttatgttcttgatctatggtagaacagggtggattgggggtttgctggggaaattgtgtgaaaagcaaggaattccgtatgaatatggaaagggtcgcctagaggaccgctcctcactcttggctgatcttcagaatgtgaagcctacacatgtttttaatgctgcaggagtgaccggcagacccaatgttgattggtgtgaatcccataaaacagaaaccatccgcaccaatgttgctggtaccttaacaatggctgatgtctgcagagagcatgggatcttgatgataaattatgctactgggtgcatattcgagtacaatgcaacacatcccgagggctctggcattggttttaaggaggaagacaagcccaatttcattggctctttctattccaaaactaaagctatggttgaggagctcttgagagactatgacaatgtatgcacactcagggttcgcatgccaatttcgtcagacctgagcaacccgcgcaacttcataacaaagatttctcgttataacaaagtggtcaacattccaaacagtatgactattttggatgaacttctgcctatctcaattgagatggcaaagaggaacttgaagggaatctggaacttcacaaatccaggggttgtgagccacaatgagatccttgagatgtacagggattacattgacccaaacttcaagtggtctaacttcacccttgaagagcaagcaaaggtgattgttgctcctcgaagcaacaatgagatggacgcatcaaaattgaagacagaattcccagaattgctttccatcaaggaatcactcatcaaatatgtctttgagccaaacaagaaaacataagcaggtttatgttattcagacaaggcagttatgtgttcaggctatatagaccagtgaaattggattttctaaactaagttattgtaaaaaaaaaaaaactgatgaaagggaagaacatcattagatattgttgataaattccattactattagtacaccaaatgtggcaaatatgttctgctcatatgttatccattgacctttctcacctcatccgtatatattttttggacttgtg

SEQ ID NO: 12172 - DNA, 2296 bp, Castanea mollissima
ctcttgcaaatctctgtgagctatttatttaaactcttgcttgtcagaaaatttcattctctccctttttctctctctggcctgttctttcctaaacataattggtcttgatctgtagaaatttgacattgctttaagatggctacttatacccctaagaacatcctcatcactggggctgccgggttcattgcatcccatgttgccaaccggctgatccgtaactaccctgactacaagattgttgtgcttgacaagcttgattattgctcgaatctgaaaaacctcctaccctcaaaatcatctcctaatttcaagtttgtgaagggggatattggtagtgctgaccttgtcaacttcctcttaatcactgagtctattgacactataatgcactttgctgcccagacccatgttgacaactcatttggcaacagctttgagtttaccaagaacaatatctatggtacccacgtccttttggaagcctgcaaggtcactggccagatcaggaggttcatccatgtgagtacggatgaggtctatggggagacagatgaggatgcagttgtgggaaaccatgaggcttctcaactcctcccaacaaacccatattctgccacaaaagctggagcagaaatgcttgttatggcatatggtaggtcatatgggttacctgtgataacaacacgtgggaataacgtgtatggacccaatcagtttcccgaaaaattaattccaaagttcatcctcttggccatgcaagggaaacctcttccaattcatggggatggttctaatgtgaggagttatttgtattgtgaggatgttgctgaggctttcgaagtcattcttcataagggagaggttggtcatgtgtacaatatcgggacaaagaaggaaaggagagttattgatgtggccaaagatatatgcaggcttttctcgatggacccagagaaaagcatcaagtttgtggagaacagaccatttaatgaccagaggtactttctagatgatcagaagctgacaattctggggtggtcagagcaaactacatgggacgaggggctgaggaagactatggagtggtatattaacaatcctgattggtggggtgatgtctctggggcactgcttcctcatccaaggatgctgatgatgcctggtgggattgagagacactttgatgggtctgaagagggcaaatctgcatcttatgtctcaaataatacccggatgctggttccaccttccaaaagcattggctctcctcgaaaacattccctgaagttcttgatctatggtaggactggttggcttggtggtctgcttgggaagatatgtgagaaacaagggatttcattcgaatatggaagagggcgtctagaggatcgatcatcgctcttggcagatattcagaatgtgaagccaacccatgttttcaatgctgctggtgtgactggtagacccaatgtagattggtgtgagtctcacaaaaccgaaacaattcgtgcaaatgttgctggaaccttaaccttagcagatgtttgccgagagcatgggctattgatgatgaattttgctacaggatgcatatttgagtatgatgctgcacatcctgagggttctggcattggctttaaagaggaagataaacccaatttcattggttctttctattccaaaaccaaggctatggtcgaggagctgttgaaagaatatgacaatgtctgcaccctcagagttcggatgccaatatcatctgacctaagtaacccacggaacttcataaccaagatttctcgttacaacaaagtcgttaacattccaaacagcatgaccatcttggatgagcttcttcccatttcagttgagatggcgaagcggaacttgaggggtatatggaacttcacaaaccctggggttgtgagccataacgagattctggagatgtacaagcaatacattgaccccaacttcaagtgggctaacttcacacttgaggagcaagccaaggtgatagtggcccctcgaagcaacaatgagctggatgcgtcaaagttgaagaaagagttccccgagttgctatctatcaaggagtccctgattaagtacgtattcgaaccaaacaagaaaaactaagcagaataataagcagttttgagcggtagacctcagtattgacttctgcagtttgaactaggcttcatttttcagctttcttccctataaaacgttgattattccccccaattattattcattgttagcttcatatcataatattttccac

SEQ ID NO: 12173 - DNA, 2570 bp, Actinidia deliciosa
atacgtacacgcacatatatatatataggcacctcaaaactccccccttttctcgcaagtctttgtgctctgttatccgataatcattgctctgttcccaataatcattgcttgtccgaaaatctctctcgctctcgtcttctgcgtttgtttctccagtctcgttgtcttctctctcccggattgatcttggtctgaacccaattcaggttgctttaatatggctacgtatacccccaagaacattctcatcacgggggctgctggtttcatcgcatctcatgtcgctaaccggcttatccggaattaccctgaatacaagattgttgtgcttgacaagcttgattactgctcaaatcttaagaatctaactccttctcgatcatcccccaacttcaagtttgtcaagggagacattggcagtgctgatcttgtcaatttcctcctcatcactgaatccattgacaccataatgcactttgcagcccagactcatgttgataattcctttggtaatagctttgagttcacaaaaaacaacatttatggcacccatgtccttctagaggcatgcaaagtcaccggccaaatcagaaggttcatccatgtaagcacagacgaggtctatggagagacagacgaggatgccgtagtgggaaaccatgaagcttctcaacttcttcccaccaatccgtactccgcaacaaaagcaggagcagaaatgcttgttatggcgtatgggagatcatacgggttacctgtgataaccactcggggaaacaatgtttatggccctaaccaatttccagagaaactaatcccgaagtttatcctcttagccatgcaagggaagcctcttccgatccatggggatggttctaatgtgcggagttatctttattgcgaggatgttgctgaggcttttgaactcattcttcaccgtggagaagtcggtcacgtctacaatattgggacaaagaaggagaggagggtaattgatgtggccatggatacatgcaaactcttctcaatggatccatacacaagcatcaagtttgtagagaacaggccatttaatgaccagaggtactttcttgatgatgagaaattgaagaacttggggtggtcagaacgaactacgtggaatgaagggttgaagaagacgatggaatggtatattaataaccccgattggtggggagatgtctccggagcattgcttcctcatcccagaatgcttatgatgcctggtggaattgagagacattttgacgggaccgagaagtgcagtgatggatcctctaagtttttgagtgcctctaatcagaccaaaatggtggtaccagtttccaaaagcactggctctcctcgaaaaccgcccttcaaattcttgatttatggtaggaccgggtggattggtggtctactcgggaagttatgtgagaaacaaggaattccgtacgagtatggaagagggcgtctagaggatcggtcccaacttctggcagatattcagaatgttaagcccacccatgttttcaatgctgccggtgtgactggcagaccaaacgtcgattggtgtgaaactcataaaacagaaacaatacgtaccaatgtcgctggtacactaaacttggctgatgtttgcagagagcatggacttctgatgatgaatttcgccaccggatgtatatttgagtaccatgctgctcatcccgaaggttctagcattgggtataaggaggaagacaaacctaattttactggttctttctattcaaagaccaaggccatggttgaggagctggtgaaagaatatgacaacgtctgcaccctcagagtccgaatgcctatctcttcagacctcagcaatcctcgcaacttcattactaaaattagccgctataataaagtggtcaacattccaaacagcatgaccatcttggatgagcttctgcctatttcaatccagatggcaaagcggaacctcaggggcatatggaatttcacaaacccgggtgtcgtgagtcacaacgagattcttgagatgtacaaggagtatatcgatcccagcttcaagtgggtcaacttcacgctggaagagcaagccaaggtgattgttgccccccgaagcaacaacgagatggatgcttccaagttgaagaaggaatttcccgaattgctagctatcaaggagtcgttgatcaagtacgtgtttgaacccaacaagaaaaaagttcccgagtaagcattttagagctgtgaatctcagcgacgattatgcatttctcattatgcaatatggtttggattacatctactgcaacccatgccgatattcattctttaagctttattgcattcatgaatttagagagtgattaggatgggttcggaagatgttttcagtttagttatctagttagattttactaattttcatgagatttgtttctacaaggaactatgagtaggctctttatacattagttgccatcccccagcttgcagggtgctagtttcggattctggtatatgaatccgttggtggttaattccaatcataattg

SEQ ID NO: 12174 - DNA, 2592 bp, Quercus alba
ttcaattcttgcttgtctgaaaatttcattctctccctttctctttctctctctctctctggcctgttctttcctaaacaaaattggtcttgatctgtagaaatttggcattgctttaagatggctacttatacccctaagaacatcctcatcactggggctgccgggttcattgcatcccacgttgccaaccgactgatccgtaactaccctgactacaagattgtcgtgcttgacaagcttgattattgctcgaatctgaaaaacctcctaccctcaaaatcatctcctaatatcaagtttgtgaagggggatattggtagtgctgaccttgtcaacttcctcttaatcactgagtctattgacacgataatgcactttgctgcccagacccatgttgacaactcatttggcaacagctttgagtttaccaagaacaatatctatggtacccatgtccttttggaagcctgcaaggtcactggccagatcaggaggtttatccatgtgagtacggatgaggtctatggggagacagatgaggatgcagttgtgggaaaccatgaggcttctcaactcctcccaacaaacccatattctgccacaaaagctggagcagaaatgcttgttatggcatatggtaggtcatatgggttacctgtgataacaacacgtgggaataacgtgtatggacccaatcagtttcccgaaaaattaattccaaagttcatcctcttggccatgcaagggaaacctcttccaattcatggtgatggttctaatgtgaggagttatttgtattgtgaggatgttgctgaggctttcgaagtcattcttcataagggagaggttggtcatgtgtacaatatcgggacaaagaaggaaaggagagttattgatgtggccgaagatatttgtaggcttttctcgatggacccagagaaaagcatcaagtttgtggagaacagaccatttaatgaccagagatactttctagatgatcagaagctgacaatcttggggtggtcagagcaaactacgtgggacgaggggctgagaaagactatggagtggtatattaacaatcctgattggtggggcgatgtctctggggcactgcttcctcatccaagaatgctgatgatgccaggtgggattgagagacactttgatgggtctgaagagggcaaatctgcatcttatgtctcaaataatacccggatgctggttccaccttccaaaagcattggctctcctcgaaaacattccctgaagttcttgatctatggtaggactggttggcttggtggtctgcttgggaagatatgcgagaaacaagggatttcattcgaatatggaagagggcgtctagaggatcgatcatcgctcttggcagatattcagaatgtgaagccaacccatgttttcaatgctgctggtgtgactggtagacccaatgtagattggtgtgagtctcacaaaactgaaacaattcgtgcaaatgttgctggaaccttaaccttagcagatgtttgccgagagcatgggctattgatgatgaattttgctacaggatgcatatttgagtatgatgctgcacatcctgagggttctggcattggctttaaagaggaagataaacccaatttcattggttctttctattccaaaaccaaggctatggttgaggagctgttgaaagaatatgacaatgtctgcaccctcagagttcggatgccaatatcatctgacctaagtaacccacggaacttcataaccaagatttctcgttacaacaaagtcgttaacattccaaacagcatgaccatcttggatgagcttcttcccatctcagttgagatggcgaagcggaacttgaggggtatatggaacttcacaaaccctggggttgtaagccataacgagattctggagatgtacaagcaatacattgaccccaacttcaagtgggctaacttcacacttgaggagcaagccaaggtgatagtggcccctcgaagcaacaatgagatggatgcatcaaagttgaaaaaagagttccccgagttgctatctatcaaggagtccctgattaagtatgtattcgaaccaaacaagaaaaactaagcagaataagcagttttgagcggtagacctcagtattgacctctgcagtttgaactaggcttcatttttcagctttcttccctataaaaggttgatcattccccccaattattattcattgttagcttcatatcataatattttccactgttctaggaggccatgaggataattctattagttatggatcttttatttttaactttcccgtttgtattttagtttgcttggttactttcagcaaaggaacattctggtcaatagcttctttataatggatgtcatctactacaaacaagcctgagagtgtattaaatttgcagtctatgttatgaaatatgtgtggcctttaattctttaattactcaacttttttagtatccattcaataaaattatgcttgtattcttacgtactcagaatatccggaagaaagtcaatgaaggtgtttactcaattctacct

SEQ ID NO: 12175 - DNA, 2585 bp, Mimulus guttatus
agacgttgttggatactccttgcttatcgccactcaatcacctccccttttgtttgtctgaataaatttccctttttctttccgatttctcgttgaagattttttttatttttttttgaattattttctgattgctggtggatcctgatccgagtacgcgaaaacacgaactagagtacgatgtcgacattcacgcccaagaacatcctcattactggggcagctggattcattgcttcccatgttgcaaaccggctgattcgaaactaccccgagtacaagatcgttgtactcgacaaactcgattactgctccaatctcaaaaacctcctcccttccaaagcctcggcgaacttcaagttcgtcaagggtgacattggcagtgctgacctagtcaactaccttctcatcaccgagaacatcgacaccatcatgcactttgccgcccagacccatgttgacaattctttcggtaacagtttcgagttcaccaagaacaacatttacgggacccacgttcttttggaggcttgcaaagtcactggccagatcagaagatttatccacgtcagcacagacgaggtctatggagagaccgaggaggatgctgttgtgggaaatcacgaggcatctcagcttctgcccacgaatccttactcagccacgaaagctggtgctgaaatgcttgttatggcttatggtagatcttatgggttgcctgttattacaacccgaggaaacaacgtttacggtcctaatcagttccctgagaagttgattccaaaattcatccttttagccatggcggggaaaactcttccgattcacggtgatggttcgaacgtgcggagttacctgtactgtgaggatgtagcggaggcttttgaagtcgttcttcacaagggagaagtgggccatgtttacaacattggaacgaagaaggaaaggagggtcattgatgttgccgaagatatatgcaaactgttcaacatggatcctgagaagagcatcaagttcgtggagaataggccgtttaatgatcagaggtacttcctcgacgaccagaagctgaagaacattggctggtccgaaaagaccgcatgggaagagggtctgaaaaagaccatcgagtggtacagaagcaatcccgagtggtggggcgatgtgtctggtgcactgctcccccatccaagaatgctgatgatgccaggtggcatcgagaggcatttcgatggggctgagaagtacgaatctggtaaatctgaattcaccggagagtctaaacccaatcccgaaatcagcccatcgccacaaaaaccagcactgaagttcttgatctacggtaaaacagggtggatcggtggtttgctcggaaaactgtgcgagaaacaggggattgcgtatgaatatggaaaggggcgtcttcaagatcgctcgacacttttggctgacataaaatctgttaagccgacacatgtttttaatgctgctggagtaactggtcgaccaaatgttgattggtgtgagagtcacaaaaccgaaacaattcggaccaatgtcgttggcacattgaccttggcagatgtgtgtagagagcaaggcttactcatgatgaactacgccactgggtgtatattcgaatacgacgctgcacatccggaaggttccggtattggattcaaggaggaggacacccccaatttccacggatctttctattccaaaaccaaagccatggtggaagagctcttgaaagagtacgacaatgtctgcacattgagggttcgtatgccaatatcttcggacctgagcaacccgcgtaatttcatcacaaagatctcgaagtacaacaaggtggtgaatattcccaacagcatgacagttttggacgagctccttccgatttcgattgagatggcgaaaaggaatcttaggggaatatacaacttcacaaaccctggagttgtgagccacaacgagatcttggagatgtacaagcagtacatcgacccggatttcaagtacagcaacttcactctcgaagagcaagcaaaggtcatagtcgctgctagaagcaacaacgaaatggatgcctctaagttgaagaaagagttccccgagctgctttcgattaaagactcgttgatcaagatcgtattcgaacccaaccgtaaaacccctgctgcataagcgtttcttgattcgggtctacgtgtgcttttttaatttttaatatttttttttaatgtttttctttttttttagagaatatgctatgttgaggaaggtggttttgcaggatatgcccatttactttgaaattgtattattgtactgcactaaaaagaacatctctgcatgtggtttgtgacatgtttgttcttagatgtaataaattcttgtatttgtttagttaatttgtattcaatttaaggattattatttcttcaggatttattacttttgttcagtaattaatgaacctaaagagtcttgttaatgtaaatttcgaaagattaagacgattaatctttcctatataagcatgtatatatatatatatagatatatatatatgttttcag

SEQ ID NO: 12176 - DNA, 2579 bp, Cajanus cajan
cctcttctcattaacacacacaacacacccaaactagcaacgaatcttccaccttttccttattccattgttgtctcaaaactatattttcttcttcttcttcttcttcttcttcttctttgttctggattcgcttccattttaagttgcctaacatggcttcatataaaccaaagaatatcctcattactggggcagccggatttattgcgtctcatgttgccaatcggcttgtccggagttaccctgattacaaaattgttgtgcttgacaaacttgattattgttcaaatctgaagaacctccttccttctaattcatcccccaacttcaagtttgtgaagggggatattggtagtgctgatcttgttaactaccttctcatcactgagtccattgacactataatgcactttgctgctcaaacccatgttgacaactcctttggtaatagttttgagttcaccaagaacaacatatatggtactcatgttctattagaagcctgcaaggtaactggccagatcagaaggttcattcatgtgagtactgatgaggtctatggagagaccgaggaggatgctcttgtaggaaaccatgaggcttctcaacttcttcccacaaacccatactctgcaacaaaagctggggcagaaatgcttgtcatggcatatggtaggtcttatgggttaccagttatcacaactcgtggaaacaatgtttatgggccgaatcagtttcccgagaagttaatcccgaagttcatcctcctggctatgcagggaaagaatcttccaattcatggggatggttctaatgtgaggagttatttatattgtgaagatgttgcagaggcttttgaagttgtccttcacaagggagaggttggccatatttacaatattgggacaaagaaggaaaggagggttattgatgtagccaaagatatatgcagacttttcaaaatggactcagaaactagcataaaatttgtagagaacagaccatttaatgatcagagatactttcttgatgatcaaaagctgaaggacttgggttggtctgagaggaccacttgggaagaaggcttgaagaaaaccatggattggtacatcaataaccctgattggtggggcgatgtcaccggagcgctgcttcctcatccaaggatgctgatgatgcctggtggcatggagaggcatgccgacggatctggagagggaaaggctgcacctgttggctcatctaacaccaagatggttgttccatcgtccaagagcaccagctctcagcagaagcctccttttaagttcttgatctatggtagaacagggtggattgggggtttgctggggaaattgtgcgacaagcaaggaattccatatgaatatggaaagggtcgcctagaggatcgtgcttcactcttggctgatattcacaatgtgaagccaacacatgtttttaacgctgcaggagtgactggcagacccaatgttgattggtgtgaatcccacaaaaccgaaaccatccgggccaacgttgctggtaccttgacattggctgatgtctgcagagaaaatgggattttgatgataaattatgctaccggctgcatattcgagtacaatgcaacacaccctgaaggctctggcattggtttcaaggaggaagacaagcccaatttcattggctctttctattccaaaactaaagctatggtcgaggagctcttgaaagaatatgacaatgtatgcaccctcagggttcgcatgccaatttcgtctgatctgagcaacccacgcaacttcatcaccaagatttctcgttacaacaaggtagttaacattcccaacagtatgactattttggatgaactgcttcctatttcaattgagatggcaaagagaaacttgaagggaatctggaacttcacaaatcctggggttgtgagccacaatgagatccttgagatgtacagggattacattgaccccaaattcaagtgggctaacttcaccctcgaggagcaagcgaaggtgatcgtggctcctcgaagcaacaatgagatggatgcatccaagttgaagaaggaattcccagaattgctttccatcaaggaatcactcatcaaatatgtttttgagccaaacaagaaataagcagctttatgttaactaggcaaggaagtcgtgccttgaggctatatagatcacatattattccacatttagctccattcagttactgtgtgtagagtgtggctagtattacaattggtttaggtttgttttccaggtcttcatttcttcatatatattcaagtgtcctttggtaatagcagcagctttagttacatgttttgtcatctacaagcctgtgatgggcaacttttgcaccctgcaagggctgtattcttttattgctcatctagaatgaaaattttaaataattggttacattattgagatgtacttgaataattatctgtaatatagaatgaaaatctttgaataagagaaattatttgttatttttggagtaaaagaaatggtgttcacttcactgatcttgtttaaggt

SEQ ID NO: 12177 - DNA, 2497 bp, Glycine max
atatgtacgatttcgcagctctaccctcttctcgttaacacacacagaagtgaaaaagttgcctgatatggcttcatataccccaaagaatatccttattactggggctgctggatttattgcgtctcatgttgccaaccggcttgtccggagctaccctgactacaaaattgtcgtgcttgacaaacttgattattgttctaatctaaagaatctccttccttcaaaatcatcccccaacttcaagtttgtgaagggggatattggtagtgctgatcttgttaactaccttctcatcactgagtccattgacactataatgcactttgctgcccaaacccatgttgacaactcgtttggaaatagctttgagttcaccaagaacaacatatatggaacccatgtcctattagaagcctgcaaggtaactggccagatcagaaggttcattcatgtgagcaccgatgaggtctatggagagacggaagaggatgctgttgttggaaaccatgaggcttctcaacttcttcccacaaacccatactctgccacaaaagctggggctgaaatgcttgtcatggcttatggtaggtcatatgggttacctgttattacaactcgtggaaacaatgtttatgggcccaaccagtttcctgagaagttgattccaaagttcatcctcctggctatgcagggaaagaatcttccaattcatggggatggttcaaatgtgaggagttatttatattgtgaagatgttgcagaggcttttgaagttgtccttcacaagggagaggttggtcatgtttacaatatcgggacaaagaaggaaaggagagttatcgatgtagccaaagatatatgcagacttttctctatggacccagaaatttgtataaaatttgtagagaacagaccatttaatgaccagagatactttcttgatgatcaaaagctgaaggacttgggttggtctgagaggaccacttgggaagaaggcttgaagaaaaccatggattggtatattaataaccctgattggtggggtgatgtcactggggcattgcttcctcatcctaggatgctgatgatgcctggcgggttggataggcattttgagggatctgaagaggaaaaacctgcatcttttggctcaagtaataccaggatggtggttccaccgtccaagaacaccagctctcaacataaacatccttttaagttcttgatctatggtagaacagggtggattgggggtttgcttgggaaattgtgtgaaaagcaaggaattccatacgaatatggaaagggtcgcctagaggaccgctcctcactcatggctgatcttcagaatgtgaagccgacacatgtttttaatgctgcaggagtgactggcagacccaatgttgattggtgtgaatcccataaaacagaaaccatccgcaccaatgttgttggcaccttaacaatggctgatgtctgcagagagcatgggatcttgatggttaattatgctactgggtgcatatttgagtataatgcaacacatcctgaaggctctggcattggttttaaggaggaagacaagcccaatttcattggctctttctattccaaaactaaagctatggttgaggagctcttgagagaatatgacaatgtatgcacactcagggttcgcatgccaatttcatctgacctgagcaacccacgcaacttcataacgaagatttctcgttataacaaagtagtcaacattccaaacagtatgactattttggatgaacttctgcctatctcaattgagatggcaaagaggaacttgaggggaatctggaacttcacaaatccaggggttgtgagccacaatgagatccttgagatgtacagggattacattgaccccaacttcaagtgggctaacttcacccttgaagagcaagcgaaggtgatcgttgctcctcgaagcaacaacgagatggatgcatccaaattgaagacggaattcccagaattgctttccatcaaggaatcactcatcaaatatgtctttgagccaaacaagaaaacataagcagctttatgttatttagacaaggctgttatgtgttcaggctatatagatcactgactcattatttcactattagctcctttcagttactgtgtagagtgtggctagtattacaattgggttaggtatgttccctaagtcttcaactctgcagttttattcatgtgtcctctggtaatggcaatggtagctttagatagatgtcttgttatctacaagcttctgatgggcaacttttgcaccgtgcaagggctgtattcttttattgctcatctagaatgaaaatttaaaataatttgttaccatattgagatgtacttggatatttatctgtaatatagaatgaaatctttgaaaagagaaattatgttatttttaaactaataaaatgataatgttaatttcattggtcttatttaacgt

SEQ ID NO: 12178 - DNA, 2500 bp, Daucus carota
gatatgtaggaaaaggagtataggtatggttagcttataaataaggggcaattacgattgtctctcctcacgtttcgctgtgctgagagttgctcttgcctcctcctcctccctcattatcttctcctctgctttcaaagtcttttctgcgtctcccttcattcctacattcattcctaattttggtttgagatggctaattatactcccaagaatatcctgattacgggagctgctggcttcattgcttctcatgtggctaatcgtcttgttcggagctaccctgagtacaagatcgttgtgctcgataagcttgattactgctccaatcttaagaatcttaatccctctcgtactgctcccaactttaagtttgtcaagggagatattggaagtgctgatctcgtcaactatcttttgatcactgagtcgattgatactattatgcactttgctgctcagacccatgttgataactcttttggtaacagttttgagttcaccaagaacaacatttatggtactcatgtgcttttagaagcctgcaaagtgactggacagatcaggcggttcatccatgttagcacggatgaggtctatggggagacagatgaggatgctgttgtgggtaatcacgaagcttcacaactccttccgacgaatccttattctgccactaaagctggggctgagatgcttgtcatggcttacggcaggtcatatggtttacctgttattacaacccggggtaataatgtctatggtcctaatcagtttccagaaaagttgatcccaaagttcatccttttagccatgaggggaatgcaacttcctattcatggggatggtgccaatgtgcgcagttatctctactgcgaggatgttgctgaggcctttgaggttgttcttcacaagggagaagttggccatgtttataatattgggacaaagaaggaaaggagagttactgatgttgccagagacatctgtaaacttttttctgtggacccagaaacaaatattaactatgtagagaacaggccattcaatgatcagaggtatttcctagatgatcagaagttgaaaaacttgggctgggctgagcgcactacatgggaagaagggctaaaaaagactatggactggtacactagcaaccctgattggtggggagatgtatctggagcattgcttcctcatccaagaatgctgatgatgcctggtggaattgagagacactttgacggatctgaaaaccgtgacgctgaatcaacccgtttcgtggataaatctgccccatcacaggtttcttcctcagatcccaaaagcacagtgcctcagaaattagctcttaagtttttaatttatggtaggactgggtggattggtggtctgctcggaaaattatgtgaaaaacaaggtattccatatgaatatggaagggggcgcctagagtatcgatcacagctagtgtctgatctccagatagttaaacccacacatgtttttaatgctgctggtgtgactggtagacccaatgtcgattggtgcgagtcccacaaaacagaaaccattcgtacaaatgtcacgggtacactgacactagctgatgtatgcagagagcaaggacttctgatgattaattttgctactggatgcatatttgagtatgatgctgcacacccagaaggttctggcattgggttcaaagaagaagacacacccaattttcatggatcattctattcaaagacaaaggccatggttgaagaactcttgaaagagtttgacaatgtttgcaccctcagagttcggatgcccatatcatcagacctcagcaacccccgcaacttcatcacaaagattagtcgttataataaggtggttaatattcccaacagcatgacagtcttggatgagttgctacctatctcaatcgagatggccaagaggaaccttaaaggtatatggaacttcaccaaccctggagtcgtaagccacaatgagattttggagatgtacaagcaatatatcgacccatcttttaaatactcaaacttcacactagaggagcaagccaaagtaattgtagcagctagaagcaataatgagatggatggggcgaagttgaaggccgagttccctgagttgctgtcaatcaaggaatcattgatcaagtatgtttttgaacccaacaaaaaagtttagctgctggttgagcactgtagaatagtaaacttcaggcgacctctacagtcttgatttaccttactattattaccctgaggtcattattactgtcatagtagatttcctgctgattcctgtgttttcttaatattgttataatatatttccttttacaaacaaatacccgtccgtgtttagaagttcttggtttataggtgttcctccacatatgttttcttcttcaagccaccgctacttttgtaatatgtgattctgttacagttcatttatatcagtattcctttatttc

SEQ ID NO: 12179 - DNA, 2403 bp, Daucus carota
tatatatataaacatagaacaagtgtccggattcgcataggtggtctcttttatttcttttccgagtttgtatttgctgcgttgatcattttagaattcgttcgatatgactagttatactcctaaaaatatccttataactggagctgctggcttcattgcatctcatgttgctaatcgtctcgttcggagctaccctgattacaagattgttgtgcttgataagcttgactactgttcaaatctgaagaaccttaatccatctcggtcagctccaaacttcaaatttgtcaagggtgatattggcagtgctgatcttgtcaactaccttctcatcaccgagtccattgatactattatgcactttgctgcccagacccatgttgataattcttttggtaacagctttgagtttaccaagaacaacatttatggcactcacgtgcttttagaagcctgcaaagtgactggacaaatcagaaggtttatccatgtaagtacagatgaggtctatggcgagacagaagaggatgctgttgtgggtaatcatgaagcttcgcaactcctccctaccaatccatattcagccacaaaagctggggcggaaatgcttgttatggcttatggcaggtcatacggcctacctgttataacaactcggggcaataatgtgtatggtcctaatcagtttccggaaaaattgattccaaagttcatccttttagccatgaggggaatgcaacttcctattcatggggatggtgccaatgtgcgcagttatctctactgcgaggatgttgctgaggcctttgaggttgttcttcacaagggagaagttggccatgtttataatattgggacaaagaaggaaaggagagttactgatgttgccagagacatctgtaaacttttttctgtggacccagaaacaaatattaactatgtagagaacaggccattcaatgatcagaggtatttcctagatgatcagaagttgaaaaacttgggctgggctgagcgcactacatgggaagaagggctaaaaaagactatggactggtacactagcaaccctgattggtggggagatgtatctggagcattgcttcctcatccaagaatgctgatgatgcctggtggaattgagagacactttgacggatctgaaaaccgtgacgctgaatcaacccgtttcgtggataaatctgccccatcacaggtttcttcctcagatcccaaaagcacagtccctcagaaattagctcttaagtttttaatttatggtaggactgggtggattggtggtctgctcggaaaattatgtgaaaaacaaggtattccatatgaatatggaagggggcgcctagagtatcgatcacagctagtgtctgatctccagatagttaaacccacacatgttttcaatgctgctggtgtgactggtagacccaatgtcgattggtgtgaatcccacaaaactgaaacaattcgtacgaatgttgttggcacactgaatttagcagatatatgcagagagcagggacttctgatgattaattttgctactggatgcatattcgagtatgatgctgcacaccctgaaggttctggcattggattcaaagaagaggacacacccaactttcatgggtcattctattcaaagacgaaggccatggttgaagaactcttgaaagagtatgacaatgtctgcacgctccgagttcggatgcccatatcatcagacctcagcaacccacgcaacttcatcacaaagattagtcgttataataaggtggttaatattcccaacagcatgacagtcttggatgagttgctacctatctcaatcgagatggccaagaggaaccttaaaggtatatggaacttcaccaaccctggagtcgtaagccacaatgagattttggagatgtacaagcaatatatcgacccatcttttaaatactcaaacttcacactagaggagcaagccaaagtaattgtagcagctagaagcaataatgagatggatggggcgaagttgaaggccgagttccctgagttgctgtcaatcaaggaatcattgatcaagtatgtttttgaacccaacaaaaaagtttagctgctggttgagcactgtagaatagtaaacttcaggcgacctctacagtcttgatttaccttactattattaccctgaggtcattattactgtcatagtagatttcctgctgattcctgtgttttcttaatattgttataatatatttccttttacaaacaaatacccgtccgtgtttagaagttcttggtttataggtgttcctccacatatgttttcttcttcaagccaccgctacttttgtaatatgtgattctgttacagttcatttatatcagtat

SEQ ID NO: 12180 - DNA, 2421 bp, Chrysanthemum coronarium
tcttccgatctaaaaaacacacacacatatatatctcgtgatcttaatcatcatctcctttcccttgattcagttctacatccaggatggctacttacacgccaaagaatatcttaatcaccggggctgctggcttcattgcctctcatgtcgctaatcgcctcatcagaagctaccctgattacaagattgttgtcctcgacaagcttgattattgctccagtcttaagaaccttaacccgtctagatcatcgcctaactttaagtttgttaagggtgatatcgggagtgctgatctagtcaactaccttctgatcactgagtctattgatacgattatgcactttgctgcacagactcatgttgataactcatttggcaacagttttgagttcacgaagaataacatctatggtactcatgtgcttctcgaggcgtgtaaggtcactggtcagattagaaggtttattcatgtgagtacggatgaggtttatggggaaaccgaggaggatgctattgttggtaaccatgaggcttcgcaacttcttcctacaaacccgtattcagccacaaaagctggtgcggaaatgcttgttatggcttatggtagatcatacgggttgcctgtgatcacgactagaggaaacaatgtttatggcccaaaccagttcccagaaaaactaatcccgaagtttattcttttggctatgcaaggaaagccacttccgattcacggtgatggttctaatgtaaggagttacctctactgtgaggacgttgctgaggcgtttgaagtgattcttcacaagggtgaagtcggtcatgtttacaacatcgggacgaaaagggagaggagagttattgatgttgcaaaggatatgtgcaagcttttcaatatggatgctgatgcaagcatcaagtttgttgaaaaccgaccctttaatgatcagaggtactttttggatgacgagaagttgaagagcttgggttggtctgagagaacccgatgggaagagggtctgaagaagaccatcgagtggtacacaagcaatcctaattggtggggcgatgtctctggagcgctgcttcctcatccaaggatgttgatgatgcctggtggagttgatcgacttgctgatggacccgatcacactgaatttgatgcatctgacccagcaatcaacactgcacagatcggagtgcaagttccctcaaagaccagtagcaacgctcctaaaaaaccagcattgaagttcctcatctatggtaagacagggtggatcggtggtttacttgggaaactgtgtgagaaacaagggattcaatacgagtatggaaaaggtcgtttggaagaccgctctcagcttttgtctgatattcagactattaaacctactcatgttttcaatgctgctggtgtcactggcagacctaatgtcgattggtgtgaatctcacaagacggaaactattcgtgtcaatgtgtgtggcacattgaacctagctgatgtctgcagagaacaaggtctcttaatgatcaatttcgctactggatgcatttttgagtatgatgctaaacaccctgagggttctggtatcggttttaaggaagaagacacgcccaacttcaccgggtcgttttattcaaagaccaaagctatggttgaggagctcttgaaagaatatgacaatgtctgcacacttcgagtccgaatgccaatatcatcagacctcaacaacccacgaaacttcatcactaagattgctcgttacaataaagttgtgaacatacccaacagcatgacaatcttggatgagcttttaccaatttcaatcgaaatggcaaagagaaacctaaagggaatctggaacttcacaaatcctggggttgtaagccacaacgagattcttgaaatgtacaaaaagtacataaacccggaattcaaatggcagaacttcacactggaagaacaagcgttagtgatagtggcgccacgaagcaataacgaattagatgcatcaaagttgaagaaagagttccctgagttgctttcaatcaaggactcattgatcaagtacgtattcgaacccaacaaaaaacagtaataatgattcttttttagcatttgtaaactccagattcacttgtgttctcgttacttactagttactgtatggtttggattatacatctgtaatgttttaagtcaaaagtcaaagacagcgagtcagtcgacggcagttatctaccacatttgttctagtctttgtttccgagtatgatcacactgagattatagggggccatttgtctaggtattttatattcatcatattccgttacaacctttgtttaacagttgttacgaatattttccctttagttatgttaaaaaaaccgcacgcagggttgtaatatcgg

SEQ ID NO: 12181 - DNA, 2844 bp, Echinacea purpurea
cggccgggggactcgcaaaccacataatcccccaacaaaccttagacatgtatatatatccctgtttatatatcgatcaaggcgtcggttgcactcctcgagtctcgcgagaaatttcgtgatctctttctcaaatcacctttctggtcgagatctttctctctctcatacgcataatctgccatttatcccgatccggattacaatttctctccggtatggctacatacgtaccaaagaacatccttatcactggagctgcgggcttcattgcctctcatgttgctaatcggctgatcagaaactaccctgattacaagattgttgtgcttgacaagcttgactattgttccaatctcaagaacctcaacccttccaaatcctctcccaacttcaagtttgttaagggggacatcgggagtgctgacctcgtcaactacctcctgatcactgagtctattgataccattatgcactttgctgcacagactcatgttgataactcatttggcaacagttttgagttcacaaagaataacatctatggaacccatgtgcttctagaagcctgcaaagtcactggccagatcagaaggtttattcatgtgagcacagatgaggtttatggagaaacagaggaggatgctgttgtcggtaaccatgaagcttcacaacttcttcctacaaacccgtattcagccacaaaagctggggcagaaatgcttgttatggcttacggtaggtcatacgggttgcctgtgattaccaccagaggaaacaatgtttatggcccgaaccaattcccagaaaaactaatcccgaagttcattcttctggcgatgagaggacaaccacttccaattcatggtgatggttcaaatgtaaggagttacctctactgtgaagacgttgctgaggcgtttgaagtaattcttcacaaaggagaagttggtcatgtctacaacatagggaccaaaaaggaaaggagagtgatcgatgttgcaaaagatatgtgcaagcttttcaatatgaatcctgattcaagcatcaagttcgtggagaacagaccgtttaatgatcagaggtattttttggatgatgagaaattgaagagcttgggttggtctgaaaggaccacatgggaagagggtctgaaaaagaccattgagtggtacaccagcaaccctaactggtggggagatgtctctggagcacttctgcctcatccaagaatgttaatgatgccaggtggcgttgatagacttgtggacgggcctgaaaatgctgagtttgattcagctgatgtggcaatcaatacttctcagatcggagtccagattcctagctcaaaagcctgtggtatttctgctaaaaaaccagctttgaagtttctcatttatgggaaaacagggtggattggtggtttacttgggaaattatgtgaaaaacaacaaattccgtacgagtatggaagaggtcgtttggaagaccgttcacaacttctggctgatattcaaactatcaaaccgactcatgttttcaatgctgctggtgtcactggtagaccaaatgttgattggtgtgaatctcacaggacagaaaccattcgtaccaatgtttcgggcacactaaatctagcagacgtctgtagagaacatggtctcttgatgatcaattttgctactgggtgcatctttgagtatgatgctaaacacccggaaggttctggaatcgggtttaaggaagaagatacacccaatttcatcgggtcattctattcaaaaaccaaagctatggtggaggagcttttgaaagaatatgacaatgtgtgcactcttagagtccgaatgccgatatcatccgacctcaacaacccacgcaactttatcaccaagattgctcgttatgataaagttgtgaacatacccaatagcatgacaatcttggatgagctattaccaatttctatcgagatggcaaagaggaatctgaggggaatctggaacttcacaaatcccggggtcgtaagccacaacgagatactcgaaatgtacaagaagtacataaaccctgaattcaagtgggtaaatttcacactggaagaacaagcaaaggtgattgtggccccacgaagcaataacgagttggatgcatcaaagttgaagaaagagttccccgagctgctatcgatcaaggagtcattgatcaagtacgtattcgaaccaaacaaaaagcagtaaaaatgatatgatgatgattctttatagaatttgtagaactcaagattcacttgtgtttggttacttgctagtttggtttggattatacatctgtaatgtttaaagtcatattcgttctagtgtttgtttcctagcatcatcacacaaagcttataggaggtgaggccgattctctaggcgtattttatattcatcattttgtctacggtcagtttcggataatttctgttcagttttattagaaaccgcgcgcaggcttgtactattggattctctatgatatttgttatatcttcatttcttgaccatagattgtttgtttgaaatcttcatgtcatgtttgagaaacaagtattgttgtgaagatgtatacactgaatacacaatttgagatgggacagctaacgtgccagttgtgaccagcaaatggcttactcacatggtccatttgacagacagttaccctgcttagcttttatggttcacacgggatcagagctgtcctttatgttttaagagccggtaggaccttttgtggaactgtacatgttgatatttaaactccaacatcgaaaagtcttgacaaatcagtcggagtgtcaat

SEQ ID NO: 12182 - DNA, 2617 bp, Artemisia annua
ggaggcaaggggtagcaattaaagcacaaataacgagtataaatacacatttgcgtatttcgatctaagcgtcatttgctactccccccgcaacataacacaaaataacacatttctcgtgatccgatcaccaccaccacgaccacctttctggtctcatctcctttctcttgattcaattctacatccgggatggctacttacacgccaaagaacatcttaatcactggggctgctggcttcattgcctcacatgtcgccaatcgcctcatcagaagctaccctgattacaagattgttgtccttgacaagcttgattattgttcaaatcttaagaaccttaacccgtcaagatcatctcctaactttaagtttgtcaagggtgatatcgggagtgctgatctagtcaactaccttctgatcactgagtctattgatacgattatgcactttgctgcacagactcatgtcgataactcatttggcaacagttttgagttcaccaagaataacatctatggtactcatgtgcttctcgaggcgtgtaaggtcactggtcagattagaaggtttattcatgtgagtacggatgaggtttatggggaaaccgaggaggatgctattgttggtaaccatgaagcttcacaacttcttcctacaaacccgtattcagccacaaaagctggtgcggaaatgcttgttatggcgtatggtaggtcatacgggctgcctgtgatcaccacacgaggaaacaatgtttatggcccaaaccagttcccagaaaaactaatcccgaagtttattcttttggctatgcaaggaaagccacttccgattcacggtgatggttctaatgtaaggagttacctctactgtgaggacgttgctgaggcgtttgaagtgattcttcacaagggtgaagtcggtcatgtttacaacatcgggacgaaaagggagaggagagttattgatgttgccaaagatatgtgcaagcttttcaatatggatgctgatgcaagcatcaagtttgttgaaaaccgaccctttaatgatcagaggtactttttggatgacgaaaagttgaagagcttgggttggtctgagagaaccagatgggaagagggtctgaagaagaccatcgagtggtacacaagcaatcctaattggtggggcgatgtctctggagcgctgcttcctcatccaaggatgttgatgatgcctggtggagttgatcgacttgctgatggacccgatcactctgaatttgatgcagctggtccagcaatcaacactgcacagatcggagtgcaagttccctcaaagaccagtagcaacgctgcaaaaaaaccagcattgaagttcctcatctatggtaagacagggtggatcggtggtttacttgggaaactgtgtgagaaacaagggattcaatacgagtatggaaaaggtcgtttggaagaccgctctcagcttttgtctgatattcagactattaaacctactcatgttttcaatgctgctggtgtcactggcagacctaatgtcgattggtgtgaatctcacaagacggaaactattcgtgtcaatgtgtgtggcacattgaacctagctgatgtctgcagagaacaaggtctcttaatgatcaatttcgctactggatgcatttttgagtatgatgctaaacaccctgagggttctggtatcggttttaaggaagaagacacgcccaacttcaccgggtccttttattcaaagaccaaagctatggttgaggagctcttgaaagaatatgacaatgtctgcacacttcgagtccgaatgccgatatcatcagaccttaacaacccacgaaacttcatcactaagattgctcgttacaataaagttgtgaacatacccaacagcatgacaatcttggatgaacttctaccaatttcaatcgaaatggcaaagagaaacctaaagggaatctggaacttcacaaatcctggggttgtaagccacaacgagattcttgaaatgtacaaaaagtacataaacccggaattcaaatggcagaacttcacactggaagaacaagcgttagtgatcgtggcgccacgaagcaataacgaattagatgcatcaaagttgaagaaagagttccctgagttgctttcaatcaaggagtcattgatcaagtacgtattcgaacccaacaaaaaacagtaataatgattcttttttagcatttgtaaactccagattcacttgtgttctcgttacttactagttactgtatggtttggattatacatctataatgtttaagtcaaagtcaaagacagtgagtcagtcgacggcagttatcataccatgtttgttctagtctttgtttcctagcatgatcacactgagattatagggggccatttgtctaggtattttatattcatcatattcctttgcaaccaacatttgtttaacagttgttacgaatattttccctttagttatgttaaaaaaaccgcacgcggggttgtaatatcggattctctataagattttttatattgttattacttggtgacagacactgcgtctgaaatctctatctttctgtccaaactacagtgct

SEQ ID NO: 12183 - DNA, 4573 bp, Musa acuminata
gttcttgtcatgtgatcgttggatctctcctccctccgtcacctcctcaaatctctccatcatctcttaacgcctcgttaattagctccctcatctccctgctcacgcgataaatcctccccttcttgtcggtcgccggttcccattcatcacctccgcgttggtcagggtatcacagccatcccgcattctcgattccctttcttcctccccttcgctcgttctcttgtcggaagaaggcttccctcttcccctccttccgctcccgatcacagtttagtttatagatggcgacgtacaaacccaaaaacatcctcattacaggggcggcaggcttcattgcgtcccatgttgccaaccgcctcgtttggaactaccccgagtacaagatcgtggttctcgacaagcttgattactgctccaacctgaagaacctcaacctgtcgcgctcctctccgaacttcaagtttgtcaagggtgatattgggagcgccgacctcgtcaactacctcctcatcaccgagtcgattgataccatcatgcattttgcagcccagacccatgttgataattcttttggtaactcctttgagttcaccaagaacaacatatatggcacccacgtcctcctggaggcctgcaaggtcactggtcagattaagaggtttatccatgttagcaccgatgaggtctacggagagactgatgaggacgctgtggttggcaaccacgaggcatctcaacttctgccaaccaacccatactcggcaacaaaggctggggctgagatgcttgttatggcttatggaaggtcatatggcttgcctgtgatcactacccgaggaaacaatgtgtatgggccaaatcaattccctgagaagatgatcccaaaatttattctcttggccatgagagggcagccacttccaattcacggtgatggctcaaatgtgagaagctatttgtactctgaagatgttgcagaggcttttgaggtcatcctccacagaggagaagttgggcatgtttataatatcggcacaaagagagaaaggagagtgattgatgtggcgagggacatctgtgcacttttttcactagacccagttaaggttattcagtttgtggagaatcgacctttcaatgaccagaggtactttttggatgatcagaagctgaagaacctgggatggtcggagcggactgcatgggatgatggactcaagaagacgatggagtggtatatgagccatccagattggtggggagatgtttcaggagcacttttacctcatccacggatgttgatgatgcctggtattgaaaggcatactgatgggtctgaagaaaccaagtccatgtcttcgcagtcaacgaccactaatagtcagaaccggatggtggttcctgctgcaagaagcagtgtggtacctcctaagaaaccatatttgaagttcttgatatacggtaggactggatggatagggggccttcttggcaagatatgcgagaagcaggggataccatacgagtatggaaggggtcgtttggaagagcgttcccatctcatacttgacattcagaatgtgaagccaactcatgttttcaatgctgctggtgtgactggtagacctaatgttgactggtgcgaatctcataagcaggagacaattcgcacgaatgttgtgggaactctgaatttagcagatgtctgtagggatcatgacctgttactgatgaattatgctaccggttgtattttcgagtatgatgctaaacatcctgaagggtcgggcattggattcaaggaggaagagaagccaaactttattggatccttctattcaaaaactaaagcaatggttgaagagcttttgagggaatatgagaatgtctgtacccttagagttcgaatgccaatatcttctgatcttagcaatccacgtaacttcattaccaaaatcgctcgttatgacaaagttgtgaacattccaaatagcatgacggttttagacgaacttctccccatttcaattgagatggcaaagagaaattgcagaggaatatggaactttaccaatcctggtgtggtgagccacaatgagatcctagagatgtacaggagctacattgatcccagttttaagtggaccaattttacattggaagaacaggctaaagtcatagttgcacctcgaagcaacaatgagatggatgctacaaaattaaagagagagtttcctgagttgttgtccatcaaagattctctcatcaagtttgtttttgagccaaacaagaaggtcctttctcactgataggcttcctcaatgtcacagtttccctagactttggaactaagcagttgacccttagtcttttaatcattaatgtcatccaatactttgcagtatgactatcataatacaaactctgcatcaggaatacttttttctaggcgggaggaaaaacctgattaattttattaggtagtctgcctcgttcttgtttaggttctttacaagaggctattattatttgtcttctaaatttgtactgtccactctatgtggcatgtagtagcttcattctgttaatgcatccatttattgtttacattctgcattctatttgtcattttttttcttcttctactttgataatatttctatggaatctatctttcgatctttgtgcgcaatggagtccaaatcatggatatccagtttgattatttttttgattgtgtacattttgtttattattttgaatcattttttactagttgatcctggtgaattgccaagtaggcatggagctaatcttcaggaaggcaccaagttgcctttcagtaacaggaactctgttttgacaagaggttgacattggatgttactgtgagatctcagtcgtcatcagcacaagcactgacatgtcgtgatcgtgggattggacggtgggctacgagggggagaagggagaggagggctcgactatcgactgtcgagggggagttctttattaaattaaaggaaatatgaatactatctatctctaaaatataaaaacatgaacaccttccaaaaaagctaaaaaagaagagattttgaataaaaattatcctttttactatgcattatatatatataaataaaatctccatcgaagaaggcaaccgatgataaatatattgttgaaagaaatctgctgaacttctcaagtttccattagaaaatatcagactggaggagaatgacttcattcccccgtagtcgaggcagcaacagcgcaattcacacctgacaggttcgtggatgaaaggattgagccgtgtttggctctctttctcgtcccaataaggcttttaatgatgaacgaacgaaccaagaagttgatcgcgccttttccagaagatggcgagaagcgtgcttctgatgggacgcacgtgcttcgcatgtgattgtttagaggttcctttcacctcctcaaatatgttcttatctctttaaccgcctcattaatcacatttctcatcgccgctctgcattccccccgttccttttctcatcgccgcttcgcatccggtgggacttactcgttctcctgtcggaataagccttccccgttcctccctcctcctgctcaccatctcgcagttcagtctgtagatggcgccgacgtacaaacccaaaaacatactcataaccggagcggcaggcttcattgcgtcccatgtcgccaaccgcctcgtttgtaactacccccagtacaagatcgtggttctcgacaagcttgattactgctccaacctcaataacctcaacccatcacgctcctctcccaacttcaagtttgtcgaggatgatattaggagcgctgacctcatcaacgacctcctgatcaccgaatcgattgataccatcatgcattttgcagcccagacccatgttgataattcttttggtaactcctttgagttcaccaagaacaacatctacggcacccacgttctcctggatgcctgcaacgtcactggtcgggttaggaggtttatctatgttagcactgatgaggtctatggagagacagatgaggatgccacggttggcaaacacgaggggtctcaacttctgccaaccaacccatactcggcaacaaaagccggggctgagatgcttgttatggcttatggaaagtcatacggcttgcctgtgatcactacccgaggaaacaatgtgtatgggccatttcaatttccggagaagctgatcccaaaatttattcttttggccatgagagggcagccacttccgatttacggtgatggctccaatgctagaagctttttgtactgtgaggatgttgcagaggcttttgatgtcatcctccacaaaggagaagttgggcatgtttataatatcggcacaaagatagaaaggagagtgattgatgtggcgaaggacatctgtgcacttttttcactagacccagataaggtcattcagtttgtggagaatcggcctttcaatgaccagaggtactttttggattatcagaagctgaagaacctgggatg

SEQ ID NO: 12184 - DNA, 2433 bp, Eschscholzia californica
ctttctctctctctctttatttctcttgaacatataaattccgtttcccaccttcataatattttccttccaaatcactcagatctggatctaccattaggcgtataaggatggcgaattacacacctaaaaacattctcatcactggagctgctggcttcattgcatcacatgtagcgaatcggctcatcaggagctatcctgactacaagattgttgttcttgacaaacttgattactgttcgaatctgaagaatttgcttccatcccgttcgtcagccaacttcaagtttgtcaagggagatattggaagtgctgaccttgttaactaccttctcattaccgagtctatcgacacaattatgcacttcgctgcccaaacccatgttgataactcgtttggtaacagcttcgagtttacgaagaacaatatctatggaacccatgttcttcttgaagcttgtaaggttaccggccagattagaaggttcatccatgtgagcacagatgaggtttatggtgaaacagatgaagatgctgttgtgggaaatcacgaggcttctcagctcctaccaacaaacccatattctgcaactaaggctggtgcagaaatgcttgtgatggcatacggaagatcatatggtctcccagtgataacaaccagaggaaacaatgtttatgggcctaatcagtttcccgagaaattaatcccaaagctcattctcttggcaatgaaagggaaggatcttcctattcacggagacggatctaatgtccggagctatctttactgtgaggatgtagctgaggcttttgaggttattcttcacaaaggagaaattggccatgtttacaacattggcacgacaaaggaaaggagggtgattgatgtagcaaaggatgtctgcaaacttttctctctcgatgctgagtctgttattaagtttgttgagaacaggccattcaacgatcaaaggtacttcttggatgatcagaagctgaagatcctcggttggtcagaacgaacttcgtgggaagaagggctaaaaaagacaatggagtggtatgtaaacaatcctgattggtggggtgatgtttctggagctctattgcctcatccaagaatgctaatgatgcctgggaatgaaagatattgtgatgggtctgaagatggcaatgctatatcttctaatgggagcaatcctacccagaacaagatggttactccagctccaaaatcaaccaactcgcctcgctcaaagccatctttgaagtttttgatatatggtaggactggctggattgggggtcttcttggaaagatctgtgagaaacagggaatactctacgagtacggaaaagggcgcctggaagaaagatcacagcttatagctgatattcaaaacatcaaacctactcatgtctttaatgctgcaggtgtgactggtcgacctaatgtcgactggtgcgagtctcacaaaccagagacaatccgtgccaatgttgctggtacattaaatttggcagatgtttgtagggaacatggattattgatgatgaacttcgctactggttgtatatttgagtatgatgctgctcacccagaagggtcaggtatcggattcaaggaagaagacacacccaatttcgctggttctttctattcaaagaccaaagctatggttgaagagctattgaaggaatacgacaatgtctgcacacttagagtccgaatgccgatttcttcagaccttaacaacccacgaaacttcattacaaagattagccgatacaacaaggtggttaacattccaaacagcatgacaatcctcgacgaacttcttcctattgcagttgagatggctaaacgtaatctacgaggtatatggaactttacaaacccgggtgtggtaagtcacaacgagatcttagagatgtacaagaactatatagactcggactttaagtggggaaacttcactatcgaagaacaggctaaggtaatcgttgcagcacgaagcaataacgaaatggatgcttccaaattaaagaaagagttccccgagttattaccgatcaaggagtctctaatcaagtacgtctttgaacccaacaagagaacttagatcgacggtattacagaataaacaacttattttgggttttcctgttgaagggttatattattacgtataatttggctatggttcgttattaattcatgggtagcttccactattattatacttgatattgttctagttatcaagcccttagaaacttgagaatagttggactaggttattactctagttattccttttattagttataattctagtggcttggttattgtttctttatttttctacaagtgtttttcttgtagtttgtttaaatgttttcagatgattttgaagcttttacgggtat

SEQ ID NO: 12185 - DNA, 2319 bp, Allium cepa
atcttcggttcttcatttgtagattgattttcacataaattaaaggaattccaactttgagaaaagactggaagggatgactgcatataaacctaaaaacatactcatcactggtgcagctggcttcattgcctgccatgtagcaaaccgccttgtccgcagctacccagactataaaattgtagttcttgataagctcgactactgctcaaacctaagaaatctttctccttctcgatcctctcctaatttcaaatttgtcaagggagacatagctagtgccgacttagtcaattatctcttgattactgaaaatatcgataccataatgcattttgcagctcaaactcatgtagataactcatttgggaactcattcgagtttaccaagaacaatatctatgggacacatgttcttctagaagcatgcaaagtcaccggccaaattcaaagattcattcatgtaagtactgatgaggtgtatggggaaacagatgaagatgctgttgttggaaatcatgaagcttctcagcttcttcctaccaacccttactcagccactaaagcaggagctgaaatgcttgtaatggcatatggccgatcatatggtttgcctgtgataactacacgtggaaacaatgtatatggacccaatcaatttcctgaaaaactcattccaaaattcatacttttagctatgaaaggaaaagaacttccaattcacggtgatgggtctaacgttagaagttacttatactgtgaggatgtggcagaggcttttgaggttgttctacataaaggagaagtgggccatgtttacaatatagggacaaagaaagagaggagagtgattgatgttgcaaaggatgtatgcaagcttttctcacttgacccagatagcgttatcaagtttgtcgagaataggccatttaatgatcaaaggtatttcttagatgatcagaaattaaaaaacttgggttggtcagagaagactacatgggaagaggggttgaagaaaaccatggagtggtatatgaacaatcctgattactggggagatgttagtggagctttgttgcctcatccaagaatgcaaatgatgcctggaatcgagcgacaagtagaatgtgaggaagctaaaactgtaggtgctaattcagcagtatcccatacccaaaaaatggttactccatcattgaagagcagcagctctcctcacaagagttcattgaagttcttgatttatggtagaactggttggattggtggtcttcttggaaaaatatgcgaagagaaagggatatcatatgaatatggaaaggggagactggaagagcgttctactcttgcacaagacattcagattgtgaaaccaactcatgtttttaacgcagcaggtgtgactggaaggccaaatgttgattggtgtgagactcatagacctgagaccattcgtacgaatgttgtgggtactttgactctagctgatgtttgtagacaacatgggctgttaatgatgaattatgctaccgggtgtatttttgagtatgatgctgcacacccagaagggtctggtattggattcaaagaggaagacactccaaatttcgcaggctccttttactcgaaaactaaggctatggtagaagagctactaaaagaattcgacaacgtatgcaccctgcgagtgaggatgcccatctcgtccgacctcagcaacccacgcaacttcatcacaaaaatatcgcgctacagcaaagtggtcaacatcccaaacagcatgactgtcctagacgagcttttgcccatatcggtcgagatggcaaaaagaaacctgagaggcatctacaacttcaccaaccctggggttgtcagccacaatgaaatcctcgaaatgtacagggattacatcgatcctgattacaagtgggaaaacttcaccctcgaagagcaagccaaagtcatcgttgcagctagaagcaataacgagatggatgcttcgaaactgaaagcggagttccctgaattgctctccatcaaagattcgctcataaagtatgtgtttgagcctaacaagaaggttgggaacaagtaagataattaggtcttatatttggtagtaatttatcatttgttgcagattcgggtgttttaaactttatcgttgtggaactgttgaaatgctactggttcaattgttttgtgtgttcagtttgatgtttaggtatatggcatgtgtatttaaaagcacggcagcagggatgtaacctacagaatactattatttataccatttagtacgacttaaataaatcctac

SEQ ID NO: 12186 - DNA, 2422 bp, Allium cepa
ctcttcccctatttaacgcaagcttccttcatcgaatggagattgaattgccgaaatcaaatacaaaaaatacgcagaaataatcaaatcgactcgatcaacaattttgttccagggattcgtggatcggatcatcgtattattcttattgaattggaaaaaatctcgaaggaatgactacgtataaacccaaaaatatactcattactggtgcggctggttttattgcatgccatgtcgcaaaccgccttgtccgcagctatccagaatataagattgtagttcttgacaagcttgactactgttcaaatttaagaaacctttccccttctcgctcctctcctaattttaaatttgtcaagggagatatagctagtgctgacttagtcaattatctcttgataactgaaaatattgataccataatgcattttgcggcacaaactcatgtggataactcatttgggaactcgttcgagtttaccaagaacaatatctatggtacacatgttcttctagaagcatgcaaggtcaccggccagattcaaagattcattcatgtaagcaccgatgaggtgtatggggaaacagatgaagacgctgttgttggaaatcatgaagcttcgcagcttcttcctaccaacccttactcagccactaaagctggagctgaaatgcttgtcatggcatacggtcgatcatatggtttgcccgtgataactacacgtggaaacaatgtatatggacccaatcagtttcctgaaaagctcattccaaaattcatacttctagcaatgaagggaaaagaacttccaattcacggtgatgggtctaacgttagaagttacttgtactgtgaagacgtggcagaggcttttgaggttgttctgcacaaaggagaagtgggccatgtttacaatataggaacaaagaaagagaggagagtgattgatgttgcaaaggatgtatgcaagatgttctcactcgatccagacagcgttatcaagtttgtcgagaataggccatttaatgatcaaaggtatttcttagatgatcagaaattgaaaaacttggggtggtcagagaaaactacatgggaagaggggttgaaaaaaaccatggagtggtatatgaacaatcctgattactggggagatgttagcggggctttgttgcctcatccaagaatgcaaatgatgccagggattgagcgacaggtagaatgcgaggaagctaaagctagttctaactcagcagtaacctatacccaaaaaatggttactccttcattgaagagcagcagctctcctcacaagggttcattgaaatttttgatttatggtagaactggttggattggtggtcttcttggaaaaatatgtgaagagaaagggatatcatatgaatatggaaagggaagactagaagagcgttccactcttgcacaagacattcagattgtgaagccaactcatgtttttaatgcagcaggagttaccggaaggccaaatgttgattggtgtgagactcatagacctgagactattcgtacgaatgttgtgggtactttgactctagctgatgtttgtagacaacatgggctgttaatgatgaattatgctactgggtgtattttcgagtatgatgctgcacacccggaagggtctggtattggattcaaagaagaagacactccaaatttcgccggctccttttactctaaaaccaaggctatggtcgaagagctactaaaagaatttgacaatgtatgcaccctgcgagtgaggatgcccatctcgtccgacctcagcaacccacgcaacttcatcacgaaaatatcgcgctacaacaaagtcgtgaacatcccaaacagcatgactgtcctagacgagcttctgcccatatcagtcgagatggcaaaaagaaacctcagaggcatctacaacttcaccaaccctggagttgtcagccacaacgaaatcctcgaaatgtacagggattacatcgatcccaattacaagtggcaaaacttcaccctcgaagagcaagccaaggtcattgttgcagctagaagcaacaacgagatggatgcttcgaaactgaaggcggagttccctgaattgctctccatcaaagattcgctcataaagtacgtgtttgagcctaacaagaaggttggaaacaagtaaaaagctaattaggtattatatttggtagtagtaatctattatttattgcagtttcgggtgttttaaaatttatggttgtgaaactgttggaatgctagtggttcaattgtttttgtgtgttgagtttgatgtttaggtatatggcacgtgtatttaaaagcactgcagcaggaatgtaatccaccgaatactgttatttatacctaaacatcaaactcaacacacaaaaacaa

SEQ ID NO: 12187 - DNA, 2583 bp, Theobroma cacao
atacacgaagtctgcacactttccctctccctcaaagcttctttctccaattctccgtgtttttctctctcaacattttgtatctctgtcaacactctcaacatatctctctctctctagaatttgtgtgtttctatttctctatctggattttgattgatttctcttcatctcaattggtttcagtatggctagttatacccccaagaatatcctgattactggggctgctgggttcattgcatctcatgtcgccaatcggctcattcgaaactacccagactacaagattgttgtgcttgacaagcttgattactgctcaaacctgaaaaacctccttccctctaagtcctctccaaactttaagtttgtgaagggggacattggcagtgctgaccttgttaactacctcctcatcactgagtctattgacacaataatgcactttgcagctcaaactcatgttgataactcatttggaaatagctttgagtttaccaagaacaatatctatggcactcatgtcctgcttgaagcctgcaaagttaccggccagatcaggaggttcatccatgtgagcacagatgaggtttacggggagacagatgaggatgctgttgtaggaaaccatgaggcttcccaacttctcccaacaaacccctactctgcgacaaaagctggtgctgaaatgcttgttatggcatatggtaggtcatatgggttacctgtgattacaacccgcggaaacaatgtttatggtcccaaccagtttcctgaaaaattaattccaaagtttatcctcttagcaatgagggggaagactcttccaattcatggggatggttctaatgtgaggagttatttatactgtgaggatgtggctgaggcatttgaagtcattcttcacaagggtgaagttggccatgtttataatattggaacaaagaaggaaaggagagtgattgatgttgccaaagatatatgtaaacttttttcaatggatcctgaggcaagcatcaagtttgttgaaaacagaccattcaatgaccaaaggtattttctcgatgatcagaaactgaagatcttgggatggtctgagcgaactgtatgggaagagggtttgaagaaaactatagagtggtacactcaaaatcctgattggtggggtgatgtgtctggtgcactgcttccgcacccaaggatgttgatgatgcctggtggtaggcactttgattctgaagagggaaaaggttcatcatttgtaagtggtcctaatcagacccgaatggtggttccaacctccaaaagtagtggctctccccgaaaaccatccttgaagttcttactatatggcaggactggctggattggaggcctacttggtcagttatgtgagaaacaaggtattccctttgaatatggaagaggacgcttggaagatcgttcatcgcttctggcagatatccaaaatataaagccaacccatgtttttaatgctgctggtgtgacaggtagacccaatgttgattggtgtgaatctcacaaaacagaaacaattcgcaccaatgtggctggaaccttgaccttggcagatgtttgcagagagcatgggcttttggtgatgaattttgctactgggtgtatatttgagtatgatgctaaacatcctgagggctctggcattgggtttaaagaggaagacaaacccaatttcactggttccttttattcaaaaaccaaggctatggttgaagagctgttgaaagaatatgacaatgtctgcaccctcagagtccgaatgccaatctcatctgacctaaacaacccccgcaacttcatcaccaagatttcacgctacaacaaggtggtcaacattcccaacagcatgacaatcttggatgaacttctacctatttctattgagatggcgaagaggaacttgaggggtatatggaacttcacaaaccctggggttgtgagccacaatgagatcctggagatgtacaagacttacattgactccaactttcagtggacaaacttcacattggaagaacaagccaaggtgatagttgcccctcgtagcaataatgagatggatgcatccaagttgaagaatgagttccctgagttgctaccaatcaaggaatcactgattaagtatgtctttgaacccaacaagagaacctgagcctaataaagcaggtttccagctatataaccccagcattgacttctgctttctgcatttagtattatggccaggaatatcttttcagttccattcatttgttattgttggcttccacctattaattttacgcaaactataaggtattaggtattccatctttcattccatacgagccgggtcagagctgtatcttagtttgcttagtattcgttcttttaagaaacattttaggtactttacaatttgtgtcatctgcagcctcctagcaggtgtattattttttgaataccacggcttcaacactcatgtactagtctttaatggaagaaattgcatttatgtcttatggaaatgagtgaataattaatggatttgagtcttcatatctc

SEQ ID NO: 12188 - DNA, 2382 bp, Arnica chamissonis
cctttctggtcgagatctctctctcactcatacgcacaatctgctattataccaatccggaataaatttttatatccggtatggctaattacacgccaaagaacatccttatcacgggggctgctggcttcattgcctctcatgttgctaatcggcttatcagaaactaccctgattacaagattgttgtgctcgacaagcttgattattgttcaaatcttaagaacctcaacccttccagatcatctcccaacttcaaatttgtgaagggtgacattggtagtgctgatctagtcaactacctcctgatcactgaatctattgataccataatgcactttgctgcacagacccatgttgataactcatttggcaacagctttgagttcacaaagaacaacatctatggcacccatgtgcttctagaagcctgcaaagtcactggtggccagatcagaaggttcatccatgtgagcacggatgaggtctatggtgaaacagaggaggatgctgtggttggtaaccatgaagcttcacaacttcttcctacaaacccatattcagccacaaaagctggtgcagaaatgcttgttatggcttatgctagatcttatggactgcccgtaattactacaagaggaaacaatgtttatggcccaaaccaattcccagaaaaactaatccctaagttcattctattagctatgagaggaaaatcacttccaattcatggtgatggttctaatgtaaggagttacctttactgtgaagacgttgctgaagcttttgaagtaattcttcacaaaggagaagttggtcatgtttacaacattgggaccaaacgagaaagaagagttattgatgttgcaaaagatatgtgcaaacttttcaatatggatcctgattcaagcatcaagtttgtagaaaacagacctttcaatgatcaaagatatttcttagatgatgagaaattgaagagcttgggttggtctgaacggaccatttgggaagaaggtttgaaaaagaccatcgagtggtacaccagtaaccctaattggtggggagatgtatctggagcacttcttcctcatccaagaatgttaatgatgccaggtggtgttgatagacttgttgatggacctgaaattgctgaatttgattcagctaatttggcaatcaatacttctcagatcggcgtccaggtttctaaatcaaaaacaagcatttcttccaagaaaccaactttgaagttcctgatttatgggaaaacgggttggatcggtggtttacttgggaaattatgtgaaaaacaacaaattcaatacgagtatggaaaaggtcgtttggaagaccgttcacaacttttggctgatattcaaactattaaacctactcatgttttcaatgctgctggtgttactggcagaccaaatgttgattggtgtgaatctcacaaaacagaaactattcgtgccaatgtttcgggcacactcaatttagcagatgtctgcagagaacacgggctcttaatgatcaattttgcaactggttgcatttttgaatatgatgctaaacatcctgaaggttctggaatcggtttcaaggaagaagacaaacccaatttcattgggtccttttattcaaagaccaaagccatggtggaggagcttttgaaagaatatgataatgtttgcacccttcgagtccgaatgccgatatcatcagatctcaacaacccacgcaattttatcactaaaatagcccgttatgataaagtcgtgaacataccaaacagcatgacaatcttggatgagcttttaccaatttcaatcgagatggcaaagaggaatcttaggggaatctggaactttacaaatcctggggtggtaagtcacaatgagattcttgaaatgtacaagaagtacataaacccagaatttaagtgggcaaatttcacactggaggaacaagcgaaagtgattgtggctccgcgaagcaataacgagttggatgcatcaaagttgaagaaggagttccctgagttgctatctatcaaggagtcgttgatcaagtacgtattcgaaccaaacaaaaaacattaataatatttgattctttattagaatttgtaaaactgaagattcacttgtgtttggttacttggtcctcctcctgtatggtttggattatacatctgtaatgtttaaagtctttcccttcctagcaagcagcatatcatcagtcatcacatcacactcaaattatatttcgattcatcctcattggtctcaactacatttagttcaatattttcacttttatttgttaaaaccgcacgtgggcaggcttgtactattggattttctataagatttgatattt

SEQ ID NO: 12189 - DNA, 2399 bp, Chrysanthemum coronarium
acaagtataaatagagaaacacatatttgttgtatgtgtatctacatttcttggatccaagcgtcggtttaaaaccaaataaaaagaaaaacacatatatttctcgtgatcttaattaatcatcatcacctttcccttgattcacttttacatccgggatggctacttacacgccaaagaatatcttaatcaccggggctgctggcttcattgcctctcatgtcgctaatcgcctcatcagaagctaccctgattacaagattgttgtcctcgacaagcttgattattgctccagtcttaagaaccttaacccgtctagatcatcgcctaactttaagtttgttaagggtgatatcgggagtgctgatctagtaaactaccttctgatcactgagtctattgatacgattatgcactttgctgcacagactcatgtagataactcatttggcaacagttttgagttcacgaagaataacatctatggtactcatgtgcttctcgaggcgtgtaaggtcactggtcagattagaaggtttattcatgtgagtacggatgaggtttatggggaaaccgaggaggatgctattgttggtaaccatgaagcttcgcaacttcttcctacaaacccgtattcagccacaaaagctggtgcggaaatgcttgttatggcttatggcagatcatacgggttgcctgtgataacaactagaggaaacaatgtttatggcccaaaccagttcccagaaaaactaatcccgaagtttattcttttggctatgcaaggaaagccacttccgattcacggtgatggttctaatgtaaggagttacctctactgtgaggacgttgctgaggcgtttgaagtgattcttcacaagggtgaagtcggtcatgtttacaacatcgggacgaaaagggagaggagagttattgatgttgcaaaggatatgtgcaagcttttcaatatggatgctgatgcaagcatcaagtttgttgaaaaccgaccatttaatgatcagagatactttttggatgacgagaagttgaagagcttgggttggtccgagagaaccagatgggaagagggtctgaagaagaccatcgagtggtacacaagcaatcctaattggtggggcgatgtctctggagcgctgcttcctcatccaaggatgttgatgatgcctggtggagttgatcgacttgctgatggacccgatcactctgaatttgatgcagctgatccagcaatcaacactgcacagattggagtgcaagttccctcaaagaccagtagcaacgctcctaaaaaaccagcactgaagttcctcatctatggtaagacaggatggatcggtggtttacttgggaaactgtgtgagaaacaagggattcaatacgagtatggaaaaggtcgtttggaagaccgctctcagcttttgtctgatattcagactattaaacctactcatgttttcaatgctgctggtgtcactggcagacctaatgtcgattggtgtgaatctcacaagacggaaactattcgtgtcaatgtgtgtggcacattgaacctagctgatgtctgcagagaacaaggtctcttaatgatcaatttcgctactggatgcatttttgagtatgatgctaaacaccctgagggttctggtatcggttttaaggaagaagacacacccaacttcacagggtcgttttattcaaagaccaaagctatggttgaggagctcttgaaagaatatgacaatgtctgcacacttcgagtccgaatgccgatatcatcagacctcaacaacccacgaaacttcatcactaagattgctcgttacaataaagttgtgaacatacccaacagcatgacaatcctggatgaacttctaccaatttcaatcgaaatggcaaaaagaaacctaaagggaatctggaacttcacaaatcccggggttgtaagccacaacgagattcttgaaatgtacaaaaagtacataaacccggaattcaaatggcagaacttcacactggaagaacaagcgttagtgatagtggcgccacgaagcaataacgaattagatgcatcaaagttgaagaaagagttccctgagttgctttcaatcaaggactcattgatcaagtacgtattcgaacccaacaaaaaacagtaataatgattcttttttagcatttgtaaactccagattcacttgtgttctcgttacttactagttactatatggtttggattataaatctgtaatgtttaagtcaaagtcaaagacagcgagtcagtcgacggcagttatctaccacatttgttctagtctttgttcctagtatgatcacactactgagattatagggggccatttgtctaggtattttatatt

SEQ ID NO: 12190 - DNA, 2451 bp, Daucus carota
attgtctctcctcacgtttcgctgtgctgagagttgctcttgcctcctcctcctccctcattatcttctcctctgctttcaaagtcttttctgcgtctcccttcattcctacattcattcctaattttggtttgagatggctaattatactcccaagaatatcctgattacgggagctgctggcttcattgcttctcatgtggctaatcgtcttgttcggagctaccctgagtacaagatcgttgtgctcgataagcttgattactgctccaatcttaagaatcttaatccctctcgtactgctcccaactttaagtttgtcaagggagatattggaagtgctgatctcgtcaactatcttttgatcactgagtcgattgatactattatgcactttgctgctcagacccatgttgataactcttttggtaacagttttgagttcaccaagaacaacatttatggtactcatgtgcttttagaagcctgcaaagtgactggacagatcaggcggttcatccatgttagcacggatgaggtctatggggagacagatgaggatgctgttgtgggtaatcacgaagcttcacaactccttccgacgaatccttattctgccactaaagctggggctgagatgcttgtcatggcttacggcaggtcatatggtttacctgttattacaacccggggtaataatgtctatggtcctaatcagtttccagaaaagttgatcccaaagttcatccttttagccatgaggggaatgcaacttcctattcatggggatggtgccaatgtacggagttatctctactgtgaggatgttgctgaggcctttgaggttgtccttcacaagggagaagttggacatgtttacaatatagggacaaagaaggagaggagagttactgatgttgcccaagacatctgtaaacttttctccatggatcctcaatctaacattaaatatgtggagaacaggccattcaatgatcagaggtactttctagatgatcagaagttgaaaaacttgggctgggctgagcgcactacatgggaagaagggctaaaaaagactatggactggtacactagcaaccctgattggtggggagatgtatctggagcattgcttcctcatccaagaatgctgatgatgcctggtggaattgagagacactttgacggatctgaaaaccgtgacgctgaatcaactcgtttcgtcgataaatctgccccatcacaggtttcttcctcagatcccaaaagcacagtgcctcagaaattagctcttaagtttttaatttatggtaggactgggtggattggtggtctgctcggaaaattatgtgaaaaacaaggtattccgtatgaatatggaagggggcgcctagagtatcgatcacagctagtgtctgatctccagatagttaaacccacacatgttttcaatgctgctggtgtgactggtagacccaatgtcgattggtgtgagtcccacaaaacagaaaccattcgtacaaatgtcacgggtacactgacactagctgatgtatgcagagagcaaggacttctgatgattaattttgctactggatgcatatttgagtatgatgctgcacacccagaaggttctggcattgggttcaaagaagaagacacgcccaattttcatggatcattctattcaaagacaaaggccatggttgaagaactcttgaaagagtttgacaatgtttgcaccctcagagttcggatgcccatatcatcagacctcagcaacccccgcaacttcatcacaaagattagtcgttataataaggtggttaatattcccaacagcatgacagtcttggatgagttgctacctatctcaatcgagatggccaagaggaaccttaaaggtatatggaacttcaccaaccctggagtcgtaagccacaatgagattttggagatgtacaagcaatatatcgacccatcttttaaatactcaaacttcacactagaggagcaagccaaagtaattgtagcagctagaagcaataatgagatggatggggcgaagttgaaggccgagttccctgagttgctgtcaatcaaggaatcattgatcaagtatgtttttgaacccaacaaaaaagtttagctgctggttgagcactgtagaatagtaaacttcaggcgacctctacagtcttgatttaccatactattattaccttgagccctgaggtcattattactgtcatagtagatttcctgctgattcctgtgttttcttaatattgttataatatatttccttttacaaacaaatacccgtccgtgtttagaagttcttggtttataggtgttcctccacatatgttttcttcttcaagccaccgctacttttgtaatatgtgattctgttacagttcatttatatcagtattcctttatttc

SEQ ID NO: 12191 - DNA, 2534 bp, Nicotiana benthamiana
cgtgtataaatacatgtacacaaaagggagacgatacagatacgatacttcactctcatcttcacacgcttttctctttctctctctaaaaagtgtcttccgtttctctcgtcttccttttcttgtagttcgggggttggatcctttattcggttctggcaaatctgatttgagttgctattaaactgagaatattgatttgaaattcgttagctgaagaacctgcatcaagatgtcgacctacactcctaagaatatactcattactggggccgcagggtttattgcatctcatgttgccaaccgccttgttcggagttaccctgactacaaaattgttgtgcttgacaagcttgattattgttccaacctgaaaaaccttaatccatctcgatcctcccctaatttcaagtttgttaagggagacattggcagtgctgatcttgttaactaccttctcatcactgagtccattgacactataatgcactttgctgctcagacccatgttgacaactcctttggtaatagctttgagttcaccaagaacaacatttatggtacacacgtgctattagaggcttgcaaagttactggtcagatcagaaggtttatccatgtcagcacggatgaggtttacggggagactgatgaggatgccgttgtgggaaaccatgaagcctcacaactccttcctacgaacccatattcagccactaaagctggggctgaaatgcttgttatggcatatgggagatcatatggattgcctgttataaccactagagggaataatgtatatggtcccaatcaatttcctgagaagttaatcccaaagtttataaacctagccatgagggggaaacctcttcctattcacggagatggttcaaatgttagaagttatttgtactgtgaggatgttgctgaggctttcgaggtcgttcttcaccgaggagaggttggtcatgtttataacattggaactaagaaagagaggagggtgattgatgttgccaaagatctatgcaagctttttaacaaggatccagatgcaagcattcagtttgtggagaacaggcccttcaatgaccagaggtattttctagatgatcagaagttgaagaacttgggttggtcagaggggaccacgtgggaagagggtctgaaaaaaaccatggactggtatatcagtaatcctgattggtggggagatgtctctggagcattgcttccccatcctagaatgctgatgatgcctggtggggtagagagaggagctgaaaaagatgattcgggatcatctgagtgctctggaaaccccaaccagacccggatggtagttccagcttccaagatcggcaacccccctaatgaatcaccttataagtttttgatttatggtaggactggttggattggtggtctgctaggcaagctttgtgagaaacagggaattccttatgagtatggaaggggacgtctgcaggatcgctcacaacttttggcagacattcacgctgtcaagcccacacatgtattcaatgctgctggtgtcaccggtagacctaacgttgattggtgtgagagtcataaaactgaaacaattcgtacaaatgttgctggaactctaaacttggctgatgtttgtaaagagcatggtttactgatgatgaattttgcaactggttgcatatttgaatatgatgctgcacacccagaaggttctggtattggattcaaagaggaagacacgcccaatttcgctggatctttctattcaaagaccaaggctatggttgaagggttgctgaaagaatacgagaatgtttgcaccctcagagtccggatgccaatatcttcagacctcagcaacccccggaatttcattaccaagattagtcgctacaataaggtggtcaatattcccaacagcatgacaattttggatgagcttcttccaatttcaattgagatggcaaaacgtaatctcaagggcatatggaatttcacaaatcccggtgttgtgagccacaatgagattttggagatgttcaagaaatatataaacccagactttacgtgggccaatttcacattggaagaacaggctaaggtaattgttgcagctcgcagtaacaatgagatggatgcttcaaagttgaaaaaggagttccctgagttgctgccaatcaaggaatcattggtcaaatatgtgtttgaaccaaatagaaaaactgctgcttaataagccttaggttattgagatcagacttctggtttggatcaatatgccacttgactttgtatcctagtttagtcattattcgtcattagtagccaatattttctattgtttagattcttaccggtgattagaattcctatgcttggttgtatgagttaataatgtttaatgtgctatgaggaagctttggataggagttccccatgtatctgttatcaaccctgtgtgctaagggtttatttactgaatctaatatatatggaattatgaattgttttttgctcca

SEQ ID NO: 12192 - DNA, 2145 bp, Vinca minor
ttctcgctctaatcactggatcgatttctttcccaattatctctctcctccatcttcattgccctgattcatctcgatctcgattcaaatttgggccactaaaatggcaactcacacaccaaagaatattcttattactggagctgctggatttattgcatctcatgttgcaaaccggctcattcgtaactaccctaaatacaagattattgtcctcgacaagcttgactactgctcaaatttgaggaacctccttccttccacttcatcccctaacttcaagtttgtcaagggagatattgctagcgctgatcttgttaactaccttcttattactgagtcaattgacacaataatgcacttcgctgcacagacccatgttgataactcatttggtaatagctttgagttcaccaagaacaacatttatgggacacacgtgctattggaggcttgcaaagtgactggtcagatcaaaagatttatccacgtaagcacagacgaggtctatggagagacagatgaagatgctgttgttgggaatcatgaagcctcacaactccttcctacaaacccatattcagccactaaagctggagctgaaatgcttgttatggcatatggtaggtcttatggattacctgtaataactactcgagggaacaatgtttatggtcccaatcagtttcctgaaaagttgatcccgaagtttatccttttggccatgagagggaagactcttcctattcatggggatggttctaatgtgcgcagctatctctattgtgaggatgttgcagaagcatttgaagttattcttcatagaggagaagttggtcatgtttacaacattggtacaaagcgggaaagaagagtaattgatgttgcccaagatatatgcaaactttttaacatggatactgaaactagcattgagtttgtggagaataggccatttaatgatcagagatatttcctagacgatgagaagctgaaggaattgggctggtcagagaggacaagatgggaagaaggactaaaaaagactattgagtggtacaccaagaatcctgattggtggggcgatgtttctggagcattgcttccgcatcccagaatgttgatgatgcctggtggagtggaaaagcttcttgatggatctgataagtataactctggatctcctgagttctcagggaaatctaagcaggactctgtggccgtctcacctgctaagagctcacctaagccatccttgaaattcttgatctatggtaagactgggtggattggtggtctgctaggaaaattgtgtgagaaacaggggattccatatgagtatggaagggggcggctggaggactgctcacaacttctagtcgacatccaaattgttaagcccacccatgttttcaatgctgctggcgtgactggtagacccaatgttgattggtgtgaatcccacaaaactgagacaattcgtacaaatgttgctgggactctgactttggcagatatctgcagagagcatggtctcctgatgatgaactttgcaactggatgtatatttgaatatgatgctgctcatccagaaggatctggtattggttacaaggaggaagacacacctaatttcactggatctttctattcaaagaccaaggccatggttgaggagctattgaaggagtatgacaatgtttgcactctacgggttcgtatgccaatatcttcagacctcagcaatccacgaaatttcattaccaagatttcccgttacaataaggtggttaacattcccaacagcatgaccatcttggatgaacttctgcccatttccattgagatggcaaaacgaaatctgaggggcatttggaacttcacaaatcctggggtgattagccataatgagattctggagatgtacaagaaatacatcgatccaaaatttaaatgggccaactttacgctggaggaacaagcaaaggtgattgtcgccccccgaagcaataatgagatggatgcctccaagctgaagaaagagttccccgaattgctatctatcaaggagtcattggtaaagtatgtctttgaaccgaacaagaaaacatctgcatgaacaagcctttagagagcaagactatg

SEQ ID NO: 12193 - DNA, 2395 bp, Daucus carota
gaatttaggtttcagtccgacttattgctcatatttgtttctttaggagctacataatcgggattggatctaaatcttattttaaactatttatcttttgctaggaattggttcgatatgactagttatactcctaaaaatatccttataactggagctgctggcttcattgcatctcatgttgctaatcgtctcgttcggagctaccctgattacaagattgttgtgcttgataagcttgactactgttcaaatctgaagaaccttaatccatctcggtcagctccaaacttcaaatttgtcaagggcgatatcggcagtgctgatcttgtcaactaccttcttatcactgagtccattgatactattatgcactttgctgcccagacccatgttgataattcttttggtaacagctttgagtttaccaagaacaacatttatggcactcacgtgcttttagaagcttgcaaagtgactggacaaatcagaaggtttatccatgtaagtacagatgaggtctatggcgagacagacgaggatgctgttgtgggtaatcatgaagcttcgcaactcctccctaccaatccatattcagccacaaaagctggggcggaaatgcttgttatggcttatggcaggtcatacggcctacctgttataacaactcggggtaataatgtgtatggtcctaatcagtttccggaaaaattgattccaaagttcatccttttagccatgaggggaatgcaacttcctattcatggggatggtgccaatgtacggagttatctctactgtgaggatgttgctgaggcctttgaggttgtccttcacaagggagaagttggacatgtttacaatatagggacaaagaaggagaggagagttactgatgttgcccaagacatctgtaaacttttctccatggatcctcaatctaacattaaatatgtggagaacaggccattcaatgatcagaggtactttctagatgatcagaagttgaaaaacttgggctgggctgagcgcactacatgggaagaagggctaaaaaagactatggactggtacactagcaaccctgattggtggggagatgtatctggagcattgcttcctcatccaagaatgctgatgatgcctggtggaattgagagacactttgacggatctgaaaaccgtgacgctgaatcaacccgtttcgtggataaatcttccccatcacaggtttcttcctcagatcccaaaagcacagtgcctcagaaattagctcttaagtttttaatttatggtaggactgggtggattggtggtctgctcggaaaattatgtgaaaaacaaggtattccatatgaatatggaagggggcgcctagagtatcgatcacagctagtgtctgatctccagatagttaaacccacacatgtttttaatgctgctggtgtgactggtagacccaatgtcgattggtgcgagtcccacaaaacagaaaccattcgtacaaatgtcacgggtacactgacactagctgatgtatgcagagagcaaggacttctgatgattaattttgctactggatgcatatttgagtatgatgctgcacacccagaaggttctggcattgggttcaaagaagaagacacacccaattttcatggatcattctattcaaagacaaaggccatggttgaagaactcttgaaagagtttgacaatgtttgcaccctcagagttcggatgcccatatcatcagacctcagcaacccccgcaacttcatcacaaagattagtcgttataataaggtggttaatattcccaacagcatgacagtcttggatgagttgctacctatctcaatcgagatggccaagaggaaccttaaaggtatatggaacttcaccaaccctggagtcgtaagccacaatgagattttggagatgtacaagcaatatatcgacccatcttttaaatactcaaacttcacactagaggagcaagccaaagtaattgtagcagctagaagcaataatgagatggatggggcgaagttgaaggccgagttccctgagttgctgtcaatcaaggaatcattgatcaagtatgtttttgaacccaacaaaaaagtttagctgctggttgagcactgtagaatagtaaacttcaggcgacctctacagtcttgatttaccttactattattaccctgaggtcattattactgtcatagtagatttcctgctgattcctgtgttttcttaatattgttataatatatttccttttacaaacaaatacccgtccgtgtttagaagttcttggtttataggtgttcctccacatatgttttcttcttcaagccaccgctacttttgtaatatgtgattctgttac

SEQ ID NO: 12194 - DNA, 2432 bp, Daucus carota
attgtctctcctcacgtttcgctgtgctgagagttgctcttgcctcctcctcctccctcattatcttctcctctgctttcaaagtcttttctgcgtctcccttcattcctacattcattcctaattttggtttgagatggctaattatactcccaagaatatcctgattacgggagctgctggcttcattgcttcccatgtggctaatcgtcttgttcggagctaccctgagtacaagatcgttgtgctcgataagcttgattactgctccaatcttaagaatcttaatccctctcgtactgctcccaactttaagtttgtcaagggagatattggaagtgctgatctcgtcaactatcttttgatcactgagtcgattgatactattatgcactttgctgctcagacccatgttgataactcttttggtaacagttttgagttcaccaagaacaacatttatggtactcatgtgcttttagaagcctgcaaagtgactggacagatcaggcggttcatccatgttagcacggatgaggtctatggggagacagatgaggatgctgttgtgggtaatcacgaagcttcacaactccttccgacgaatccttattctgccactaaagctggggctgagatgcttgtcatggcttacggcaggtcatatggtttacctgttattacaacccggggtaataatgtctatggtcctaatcagtttccagaaaagttgatcccaaagttcatccttttagccatgaggggaatgcaacttcctattcatggggatggtgccaatgtacggagttatctctactgtgaggatgttgctgaggcctttgaggttgttcttcacaagggagaagttggccatgtttataatattgggacaaagaaggaaaggagagttactgatgttgccagagacatctgtaaacttttttctgtggacccagaaacaaatattaactatgtagagaacaggccattcaatgatcagaggtactttctagatgatcagaagttgaaaaacttgggctgggctgagcgcactacatgggaagaagggctaaaaaagactatggactggtacactagcaaccctgattggtggggagatgtatctggagcattgcttcctcatccaagaatgctgatgatgcctggtggaaatgagaaacactttgatggatctgatacccgtgactctgaatctcgatttgtaaataaatctattgcatcacaggcatctgctacaaatccgaaaggcatcatccctcagaaagcggctgttaagtttttgatttatgggaggactgggtggataggtggtctgcttggaaaattatgtgaaaaagaaggaatccagtatgaatacggaaggggacgtctagaaaatcgatcacaactattgtctgatctccagttagttaaacccacacatgtttttaatgctgctggtgtcactggaagacccaatgtcgattggtgtgaatcccacaaaactgaaacaattcgtacgaatgttgttggcacactgaatttagcagatatatgcagagagcagggacttctgatgattaattttgctactggatgcatatttgagtatgatgctgcacacccagaaggttctggcattgggttcaaagaagaagacacacccaattttcatggatcattctattcaaagacaaaggccatggttgaagaactcttgaaagagtttgacaatgtttgcaccctcagagttcggatgcccatatcatcagacctcagcaacccccgcaacttcatcacaaagattagtcgttataataaggtggttaatattcccaacagcatgacagtcttggatgagttgctacctatctcaatcgagatggccaagaggaaccttaaaggtatatggaacttcaccaaccctggagtcgtaagccacaatgagattttggagatgtacaagcaatatatcgacccatcttttaaatactcaaacttcacactagaggagcaagccaaagtaattgtagcagctagaagcaataatgagatggatggggcgaagttgaaggccgagttccctgagttgctgtcaatcaaggaatcattgatcaagtatgtttttgaacccaacaaaaaagtttagctgctggttgagcactgtagaatagtaaacttcaggcgacctctacagtcttgatttaccttactattattaccctgaggtcattattactgtcatagtagatttcctgctgattcctgtgttttcttaatattgttataatatatttccttttacaaacaaatacccgtccgtgtttagaagttcttggtttataggtgttcctccacatatgttttcttcttcaagccaccgctacttttgtaatatgtgattctgttacagttcatttatatcagtattc

SEQ ID NO: 12195 - DNA, 2250 bp, Cichorium intybus
aaatttatcttctccaatatcagtatggctacttacacgccaaagaacatcctcatcactggggcagctggcttcattgcttctcatgtagctaaccgactcatcagaagctaccctgattacaagattgtcgtccttgacaagcttgattactgctcaagtctcaagaacctcaatccctcaagatcatctcccaacttcaaatttgtcaagggtgacatcgggagtgcagatctagtcaactacctcctgataaccgaatcaatcgataccataatgcactttgctgcacaaactcatgtcgacaactcattcggcaacagcttcgagttcacaaagaacaacatctatggcacccatgtccttctagaagcctgcaaagtcactggtcaaatcagaaggttcatccatgtcagcacagatgaagtctacggtgaaacagaagaagatgccattgttggtaaccatgaagcttcacaacttcttcctactaacccttattcagccacaaaagccggtgctgaaatgcttgtaatggcatacggtagatcatacgggttacctgtaatcaccacaagaggtaacaacgtgtacggtccaaaccaattccctgaaaaactaatccctaaattcattctcttagccatgagaggaaaaccacttccaatccatggtgatggttcaaatgtaagaagttacctctactgtgaagatgtagctgaagcttttgaagtcattttacacaaaggtgaagttggccatgtgtacaatatagggacgaaaagggaaagaagagttatcgatgttgcaaaagacatgtgcaaacttttcaacatggatcctgattcaagcatcaagtttgttgaaaacagaccgttcaatgatcaaagatattttctagatgatgaaaagttaaaaagcttagggtggtccgaaaggacaatatgggaagaaggtttgaaaaaaacaatcgaatggtacacaagtaaccctaattggtggggtgatgtgtcaggtgcacttctccctcatccacgaatgttaatgatgccaggtggcgttgaccgcctcgttgacggaccggaaaacaccgaattcgacacaccccatgaagcaaacaacaattcccagatcggaatcagcgtttccgccccgaaaacaacttccattccctccaagaaaccttccttgaagttcttgatctatgggaaaacagggtggattggtggattacttggaaagatttgtcaaaaacaagggattcaatttgaatatggaaaagggcgtttacaggatcgatcacagcttttggttgatattcaaaatgttaaaccaactcatgtttttaatgctgctggtattacgggtagaccgaatgttgactggtgtgaatcacataagactgaaacaattagtacaaatgtttcagggacacttaatttggcggatgtttgtagggaacatggtttgttgatgattaattttgctactggatgtatttttgagtatgattctgcacatccggaaggttctggaattggtttcaaggaagaagatacacccaatttcactggatcgttttattccaagactaaagccatggtggaagaactcctaaaagaatacgacaacgtatgcacactccgagtccgcatgccgatttcctcggacctcacaaacccgcgaaacttcatcacaaaaatcgcgcgttacaacaaagtcgtcaacatccccaacagcatgacaattctggacgaacttttaccgatttcaatcgaaatggcaaaacgaaacctcaaaggaatctggaacttcacaaacccaggtgtcgtaagccacaacgaaatcctcgaaatgtataaaaaatacataaatcccgaattcaaatacgtcaacttcacactcgaagaacaagctctcgtaatcgtggccccacgtagcaataacgaattggatgcttccaaattgaagaaggagtttcccgagttgatgtcgattaaggagtcgttgatcaagtacgtgttcgaacccaataaaaaacattaacaataataacaataaataacgaaatgaaatgaaatgaaatgattttttagaatttgtaaactcgagattcatgtaccatgttatcgggattttatcggaggaggttgttttgtgtttaggtattttatattgatattgttttcgactttttgtgtcggtaagagttttagtttgtttaacggtgggtttatgagtattttagat

SEQ ID NO: 12196 - DNA, 2576 bp, Lactuca sativa
gaaacgaggcacgacaaaaattgatgcaaggatccatccaaacatggttcacagcactacagcagtgttatgttggtaaaggtagggcaagaaagtgtgaataaatattaaattttgtgggggttttcataaagcgtgtaggtgtcacaccataactcaattcatcgtcataattgccatcatattctttgccttcgctggattatatatctacacacgctaatcctcacacaatcttcctgtactgtgtgtatatatagcaactagcatcggtttccactcggtgaaattgtccgcggtttctttcttcataattcataattttggtggaagtctgttttgctttgcaactctctctgctttcaaattcatattttggtcctgtcacaaatccggatcaaatttatattgatccagtatgaccacatatacaccaaaaaacatcctcatcactggagctgctggcttcattgcatctcatgtcgccaatcgccttatcagaagctacccagattacaagatcgttgttcttgacaaacttgattactgctcaaatctcaagaacctcaacccctccaaatcatctcccaacttcaaatttgtcaaaggagacatcgggagtgcagatctggtcaattacctcttaatcaccgaatccattgacaccataatgcactttgctgctcaaacccacgtagacaactcattcggaaacagtttcgagttcacaaaaaacaacatatacgggacccacgtgcttctcgaggcctgcaaagtcacccgccagatcagacgattcatccacgtcagcacagacgaagtatatggtgaaacagaggaagacgccattgttggcaaccatgaagcctcacaacttcttcccacaaatccatattctgccacaaaagcaggtgcagaaatgcttgtgatggcttatgggagatcatatgggttacccgtgattacaacaagaggaaacaatgtttatggcccaaatcagttcccagaaaaactaatccctaaattcattctcttagccatgagagggaaaccacttcccattcatggagatggatctaatgtcagaagttatctctactgtgaagatgttgctgaagcttttgaagtcattcttcacaaaggcgaagtgggacatgtttacaacattggaactaaaaaagaaagacgagtcatcgatgttgctaaagacatgtgtaaccttttcaacatggatcctgaatcaagcatcaagtttgttgaaaacagacctttcaatgatcaaagatactttctagatgatgaaaagctcaaaagcttagggtgggccgaaagaacaacatgggaagaaggtttgaaaaagacaatggaatggtacattagcaaccccgattggtggggtgatgtatcgggtgcactcctccctcatccaagaatgctaatgatgccaggtggcgttgaacgagtggtcgatgtatccgaaaacattcaatccgattcccctcattctgctgttaacccttcccaattccgaaaagtgggccccgttaccaaaccaaataaaccatctttcaagttcttgatttatgggaaaacaggatggatcggtggattacttgggaagctatgtgaaaaacaaggaatccaatatgaatacggaaaagggcgtttggagaatcggtcacagattctagaagatatccaaaaaatcaaacccacccatgttttcaatgctgcgggtatcacgggtcgacccaatgtcgattggtgcgaatcacataaaaccgaaacgattcgcaccaatgtctctgggaccctcactttagcagatgtctgcaaagaatccggaatcttgatgatcaatttcgccaccggatgcatttttgaatatgatgagaagcatccggaaggttccggaatcggtttcaaagaagaagacactcctaatttcaccggatccttctattccaaaaccaaggctatggttgaggagctactgaaagaatacgacaacgtgtgcacgttgcgggtccggatgccgatttcatcggatctaaacaacccgcgaaacttcattacgaaaattgcgcgatacgacaaagtggtgaatattccgaacagtatgacgattttggatgagcttttaccgatatcgattgaaatggcaaagagaaacttgagggggatatggaattttacaaatccgggggttgtgagtcataatgaagtgttggagatgtataaggagtatataaatccggggtttaagtggacgaatttcacgcttgaagagcaagcgagagtgattgttgcaccaaggagtaataatgaattggatatgacgaaattgaaggaggagtttccggagttgttgtcgattaaggagtcgttgatcaagtatgtgtttgaaccgaataaaaaagtttaatttttttttttttttttattattattattgttacatgtgtaatgtttaaatagtttgagattatagggaaaggaagatcatactgatagtctgatactatattgttagcagattggtattcttggttttttttacaggttttgttgttaat

SEQ ID NO: 12197 - DNA, 2713 bp, Aquilegia formosa
gcccattcgtaattttggctttcctgggggcaaattaactctattttgtttaaataagggtatctcaaatttccactttcaaatgtgaaaaagccctgcataacttgatctaaaacaaagacctgaaacaaaaccagaactaatcttcatttctcgcaaatccctgtgctttgagtttccctctattttgtctgaagaacacaaatccctctctctatctatctctctcgatcgatcgatcgcgagtttcttctctattttcaatctcgatcagatctaggctgcttggaaatggcctcgtatacacccaagaacatcctcatcacaggtgcagctggcttcattgcatcccatgtcgccaaccgactgatcaggaatcatcctgactataagattgtcatcctcgacaaacttgattattgttcaaatttgaagaatcttcttccatcccgatcttcccctaacttcaagtttgtcaaaggagacattggtagtgctgatcttgtcaactatcttctcattgctgagtcaatagacacaataatgcactttgcagctcagactcacgtcgataactcctttggtaacagctttgagtttacgaagaacaacatctacggtactcacgttcttttagaagcctgcaaagtaactggacaaattaagaggttcattcatgtgagcacggatgaggtctatggtgaaacagatgaggatgctgttgtgggaaaccatgaggcttcacagctcctcccaacaaacccctactccgcaacaaaggctggagcggagatgcttgttatggcatatgggaggtcatatgggttgcctgttataactaccagaggaaacaatgtttatggaccaaaccagtttcctgaaaaattaatcccaaagtttattctcttggctatggcggggaagcctctcccaattcatggggatggttctaatgtccggagttatctctattgtgaggatgttgccgaggcttttgaggtgatccttcacaagggagaagtcggtcatgtttacaacattggcactaagaaagagaggagagtaattgatgtggcaaaggatgtttgcaagcttttttctctggatccagaaacagtcattaagtttgtggagaacaggccatttaatgaccaaaggtacttcttggatgatcagaagctaaccaacttaggttggtcagagagaactacatgggaagaagggttaaaaaaaactatggactggtatactagcaatcctgattggtggggtgatgtatctggagcattgctgcctcatccaagaatgctgatgatgccaggaattgaaagacagttcgaaggatatgaagatggcaatgctgctgcctcccaggcaaagagcaattctactcagacccagatggtggttccagttaagggcaacccttctaccccaaagtcacccctgaagttcttaatatatggtagaacaggatggattggtggccttcttaagactatatgtgaaaagcaaggtattccctttgagtatggtaaagggcgactagaggaaaggtcaacactcgctgcagacattcaaaatgtgaaacctactcatgtttttaatgctgccggtgtgacgggtagacctaatgttgattggtgtgaatctcacaaaccagagactatccgcacgaatgttgcaggtacattgaacttagcagatgtatgcagggagcatgggctgttaatgatgaactttgctactgggtgtatatttgagtatgatgctgcacaccctgaaggttctggcattgggttcaaggaagaagacaaacccaattttaccggttcattttactcaaagaccaaggccatggtcgaagagctcttgaaagaatacgaaaatgtctgcactctcagagtccgcatgcccatttcatctgacctgaccaaccctcgaaactttattacaaagatatctcgttataacaaggtagttaacattccaaacagcatgactgtcttggatgagcttctgccaatatcagttgagatggcgaaacggaatttgactggcatctacaatttcacaaatccaggtgttgtgagccataatgagattctagagatgtacaaaagttacattgatcctaacttccagtggaagaatttcaccttggaagagcaggccaaggtaatagttgctccacgaagcaacaatgaaatggatgcttccaagttgaaaaaagagttccctgagttgttatctatcaaggaatcactgatcaagtatgtctttgaaccaaacaagaaaacttaagctcttgagcataaaattaggcattgcgttactagaaatctcatgactgacctctcatgatgtgttagctcataggccatattttgttgtcaattaatattgccattcatctttcatgtcagcattacccttgttctggagtagcagttaggatacctctgctaggctgttcctagttgtctttttccattatcctttttgttatttggcctgctccatgtgaggacctatagatggattctatatcttctacaatattacagcattgtaattctttgaatttaatttatgaaattgttgtttctattttttaccattgtcttccattgttaatgtaaatggtagactggatgatgttggagtcgtcttccataaaagctctggttcctctcatgtacaatgtattatt

SEQ ID NO: 12198 - DNA, 2285 bp, Cyclamen graecum
gctgctccaacatggctgcatatactcccaaaaacattctcattactggggctgctggatttattgcatcccatgtggccaacaggcttatccgtaactaccccgactataaaattgttgtgcttgacaaacttgattattgctctagtctggaaaatttaaacccttctcaatcatcccccaacttcaagttcgttaagggggacattgctagtgctgatcttgtcaactaccttctcataactgaatctatcgacaccataatgcactttgcggctcagacccatgttgacaattcctttggaaacagttttgaatttaccaaaaataacatttacggtacccatgtgcttctagaggcttgcaaggttactggccaaatcaggaggtttatccatgtcagcacggatgaggtgtacggagagaccgatgaggatgctgtggtgggaaaccatgaagcttctcagcttcttcctacaaatccttactcggctacaaaagccggagccgaaatgcttgtaatggcttatgggaggtcatatggtttacctgtcattactactcgtggtaataatgtgtatggtccgaatcaatttcctgaaaaattgattccgaaatttattctcctagcaatgcaaggaaaagttctccctattcacggagatgggtctaatgtgaggagctatctgtattgtgaggatgttgctgaggcatttgaggtcattctccataagggagaggttggtcatgtttacaatatcgggacgaagagagagaggagggtcattgatgtggcgcaagatatatgtaaacttttttccatggacccagaaaagagcattaagtttgtggagaacaggccgtttaatgatcagaggtactttctcgatgatgagaagttgaagaacttgggttggtctgagaggactatatgggaggacggtttgaagaagacgatggaatggtataataataatcctgagtggtggggtgatgtgtctggagctttgcttcctcatccccggatgcttatgatgcccggtgggatcgagcgccactctgatggaattgaaaaatgctacgaagaatctaaaagtgtttcatttgctgggaacaaaaaggtagaaaccatttccggagatagtccttttaagtttttgatctatggtaggaccgggtggattggtggccttctggggaagttatgtgagaaacaaggaattccatatgagtatggtaagggtcgtttggaagatcgatcaagccttaaggaagatatacgaaatgtgaagccgacccatgttctcaatgctgccggtgtcactggaaggccgaatgttgactggtgcgaaactcataagccagaaactatacgtgccaatgtggctggtactttgactttagctgatgtttgtagggagaatggacttctgatgttgaactttgctactgggtgtatattcgaatataatgcttctcatccagaaggttctggaatcggatttaaggaagaggacacacccaacttcatcggttctttttactccaagaccaaggccatggttgaggagctcttaaaagaatatgacaatgtgtgcacccttagggtccggatgcccatatcctcagatctcaacaacccgcgaaacttcatcaccaaaatctctcgctacgacaaagttgtcaacattcccaacagcatgaccatcttagatgagcttctaccaatttccgtcgagatggctaagcgtaacctcaggggcatatggaatttcactaaccccggtgttgttagccacaatgagattttggagatgtacaaaaagtacatagatccggagtttaagtgggctaatttcaccttggaagagcaagcaaaggtgattgttgcgcaacgtagcaacaatgagatgagcgcatccaagttgaaagatgaattcccagagttgctgccgatcaaggagtcgttgatcaagtatgtgtttgaacccaacaagaaaatttccgtctagtaagcattttgtgcaatttttagattaggcaatatggtgttggattaagtcattaaaagatacaaattttggggtacatccccctagtattttagtttcatttccaattcgtttttagcttacattgaatcgttcattatggatttagaaagtctctgtcgtgatcatatcgtcatatggctagagacgatgtcttcttagcctaggtcttagttactagaattacatatcggaacttatgattagaggcttcttatatatttgttatccgtg

SEQ ID NO: 12199 - DNA, 2604 bp, Vaccinium corymbosum
ttccgcatgtatacatacattttacattcattcttgtatatatagattcataggcgcctcttctcctctattctcgcaacaatcattgcttctccgagagatattctctccctctagtcttctgtttttctctctctactctcatccactctctctcccccctctacaatctccatatcggttgatcttggtccgaacccaattcattctatacatagaggcctttctaatatggcttcatataccccaaagaatatccttattactggggctgctggattcattgcatctcatgttgctaaccggcttatccggaactaccctgactacaagattgtcgtgctcgacaaactcgattactgttcaaatctcaagaatttacttcctgctcgatcatcccccaacttcaaatttgttaagggggacattggaagtgctgacctcgtcaacttcctcctcatcaccgaatctatcgacacgataatgcactttgcagcccaaactcatgtggataattcctttggtaacagctttgagtttaccaaaaacaacatttacgggacccatgttcttctagaagcatgtaaagtcactggccaaattagaaggttcatccatgtgagcactgacgaggtctatggagaaactgatgaagatgctgtggtgggaaaccatgaagcttcccaactccttcccacgaatccctactccgcgacaaaagctggtgcagaaatgcttgttatggcttatgggagatcgtatgggttacctgtgataaccacccgtggaaacaatgtttatggcccgaaccaatttcctgagaaactaatcccaaagtttatcctcttagccatgcaagggaaggttcttccgattcacggggatggttctaatgttaggagctatctatactgtgaggatgttgctgaggcttttgaagtcattctccacaaaggagaagttggtcatgtctacaatatagggacgaaaaaggaaaggagagtaattgatgtagccacggatgtatgcaaactcttctctatggatccagaaactagcattaagtttgtggataataggccatttaatgaccaaaggtattttcttgatgacgagaagttgaagaacctggggtggtcagaaaggactaggtgggaagaagggttgaagaaaaccatggactggtatattaacaatcccgattggtggggagatgtctctggagcattgcttcctcaccctagaatgcttatgatgccgggtggaatcgagaggcattttgacggagctgaaaagtgcaacgatgggtcatctccatattcaaccacttctcagaccaaaatggtggtaccagtctccaaaagcagcggatctcctagaaaaccgcctctgaaattcttgatttatggcaggaccggttggcttggtggtttactcgggaaaatatgtgagaaacaaggaattgcttatgagtatggaaaagggcgtctggaggatcggtcgctacttttggcagatattcagaatgttaaacccactcatgttttcaatgctgccggtgtgacaggaaggccaaatgttgattggtgtgaaagtcataaaacggaaacgatacgcgctaatgttgctggtacattaaccttggctgatgtttgcagagaacatggacttctggtgatgaattttgctactgggtgtatatttgaatatgatgctaatcatccagagggttctggcattggatttaaggaggaagacacacccaatttcaccggttctttctattcaaagacgaaggccatggttgaggagctcttgaaagaatatgacaacgtatgcaccctcagagtccgaatgccaatatcttcggacctcaacaacccgcgcaacttcatcactaaaatcagccgttacaacaaagtggtcaacattcccaacagcatgaccatcttggatgagcttctgccgatttcaatcgaaatggccaaacggaacctcaggggcatatggaacttcaccaacccgggtgtcgtgagccacaacgagattctggagatgtacaaaaaatatatcaatccagacttcaagtgggccaacttcaccctggaagagcaagccaaggtgattgttgccccgcggagcaataatgaaatggatgcttccaagttgaagaaagagttccctgaattgcttcctatcaaggagtccttgatcaagtacgtgtttgaacccaacaagaaaaccattgcggagtaattgtttttgttatagctgtaaacccatgggatgattgtgtgcatcttccattaggcaatatggttttcaattgcctatcaaaaaacaagggttttcaattcagtttaggtcagtccattttaagtcgctacgcattgttggtgttactgcattcgggtttatagatcgcgatctgggatggccctagaagatgatttgtgttcagtttttctagttagagctttgattcctttatacaaggatcttatgaaaaagctctatcgaaatttgttgtcatccgcgaccttgctgtggtgtaactttggatttatcatatgaattcgtttgttgattaattcgtgtcataaa

SEQ ID NO: 12200 - DNA, 2474 bp, Amsonia hubrichtii
tgtaattatcgctatcaatttctctctcctctctcttgcttcgtcctggttgatcttgatttgaattctactctaggccactaagatggcaacacacaccccaaagaatattcttattactggagctgctggatttattgcatctcatgttgcaaaccggctcattaggaactaccctgaatataaaattgttgtcctcgacaagcttgactactgctcaaatttgaagaacctccttccttcccagtcatcccctaacttcaagtttgtcaagggggatattgctagtgctgatcttgtcaactaccttctcataacagagtcaattgacacaataatgcactttgctgcgcagacccatgttgataactcatttggtaatagctttgagttcaccaagaacaacatttatggcacacacgtgctactagaggcttgcaaagttactggccagatcaagaggtttatccatgtaagcacagatgaggtttatggagagacagatgaagatgctgttgtgggaaatcatgaagcctcacaactcctccctaccaacccatattcagccaccaaagcgggagcggaaatgcttgttatggcatatggtaggtcatatggattacctgtaataactacacgagggaacaatgtttatggtcccaatcagttccctgaaaagttgatcccaaagttcatccttttggccatgagagggaagaatcttccaattcacggagatggttctaatgtgcgcagctatctctattgcgaggatgttgcagaagcatttgaagttattcttcacaggggagaagttggtcatgtttacaacattgggacaaagaaggaaagaagggtaattgatgttgccaaagatatatgcaaactttttaacatggatactgaaaccagcattgagtttgtggagaataggccatttaatgatcagagatatttcctagatgatcagaagctaacgaacttgggctggtcagagaggacaacatgggaagaaggactaaaaaagactatggaatggtacacccaaaatcctgattggtggggggatgtttctggagcgttgcttcctcatcctagaatgctgatgatgcctggtgggatagaaaagcttcttgatgggtctgataagtatgaatctggatcttctgaattctcagggaaatcaaatcaggaccgaatgcttgtcccaccttctaagagcccacctaataaaccatccttgaaattcttgatctatggtagaactgggtggattggcggtctgcttgggaaattgtgtgagaaacaagggattccatacgagtatggaagggggcgaatggaggaccgctcacaacttttagcagacatccaaattgttaagcccacccatgttttcaatgctgctggggtgactggtagaccaaatgttgattggtgtgaatcacacaagactgaaacgattcgtacaaatgttgccgggactctaactttggcagatatctgcagagagcacggtctcttgatgattaactttgcaactgggtgtatatttgaatatgatgctgcacatccagaaggatctggtatcgggtataaggaggaagacacacctaatttcactggatctttctattcaaagaccaaggcgatggttgaggagctactgaaagagtacgacaatgtctgcactcttcgggttcggatgccaatctcttcagacctcagcaacccacgaaatttcatcaccaagattagccgatataataaggtagttaacattcccaacagcatgaccatcttggatgaacttctgcctatttccattgagatggcaaaacgaaatctcaggggcatttggaacttcacaaatcctggggtggttagccataatgagattctggagatgtacaagaagtacatagatccagaatttaaatggtccaactttacacttgaggagcaagcgaaggttataatcgcccctcgaagcaataatgagatggatgccaccaaattgaagaacgaattccctgaattgctacctatcaaggagtcattgataaagtatgtctttgaacctaacaagaaaacatctgctgcttgaattagcgtctagagagaaacggtggggctaaattttgcatttctgtatcaggccatattatcgtgtgttagtcggtattagttattattgatgataacctcggctcattcttttgtattgttttagaatctggatagtgattagggaggctttactaggttaccttcatttctctatctcccaagtcttagctcagcattcgagaatgaatatcacatattccttgtaagtttattacatctgttgttccattatgcaggattggaaaatttgtaacactatatggatttatttgatgttcatttgtcacctttacagccaagatgctttgcacaattagaaaataactgtttagttatgtaggtac

SEQ ID NO: 12201 - DNA, 2431 bp, Olea europaea
gttagtgtctctccttacttctcgccactgagtcattcatattccttaattacttggtccgaagcattttcctcgctttgtttctctctctggaggtggaatttttggtgtgcttggtggattttgatctgaattattaaaaaatttgcagattttgagcaataatggcgacatatacacccaagaatatcctcattactggtgctgccggatttattgcatctcatgttgcaaataggcttatcagaaactatcctgactacaagattgttgtcctagacaagcttgattactgttctaaccttaagaacctccttccttccagtgcttcccctaacttcaagtttgttaagggggacatcggtagtgatgatcttgtcaactaccttctcattactgaaaacattgacactataatgcactttgcagctcagacccacgttgataattcttttggtaacagttttgagttcaccaagaacaacatttatggcacccatgttctattggaggcctgcaaagttactggacaaatcaaaagatttattcatgtaagcacggatgaggtatatggagagactgatgaggatgctgttgtaggaaatcacgaggcgtcgcaactcctgcccacaaacccatattcagccacaaaagcaggggcagaaatgcttgttatggcttatggtagatcttatggattgcctgtgataaccactcgtggaaacaatgtttatggtccaaatcagtttcccgaaaagttaattcccaagtttatccttttagccatgagagggcagcctcttcctattcatggggatggttctaatgtgcgaagttatctctattgtgaggacgttgctgaggcattcgaatgtgttcttcacaagggcgaagttggtcatgtttacaacattggaacgacgagggagaggagagtaattgatgtcgcacaagatatatgcaatttatttaacacggacccggacaaaagcattcagtttgtggataacaggccattcaatgatcagagatacttccttgatgatcagaagctgaagaagctgggttggattgagaggactacatggaatgaaggtttgagaaagaccatggagtggtataccagcaatcctgactggtggggtgatgtatctggagcactggttcctcatcctagaatgctcatgatgcctggtggaattgaaagacttgatggagctgacaaggacgagtctaaaaagtctgaattcttgggcaagcctaaccagagccacatggtggttccttcctccaaaaacaatacatctcaaaaaccaccattgaagttcttgatctatggtaggactgggtggattggcggtttgctcggaaaattatgtgagaaacaggggattccgtatgagtatggaaagggacgcttgcaggatcgctctcagctgttggcggatatcctcagtgttaagccaactcacgtatttaatgctgctggtgtaactggtagacccaatgttgattggtgtgagagtcacaagacagaaacaattcgcaccaatgttgctggtacactgaccttagctgatgcatgcagagagcatggacttctgatgatgaattttgccacagggtgtatatttgaatataatgctacacaccctgaaggttctggcattgggtttaaggaggaagacacgcccaatttcataggttccttttattcaaaaaccaaggccatggtggaagagctcttgaaagaatatgacaacgtctgcacactcagagttcgaatgccaatatcttctgacctcaacaatccgcgaaacttcattaccaagatttccaagtataacaaggtggttaatattcccaatagcatgaccatcttagacgagcttcttcctatctcaatcgagatggcaaagcgaaacctcaggggcatttggaacttcacaaacccgggtgttgtgagccacaatgaaattttggagatgtacaaggagtacattgatccagaattcaaatgggttaacttcacacttgaagagcaagctaaggtgattattgctcctcgaagtaacaacgaattggatgcctccaagttgaagaaagagttccccgatttgctctcgatcaaggagtcgttgatccagtatgtttttgaacccaacaggaaaaccccttctgcttaattattttgggttgtcaatctgagtgctgatattggattttgtataagtatgtttagccatgatcttgctgagctgcagcttatttttagagtaatttacattttcagaatctgggatagttgctgtgatagttctatctgtcatattcatttttattcttctatgaatcacttcttagattgatatggaaagaacacaatgttgaggtgtaatatttaaaatttataatataaagtgattctttt

SEQ ID NO: 12202 - DNA, 2628 bp, Prunus mume
cggctctcctcaactgattctgagattctcagagtcgtatatatatatatatacgtagagactctgcacctccggtctttcacaaatcaatccgtggctgaggcttcttcgtccgaatttctctgtctgggggttggtcgattttgattcaggccaaaatctaaggttccttgacatgggttcatatacccccaagaacatcctcataactggggctgctggcttcattgcatctcatgttgccaaccggctcatccgcagttaccctgactacaacattgttgtgcttgacaagcttgactattgttcaaatctgaaaaacctccttccctctaaatcatcacccaatttcaagtttgttaagggggacattggcagtgctgatcttgtcaactatctcctcatcactgagtcgattgacaccataatgcattttgcagcccagacccatgtcgacaattcctttggtaacagctttgagttcacaaagaacaacatctatggcacccatgttctgctagaagcatgcaaagtgactggccaaatcaggaggttcatccatgtcagcacagatgaggtctatggtgagactgatgaagatgctgttgtaggaaaccatgaagcatctcaactcctcccaacaaatccatactctgcaacaaaagcgggagcagaaatgcttgttatggcgtatgggagatcatatggattgcctgttataacgacccgtggaaacaatgtttatggaccaaatcaatttcctgaaaaattgattccaaagttcattctattggccatgcaagggaagcctcttccaattcatggggatggctctaatgtgagaagctatctatactgtgaggatgttgcggaagcttttgaactcattcttcacaagggggaagttggccatgtttacaatattggaacaaagaaggaaaggagagttattgatgtggccaaagatatatgcagacttttctcagtggacccagagacaaacatcaagtttgttgaaaacagacctttcaatgatcagaggtatttcctagatgatcagaagctaaagattttggggtggtcagagcgaactatatggcaagaggggttgaagaagactatagaatggtacactaagaatcctaattggtggggtgatgtgtctggggcactgctgcctcatccacgaatgctgatgatgcctggtgggattgagagacatctggaagggtctgaagaggaaaaatctgaatcttttgtcccaagtaatacccgaatgttggttccaccttccaaaagctgtagctctcctcgtaaacctccctataagttcttgatctatggtaagactggctggattgggggtctacttggaaagctatgtgaaaaacaagggattccttttgaatatggcaaagggcgtctacaggatcgatcatcactcttggcagatattcagaatgtcaggccaacccatgtgttcaatgctgctggtgtgactggtagacctaatgttgattggtgtgaatcccataaagcagaaactattcgagccaatgttgctggaaccttaaccctagcagatgtttgcagagagcatggactcttgatgttgaattttgccactggctgtatatttgagtatgatgctaaacatccggagggttctggagttgggttcactgaagaggacaaacccaatttttttggttcgttctattccaaaaccaaggccatggttgaggagctgttgaaagaatatgacaatgtttgcacgcttagagtgcgaatgcccatctcatctgacctgaacaaccctcgtaacttcatcactaagatttctcgttataacaaagtggttaatatccctaacagcgttaccatcttggatgaattactacccatctctattgagatggcgaagcggaacttgagaggtatatggaactttacaaaccctggggtcgttagccataatgagattctggagatgtacaagcattacattgacccaaagtttacatgggcaaatttcacaattgaagagcaagccaaggttatagttgcagctcgaagcaacaatgaaatggatgcatccaagttgaagaaagagttccctgagttgctaccggtcaaggagtcgctgattaagtatgtttttgaaccaaacaagacaaactccacacaataagcaaatcgcagttatagacctcaggattaacctctgctttccgcattaggtgatatgctatagatgacctcaatttagtttaatcagtatcagtcattattcattcttagccttgtctcattatttcttctgtgctagagttgttggtatgattttactaagtgtgcttctttcttttctgttttcttgggtgtatcttagtttcctttgtgttccattttataagaaactttgaacaggttccctatagatgattctgtaattttgcattcagttcaatgaacatgtggtgttgcattctgtcccttcgagctcaagagccaaaagaaaatccagggagaaatcgtctaaagcttcatagtataattattcatgcatggattttaatttcaaaatcaacgcgttcagaagagtttttgacagtgtcaaccaaagat

SEQ ID NO: 12203 - DNA, 2426 bp, Arabidopsis thaliana
aggagtctttagtgttcgttctcttcttcttctatttttgctgtgtgacgaacgagaagactcttttttgaattttgattcttcttcttctccgtttctttcgctacttcctcagcttcgtcaccgtcgaaaattcttcacgttttcctcggaattttccaattgtcttctccaattctcttgcgatcgttgaagatctgaaaaattcgaagcgtttgatcatggcttcgtacactcccaagaacattctcatcaccggagctgctggtttcattgcgtctcatgtcgccaacagactcatacgaagctatcctgattacaaaatcgttgtgcttgacaagcttgattactgttcaaatctcaagaatctcaatccttctaagcactctccgaacttcaagtttgtcaaaggtgatatcgctagtgctgacttggtgaatcatcttctcatcactgaaggtattgacaccatcatgcatttcgctgctcagactcacgtcgacaattccttcggtaacagtttcgagtttactaagaataatatctatggaactcatgtccttcttgaggcttgtaaagttactggtcagattaggaggtttattcatgttagtactgatgaagtttatggtgaaactgatgaggatgctcttgttggtaaccatgaggcttctcagctgcttccgacgaatccttactctgccacgaaagctggtgctgagatgcttgttatggcttatggtagatcttatggtttgcctgttattaccactcgtgggaataacgtctatggaccgaatcagtttcctgagaagttgattcctaagttcattttgctggcaatgagagggcaggttcttcccattcatggagatggatcaaatgtcaggagctacctctactgtgaagacgttgctgaggcttttgaagttgttcttcacaagggagaagttggccatgtttacaatattgggacgaagaaggagaggagagtgaatgatgttgccaaagacatctgcaaactcttcaacatggaccctgaggcgaacatcaagtttgtcgacaacagaccttttaacgatcagaggtacttccttgacgatcagaagctcaaaaagttgggatggtcagagagaaccacgtgggaagaagggttgaagaaaactatggattggtacacacagaacccggagtggtggggtgatgtttctggagcattgcttcctcatccaaggatgctgatgatgcctggtgggcgacactttgatggctccgaggacaattcgctggcagctactttatctgaaaaaccaagtcaaacccatatggttgttccaagccaaaggagcaacggcacacctcaaaagccttcgctgaagttcctgatatatggaaagaccggatggatcggtggtctgcttggaaagatatgtgataagcaaggaattgcttacgagtatgggaaaggtcggttggaggatcgatcttctcttctgcaggatattcagagtgttaagccaacccatgttttcaattccgctggtgtgactgggagacccaatgttgactggtgtgagtctcacaagaccgagactatccgtgccaatgtagctggcacattgactctagctgatgtctgcagagagcacggactcctaatgatgaatttcgctactggttgtatattcgaatatgacgacaagcatccggaaggttcaggaattggcttcaaggaggaagacacacccaacttcactggctctttctactcgaaaaccaaagccatggtcgaggagctgctaaaggagtatgacaacgtatgcacattgagggtaaggatgccgatctcctcggatctaaacaacccgcgcaacttcatcaccaagatctccaggtacaacaaagtagtgaacatcccaaacagcatgactgtgttggacgagttattaccaatctccatcgagatggcgaaaagaaacttgaaaggaatctggaacttcacaaacccaggtgtggtgagccacaacgagatcctagagatgtacagagactacatcaaccctgaattcaaatgggcaaacttcacattagaggagcaagctaaagtcattgtggctccaagaagcaacaacgagatggatgcttccaagctcaagaaagagttccctgagctactctctatcaaggagtctctgattaagtatgcatacgggccaaacaagaaaacctgaagagaatgattgtgattcgtcattagataatcacctttaatatcagtttcgtgtattttgttttgttattgtttaattaccccttctttcattagatttgcttaaggggtgtatttgtagttcgaatattatatgtaataagagcttgttctcatttgtgtcataagttgctctactcttattatattagaatca

SEQ ID NO: 12204 - DNA, 2384 bp, Chrysanthemum coronarium
catatatttctcgtgatcttaattaatcatcatcacctttcccttgattcacttttacatccgggatggctacttacacgccaaagaatatcttaatcaccggggctgctggcttcattgcctctcatgtcgctaatcgcctcatcagaagctaccctgattacaagattgtcgtgcttgacaagcttgattattgttctaatcttaagaaccttaacccgtctagatcatctcctaactttaagtttgttaagggtgatatcgggagtgctgatctcgtcaactacctcctgatcactgagtctattgatacgattatgcactttgctgcacagactcatgttgataactcatttggcaacagttttgagttcaccaagaataacatctatgggacacacgtgcttttagaggcgtgtaaggttactggtcagattagaaggtttatccatgtgagtactgatgaggtttatggggaaaccgaggaggatgctattgttggtaaccatgaagcttcacaacttcttccaacaaacccgtattcggccacaaaagctggtgctgaaatgcttgttatggcttatggtaggtcatacgggttgcctgtgatcaccacacgaggaaacaatgtttatggcccaaaccagttccctgaaaaactaatccccaagtttatccttttggctatgcaaggaaagccacttccgattcacggtgatggttctaatgtaaggagttacctctactgtgaggatgttgctgaggcgtttgaagtgattcttcacaagggtgaagtcggtcatgtttacaacatcgggacgaaaagggagaggagagttatcgatgttgcaaaagatatgtgcaagcttttcaatctggatgctgatgcaagcatcaagtttgttgaaaaccgaccctttaatgatcagaggtactttttggatgacgagaagttgaagtgcctgggttggtctgagagaacccgatgggaagagggtctgaaaaagaccatcgagtggtacactagcaatcctaattggtggggagatgtctctggtgcactgctccctcatccgagaatgttgatgatgcctggtggagttgatcgacttgctgatggacccgatcactctgaatttgatgctgctgatccagcaatcaacactgcacagatcggagtgcaagttccctcaaagaccagtaacaacgctgctaaaaaaccagcattgaagttcctcatctatggtaagacagggtggatcggtggtttacttgggaaactgtgtgagaaacaagggatacaatacgagtatggaagaggtcgtttggaagaccgctctcagcttatgtctgatattcagactattaagcctacccatgttttcaatgctgctggtgtcactggcagacctaatgtcgattggtgtgaatctcacaagactgaaactatccgtaccaatgtgtcgggcacattgaacctagctgatgtctgcagagaatctggtctcttaatgatcaatttcgctactggatgcatttttgagtatgatgctaaacaccccgagggttctggtatcggttttaaggaagaagatacacccaacttcaccgggtccttttattcaaagaccaaagctatggttgaggagctcttgaaaaattatgacaatgtctgcacacttcgagtccgaatgccgatatcatcagacctcaacaacccacgaaacttcatcactaagattgctcgttacaataaagttgtgaacatacccaacagcatgacaatcttggatgaacttctaccaatttcaatcgaaatggcaaaaagaaacctaaagggaatctggaacttcacaaatcctggggttgtaagccacaacgagattctggaaatgtacaaaaagtacattaacccagaattcaaatgggcgaacttcacactggaagaacaagcgttagtgatcgtggcccctcgaagcaataacgaattagatgcatcaaagttgaagaaagagttccctgagttgctttcaatcaaggagtcattgatcaagtacgtattcgaacccaacaaaacacagtaataatgattcttttttagcatttgtaaactccagattcacttgtgttctcgttacttactagttactgtatggtttgcattatacatctgtaatgtttaagtcaaagtcaaagacagagtcagtcgatggcagttatcgtaccacatttgttctagtctttgtttcctagtatgatcacactgagattatagggggccatttgtctaggtattttatattcatcatattccgttacaaccaatgttagtttgtttaacagttgttacgaatattttccctttagttttgttaaaaaccgca

SEQ ID NO: 12205 - DNA, 2727 bp, Solanum lycopersicum
attattttctggtaaaaaatatggagatggtgatttgatttttttttgcatgagagagggtttttgcgggtataaatacacaaacaacaagatacttgactctcatcaatacacgctttctctctctaaaaaatcttttacgtttctcactctctgtgagaaactcaaaaatctgtatccatatttttacatattgggttctgaaacaaaaaaaataatcaaaaacgggtttaagttgctgttaagctctgaatatatttgatcgacatcaaaatgtctaactatacaccaaagaatatactcattactggggccgcagggtttattgcatctcatgttgccaaccgccttgttcgtagttaccctgagtacaatattgtggttcttgacaagcttgattattgctcaaacctgaaaaatctttccccatctcgatcttcccctaatttcaagtttgttaagggagatattggcagtgctgatcttgttaactaccttctcatcaccgagaacattgacactataatgcactttgctgctcagacccatgtcgacaactcctttggtaatagctttgagttcaccaagaacaacatttatggcacacacgtgctattagaggcatgcaaagttactggtcagatcagaaggtttatacatgttagcactgatgaggtttacggagagactgatgaagatgctgttgtaggaaatcatgaagcatcgcaacttctccccacaaacccatattcagccacgaaagctggagctgaaatgcttgttatggcatatgcaagatcatatggattgcctgttatcaccactagagggaacaatgtgtatggtcccaatcaatttcctgagaagctaatcccaaagttcatacttttagctttgaatgggaagcctcttccgattcacggagatggttcaaatgttagaagttatctctattgtgaggacgttgctgaggctttcgaagttgttcttcaccgaggtgatgttggtcatgtttataacatcgggactaagaaagagaggcgagtgattgatgttgccaaagatatatccaatctttttaacaaggatccagacacaagcattcagtttgtggaaaacaggcccttcaatgaccagaggtatttcttagatgatcagaagttgaagaacctcggttggtccgagaagaccacctgggaagagggtctgaaaaaaaccatggagtggtatgtcaataatcctgattggtggggagatgtctcaggggcattgcttccccatcctagaatgctgatgatgcctggtggggtagagagaaattcggatggagctgaaaaagatgattctggatcatctgagatctcaggaaacacgaaacttaacggaatggtagttccagcttccaagatcagcaactcccctagtagatcaccttataagtttttgatttatggtagaactgggtggattggtggtctcctaagcaaactgtgtgagaaacagggaattccttatgagtatggaaagggacgtctggaggatcgctcacaacttttgtcagacattcatgctgtgaagcccacacatgtattcaatgctgctggtgtcactggtaggcccaatgttgattggtgtgagagtcataagactgaaacaatccgtacaaatgttgctggaactctaaacttggcagatgtttgtaaagagaatggtttactgatgatgaattttgcaaccggttgcatattcgaatacgatgctgcacaccccgaaggttctggcattggattcaaagaggaagacacacccaatttcaccggttctttctattcaaagaccaaggccatggttgaagagttgttgaaagagtaccccaatgtttgcacccttagagtcaggatgccaatttcttcagacctcaacaacccccgtaacttcatcaccaagattagccgctacaataaagtggtcaacattcccaacagcatgacgattttggatgagcttcttccaatttcaatcgagatggcaaagcgtaatctcacaggcatatggaatttcacaaaccctggtgttgtgagccataacgagatcttggagatgtacaagaaatacataaacccagaatttaaatggtccaacttcacactggaagagcaggctaaggtaattgttgcacctcgcagtaacaatgaaatggacgcgtccaagttgaaaaaggagttccctgagttgttgtctatcaaagaatcattgatcaaaaatgtgtttgaaccaaatagaaaaacttctgcataagaagcccatcaggatgtggagagcagacttctggtttggatcaatatgctacttgactttctactctagtttagtcattattagccatcattttaaaatatttaggttcttactggtgtctagaattcctacacttggtctatgttgtcagtttatttatgagtttaatgtgctataaggtggtttgcgtaggagttaccattcatcttttatcagctcgggtcgatttgttggatcttaatatatatgaaattatgatttgtttcttgctccatttgtgttgtgctagtttccttcacatattgtcatattgattgggaagtagctttgtgttttgccagtattctttaggcagatggcatgtatagaaacatttctgttgagctccagcagtaaacaatgtaagggcatatttagtttgaattgttc

SEQ ID NO: 12206 - DNA, 2461 bp, Citrus clementina
cttccctctcactcttcaaaaagatcactgcggtttcttctcagtttccattttcaacacagtttctctctctagattcgcgttttggcatttgggtttgactcgtcttcgttgatctgatcgtctttaagttgatttgcaatggctacgtataccccgaagaacatcctcatcactggggctgctgggttcattgcttcccatgtatgcaaccggctgattcgtaactatcccgagtacaaaattgttgtgcttgacaagcttgattattgttcgaatctgaaaaacctaataccctccaaagcatcctccaactttaagtttgttaagggggacattgccagtgctgaccttgtcaactttcttctcatcactgagtccattgacactattatgcactttgctgcgcaaactcatgtggacaactcttttggaaatagttttgagtttaccaagaacaatatctatggtactcatgtcctccttgaagcctgcaaagtgactgggcagatccggaggttcatccatgtcagcacagatgaggtctatggggagactgacgaggatgctgttgtgggtaaccatgaagcttcccaactcctgccaacaaatccttattctgcaactaaagctggagcagaaatgcttgttatggcttatggtaggtcatatgggctaccagtgattacaacccgtggaaacaatgtttatggaccaaatcagttccctgaaaaactaattccaaagtttatcctcttggccatgaggggtttgcctcttccaattcatggtgatggttctaatgtgagaagttatttatactgtgaggatgttgctgaggcttttgaatgcattcttcacaagggagaagttggccatgtttacaatgttggtacaaagaaggaaaggagagtgattgatgtggcaaaagatatttgcaaactcttttcaatggaccctgagacaagcatcaagtttgtagaaaataggccatttaatgatcagaggtattttcttgatgatcagaagctgacaagcttggggtggtcagaacgaaccatatgggaagaagggttgaggaagactattgagtggtacactcagaaccctgattggtggggtgatgtctctggtgctctgcttcctcatccaagaatgctgatgatgcctggtgggagacattttgatgggtctgaagagaacaaagcggtgtccagtgtctcaacaaataacattcagtcccgtatggtggttccagtttccaaatgcagctctcctcgaaaaccatccatgaagtttttgatctatggcaggacaggatggattggaggtctactaggaaagttgtgtgagaaagagggtattccatttgaatatggaaaaggacgtttggaggatcgttcatctctcattgcagatgttcagagtgttaaacccacacatgttttcaatgctgctggtgttactggcagacccaatgttgattggtgtgaatctcataaaactgacaccattcgcaccaatgttgctggaaccttaaccttggcagatgtttgcagagaacatgggatcttgatgatgaattatgctaccggttgcatatttgagtatgatgctgctcatcctgagggctctggcattgggtataaagaggaagatacacccaattttactggttctttctactcaaaaaccaaggccatggttgaagagctgttgaaagaatacgacaatgtttgcactctcagagtccgaatgccaatatcttctgacctaaacaacccccgcaacttcattaccaagatttctcgttataacaaggtggtcaacattccaaacagtatgactgttttggatgaacttctccccatttcaattgagatggcaaagcgtaacttgaggggtatttggaacttcacaaaccctggggttgtgagccacaatgaaattcttgagatgtacaagaagtacattaacccagaattcaagtgggtgaacttcacattagaagagcaagcaaaggtgatagtcgccccaagaagcaacaacgagatggatgcttctaagttgaagaaggagttccctgagttgctatccatcaaggattcactgatcaagtatgtctttgagcccaacaagaaaacctagggtacattaagcagctttcagttgtaggggcctcttgtttgaccaacacattctgcattacataataggtttggagtaccattgtactgttaatcagctttactcatttctttttggtgtaatcactttatatttactgcactagagataattagccatgcttctttcattatttttcttggagttttattgagatatggttagtgtattttttctagaataggttgctaatatttaatggcatctgctagttgctagtatgtaacttttgcagtatctgttaaatgaatatggccgcatgctgttcgatgta

SEQ ID NO: 12207 - DNA, 2351 bp, Cucumis sativus
ttggttttgacatggctacgcacactcctaagaacatcctcattaccggggctgctggatttattgcatcccatgtcgctaacagacttgtgagaaactatcctggctacaaaattgttgtacttgacaagcttgattattgctcaaatctgaagaaccttcttccatctaaaccatctcccaatttcaaatttgttaagggagacattggcagtgctgaccttgtcaattatctcctaattactgagtccattgacacaattatgcactttgctgcccagactcatgttgacaactcgtttggtaatagttttgagttcacgaagaataacatctatggtacacatgttcttttagaagcatgcaaggtcactggacagattcggaggttcatccacgttagtacggatgaagtgtatggagagacagacgaggatgctgttgtgggaaaccatgaggcttcccaactcctcccaacaaatccttattctgcgacaaaagctggagctgaaatgcttgtgatggcctatggtaggtcatatggattacctgtgatcacgaccagaggaaacaatgtttatggacctaatcagtttcctgagaagctaattccaaagttcattcttttggccatgagaggtcagcctcttcccattcatggagatggttctaatgttaggagttatctgtactgtgaggatgttgctgaggcttttgaagtcattcttcacaaaggagaggttggccatgtttataacattgggacaaagaaggagagaagggttatagatgttgcaaaggatatatgcagacttttctcgatggatgcagatgcaagcatcaaatttgtagaaaacagaccttttaacgatcagaggtatttcttggatgacgagaaactcaagaacttgggatggtcagaacgtacaacatgggaagaagggctgaagaagacaattgaatggtacaccaagaaccctgattggtggggtgatgtctctggggctttgctgccacatcctagaatgctgatgatgcccggtggagttgagaggcactttgaagggtctgaagagggaaaaccagccgcttatgcttcaagtaatactaaaatggttgtcccaacctccaggaatccaggcactcctcaccagtcatccttcaaatttttgatatatggtaggacagggtggattggaggccttcttgggcagttatgcgataaacaaggcattgcctatgcgtatggcaaagggcgtctagaggatcgagcctcacttttggcggatattcagaatattaaaccaacccatgtttttaatgctgccggcgtgacaggcagacccaatgttgattggtgtgaatctcacaaaacagagactattcgagctaatgttgcgggaaccttgtctttagcagatgtttgcagggagcatggactcttgatgatgaactttgccactggctgtatatttgagtacgatgctaaacatccagagggttctggtattggatttaaagaggaggacaagccaaatttcattggttccttttattcaaaaaccaaggccatggtggaggagcttctgaaagaatatgataacgtctgcaccctccgagttcggatgccgatatcatctgacttgaacaacccacgcaacttcattaccaagatttctcgctacagtaaggtggttaacatcccaaacagcatgaccatcctggatgagcttctgcccatttcgatcgagatggcaaagcgtaacttgaggggcatctggaacttcacaaaccccggtgttgtgagtcacaatgagattctggagatgtacaagaaatacatcgaccctgaattcaagtgggctaacttcacactggaagaacaggctaaggtaattgtggctcccagaagcaacaatgagatggatgcttcaaagttaaagaatgagttcccggagatgctcgggatcaaggagtcgttgatcaagtacgtcttcgaaccaaacaagaaaacctctgcctaataagttttgatctatagaacttaggattcataattgcattctgcattagtttacatgtttatgattatcacatttcatctatgatgatgatgcttcattttcactcataattaattgttattgtttctgctctgctgctatagaaggtgagattagattcaaatccacctgatatgatgtattttagattttttttcttttttggtcctgggtttatcaaaagcattattttaggataccagaaaactgtagtctgcattgtgcagaagaactgcaagtttcaaatcctataattgaatggtattaatttttgcatattattatttt

SEQ ID NO: 12208 - DNA, 2503 bp, Citrullus lanatus
ctttcgcctcattgcttttcgcaattcgtctctgcttttcttttccatttccttctcccgaagatctctctctccttccctctcttctctctctacaagagaagttgctttgacatggctacacacactcctaagaacatcctcattactggggctgctgggtttattgcatcccatgttgctaacagacttgtgagaaactatcctggctacaaaattgttgtacttgacaagcttgattattgctcaaatctgaagaaccttcttccatctaaaccatctcccaacttcaaattcgttaagggagacattggcagtgctgatcttgtcaattatctcctaattactgagtcgattgacacaattatgcactttgctgctcagactcatgttgacaactcatttggtaatagtttcgagttcacaaagaataacatctatggtacgcatgttcttttagaagcatgcaaggtcactggccagattcggaggttcatccatgttagtacggatgaagtgtatggagagacagatgaggatgctgttgtgggaaaccatgaggcttctcaactcctaccaacgaatccgtactctgcgacaaaagctggagctgaaatgcttgtgatggcctatggtaggtcgtatggattacctgtgatcacgacccgaggaaacaatgtctatggacctaatcagtttcctgagaagctaattccaaagttcattcttttggccatgaggggtcagtctcttccaattcatggggatggttctaatgttaggagttatctgtactgtgaggatgttgctgaggcttttgaagtcattcttcacaaaggagaggttggccatgtttataacattgggacaaagaaggagagaagggttatagatgttgcaaaggatatatgcagacttttttcgatggatgcagatgcaagcatcaagtttgtagaaaacagaccttttaatgatcagaggtatttcttggatgatgagaaactcaagaacttgggatggtcggaacgtacaacgtgggaagaagggctgaagaagacaattgaatggtacaccaagaaccctgattggtggggtgatgtctctggggctttgctgccacatcctagaatgctaatgatgcccggtggagttgagaggcactttgaagggtctgaagagggaaaaccagctgcttatgcttcgagtaatactaaaatggttgtcccaacttccaggaatccaggctctcctcaccagtcatccttcaaatttttgatatatggtaggacagggtggattggaggccttcttggacagctatgtgataaacaaggcattgcctatgcatacggcaaagggcgtctggaggatcgggcctcacttttggcagatattcagaatattaaaccgacccatgttttcaatgctgcaggagtgactggcagacccaatgttgattggtgtgaatctcacaaaacagagactattcgagccaatgttgctggtaccttaactttagcagatgtttgccgggagcacgggctcttgatgatgaactttgccactgggtgtatatttgagtacgatgccaaacatccagagggttctggtattggatttaaagaggaggacaagccaaatttcattggttccttttattcaaaaaccaaggccatggtggaggagcttctgaaagaatatgataacgtctgcacccttcgagttcggatgccgatatcatctgacttgaacaacccacgcaacttcattaccaagatttcccgctacaataaggtggttaacatcccaaacagcatgaccatcctggatgagcttctgcccatttcgatcgagatggcaaagcgtaacttaaggggcatctggaacttcacaaaccccggcgttgtgagtcacaatgagattcttgagatgtacaagaaatacatcgaccctgaattcaaatgggctaacttcacacttgaagaacaggctaaggtaattgtggcccccagaagcaacaatgagatggatgcttcaaagttgaagaacgagttcccagagatgctcgggatcaaggagtcgttgatcaagtacgtcttcgagccaaacaagaaaacctctgcctaataagttttgatctttagaacttaggattcataattgcattctgcattagttatatgtttatgattgtcacatttcatctatgatgatgatgtttttcattttcattcataattaattgttattgtttctgctctgctgctatagaaggtgagattagattcaatccacctgatgatgtattttagagttttcttttttttttttttccccttttctttgtcctggctctatcaaaagtattattttaggataccagaaaactgtagtctgcattgtgcagaagaactacaagtttcaaatcctatgaatgaatggtattaatttttgcagattattattttattcccctatattctcttttccaaaagtaccaata

SEQ ID NO: 12209 - DNA, 2509 bp, Trifolium pratense
cttttcttctcattctctttaccaatttaagttgcttgatatggcaacgcacaccccaaaaaatatcctgattaccggggcagctggattcattgcatctcatgttgccaaccggctaatccggaattatcctgactacaaaattgttgtgctcgacaaacttgattactgttctaatctgaagaacctcattccttcaaaatcatctcctaacttcaagtttgtgaagggagacattgaaagtgctgatcttgtcaactaccttctcattaccgagtctatcgacacaattatgcactttgctgctcaaactcatgttgacaactctttcggtaatagttttgagttcaccaagaacaacatatatggtactcatgtcttattagaagcctgcaaggtaacgggacagatcaaaaggttcatccatgtaagcactgacgaggtctatggagagacagatgaggatgccgttgttggaaaccatgaagcttctcagctacttccgacaaatccatactctgcaactaaagctggggcagaaatgcttgtcatggcctatggtaggtcgtatggactacctgtgatcacaacacgcggaaacaatgtctatggcccgaaccagtttcctgaaaagctaattccaaagttcatccttttggcaatgcaaggcaaagttcttccgattcatggtgatggttcaaatgtgaggagttatttatattgtgaagatgttgcagaggcttttgaagttatccttcataagggagaggttggacatgtttacaatattggaacaaaaaaggaaaggcgtgttattgatgtagccacagatatatgccgactcttctcgatggatccagagactagcataaagtttgtagagaacagaccgtttaatgatcagaggtactttcttgacgaccaaaagttgaaggttttgggttggtcggagagaacaacgtgggaagaaggcttgaagaaaaccatggattggtatatcaacaatcctaattggtggggtgatgtgagcggtgcattgcttcctcatccaaggatgttaatgatgcctggtggtatggagagacatttcgacggatctgaagaagaaaattctgcaaactatgtctcaagtacgaatactcgaatggtggttccaccaaccaagaacattggctcctcacaaaaacctcctctcaagttcttgatctatggcagaacaggttggatcggtggtctgctggggaaactgtgtgagaagcaagggattccttatgagtatggaaaagggcgccttgaggatcgttcatcacttgtggctgatattcagaacgtgaagccaactcatattttcaatgcagcaggagtgaccggaagacctaatgttgattggtgtgaatctcataaaactgaaaccatccgtgtcaacgttgctgggactttaacattggctgacgtaagcagagagcatgatcttttgatgataaactatgctactggatgcatattcgagtacgatgaagctcatccagaaggttcaggcattggttttaaggaggaagacacacctaatttcaccggttctttctattccaaaactaaggctatggttgaagagctcttgaaagaatatgataatgtatgcacgcttagggttcgcatgccgatatcatctgacctaagcaatccacgcaacttcatcaccaagatttctcgttacaacaaagtagttaacatcccaaacagcatgactattttggacgaacttcttcctatttcaattgagatggcaaagaggaacttaaggggtatctggaacttcacaaatcctggtgccgtgagccacaacgagattctcgagatgtacagggattacattgatccaaacttcaagtgggttaacttcacactagaagagcaagccaaagtgatagttgctgcaagaagcaacaatgaaatggatgcatccaaactgaaaagtgagtttccagaattgctttccattaaggaatcacttatcaagaatgtctttgagccaaacaagaaaagtgcttaaaaaagatcaagtagcttcaagttttaggacatcatttgctaccaaattttcttgtctggctacttagattatcactctcattatttcattgttatcgttccatcatgttattgtctttagaggatggtattgataattgataagttttattatacttgggtttagtaatggttctaaacagttttatgcagctttattatagttcatagtgtactatggtttagagcatccttagggtcttgtttgttaccttgtgatcttgctatggatatacttggtagtattgaagacatgtattcttttattactcatcttttttgtgacatgtgtttgtatttgtatttgtcttgtaattgagattcatttaattttctcatttagagaaaaactagtgttgttgagcacttatgttgtggaaaatacaaatataacaccatttgaacaaacaaagcctta

SEQ ID NO: 12210 - DNA, 2581 bp, Medicago truncatula
atacacaatcgcatagtatataaatacagaacaaagaaagagtatagactccaaatctaaatctccgtagatttcgatttcagttcctattttctctcttcaattctttatattttcttccaatttaagtttctgatatggcaacgcacaccccaaaaaacatcctcattacgggggcagctggattcattgcgtctcatgttgccaaccggcttatccggaactatcccgactacaaaattgtggtcctcgacaaactcgattactgttctaatctgaagaaccttattccttcaagatcatctccaaacttcaagtttgtgaagggagacattgaaagtgctgatcttgttaactaccttctcataaccgagtcgatcgacacaattatgcactttgctgctcaaactcatgtcgacaactcttttggtaacagctttgagttcaccaagaacaacatatatggtactcatgtcttattagaagcttgcaaggtaactggtcagatcaaaagattcatccatgtaagcactgatgaggtctatggagaaacagatgaggatgcggttgttggaaaccacgaggcttctcagctacttccgacaaatccgtactctgccacaaaagctggggctgaaatgctcgtcatggcgtatggtaggtcttatgggttgccggtgatcacaactcgtggaaacaatgtctatggcccgaatcagtttcctgaaaagttgattccaaagtttatcctcttggcaatgcaaggaaaagttcttccgattcatggtgatggttcaaatgtgaggagttatttgtattgtgaagatgttgcagaggcttttgaagttatccttcataagggagaggttggacatgtttacaatattggaactaagaaggaaaggagagttattgatgtagccaccgatgtatgcaaactcttctcaattgatcctgagactagtatcaaatttgtagagaacagaccgtttaatgatcagagatactttcttgacgatcaaaagttgaaggttttgggttggtcagagagaacaacatgggaagaaggcttgaagaaaaccatggactggtatatcaacaatcctaattggtggggcgatgtgagtggtgcattgcttcctcatccgaaaatgttaatgatgcctggtgggatggagagacatttcaatgggtctgaagaagaaaattctgcaccgtttgtctcaagtactaatactcgaatggtggttccacctacaaagagcattggctcttcgcagaaacctcctctcaagttcttgatctatggaagaactggttggattggtggtttgcttgggaagttgtgcgagaaacaagggattccatatgaatatggaaaagggcgtcttgaggatcgttcatcactcgtggctgatattcagaatgtgaagccaactcatattttcaatgcagcaggtgtgactggtagacctaatgttgattggtgcgaatctcataaaactgaaaccatccgtgtcaacgttgttgggactttaacattggctgatgtaagcagagagcataaccttttgatgataaactatgctaccgggtgcatattcgagtacgatgaagctcatccagaaggttcaggcattgggtttaaggaagaagacactcctaatttcgctggttctttctattccaaaaccaaggcaatggttgaagagcttttgaaagactatgacaatgtatgcactctaagggttcgcatgccgatttcatctgacctaagcaatcctcgcaatttcatcaccaagatttcacgttacaacaaggtagtcaacattccaaacagcatgactgttttggacgaacttctgcctatttcaattgagatggcaaagaggaacctaagaggtatctggaacttcacaaatcctggtgccgtgagccacaacgagattctcgagatgtacagagattacattgatccaaacttcaaatgggctaacttcacacttgaagaacaagccaaagtgatagttgctgcaagaagcaacaatgaaatggatgcatccaaattgaagaatgagttcccagaattgctttccatcaaagaatcacttatcaagtacgtctttgaggcaaacaagaaaagtgcttaacaatattaagtagcttcaagtttagaacatcatttgctaccaaatttttgtgttttggctacttagtttatcattctcattatttcattgttagtttcatactgttgttgttgtgtttagtggatgatattgataatcgataagtattataaatggggttagggatggtttctaaattacgatttatgcagctttattgaagttttcttgtgtactatgtcaagatcattcttggggtcttgtttgttgcattgtgtgcttgctacggataaacttgccattcttttcttggtagtgaagacatgtattcttttattactcatatatatctttttttgtgagttatgtttgtatcggatttgcgttgtaactgagattcatttaatttcctcatttaaataaaaatctagtgttatctagcacttatgccg

SEQ ID NO: 12211 - DNA, 2818 bp, Arnica chamissonis
agataaggttgtctgtagcagaggcatctaccacgcctgacaaccgcctgaaaagtgaagaaatccgactggactcgcatgaatgcacccacgcaggtgaagaaatccgtcgtggttgtgtgaggtagaagaacgggtacgtgaaagaggcgtgacgtgaaacaccgttacaaccgtgcgtgaagaggacgtgatgacgtgaagcgtcatcttctacgcatagcttaagagtgttagtaatacttttcgaaaaatatcttgtaaaatatctaaattgttatgcttactctatataatttcaataataatcctcaaaccacatattcccccaacaaacctcacacatgtatatatatctgtgtgtatttatcgattgaggcgtcggttgccactcctcgagtctcgcgagaagtttcgtgatctcttctcaatcacctttccggtcgagatctttctctctctcatacgcacaatctgccattgatcccgatccggattgaaatttatctccagtatggctacttacgtgccaaagaacatccttatcactggagctgctggcttcattgcctctcatgttgctaatcggctaatcagaaactaccctgattacaagattgttgtgcttgacaagcttgattattgttccaatcttaaaaacctcaacccgtccagatcgtctcccaacctcaagtttgttaagggggacattgggagcgctgaccttgtcaactacctcctgatcactgaatctattgataccataatgcactttgctgcacagacccatgttgataactcatttggcaacagttttgagttcacaaagaataacatctatggaacccatgtgcttctagaagcctgcaaagtcactggccagattagaagattcatccatgtgagcacagatgaggtctatggagaaacagaggaggatgctgttgtcggtaaccatgaagcgtcacaacttcttcctacaaacccatattcagccacaaaagctggtgcagaaatgcttgttatggcttacggtaggtcatatgggttgcccgtgattaccaccagaggaaacaatgtttacggccctaaccaattcccagaaaaactaatccctaagtacattctcctggctatgagaggacagccacttccaattcatggtgatgggtctaatgtaaggagttacctctactgtgaagacgttgctgaggctttcgaagtaattcttcacaagggggaagttggtcatgtttacaacatagggaccaaaaaggaaaggagagtgattgatgttgcaaaggatatgtgcaagcttttcaatatggatcccgattcaagcatcaagttcgtggagaacagaccattcaacgatcagaggtatttcttagatgatgagaaattgaagagcttgggttggtctgaaaggaccatatgggaagagggtctgaaaaagaccattgagtggtataccagcaaccctaattggtggggagatgtctctggagcacttctccctcatccaagaatgttaatgatgccaggtggtgctgatagacttgttgatggacctgaaaactccgaatttgattcagctgatgtggcaatcaatacttctcagatcggtgtccatatgcctagctcaaaagccagtggcatctctgctaagaaaccagctttgaagtttctcatttatgggaaaacagggtggatcggtggtttacttgggaagttatgtgacaaacagcaaattcaatacgagtatggaagaggtcgtttggaagaccgttcacaacttttggccgatattcaaactatcaaacctactcatgttttcaatgctgctggtgtcactggcagaccaaatgttgattggtgtgaatctcacaagacagaaaccatccgtaccaatgtctcgggcacactcaatcttgcagatgtctgcagagaacatggactcttgatgatcaattttgctactggatgcatttttgagtatgatgctaaacacccagaaggttctggaatcggttttaaggaagaagataagcccaatttcattgggtccttctattcaaaaaccaaagctatggtggaggagcttttgaaagaatatgacaatgtgtgcacccttagagtccgaatgcccatatcatcagatctcaacaacccacgcaattttatcaccaagattgctcgttatgataaagttgtaaacatacccaacagcatgacgatcttggacgagcttttaccaatttcaatcgagatggcgaagaggaatctgaggggaatctggaactatacaaatccgggggtggtaagccacaacgagatccttgaaatgtacaagaagtacataaatccagaatttaagtgggtaaattttacactggaagaacaagcaaaggtgatagtggcaccacgaagcaataacgagctggatgcatcaaaattgaagaaagagtttcctgaattgctatcaatcaaggagtcgttgatcaagtacgtattcgaacccaacaaaaaacagtaataataatgatatgatgattctttatagaatttgtagaactccagattcacttgtgtttggttacttgctagttcctcctgtaatgtttaaagtcaattgagtcagtcagatttgttctagtgtttgtttcctagtatcatcacactgagattataggtggcgaggccggtcctctagcggtattttatattcatctgtcttttgttacgactacagtcgacagttagtttgttcaacagtcattacgagtgttttcccttgagttttgttaaaaaccgcacg

SEQ ID NO: 12212 - DNA, 3402 bp, Chrysanthemum coronarium
tgaagaaaagaaatttccacagaaattgatcaacaagaacagatgtaagaaaaacagataacatataatcatgaaataaaagacacgtggttccactttcggccttcatagtcagtcggaataaaagcaacttagagttggataaaattcaagatggcctaaagttcagtcgtgtttgctgacaacacagttgatatgggaacatactaggcattgacattaaaatttaacaaacatacgtaaacagaaaacataaggatggagcaaacggtgagcgcgctactctatataatcgaccttagcattgaagacactaacctcttcttgtttcaacttaggaatagttaactttaacacacctgatccccttttcatctctgccttgatatcagttaacttgaagcggtcgatatattctgaatcaaaccagtaatagtaactttgtatgccgagcttggaatgtactttctgatttggtcgacctttaatggcgataatctcgtgttctacagataccttgagatcctcttccaacactccaggcattttgaggtataagcataaactttgagcatcatccctcaccctgtaaggcccaatcaaccaggcatccagtgaatctaaaagcttcattctttcattaaagcgttcacaatatttgtttagcatatatcgtacatgcggaagatctttagaccctaacgccgccgggatgacaggagatctggttaaagaattgacagatctgctgacgatgatggacccagaacatctggtgaaaggattgacagatctgttgttgatgatgatgttgttggacccaacaataagttttctcaatgaagaagacatcatgttcgattttacttttccaggtagagagtgtttggtttctccggggtatataacataacacaacacatatatatctcgtgatcctcaatcaatcaatcaatcatcacctttctggtctggtctcatctcatttgattcaatttcacggtatagatccgggatggctacttacacgccaaagaacatcttaatcactggggctgctggcttcattgcctctcatgtcgccaatcgcctcatcagaagctaccctgattacaagattgtcgtccttgacaagcttgattattgttccagtcttaagaatcttaacccctctagatcatctcctaactttaagtttgttaagggtgatatcgggagtgctgatctcgtcaactacctcctgatcactgagtctattgatacgattatgcactttgctgcacagactcatgttgataactcatttggcaacagttttgagttcaccaagaataacatctatgggacacacgtgcttttagaggcgtgtaaggttactggtcagattagaaggtttatccatgtgagtactgatgaggtttatggggaaaccgaggaggatgctattgttggtaaccatgaagcttcacaacttcttccaacaaacccgtattcggccacaaaagctggtgctgaaatgcttgttatggcttatggtaggtcatacgggttgcctgtgatcaccacacgaggaaacaatgtttatggcccaaaccagttccctgaaaaactaatccccaagtttatccttttggctatgcaaggaaagccacttccgattcacggtgatggttctaatgtaaggagttacctctactgtgaggatgttgctgaggcgtttgaagtgattcttcacaagggtgaagtcggtcatgtttacaacatcgggacgaaaagggagaggagagttatcgatgttgcaaaagatatgtgcaagcttttcaatctggatgctgatgcaagcatcaagtttgttgaaaaccgaccctttaatgatcagaggtactttttggatgacgagaagttgaagtgcctgggttggtctgagagaacccgatgggaagagggtctgaaaaagaccatcgagtggtacactagcaatcctaattggtggggagatgtctctggtgcactgctccctcatccgagaatgttgatgatgcctggtggagttgatcgacttgctgatggacccgatcactctgaatttgatgctgctgatccagcaatcaacactgcacagatcggagtgcaagttccctcaaagaccagtaacaacgctgctaaaaaaccagcattgaagttcctcatctatggtaagacagggtggatcggtggtttacttgggaaactgtgtgagaaacaagggatacaatacgagtatggaagaggtcgtttggaagaccgctctcagcttatgtctgatattcagactattaagcctacccatgttttcaatgctgctggtgtcactggcagacctaatgtcgattggtgtgaatctcacaagactgaaactatccgtaccaatgtatcgggcacattgaacctagctgatgtttgcagagaacatggtctcttaatgatcaatttcgctactggatgcatttttgagtatgatgctaaacaccccgagggttctggtatcggctttaaggaagaagatacacccaacttcaccgggtccttttattcaaagaccaaagctatggttgaggagctcttgaaaaattatgacaatgtctgcacacttcgagtccgaatgccgatatcatcagacctcaacaacccacgaaacttcatcactaagattgctcgttacaataaagttgtgaacatacccaacagcatgacaatcttggatgaacttctaccaatttcaatcgaaatggcaaaaagaaacctaaagggaatctggaacttcacaaatcctggggttgtaagccacaacgagattctggaaatgtacaaaaagtacataaacccagaattcaaatgggcgaacttcacattggaagaacaagcgttagtgatcgtggccccacgaagcaataacgaattagatgcatcaaagttgaagaaagagttccctgagttgctttcaatcaaggagtcattgatcaagtacgtattcgaacccaacaaaacacagtaataatgattcttttttagcatttgtaaactccagattcacttgtgttctcgttacttactagttactgtatggtttgcattatacatctgtaatgtttaagtcaaagtcaaagacagagtcagtcgatggcagttatcgtaccacatttgttctagtctttgtttcctagtatgatcacactgagattatagggggccatttgtctaggtattttatattcatcatattccgttacaaccgatgttagtttgtttaacagttgttacgaatattttccctttagttttgttaaaaaccgcaggcagggttgtaatattggattctctataagattcgttatattgttattacttggtgacagattctgc

SEQ ID NO: 12213 - DNA, 2453 bp, Eutrema halophilum
aggagtcttgcgttctctatttttgctctctcgagaagactcttttttgaatttgttcttctccgttactttcgcttctcctcagcttctcaccgtcgaatttcttcacattttttctccgatatttctatcgtcttctccatttctcttgcccgatctacgattgttgatcgtgaagatctgaaaattcagaggaaataatcgtgtcttctctctcaatggcttcgtacactcccaagaacattcttatcaccggcgctgctggtttcattgcatctcatgtcgccaacaggctcattcggagctatcctgattacaaaattgttgttcttgacaagcttgattactgttccaatctcaagaatctcaatccctctaagcagtctcctaatttcaagtttgtcaaaggtgacattgcaagtgctgatcttgtgaatcatctcctcatcacggaaggtatcgacaccatcatgcacttcgctgctcagacacacgtcgacaattctttcggtaacagtttcgagttcaccaagaacaacatctatggaacacatgtacttctcgaggcctgtaaagtcactggtcagatcaggaggttcatccatgtgagtactgatgaagtctatggtgaaaccgatgaggatgctcttgtcggtaaccatgaggcttctcagcttctcccaaccaatccttactctgcaacaaaagctggtgccgagatgcttgttatggcctatggtagatcatacgggtcgcctgttattaccactcgtgggaataacgtctatggcccaaatcagtttcctgagaagttgattcctaagttcatcttgctggcgatgaggggaaaagtgcttcctattcatggagatggctcaaatgtcaggagctacctatactgtgaagacgttgctgaggcgtttgaagttattcttcacaagggagaagttggccatgtttacaatattggaaccaagaaggagaggagagtgaatgatgttgccagagacgtctgcaaactcttcaacatggaccctgaggcgagcatcaagtttgtcgagaacagaccttttaacgaccaaaggtacttccttgatgatgagaagctcaaaaagttgggatggtcagagaggaccacatgggaagaagggttgaagaaaactatggagtggtacacacagaaccccgagtggtggggtgatgtttctggagcattacttcctcatccaaggatgctgatgatgcctggtgggcgacactttgatggatccgaggagaattcattggcagcttctttcaccgataaaccaagtcagaaccacatggtggttccaagcccaaggagcagcagcacaccgcagaagccttctctgaagttcttgatatatggcaaaaccggatggatcggtggtctgcttggaaagttatgtgagaagcaaggaattgcttacgagtatgggaaagggaggttggaggatcgatcgtctcttttgcaggatattgtgagtgttaagccaacgcatgttttcaattccgctggtgtgacagggaggcccaatgttgactggtgtgaatctcacaagaccgagactatccgtgccaacgtagctggaaccttgaccttagctgatgtctgcagagagcatggcctcctgatgatgaatttcgctactggctgtatattcgaatatgatgacaagcatccggaaggttcaggaattggcttcaaagaggaagacactcccaacttcactggctctttctactcaaaaaccaaagccatggtggaggagctgctaaaggagtttgacaacgtatgcacattgagggtaaggatgccgatttcttcggatctaaacaacccacgcaacttcatcaccaagatctcaaggtacaacaaagtagtgaacatcccaaacagcatgacggtgttggacgagctgttaccaatctccatcgagatggcgaagagaaacttgaaaggaatctggaacttcacaaacccaggtgtggtgagtcacaacgagatcctagagatgtacagagagtacatcaaccctgaattcaaatgggcaaacttcacattagaggagcaagctaaagtcattgtggctccaagaagcaacaacgagatggatgcttctaagctcaagaaagagttccctgagctactctccatcaaggagtctttgattaagtatgcgttcgagccaaacaagaaaacctgaagagagagagagagagaggttgtgattcgtcactagagtcatcacctctaataatcagtttcgtttattgttcagcttgctctattgtttaattttaccccttactctttcattagatttgcttaggggtgtattgtagtttgattattattgtatttaataagagcttgatttactaatatcttgtttttgtcataaaatgttttttttttgtttaatggattt

SEQ ID NO: 12214 - DNA, 2341 bp, Eutrema parvulum
aaaattcagaggaaataatcgtgtcttctctcacaatggcttcgtatactccaaagaacattctcatcaccggcgctgctggtttcattgcatcacatgtggccaacagactcatacggagctatcctgattacaagatagtcgtgcttgacaaactcgattactgttccaatctcaagaatctcaatccctctaaacagtctccaaatttcaagtttgttaaaggtgacatcgcaagtgctgatcttgtgaatcatctcctcatcacggaaggtatcgacaccatcatgcactttgctgctcagacacacgtcgacaactcctttggtaatagtttcgagttcaccaagaacaacatctatggaactcatgttcttcttgaggcttgtaaagtcactggtcagatcaggaggtttatccatgtgagtactgatgaagtctatggtgagaccgatgaggatgctcttgtcggtaaccatgaggcttctcagcttctcccaaccaatccttactctgcaacaaaagctggtgccgagatgcttgttatggcctatggtagatcatacgggtcgcctgttattaccactcgtgggaataacgtctatggcccaaatcagtttcctgagaagttgattcctaagttcatcttgctggcgatgagggggaaagtgcttcctattcatggagatggctcaaatgtcaggagctacctatactgtgaagacgttgctgaggcgtttgaagttattcttcacaagggagaagttggccatgtttacaatattggaaccaagaaggagaggagagtgaatgatgttgccagagacgtctgcaaactcttcaacatggaccctgaggcgaacatcaagtttgtcgagaacaggcctttcaacgatcaaaggtacttccttgatgatgagaagctcaagaagttgggatggtcagagaggaccacgtgggaagaagggttgaagaaaactatggaatggtacacacagaaccccgagtggtggggtgatgtttctggtgcattgcttcctcatccaaggatgctgatgatgcctggtgggcgacactttgatggatccgaggagaattcattggcagcttctttcaccgataaaccaagtcagaaccacatggtggttccaagcccaaggagcagcagcacaccgcagaagccttctctgaagttcttgatatatggcaaaaccggatggatcggtggtctgcttggaaagttatgtgagaagcaaggaattgcttacgagtatgggaaagggaggttggaggatcgatcttctcttttacaggatattctgagtgttaagccaacccatgttttcaattccgctggtgtgactgggagacccaacgttgactggtgtgaatctcacaagaccgagactatccgtgccaacgtagctggaacgttgaccctagctgatgtctgcagagagcatggcctcctgatgatgaatttcgctactggctgtatattcgaatatgatgacaagcatccggaaggttcaggaattggcttcaaagaggaagacactcccaacttcactggctctttctactcaaaaaccaaggccatggtcgaggagctgctaaaggagtttgacaacgtatgcacattgagggtaaggatgcctatttcttcggatctaaacaacccacggaacttcatcaccaagatctcaaggtacaacaaagtagtgaacattccaaacagcatgactgtgttggacgagcttttgccaatttccatcgagatggcgaagagaaacttgaaagggatctggaacttcacaaacccgggtgtggtgagtcacaatgaaattctagagatgtacagagactacatcaaccctgacttcaaatgggcaaacttcacgttagaggagcaagctaaagtcattgtggctccacgaagcaataacgagatggatgcttctaagctcaagaaagagttccctgaactactctccatcaaggagtctttgatcaagtatgcattcgagccaaacaagaaaacctgaagagagagagagagagaggttgtgattcgtcactagagtcatcacctctaataatcagtttcgtttattgttcttgctctattgtttaattttaccccttactctttcattagatttgcttaggggtgtattgtagtttgattattattgtatttaatagagcttgatttataaatatcgtgttcctgtctcattttttgtttctttgtatgtatacaattaattcatcacttgctctactcttattatattagaatcaaacaactaaaagagtctggtaatggttacttcttgtt

SEQ ID NO: 12215 - DNA, 2050 bp, Amorphophallus konjac
tacgccaaagaacatcctcatcactggtgcagctggctttattgcctctcatgtggccaaccgcctcatccgcaactacccagattacaagattgttgtccttgacaagcttgattactgctcaaacctgaaaaatcttttccttccgttcctccccaatttcaaatttgtcaagggtgacatagcaagtgctgaccttgtgaattatctcctcataactgagtccattgacaccatcatgcattttgctgcacaaactcatgtggacaactcctttggcaactcgcttgaatttactaagaacaacatttatggtacacatgtcctgcttgaagcctgcaaagtcactggccaaatcagaaggtttatccatgtgagcactgatgaagtctatggtgaaacggatgaggatgcagtggttgggaatcatgaggcgtcacagctcctcccaacaaatccatactctgcaaccaaagctggggctgaaatgcttgttatggcctatggtcggtcctatggtttgcccgtcataaccacgcgaggtaacaacgtctatgggccaaatcagttccccgagaaacttattccgaagtttatcctattggctatgcgagggaagccactccccattcacggcgatgggtccaatgtaaggagctacctctattgtgaggatgtcgctgaggcctttgaagttattcttcaccgaggggaagttgggcatgtctataatattgggactaaaaaggagaggagggtaattgatgttgccaaagacatctgtaagctttttgatttggatccagacactgttatcaagtttgtggagaacaggcctttcaatgaccagaggtactttcttgatgatcagaagttgaagaacttgggatggtcagagcgaaccacatggcaagaagggctgaggaagacaatggagtggtatacaagcaatcctgactggtggggtgatgtctctggagcattgctgccacacccgaggatgttgatgatgccaggaatagaaaggcagtttgacgggtcagaagaagaccgaagtgtgatttcccaaacaacgagtaaccctggccagaccagaatggttgttcctttctcaaagagtaccagtggttctcctcgtaagccatctttgaagttcttgctttatggcaagactggatggattgggggcctccttgggaagatttgtgagaagcaaggaattccatttgagtacggtaaagggcgcttggaagaccgggcttcactcttagctgatattcagaatgttaaaccaactcatgtttttaatgctgctggtgtaactgggaggcctaatgttgattggtgtgagtcccacaagccagagactatccgcaccaatgtagcaggtactttgaatctagctgatgtttgcagggagcatggcctgttgatgatgaactttgctactgggtgtatatttgagtatgatgctgagcacccagaaggttctgcgataggattcaaggaagaagaaaagcccaatttcactggctcattttattcaaaaacaaaggctatggttgaagagctcttgaaagagtacgagaatgtttgcactcttagagtccgaatgccaatctcatctgacctcagcaacccacgcaacttcattacaaagatcactcgttatagcaaggtggtgaatattccaaacagcatgaccatcttggatgagcttctgccgatttcagttgagatggcgaagagaaactgtaggggcatatggaacttcacaaaccctggtgtcgtgagccacaatgagattctggagatgtacaagagctacgttgatcccaaatttacatgggtcaatttcacactggaagaacaggcaaaggtcattgttgctcctcgaagcaacaatgagctggatgcgtccaagttgaagaaagagtttcctgaattgctgtcaatcaaggaatcgctgataaagtatgttttcgagcccaacaagaagagctttggcgaggggcatgtctaagctctccaatgctctctctctctctct

SEQ ID NO: 12216 - DNA, 2447 bp, Euonymus alatus
ctgtcgttgttttctttctaccactttcctttgtctctctctctctctctctctctctctagtttcttctcacattactgaatttgaagttgaatctccaattgaagcatttttggttgttgattgctctggatcggactgaagtgtcttggacaaaatgtctacttatactccaaagaacatcctaattactggtgctgctgggtttattgcatcccatgtttgtaatcggctcatccgtaactaccccgactacaaaatagttgtgcttgataagcttgattactgttcaaatctgaaaaatctactgccctccaaattatctcccaacttcaagtttgttaagggtgatattggtagtgctgatcttgtgaactaccttctcattacagagtccattgacacaataatgcactttgctgcccagacccatgttgacaactcttttggtaatagctttgagtttaccaagaataatatctatggtacccatgtccttcttgaggcctgcaaggtcacaggccagatcaggaggttcatccatgtaagtacagatgaggtttatggggaaacagatgaggatgctgttgtgggaaaccatgaggcttctcagcttctcccaacaaacccatactctgcaacaaaggctggagctgaaatgcttgttatggcttatggtaggtcatatggtttacctgtgataacaacacgtggaaacaatgtttatgggcctaatcaatttcctgaaaaattgattcccaagtttatcctactggcaatgagaggaaaagttctaccaattcatggggatggatccaatgtgagaagctatttgtactgtgaggatgttgctgaggcttttgaagttattcttcacaagggagaggttggccatgtttacaatattgggacaaagaaggaaagaagagtaattgacgtggctgaagatatatgcaaaatttttgggacggatccagagacaaatatcaagtttgtggagaacaggccttttaatgaccagagatactttctggatgatcagaagctaaagaatttgggttggtctgagcgaactatctgggaagaggggttgaggaagaccatggaatggtataatcagaatcctgattggtggggtgatgtctctggagcactgctccctcacccaagaatgttaatgatgcctggtgggagacactttgacggatctgaagagaacaaatcaccaactcatatatcaagtaattctaaccagtcgaaaatggtagttccagtatccaggagcagtggctctcctcgaaaaccaccctataagttcttgatctatggaaggactggctggatcggggggctacttggcaagttaagtgagaagcagggtattccatatgagtatggaaggggccgtctggaggatcgctcatcactaatggcagatattcagaatgttaagcccacccatattttcaatgctgctggtgttactgggagacccaatgttgactggtgtgaatcccataagacagaaactattcgcaccaatgttgctggaacattaacgttagcagatgtttgcagagagcatggacttctgatgataaactacgccaccggatgtatttttgagtatgatgctgctcatcctgaaggctcgggcattgggttcaaagaagaagacacaccaaatttcactggctccttctattccaaaaccaaagccatggttgaagagctcttgaaagaatatgataatgtctgtacccttagagtccgaatgccaatatcatccgacttaaacaaccctcgcaacttcatcaccaagatatctcgttacaataaagttgtcaatatccccaacagcatgaccatcttggatgaacttttacctatttccattgagatggcaaagcggaacttgaagggtatatggaacttcacgaaccctggggtagttagccacaatgaaattctggagatgtacaagagttacatcgactccaacttcaaatgggctaacttcacattggaggagcaagccaaggtcatagttgcccctcgaagcaataacgagatggatgctacaaagttgaagacagagttccctgagttgctgtctatcaaggaatcgctgattaagtatgtcttcgaaccaaataaaaggacctaagtaggctagcatatgtagttgtatgtctttggattgcatattacttatcacatagctctatattgctcacctaatattcattgttagcttcattccaccgcattaccattggactagaaatttcattaatgtctcagttatgtttctttaattaggttttcttgttattttttggaagaagtattctagttggcgtcttcgccagaggactcaaaaatgcttctctatatttgtattatctgcaaacttgcagaagtgtattctttattattttgctaaa

SEQ ID NO: 12217 - DNA, 2779 bp, Centaurea maculosa
gtcgacaatcaatcacctttctggtcgagatctcattcatacacgcaatcaatctctgctgctattgatcccgatccagaggaggaacaacaactttacactgctccagtatggctacttacacgccaaagaacatccttatcactggggctgctggattcatcgcctctcatgttgctaatcggctcatcagaagctaccctgattataagattgttgtgctcgacaagcttgattattgttcgaatcttaagaacctcaatccctccagatcgtctcctaacttcaagtttgttaagggggacattggcagtgccgatcttgtcaactaccttttgatcactgaatctattgataccattatgcactttgctgcacagacccatgttgataactcatttggcaacagctttgagttcactaagaataacatctatggcacccatgtgcttctagaagcctgcaaggtcactggccagattcggaggttcatccacgtgagcacggatgaggtgtacggtgaaacagaggaggatgccgttgtgggtaaccatgaagcttcgcaacttcttcccacaaacccgtattcagccacgaaagccggggctgaaatgcttgtgatggcttatggcaggtcgtatggattgcctgtgatcaccacgaggggaaacaacgtttatggcccgaaccagttcccggaaaaactaatcccgaaattcattctcttggctatgagaggaaagccgcttccgatccacggtgatggttctaatgtacgaagctacctctactgtgaggatgttgccgaggcttttgaagtgattcttcacaagggggaagttggtcatgtttacaacataggtaccaagagggagaggagggttatcgatgttgccaaagatatgtgtaagcttttcaatatggatcctgatgcaagcatcaagtttgtggagaacaggccgtttaacgatcagaggtacttcttggacgatgagaagctgaagagcctgggctggtcggaaaggaccagatgggaagatggtctgaagaaaaccatcgagtggtataccagcaatcccaattggtggggcgatgtctctggagcactgcttcctcatccgcgaatgctgatgatgcctggtggcgttgataggcttgttgacggacctgataattctgaattcgattcagacaatgtggcacatagcggttctcagattggcattgtggttcccacttccaaaagcagtggcaacgctgccaagaagccatccatgaagttcctcatctatggtaggacaggctggatcgggggcttactcgggaagttgtgtgagaaacaacaaatcccatacgagtatggaaggggtcgcttggaggaccgatcgcagcttttggctgatattcaggctattaaaccgactcatgttttcaatgctgccggtgtcactggcagacccaatgtcgattggtgtgaatcccacaagacagaaacaattcgcaccaatgtctcgggcacactgaatctagcagatgtatgcagagatcacgggctcttgatgatcaattttgcgactggatgcattttcgagtacgatgctaaacacccagaaggctctggcattggttttaaggaagaagataagcccaatttcactggctccttttattcaaagaccaaagctatggtagaggagctgttgaaagaatacgaaaacgtctgcaccctgagagtccgaatgccgatctcctctgacctcaacaacccacgcaacttcatcacgaaaatcgctcgttacgacaaagtcgtcaacatccccaacagcatgacgatcttggacgagctcctaccgatctcgatcgagatggcaaaacggaagctgacgggaatctggaacttcacgaaccccggggtcgtcagccacaacgagatcctcgagatgtacaagaagtacatcaaccccgagttcaaatgggtcaacttcacacttgaagaacaagcccaagtgatcgtggccccacgaagcaacaacgagctcgatgcatcgaagttgaagaaggagtttccggagttgatgtcgatcaaggaatcgctgatcaagaacgtattcgaacccaacaagaagatatgaaaataaagattggtgatgatgatgattctttgttttgtttgtaaactggaaaaattggggttagttggtgtatgggatttggatttatatacgtttgtaatgtttaagtcaaatttgtttccttttggtagcttgaggatgatgatgatagaaggaagaggagggcatatttggtattttataatttcactaccaaaacttagtttgtttacgaatattttgggttttagatttgttgttgaattcgctattaaagatttgttattctgagtttaatgtgaaatcttgttttcgttctaaaaaagcatcacacatatatgggcttcatattattacattctctcatacaaaccaccatacaactgcaagaacttaacattgatcatatagaacggattggatacattagtgctaagataatcacacccctaatcatatatagccttagacatagatatacgtgagactcaactgagcctcctttgccgtttcgtgacttgccggtttgttttggcagtatccatctttagaaatggttaatgccaaaatcaaactatttgaaatatggaggagaagagaagaaataacaaagaatatctcatcttcatgcactccatatttgcccccaatgcatacttcaatggttt

SEQ ID NO: 12218 - DNA, 2609 bp, Eucalyptus grandis
gtctcactgtcccccagatctccctctctctttctctctcttgtcgtcgtcattattgtcgagctgttacagctttgcgggatcgccagtgccggtggattgctcctcgcccgcggcctcgccggattccctagtctttcgctatggctaccgcatacacaccaaagaacattctcataactggggctgccggctttattgcatcccatgtctgcaaccggcttattcggaactaccctggttataagattgtggtcctggacaagcttgattattgttcgaatctgaaaaacctgcttccatcgcgatcctctcccaacttcaagttcatcaagggggacattgccagtgctgatcttgtcaatttcatcctccttacggagtccattgacaccatcatgcactttgcagctcagacccatgtggacaactcttttggtaacagctttgagttcaccaaaaataacatctatggaacccatgtccttttagaagcctgcaaagtcaccggccagatcaggaggttcatccatgtgagcactgatgaagtttatggggagactgatgaggatgccgtggttggtaatcatgaggcttctcaactgctcccgacaaacccatattctgccacaaaagcaggtgcagaaatgcttgttatggcttatgggcgatcatatgggctacctgtcataactaccagagggaacaacgtctatggccccaatcaatttcctgagaagttgatcccaaaatttatcttgcttgccatgaaaggacaaccccttccaattcatggggatggatcgaatgtacgtagttatctctactgtgaggatgttgcagaggcgtttgaagttattctccacaagggtgaggtgggccatgtttacaacattgggactaagaaggagaggagagtgattgatgtggccaaggaaatctgcagactttttaagatggaccctgatacgcacataaagtttgtggagaacaggcccttcaatgaccaaagatatttcctagatgaccaaaaattgaagaacttgggatggtttgaacggaccatatgggaggagggcctaagaaagacgatggagtggtacgtcagcaatccagattggtggggagatgtttctggagcactgcttcctcatcctaaaatgctcatggtcccggggatcgaaagaaaatttgatgggccggatgtcaacaactcttcctcctatgcggtggaaaatcatactcctaatgggatggtggttcgagatccgaagagcagtccctctgctcaaaagcccactttgaagttcttgatttatggcagaacgggttggattggtggcctactggggaagatctgtgagaagcaaagaattccattcgagtatggaaagggacgattggagaacgctgcacagatcttggcagacattcagactgtaaagcccacacatgtattcaatgctgctggagtgactgggagaccaaatgttgattggtgtgaaactcacaaacctgagacaatccgcacgaatgtcgttggcacgctaaccttggctgatgtgtgcagagagcgtgggctcctaatgatgaattatgctactggctgtatatttgagtatgatgaaacacacccgttggggtcaggaatcggttttaaagaggaagacaagccaaatttcattggttccttctattctaaaaccaaagccatggttgaagagcttctgaaggaatatgacaatgtttgcactctaagagtgcgaatgccaatatcttctgatttgagcaatccccgtaactttatcacaaagatttcgcgatacaacaaggtggtcaacatcccaaatagcatgaccatcttggatgaacttttgccaatttcagttgagatggccaagaggaacttgaggggtatatggaacttcaccaatcccggggcggttagccacaacgagatcttggagatgtataaggcctacatcgaccctgatttcaagtgggtcaacttcactttggaagagcaggccaaggtgattgtcgcgccacgaagcaacaacgagatggacgcgtcaaagctgaagcgggaattccctgagttattatccattaaggactcactcataaagtatgtctttgaacccaataagagaacttctatcgcctgagcggcaattaggccatgaggaatgtagctgtcaggaattttttgtgactggaagcattcatcaagctgaagcatgaatcgttcctgctattaatttatcatgggtgattgtagaattgtacgcgtttattatcttcatcattaattgtcaagcacgaccttaattctatcactccatagaatttcggtctgatcgtttattatgatcgtaacccatttcgtgaagccaactgcaggctagaggggtgtactcttttttgcaaatttcgatttgtctagaattcacggagaagcgtgatagcctttcgtggatcatatttgtagcgagtcagtacttttcaaccttgtgtaataacgcattcaagaagtgtaataaccttctgtggatcacatttgtagcgagtcagtatttttgaaccttgtgcaataacgcattcgcgat

SEQ ID NO: 12219 - DNA, 2281 bp, Chelidonium majus
aggccgatagctatgacgacttacacacctaaaaacatccttattactggtgctgctggattcatcgcatcacatgttgccaaccggctcatccggaactatccggattacaagattgttgtccttgacaaacttgattattgttcgaatctgaagaatctactaccttctcgatcatcacccaacttcaagtttgtcaagggagacattggaagtgctgatcttgtcaattaccttctcattaccgagtctattgacacgattatgcactttgcagcccagactcacgttgacaactcttttgggaacagctttgagtttacaaagaacaacatctatggaacccatgttcttctagaagcttgtaaggttactggccagattagaaggttcatccatgtgagcacagatgaggtctacggggagacggatgaagatgcagttgtaggaaatcatgaggcatctcaactccttccaactaacccatactctgcgaccaaggctggtgcagaaatgctcgtgatggcttatgggaggtcatatgggttgcctgtgataaccacaaggggaaacaatgtttatgggcccaatcagttccctgaaaaattaattccaaagctcatgctattggcaatgaaagggcagactcttcccattcatggggatggatctaacgtgcgtagttatctctactgcgaggatgttgctgaggcttttgaagtcgttcttcacaaaggagaaatcggccatgtatataatattggcacgaagaaggaaaggagggtgattgatgtcgttaaggatgtttgccaactcttctctttggatccagatgcagttattgagtttgtggagaacagaccattcaacgaccagaggtacttcttggatgatcagaagctgaagaacttgggttggtcagaacggacttcatgggatgagggtctgaaaaagactatggagtggtatctaaagaatcctaattggtggggtgatgtttctggagcattactgcctcatccaagaatgttgatgatgcctgggatagaaagatattgcgatgggtctgaagatagcaatgctgcgtcttctaatgccaataatactattcagaagcaaatggtggttccagttccaaagatcaccagctcctccccatcaaaaccatctttgaagttcttgatatatggtaggacagggtggattgggggtcttcttggacagatttgtgagaaacaaggtataccatatgagtatggaagagggcgtcttgaggataggtcacagctagtggcggatattcagaatgtcaagcctacacatgtttttaatgccgctggtgtaactggtcgacctaatgttgactggtgcgagtctcacaaaacagagactattcgcaccaatgttgtcggtacattgaacttggcggatgtttgtagggagaatggattgctgatgatgaactacgctactggatgtatatttgaatatgatgctgcacacccagaaggatcaggtattggattcaaggaggaagacacacccaatttcgctggttctttctactcagagaccaaggccgtggttgaaaagctcttaaaggaattcgacaacgtttgcactctcagagtccgcatgcccatatcttcggaccttaacaacccacgcaacttcatcacgaagatcagtcgttacaacaaggttgttaacattccaaacagtatgacgatcctggatgagcttcttcctatttcagttgagatggctaagcggaatttgaggggtatatggaactttacaaacccaggtgctgtgagccataatgagattctagagatgtacaagagttatatcgatccagactttaagtattccaacttcacactcgaagaacaggctaaggtaatagttgctgctcgaagcaacaacgagatggatgcgtccaagttaaagaatgagttccctgagttgctctcgatcaaggattcgctgatcaaatacgttttcgaaccaaataagaaaacttctgctgatggaggggctaaataagggggttatatatatgactttagatctctacctggtctgcattttgtattagtttctgtaggggctttattacctacatcaagctatgagttgtccattattattcatcctcatcagtagctttttcatcatattatatcttctattattctggtcaagcccttagaactttagaatagttcgactaggctggttctagttgtgtcattccttttgctgttagttaatttct

SEQ ID NO: 12220 - DNA, 2421 bp, Trifolium pratense
tcttcttttcttctctcttaccaatttaagttgcttgatatggcaacgcacaccccaaaaaatatcctgattaccggggcagcgggattcattgcatctcatgttgccaatcggctaatccggaattatcctgactacaagattgttgtgctcgacaaacttgattactgttctaatctgaagaacctcattccttcaaaatcatctcccaacttcaagtttgtgaagggagacattgcaagtgctgatcttgtcaactaccttctcattaccgagtctatcgacacaattatgcactttgccgctcaaactcatgtggacaactcttttggtaatagttttgagttcaccaagaacaacatatatggtactcatgtcttgttagaagcctgcaaggtaacgggacagatcaaaaggttcatccatgtaagcactgacgaggtctatggagagacagatgaggatgctgttgtcggaaaccatgaagcttctcagctacttccgacaaatccatactctgcaactaaagctggggcggaaatgcttgtcatggcctatggtaggtcgtatggacttcctgtgatcacaacacgtggaaacaatgtctatggcccgaaccagtttcctgaaaagctaattccaaagttcatcctcttggcaatgcaaggcaaagttcttccgattcatggtgatggttcaaatgtgaggagttatttatattgtgaagatgttgcagaggcttttgaggttatccttcataagggagaggttggacatgtttacaatattggaacaaagaaggaaaggcgtgttattgatgtagccactgatatatgccgactcttctcgatagatccggagactaatataaaatttgtagagaacagaccgtttaatgaccagagatactttcttgatgacgaaaagttgaaggttttgggttggtcggagagaacaacgtggcaagaaggcttgaagaaaaccatggattggtatatcaacaatcctaattggtggggtgatgtgagcggtgcattacttcctcaccccaggatgttgatgatgcctggtggtatggagagacatttcgatggatctgaagaagaaaattctgcaacatatgtctcaagtacgaacactcgaatggtggttccaccaaccaagaaccctggctcattgcagaaacctcctctcaagttcttgatctatggcagaacaggttggatcggtggtctgttggggaaactgtgtgagaagcaagggattccttatgagtatggaaaagggcgccttgaggatcgttcgtcactcgtggctgatattcagaacgtgaagccaactcatattttcaatgcagcaggagtgactggaagacctaatgttgattggtgtgaatctcataaaactgaaaccatccgtgtcaacgttgctgggactttaacattggctgatgtaagcagagagcatgaccttttgatgataaactatgctaccggatgcatattcgagtacgatgaagctcatccagaaggttcaggcattggttttaaggaggaagacacacctaatttcagtggttctttctattccaaaactaaggctatggttgaagagcttttgaaagaatatgacaatgtgtgcactcttagggttcgcatgccgatatcatctgacctaagcaatccgcgcaacttcatcaccaagatttcgcgttacaacaaagtagttaacattccaaacagcatgactattttggacgaacttcttcctatttcaattgagatggcaaagaggaacttaaggggtatctggaacttcacaaatcctggtgccgtgagccacaacgagattctcgagatgtacagggattacattgatccaagcttcaagtgggctaacttcacacttgaagagcaagccaaagtgatagttgctgcaagaagcaacaatgaaatggatgcatccaaattgaagagtgagtttccagaattgctttccatcaaggaatcactgatcaagaatgtctttgagccaaacaagaaaagcgcttaaaaaagatcaagtaacttcaagttttaggacatcatttactaccaaatttttgtgtttggctacttagattatcactcattatttcattgttatagttccatcttgttattgtgtttagaggatgatattttctaaacagttttatgcagctttattatagtttagtgtactatgttaagagcatccttagggtcttgtttgttaccttgtgagcttgctatggaggataaacttggcatggaggacatgtattcttttattactcatatcttttttgtgacttatgtttgtatttgtattcttgtaattgacattcatttaaatttctcatatagagaaaaactagtgttattgagcactattaaagca

SEQ ID NO: 12221 - DNA, 2675 bp, Eucalyptus grandis
gcgaaatcgtgatttcgctttgacccagcgaccacgcttcggcgatctcccgaagcgacgtcgtccgactataagtagcagccagagatctctgctcgcttcgtcgtcgtcgtctccgaaaccgaaactcgctccgtctgcgcgtcctccgttcgttgtctgtccgaattccgatacgatccgatacgatccggtcggattcgcgagcgcccgaagccgaggccgatcggacctggatctcgactccgatctgcgactaggttgctaggtgatggctaattataccccgaagaatatcctcattactggggcggctgggttcattgcatcccatgtcgctaaccgcctcattcgtaattaccctgaatacaagatagttgtgctcgacaaactcgactattgctccaacctgaaaaacctgagtccttcacaatcatcccccaacttcaagtttgtgaagggagacatcggaagtgctgaccttgtgaactaccttctcatcacggagtctattgacaccataatgcattttgctgctcagacccacgtcgacaattcctttggcaacagctttgagtttaccaagaataatatttatggtactcatgtcctcttagaagcctgtaaggtgacagggcagatcaggagattcatccacgtgagcactgatgaagtttatggagaaacggatgaggatgcggcggtaggaaatcatgaggcatctcaactcctccccacaaatccttactcagcaacaaaggctggagcggagatgcttgtcatggcatatggcaggtcatatgggttacctgtcataacgacccgtgggaacaatgtttatgggccaaatcaatttcctgaaaagttgatcccaaagtttatccttttggctatgagagggaagcctcttcccattcatggagatggatccaacgtccgtagttacctctactgtgaggatgttgctgaggcttttgaggtagttcttcacaagggtgaggttggtcatgtctacaacatcggcacgaagaaggaaagaagagtaattgatgtggctagggacgtatgcaaacttttctccatggactcagaaaccagcattaagttcgtagagaataggccatttaatgatcagaggtactttttggatgatcagaagctgaagaacataggctggtcagagcggactacgtgggaagaggggctgaagaagactatggactggtacattaataatcctgattggtggggtgatgtttctggagcgcttctccctcatccaaggatgctgatgatgccgggtggtattgaaaggcattttgatgattctgaaggaggcgaatctccatcaaacgtccccacagcttctaatcagtccaagatggttgttccaccttcaaaaaatgcgacttcagccaagaaaccttccttgaagttcctgatatatggtaagaccggttggattggaggtctacttgggaggctatgcgagaatgaaggaatcccatttgagtatggaaaagggcgccttgaggagcggtcacagcttgtggcagacatacagaatgttaaacccacccatgttttcaatgctgctggtgtaactggtaggccgaatgttgattggtgcgaatcccataagaccgaaaccatccgcaccaatgttgctggaaccttgactctggcagatgtctgtagggagcatgggcttttgatgatgaattatgccacaggctgtatatttgagtatgatgctgcacacccagagggctcgggcattggctataaggaggaagacaaacccaattttactggctccttctattccaagacaaaggccatggttgaagagcttttgaaggaatacgacaacgtttgcacactcagagtccgtatgccaatatcctctgacctcaacaacccccgcaatttcattaccaagatttcgcgctatagcaaggtggttaacattccgaatagtatgaccattttggatgagctgcttcccatctcaattgagatggcaaagcggaacttgaggggaatatggaacttcacaaatcctggagtcgtgagccataatgagattttggagatgtacaagcagtatattgatccccaattcaagtggatgaactttacattggaagagcaagcgaaagtgattgttgccccccgaagcaataacgagatggatgctactaagttgaagaaagagtttccagatttgctaccgatcaaggagtcactgatcaagtacgtgtttgaaccgaacaggaagaactaagcagatgactggttttcggcagtggtcgtctcgttcagtatgtgcccattgcttgaggttttgtagttggattacaaacgccattccttccatattcatccgattgtttctacggttgtccccaaggaacgaggatagttctgctagtgattcaatttgtaatttttacaagctggctagtacgttttctccagtcctttcttttgggctggctatttgattcttttagtccctatgtcatcttattcttggatgacatgatatttatttttctactctatgagaactaataattatttttgacatgttataattttataagatagcctctgtccgtatacctgctcggtttgcggcaaattaattctgaattcttttttttggaaca

SEQ ID NO: 12222 - DNA, 2477 bp, Lupinus angustifolius
atcgaagagagagcgagaaaatattcatcactctcatatctatcaccttctcattattccatttcttctctccatcttctggttccatttttaagttgccagacatgggttcatataccccaaaaaatattctcatcactggggcagctggatttattgcatctcatgttgcgaaccggcttgtccgtagctaccctgactacaaaattgttgtccttgacaaacttgattactgctctaatttgaagaatctcattccttcaaaatcatctcccaacttcaagtttgtgaagggggatattggtagtgctgatcttgtcaactatcttcttatcactgagtccattgacactataatgcactttgctgctcaaacccatgttgacaactcgttcggtaatagctttgagttcaccaagaataacatatatggtactcatgtcttattagaagcttgcaaggtaactggccagatcaggaggttcattcatgtgagcactgatgaggtctatggggagaccgatgaggatgctgttgtcggaaaccatgaggcttctcaacttcttcccacaaacccgtactctgcaacaaaagctggggcggaaatgcttgtcatggcatatggtaggtcatatggattacctgttatcacgactcgtggcaacaatgtttatgggccaaatcagtttcctgagaagttaattccaaagtttattctcctggcgatgcaaggaaagaatcttccaattcacggggatggttctaatgtgcggagttatttatattgtgaagacgttgcagaggcttttgaagttatccttcacaagggagaggttggtcatgtttacaatattgggacaaagaaggaaaggagagttattgatgtggccaaagatatatgcacacttttctcgatggaccgagaagctagcataaaatttgtagagaatagaccgttcaatgatcagagatactttctcgatgatcaaaagctgaagaacttgggttggtctgagaggaccacttgggaagagggtttgaagaaaaccatggactggtatacacagaatcctgattggtggggtgatgtaaccggagcactgcttcctcatccgaggatgctgatgatgcctggtggcttggagagacactttgagggatctgaagatgaaaaacctgcatctcttggctcatctaataccagaatggttgtcccatcaaccaagaacactggcgcgcaacaaaaacctccttttaagtttttgctctatggtagaactgggtggattgggggtttgctggggaaattgtgtgaaaaacaagggattccatatgaatatggaaaaggccgtctggaggatcgcgcctcacttatcgctgatcttcagaatgtgaagccaacccatgtttttaatgctgctggagttaccggcagacccaatgttgattggtgtgaatctcataaaacagaaaccatccgcaccaatgttgctggaactctaacattagctgatgtctgcagagagcaagggattttggtgataaattatgctactgggtgcatatttgagtacaatgcagcacatcccgagggctctggaattggttataaggaggaagacaagcccaatttcattggctctttctattccaaaactaaagctatggttgaggagctcttgagagaatatgacaatgtatgcaccctcagggttcgcatgccgatttcatccgacttgaacaaccctcgtaacttcattacaaagatttctcgttataacaaggtagttaacatcccaaacagcatgactattttggacgaacttctacctatttcaatcgagatggcaaagaggaacttaaagggcatttggaacttcacaaatcccggggttgtgagccataatgagatccttgagatgtacagggattacatcgaccccaacttcaagtggaccaacttcacacttgaagagcaagccaaggttatagttgctcctagaagcaacaatgagatggatgcatccaaattgaagaaagagttcccagaattgctttcaatcaaggaatcacttatcaagcatgtctttgagccaaacaagaaataagcaatttcatgttttgaacattgcatttatgagttgggcatacatggatcactcattattccactgtttgctccatagtgtagaaagtggctagtattacacttgtgttaggaatgtttcctgaactttcatttctagagttttatccaagttatagcattagatagggtattggttatctgaaagtttgtggtgagtaaacttttaaatcatggaataagattatattcttttgttactcatctagaatgaaaatttaaaataaaagttgtttacaattttgaattattgagatgtacttggatgcttgtctgtaatgttgaatgaaaacttaggaataagagaagctaattatcaaattttaaacta

SEQ ID NO: 12223 - DNA, 3074 bp, Capsicum annuum
tctctctatacaaaaatatataataagtctcttccgcttctctctccattcttttagttcggggtggatcgaagataaataaattgtaagttaattttaattttttttttatggttatattaatttttgaatattttggttagatctggctagatctataatgtataagggaggatatagtgtgttttggatcttttgatctgtgcttgtgtttttttgaatttcatttccgtgtttttgttttcttttttgaatgtatattgagaattcatatagtcataacacaagattattttgtgatttatgatgtaattaggttgattgatagttttgctggttttaataatttttagttgtttaatttcaatagcttgggtacactttactattatgctgagtatgttgttgttgctgctattgtataatttaatttcatctgatcaagtggaattgtttattaattcttttttattattccaaatgaaaaaatgtaccagtatgatcagattctatgttggttcggactcttcaaaaatgtcattgggtgcgtatcggatccttcaaaagtagtgcatttttggagtatccgacacgggtgaggcaacttttttggagtgtccgagcaacttaggtcagatttatggcattaggaccagggtttgagttgctattaaactccgaatatatttgaaatttggcagaaaaatgtctacctacaccccaaagaatatactcattactggggccgcggggtttattgcatctcatgttgccaaccgacttgttcggagttaccctgagtacaagattgttgtccttgacaagcttgattactgctcaaacctgaaaaacctttccccatctcgatcttcccctaatttcaaatttgttaagggagacattggcagtgctgatcttgttaactaccttcttatcaccgagaacattgacaccataatgcactttgctgctcagacccatgttgacaactcttttggtaatagctttgagttcactaagaacaacatttatggcacgcacgtgctattagaggcatgcaaagttactggtcagatcagaaggtttatccatgtcagcactgatgaagtttacggagagactgaggaagatgctgttgtaggaaaccatgaagcctcacaactccttcctacaaatccatattcagccacgaaagctggagctgaaatgcttgttatggcatatggaagatcatatggattgcctgttataaccactagagggaacaatgtgtatggtcccaatcaatttcctgaaaagctaatccccaagtttatacttttggccatgcaggggaagtctcttcctatacatggagatggttcaaatgttagaagttatctctattgcgaggatgttgctgaggcttttgaagtcattcttcaccgaggagatgttggtcatgtttataacatcggtactaagaaagagaggcgagtgattgatgttgccaaagatatatccaagctttttgacaaggatccagatgcaagcattcagtttgtggagaataggcccttcaatgaccagaggtatttcctagatgatcagaagttgaagagcttgggttggtccgagaggaccacgtgggaagagggtctgaaaaaaaccatgcagtggtatatcaataatcctaattggtggggagatgtctctggagcattgcttccccatccaagaatgctgatgatgcctggtgggatagagagaactatggatggagctgaaaaagatgattctgtagcatctgaaatctcaggaaaatccaatcataccggaatggtagtcccagcttccaagatcagcaactcccctagtaaatcacctaataagtttttgatttatggtaggactgggtggattggtggtctgctaggcaaactgtgtgagaaacagggaatatcttatgagtatggaaggggacgtctagaggatcgctcactacttttggcagatattcatgctgtgaagcctacacatgtattcaatgctgctggtgtcactggtagacctaacgttgattggtgtgagagtcataagactgaaacaattcgtacaaatgttgctggaactctaaacttggcagatgtttgtaaagagcacggtttactgatgatgaattttgcaactggttgcatatttgaatatgatgctgcacacccagaaggttcaggcattggattcaaagaggaagacacacccaattttactggttctttctattcaaagaccaaggccatggttgaagagttgttgaaagagtaccctaacgtttgcaccctcagagtccggatgccaatatcttcggacctcaacaacccccgtaacttcattaccaagattagccgctacaataaagtggtcaacattcccaacagcatgacaattttggatgagcttcttccaatttcaatcgagatggcaaagcgtaatctcacgggcatatggaatttcacaaaccctggtgttgtgagccataacgagattctggagatgtacaagaaatacataaatccagaatttaagtggtccaacttcaccttggaagagcaggctaaggtaattgttgcacctcgcagtaacaatgaaatggatgcgtccaagttgaaaaaggagttccctgagttgctgtctatcaaagaatctttgatcaaaaatgtatttgaaccaaatcgaaaaactgctgcataataagccttacgatgcggtgagcagacttctggtttggatcaatatgctacttcactttgtattctagtttagacattattcatatcattagtagccaaaattttcaaaaatatttagattcttaccagtgtttaggatccctacactaggttgttctcgtcagtttatctataagtttataatgtttaatgtgccatgaggaaggtttgtgtatgagttccccacacatcttttgtcagctcggtatgctaagcgtttataagtcgatttgttggatcttaatatatatggagtcatgaattgtttcttaccccatttgtgttgtgttgttctttcacatattg

SEQ ID NO: 12224 - DNA, 2476 bp, Prunus persica
aaatcaatccgtggctctctcttttctctctcatttctctgtctgaatttctctcactctctttcttcgctagcctcttgaggcttcttcatccaaatttctctgtctgggggttggtcgattttgatccaggccaaaatccaaggttccttgacatgggttcatatacccccaagaacatcctcataactggggctgctggcttcattgcatctcatgttgccaaccggctcatccgcagttaccctgactacaacattgttgtgcttgacaagcttgactattgttcaaatctgaaaaacctccttccctctaaatcatcacccaatttcaagtttgttaagggggacattggcagtgctgatcttgtcaactatctcctcatcactgagtcgattgacaccataatgcattttgcagcccagacccatgtcgacaattcctttggtaacagctttgagttcacaaagaacaacatctatggcacccatgttctgctagaagcatgcaaagtgactggccaaatcaggaggttcatccatgtcagcacagatgaggtctatggtgagactgatgaagatgctgttgtaggaaaccatgaagcatctcaactcctcccaacaaatccatactctgcaacaaaagcgggagcagaaatgcttgttatggcatatgggagatcatatggattgcctgttataacgacccgtggaaacaatgtttatggaccaaatcaatttcctgaaaaattgattccaaagttcattctgttggccatgcaagggaagcctcttccaattcatggggatggctctaatgtgagaagctatctatattgtgaggatgttgctgaagcttttgaactcattcttcacaagggggaagttggccatgtttacaatattggaacaaagaaggaaaggagagttattgacgtggccaaagatatatgcagacttttctcagtggacccagagacaaacatcaagtttgttgaaaacagacctttcaatgatcagaggtatttcctagatgatcagaagctgaagattttggggtggtcagagcgaactatatggcaagaggggttgaagaagactatagaatggtacactaagaatcctaattggtggggtgatgtatctggggcactgctgcctcatccacgaatgctgatgatgcctggtgggattgagagacatctggaagggtctgaagaggaaaaatctgaatcttttgtcccaagtaatacccgaatgttggttccaccttccaaaagctgtagctctcctcgtaaacctccctttaagttcttgatctatggtaagactggctggattggaggtgtacttggaaagctatgtgaaaaacaagggattccttttgaatatggcaaagggcgtctacaggatcgatcatcactcttggcagatattcaaaatgtcaggccaacccatgtgttcaatgctgctggtgtgactggtagacctaatgttgattggtgtgaatcccataaagcagaaactattcgaaccaatgttgctggaaccttaaccctagcagatgtttgcagagagcatggactcttgatgatgaattttgccactggctgcatatttgagtatgatgctaaacatccggagggttctggagttggattcactgaagaggacaaacccaatttttttggttcgttctattccaaaaccaaggccatggttgaggagctgttgaaagaatttgacaatgtttgcacgctcagagtgcgaatgcccatctcatctgacctgaacaaccctcgtaacttcatcactaagatttctcgttataacaaagtggttaatatccctaacagcttgaccatcttggatgaattactacccatctctattgagatggcgaagcggaacttgagaggtatatggaactttacaaaccctggggtcgttagccataatgagattctggagatgtacaagcaatacattgacccaaagtttacatgggcaaatttcacaattgaagagcaagccaaggttatagttgcagctcgaagcaacaatgaaatggatgcatccaagttgaagaaagagttccctgagttgctaccagtcaaggagtcgctgattaagtatgtttttgaaccaaacaagacaaactccacacaataagcaaatctcagttatagacctcaggattaacctctgccttccgcattaggtgatatgctatagattacctcaatttagtttaatcagtatcagtcattattcattcttagccttgtctcattatttcttctgtgctagaggtgttgggtatgattttaccaagtgtgcttctttcttttctgttttcttgggtgtatcttagtttcctttgtgttccattttataagaaactttgaacaggttccctatagatgattctgtaattttgcattcagttcaatgaacatgtggtgttgcattctgcc

SEQ ID NO: 12225 - DNA, 2364 bp, Brassica oleracea
gagtcttgtccgtggcctttgatcgtcacaaagatccccaaaaattctcagagagatggcttcgtacacgcccaagaacatcctcatcaccggagcagccggtttcatcgcctcccacgtggcgaacaggctcatccgaacctaccctcactacaagatcgtggtcctcgacaagctcgactactgctccaacctcaagaaccttaacccttcgaaaaactcccccagcttcaagttcgtgaaaggcgacatcgccagcgcggacctcgtcaaccacctcctcatcaccgaaggcatcgacaccatcatgcacttcgccgctcagacccacgtcgacaactccttcggcaacagcttcgagttcaccaagaacaacatctatgggacccacgtcctcctcgaggcctgtaaggtgacaggccagataaggaggtttatccacgtgagtaccgatgaggtttacggggagactgacgaggacgcgctcgtgggtaaccacgaggcctctcagcttctccccacgaatccttactctgcgaccaaggctggcgcggagatgcttgtgatggcgtatgggcgatcttatggtttgccagttattactactcgtgggaataatgtttatggtccgaatcagtttcctgagaagctgattccgaagtttattttgctggcgatgagagggaaggttcttccgattcacggagatgggtcgaacgtgaggagttatctttactgtgaggacgttgctgaggcctttgaggtgattctccacaagggtgaggttgggcatgtttataacattgggactaagaaggagaggagagtgaacgatgtggctagagatgtttgcaagctctttggcatggaccctgaggcgagtattaagtttgttgagaaccggccttttaatgatcagaggtattttctcgacgacgagaagctcaagaagctggggtggtcggagaggacgacgtgggaggaagggttgaagaagactatggagtggtatactcagaaccctgagtggtggggcgatgtctctggagcgttgcttcctcatccgaggatgctgatgatgcccggcgggcggcatttcgatggatcagatgagatttcttcagcagcttcggcgtctgacaagccgagtcaaacccacatggtggttccaagcacaaggagcagtaccagcgcgccgcagaagccttctctcaagttcttgatatatggtaagaccgggtggatcggtggtctgcttgggaagctatgtgagaagcaagggattgcttatgagtatgggaaaggaaggttggaggatagagcttctcttctgcaggatgttgtgagtgttaagccgactcatgttttcaactcggctggtgtgactgggagacctaatgttgactggtgtgagtctcacaaggcagagactatccgtgccaatgtggctggaactttgactctagctgatgtatgcagagagcatgggcttctgatgatgaacttcgctactggttgtatatttgagtatgatgagaagcatcctgaaggttcgggtgttggattcaaggaggaagacactcccaacttcactggctccttctactcaaaaaccaaagccatggtagaggagctgctaaaggagtttgacaacgtatgcacattgagagtaaggatgccaatctcttcagatctaaacaacccacgcaacttcatcaccaagatctcaaggtacaacaaagtagtaaacatcccaaacagcatgacagtgttggacgagctcttaccaatctccatcgagatggccaaaagaaacttgaaagggatctggaacttcacaaacccgggcgtggtgagccacaacgagatcctagagatgtacagagactacatcaaccctgacttcaaatgggcaaacttcacgttagaggagcaagctaaagtcattgtagctccaagaagtaacaacgagatggatgcttctaagctcaagaaagagttccctgagctgctctccatcaaggagtctttgatcaagtatgcgtttgagccaaacaagaagacttgaatgagagaaaagggttgtgattcttcattagattaatcactaataatatttactatatgttttgtttcttgttatattgtttgatcacccttactactatcactagcttttctttaagggtgtgttatagtttgattattctatgtaatagagatttattttttattcatactgtttattcaacacaccattggttttgaaagagagaaaagggttgtgattcttcattagattaatcactaataatatctactatatgttttgtttattgtttcttgttatattgtttgatcacc

SEQ ID NO: 12226 - DNA, 2413 bp, Panax ginseng
aagcagtggtatcaacgcagagtacatggggatatgtagtcccgctgttgtgctctctttttatcattctttgtttgtccgagtcttttctatatctccttcctttcaaagggttctcccttttcaatctccttaccgtgattgacctggattaaattttaactgctttggtatggctacttatactccccaaaatatcctcataactggggctgctggcttcatagcatctcatgttgctaaccgtctcattcggagctaccccgattacaagattgttgtgcttgataagcttgattactgttcaaatcttaagaacctcaatccctctcgatcatctcccaacttcaagtttgtcaagggggatattggcagtgccgatcttgtcaattatcttctcatcactgagtcgattgatacaataatgcacttcgctgctcagacacatgtcgataactcctttggtaacagttttgagtttaccaagaacaacatttatggtacccatgtgcttttagaggcctgcaaagtgactggccagatcagaaggttcatacatgtaagcactgatgaggtctatggggagacagaagaggatgctgttgtgggaaatcatgaagcttcacaactcctccctacaaatccatattcagccacaaaagctggggctgaaatgcttgttatggcttatggtaggtcatatggattacctgtgataacaactcgagggaataatgtatatggccccaatcagtttcctgaaaaactaattccaaagttcatccttttagccatgagaggaaagcaactccctatccacggggatggtgctaatgtgcgtagttatctctactgtgaggacgttgctgaggcttttgaggtcattcttcacaggggagaagttggtcatgtttacaatatagggacaaagaaggagaggagagtgattgatgttgccaaagacatatgtaaacttttctctattgatcctgaagcaaacattaattttgtcgataacaggccatttaacgatcagaggtacttcctagatgatcagaagctgaaagacttgggctggtctgaacgcactacgtgggtagaggggcttaaaaagactatggattggtatattagcaaccctgattggtggggggatgtctctggagcattgcttcctcatcctagaatgctgatgatgcctggtggaattgagagacacttcgacgggtcagataattgtgactctgaatcttcgcattttgcagataaatcttccaagtcccaaatggtggttccgattcccaaaagcagcaactctcagaaacgatccattaagtttttgatttatggtaggtctgggtggattggtggtctacttggaaaattaagtgaaaaacaagaaattccatatgaatatggaaggggacgtctagaggatcgctcacagcttttggtcgatattcagactgttaagcccacacatgtttttaatgctgctggtgtgactggtagacccaatgttgattggtgtgaatctcacaagacagaaacaattcgtaccaatgttgctggtacactaaatttagcagatgtgtgcagagagaatggactcctgatgatgaattttgctactggatgtatatttgagtatgatgctgcacatcctgaaggttctggcattgggttcaaagaagaagacaagcccaattttcacggttctttctattcaaagaccaaggccatggttgaggaactcttgagagaatatgacaatgtctgcacgctcagagttcggatgcctatatcttcagacctcagcaatccacgaaatttcatcactaaaattagtcgttataataaggtggtcaatatacccaacagtatgaccatcttggatgagcttctacctatttcaattgagatggcaaagcggaaccttaggggcatatggaactttacgaatcctggagttgttagccataatgagattttggagatgtacaagcaatatattgatccagctttccagtgggctaactttacactggaagagcaagcaaaggttatagtagcagctcgaagcaataatgagatggatgcatccaagttgaagacggagttccccgagttgctatcaatcaaagagtcattgatcaagtatgtctttgaaccaaacaaaaaatgctaagcagagtagagtggtaaatttcaggctgcctctgcattatcagttaggttgtatggtcttgattacgttggtaatgttagtcatgtcattatttattcttagtttcattccgttgttcttatcattacagatcttgatgttggttggcatgattctgagagttttgttttccatttacaatcaaatatcagtgattgtcctcccctgaggaacttgttttgtagg

SEQ ID NO: 12227 - DNA, 2060 bp, Cirsium arvense
atacacgcaatctgcagttattgatcccgatcggagtaaactttagactgctccagtatggcaacttacacgccaaagaacatccttatcactggggctgctggattcattgcctctcatgttgctaatcggctcatcagaagctaccctgattataagattgttgtgcttgacaagcttgattattgttcaaatcttaagaacctcaacccctccagatcgtctcctaacttcaagtttgttaaaggggacattgggagtgccgatcttgtcaactaccttctgatcactgaatctattgataccataatgcactttgctgcacaaacccatgttgacaactcatttggcaacagctttgagttcacaaagaataacatctatggcacccatgtgcttctagaagcctgcaaagtcactggccagattagaaggttcatccatgtgagcacagatgaggtctatggggaaacagaggaggatgctgttgtgggtaaccatgaagcttcacaacttcttcctacaaatccatattcagccacaaaagctggggcagaaatgcttgtgatggcttatggtaggtcatatggattgcctgtgattaccactagaggaaacaatgtttatggcccaaaccaattcccagaaaaactaatccctaagttcattctcttggccatgagaggaaagccactaccgattcacggtgatggttctaatgtaaggagctacctctactgtgaggatgttgctgaggcttttgaagtaattcttcacaagggggaagttggtcatgtttacaacatagggaccaagagggagaggagagttattgatgttgctaaagatatgtgcaaacttttcaatatggatgctgatgcaagtatcaagtttgtggagaacaggccatttaatgatcagaggtacttcttggatgatgagaaattgaagagcttgggttggtctgaaaggactagatgggaagatggtctgaaaaagaccatcgagtggtataccagcaatcctaattggtggggtgatgtctctggagcactgcttcctcatccacgcatgctgatgatgcctggtggtgttgatagacttgttgacggacctgaaaatgctgaatttgattcagacaatgtagcaaacagcggttctcagattggcattgtggtgaaccccaaaagcagtagcacatctactaagaaaccatctttgaagtttctcatttatggtagaacaggttggatcgggggtttacttggaaagttatgtgacaaacaacaaattccatacgagtatggaagaggtcgattggaagaccgttcacaacttttggctgatattcaggccattaagccaactcatgttttcaatgctgctggtgttactggcagaccaaatgttgattggtgtgaatctcacaagacagaaacaattcgtaccaatgttgcaggcacactgaatctagcagatgtatgcagagaacacgggctcttaatgatcaattttgccactggatgcatctttgagtacgatgctaaacacccagaaggctctggcatcggttttaaggaagaagacaagcccaatttcaccgggtccttttattcaaagaccaaagctatggtagaggagctgttgaaagaatacgacaacgtatgcacccttcgagtccgaatgccaatatcatcggaccttaacaacccacgcaacttcatcaccaaaatagctcgttacgataaagttgtcaacatacccaacagcatgaccatcttggatgagcttctaccaatctcaatagaaatggcaaaaagaaaactcaaaggaatctggaacttcacaaatcccggggtcgtaagtcacaacgagattctggaaatgtacaaaaagtacataaatccggaattcaaatgggtcaatttcacactggaagaacaagcccgagtgatcgtggccccacgaagcaataacgagctggatgcatcaaagttgaagaaagagtttccggagttgatgtcgattaaggaatcgttgatcaagtacgtattcgaacc

SEQ ID NO: 12228 - DNA, 2623 bp, Glycine max
agaaagtgtgtagagtccaaatctaaatctgggaaccaccattttccatttcttctgtgtctgaaaaacctttctttcttgtcttcgtcttttctccctcttctctgcttcaccgcttgccaattcaaggctcttgacatggctacgcatacgccaaaaaatatcctcattactggagctgctggattcatcgcatctcatgttgcgaatcggcttatccggaattatccccagtacaaaattgttgttcttgacaagcttgattactgttcaaatctgaagaatctcattccttcaaaatcatctcctaacttcaagtttgtgaagggggatattggaagtgctgatcttgtcaactaccttctcatcactgagtccattgacacaataatgcactttgctgctcaaacccatgttgacaactcctttggcaacagctttgagttcaccaagaacaacatttatggtactcatgtcctattagaagcctgcaaggtaactggccagatcaagaggttcatccatgtgagcactgatgaggtctacggagagacagatgaagatgctgttgttggaaaccatgaggcttctcagttactccccacgaatccatactctgcaacaaaagctggggcagaaatgcttgtcatggcatatggcaggtcgtatgggttacctgtgatcacgactcgtgggaacaatgtttatgggcccaatcagttccctgagaagttaattccaaagttcattctcctggctatgcaaggcaagcctcttccaatccacggggatggttctaatgtgaggagttatttgtattgtgaagatgttgcagaagcttttgaacttatccttcacaagggagaggtcgggcatgtttacaatattggtactaagaaggaaaggagggttattgatgttgccaaagatatgtgcaggctttttaagatggacccagagactagtataaaatttgtggagaacagaccatttaatgaccagagatactttcttgatgatgaaaagcttaagatcttgggttggtctgagaggaccacttgggaagagggcttgaagaaaaccatggactggtatatcaacaatcctgattggtggggtgatgtcagtggtgcattgcttcctcatccaaggatgctgatgatgcctggtggattggagagacattttgatggatctgatgaagaaaaacctgcatcatatgtctcaactaatactcgaatggtggttccaacatccaagaatgttaactcctctcagaaacctgctctcaagttcttgatctatggcagaacaggttggattgggggtttgctggggaagttgtgtgaaaagcaaggaattccctatgaatatggaaaaggacgcctggaggaccgatcatcacttgtggctgatattcagaatgtgaagccaacacacatttttaatgcagctggagtaactggcagacccaatgtcgattggtgtgaatctcataagacggaaaccattcgcaccaacgttgctgggactttaacattggctgatgtcagcagagagcatggactcttgatgataaattatgctactgggtgcatatttgagtatgatgcagctcatccagagggttctggcattggctttaaggaggaagacagacccaacttctttggttctttctattccaaaactaaggctatggttgaggagctcttaaaagaatatgacaatgtgtgcaccctcagggttcgcatgccaatttcatctgacttgagcaatccacgcaatttcatcaccaagatttctcgttataacaaagtggtcaacattccaaacagcatgaccattttggatgaacttctgcctatttcaattgagatggcaaagcgaaacttgaggggcatctggaacttcacaaatcctggggccgtgagccacaatgagattcttgagatgtacagggattacatcgatccaagcttcaagtgggctaacttcaatcttgaagagcaagccaaggtgataattgctgcacggagcaacaacgagatggatgcatccaaactgaagaacgagttccctgagcttctttccatcaaggaatcactgatcaagtatgtctttgagccaaacaagaaaactgcttaaatatattaaagcggtttcatgttttagacatcacagattatgcatttttgtggcgggctacatagatcactcattatttcattgttattttgttgggttttgataagaaccatactacaaaagctagccatgtagttcttgttctcttagctataagcgattcctgtttcagcatatttccattatattaccgtgtttagagggtgacaagtattataactgggccagatatggttcctaagttaacatttctgtagctttattctagtttgtagtgtcctttgttaagagcagccttagatagggttttgttacctaaaagcttttgcatcctggaagacatgtattcttttattgctcatatattatatcctttttgtggggtatgcagttatgcatgtatcgtatttgcattgtatattatgcagtgaaatggatactactgaaatattcatttaatttccttttgttagag

SEQ ID NO: 12229 - DNA, 2565 bp, Olea europaea
gagaaaaattctggtttgcttggtgtattttgatctgaaatttgaattatcgaaaaaatatattgctcaataatggcgacatacacccccaagaatatcctcattactggtgctgctggatttattgcatctcatgttgcaaataggcttatcagaaactatcctgactacaagattgttgtgctagacaagcttgattactgttctaatcttaagaaccttctaccctccaaatcttcggctaatttcaagtttgttaggggggacattggtagtgccgatcttgtcaactaccttctcattactgagaacattgacactataatgcattttgcagcccagacccatgttgataattcttttggcaatagttttgagttcactaagaacaacatttatggtacccatgtcctattagaggcctgcaaagttactggacaaatcaaaagatttatccacgtaagcacagacgaggtctacggagagactgatgaggatgctgttgtaggaaatcacgaggcgtctcaactccttcccacaaacccatattcagccactaaagctggggcagaaatgcttgttatggcttatggtagatcttacggattgccggtgataaccacccgaggaaataacgtttatggtccaaatcagtttcctgaaaagctaattcccaagttcatccttttagcaatgagagggcagcctcttcctattcatggggatggttctaatgtgcgaagttatctctattgtgaggatgtagctgaggcattcgaatgcgttcttcacaagggtgaagttggtcatgtttacaacattggaacgaagaaggagaggagagtgattgatgttgccaaagacatatgcaatttgtttagcatggatccagacaaaagcattcagtttgtggataacaggccattcaatgatcagaggtacttccttgatgatcagaagcttaagaatttgggttggtttgagaggactacatgggatgaaggtttgagaaagaccatggagtggtataccagtaatcctgattggtggggtgatgtatctggagcactggttcctcatcctagaatgctcatgatgcccggtggaattgaaagactcgatggagctgacaaggacgagtctaaaatgtctgaattctcaggcaagtctaaccagagccatatggtggttcctgcctccaaaaacaatgcgactcaaaaatcaccatacaagttcttgatctatggtaggactgggtggattggtggtttgctcggtaaattatgtgagaaacaggatattccatacgagtatggaaagggacgcctgcaggatcgctcacagttggtggctgacatcctcagtgttaagccaactcatgtttttaatgctgctggtgttactggtagacccaatgttgattggtgtgagagtcacaagacagaaacaattcgcactaatgttgctggtacactgaccttagctgatgtatgcagagaccatggactcctgatgatgaacttcgccacagggtgtatatttgaatataatgcttcacaccctgaaggttctggcatcggatttaaggaggaagacacacccaatttcattggttccttctattcaaaaacaaaggctatggtggaagagctcttgaaagaatatgacaacgtctgcacactcagagttcgaatgcctatatcttccgaccttaataatccacggaatttcattactaagatttccaagtacaacaaggtggttaatattcccaatagcatgaccatcttggatgagcttctcccgatttcaatcgagatggcaaagcggaacctcaggggcatttggaacttcacaaaccctggcgttgtgagccacaacgaaattttggagatgtacaagaagtacattgatccagagttcaaatgggttaacttcacactcgaagaacaagctaaggtgattgttgctcctcgaagtaacaatgaaatggatgcctccaagttgaagaaagagttccccgatttactctcaataaaggagtccttgatcaagtatgttttcgaacccaacaagaaaacccctgcttctgcttaagtatttcagattgtccatttgaatgcctttgtattttagtctgtttagtcataatctttgctcggttgcagcttatttttagaataattttacattttcagaaactggaatagtggccatgagggttctatatgtcatattcttctttgaatcaattcttagattgttatgaaaagagcaccatatagaggtataacatttaaaatttataaagtgatatttttggtgtttgatactgaatatgtcaatgaaataaagtacaaattgcaacaatgttgaccgcgtaaaaatcgtcttgatctgttgacctcataaaaatggtccttccacgtggtcaatcgagagctgctccacgtgccttcctctctgtgcacggcacaaacggtcagacctacatcgccaatcccagcgaaagtggtagcggttacatatactccaacaattaagttagacgacaatagacttatt

SEQ ID NO: 12230 - DNA, 2822 bp, Aristolochia fimbriata
agttctcaaagagtacatgatttattatttttaatattcaaggaaaattgaggatcacgtattgaagcctcgaattgagtccttgaccgtttggggtatggttcttaccgtgaataaatccttggaaatatcgtgttcggttctaaaaacaaggacagtttcctcatattttcactggcaggttcgtggcttcttctcttcccgtgtgtggaactattccgaccttggaattccgcgtccctcgttaaatcacagggagtcggcactcggctgccagaggagaactgggaacagctccctagtggcgaacgtcgtctgcgctttgcgttagtgttactactcgccgacgccatcgatcgaggaaaccggcttgcgatccagagatggcgtcctacaagcctaagaacatcctcattactggtgctgctggattcattgcctcccatgtagccaatcgtctcataagaaactaccctgaatacaaaatagtggttcttgataaacttgactactgctcaaacctcaagaacctactaccttccagatcttcgccaaatttcaagtttgtcaagggtgatataggaagtgctgatcttgtcaactttctccttataacagagtctattgataccatcatgcattttgctgctcaaacacatgttgacaactcctttggaaatagctttgaattcaccaaaaacaacatctatgggacacatgtccttcttgaagcttgcaaggttacgggccaaattaggaggttcatccatgtgagcactgatgaagtttatggagagactgatgaagatgctgttgttggcaaccatgaggcttcacaactccttcctaccaatccatactctgcaacaaaagctggggctgaaatgcttgtcatggcatatggaagatcttatggattgcccgttatcactacaagaggaaacaatgtgtatggcccaaatcagtttccggagaaattgatcccaaagttcattcttttggctatgaggggcaaaccccttcctattcatggtgatggaacaaatgtgaggagctacctctactgtgaggatgttgcagaggcttttgaagtcatccttcacagaggagaagttggtcatgtttataacattgggacaaagaaggagaggagagttattgatgtggcaaaagatatttgtcgactttttaacctggactctgactcgaacattaagtttgttgagaacaggcctttcaatgatcagaggtacttcttggacgatgagaaattgaaaaacttgggctggtcagagaggaccatatgggaagagggtctgaaaaagacaattgagtggtacacgaacaatcctgattggtggggtgatgtgtctggtgcactgctgcctcatcccagaatgctgatgatgccagggattgaaagacaatttgatgggtcagaagattctagtgcagcagcagcaccccgtgctgtgagcagtggtcgccaggatagaatggtggttccatctccaaagagctcaagctccagcccaaagctgtcctataagttcttaatttatggtaggactggttggattggaggccttctggggaagctctgtgagagacaaggaatttcttatgaatatgcaaaggggcgtttggaggagcggtcacaacttgttgctgatatcacaaatgtaaagcctacccatgttttcaatggtgctggtgtaacaggccggccaaatgttgactggtgtgagtctcacaagacagaaacaattcgcaccaatgtggtcggaactttgaacttggctgatgtctgcaaggagcacaatttgctcatgatgaattttgctactggatgtatatttgagtatgattctggacacccagaaggctcaggtattggattcaaggaggaagacaaacccaatttcaccggttctttctattctaagactaaggcaatggtggaagagcttttgaaggaatatgacaacgtgtgcaccctgcgtgttaggatgccaatctcatctgatctgaataatgatcgcaacttcatcacaaagataacccgttacaacagggtggtcaacatcccgaacagcatgacagtattggacgagcttctgcccatttcaatcgagatggccaagaggaatctgagaggcatatggaacttcactaacccaggtgtggttagccacaacgagatcctggagatgtaccagaagtacattgacccagagttcaaatgggttaacttcactttggaagaacaggccaaagttattgtggccccccgaagcaacaatgagatggatgcctccaagttgaagaaggaatttcctgagctcctccacatcaaagactcgttgatcaagtatgtctttgaacccaacaagaaggtgaaatgatgtggcatttagaaggtgtttttttgtcagatgagactaggcctcggaagtaacctcctcctgcactctctttagctaataggaatgttcttcatcctcctgtcaccactagattgttactgctattagttttgtcattttatattctattgataccatgtcgggagctagaataattcttctagggttgtttcttattctttgttgattgtttggtagctcaaccttgttcattttttgttcctttttgcccttttctctttttctgttgctcctacggaactactttgttctctggcattgttaatttagaacaagagttatagatgttgaagcaagtatatatcatgaatggcacagactgcttgaacacttcattttgtaaagtaaatgatctatgcatctggcgcatcataa

SEQ ID NO: 12231 - DNA, 2464 bp, Citrus sinensis
cttccctctcactcttcaaaaagatcactgcggtttcttctcagtttccattttcaacacagtttctctctctagattcgcgttttggcatttgggtttgactcgtcttcgttgatctgatcgactttaagttcatttgcaatggctacgtataccccgaagaacatcctcatcactggggctgctgggttcattgcttcccatgtatgcaaccggctgattcgtaactatcccgagtacaaaattgttgtgcttgacaagctcgattattgttcgaatctgaaaaacctaataccctccaaagcatcctccaactttaagtttgttaagggggacattgccagtgctgaccttgtcaactttcttctcatcaccgagtccattgacactattatgcactttgctgcgcaaactcatgtggacaactcttttggaaatagttttgagtttaccaagaacaatatctatggtactcatgtcctccttgaagcctgcaaagtgactgggcagatccggaggttcatccatgtcagcacagatgaggtctatggggagactgatgaggatgctgttgtgggtaaccatgaagcttcccaactcctgccaacaaatccttattctgcaactaaagctggagcagaaatgcttgttatggcttatggtaggtcatatgggctaccagtgattacaacccgtggaaacaatgtttatggaccaaatcagttccctgaaaaactaattccaaagtttatcctcttggccatgaggggtttgcctcttccaattcatggtgatggttctaatgtgagaagttatttatactgtgaggatgttgctgaggcttttgaatgcattcttcacaagggagaagttggccatgtttacaatgttggtacaaagaaggaaaggagagtgattgatgtggcaaaagatatttgcaaactcttttcaatggaccctgagacaagcatcaagtttgtagaaaataggccatttaatgatcagaggtattttcttgatgatcagaagctgacaagcttggggtggtcagaacgaaccatatgggaagaagggttgaggaagactattgagtggtacactcagaaccctgattggtggggtgatgtctctggtgctctgcttcctcatccaagaatgctgatgatgcctggtgggagacattttgatgggtctgaagagaacaaagcggtgtccagtgtctcaacaaataacattcagtcccgtatggtggttccagtttccaaatgcagctctcctcgaaaaccatccatgaagtttttgatctatggcaggacaggatggattggaggtctactaggaaagttgtgtgagaaagagggtattccatttgaatatggaaaaggacgtttggaggattgttcatctctcattgcagatgttcagagtgttaaacccacacatgttttcaatgctgctggtgttactggcagacccaatgttgattggtgtgaatctcataaaactgacaccattcgcaccaatgttgctggaaccttaaccttggcagatgtttgcagagatcatgggatcttgatgatgaattatgctaccggttgcatatttgagtatgatgctgctcatcctgagggctctggcattgggtataaagaggaagatacacccaattttactggttctttctactcaaaaaccaaggccatggttgaagagctgttgaaagaatacgacaatgtttgcactctcagagtccgaatgccgatatcttctgacctaaacaacccccgcaacttcattaccaagatttctcgttataacaaggtggtcaacattccaaacagtatgactgttttggatgaacttctccccatttcaattgagatggcaaagcgtaacttgaggggtatttggaacttcacaaaccctggggttgtgagccacaatgaaattcttgagatgtacaagaagtacattaacccagaattcaagtgggtgaacttcacattagaagagcaagcaaaggtgatagtcgccccaagaagcaacaacgagatggatgcttctaagttgaagaaggagttccctgagttgctatccatcaaggattcactgatcaagtatgtctttgagcccaacaagaaaacctagggtacattaagcagctttcagttgtaggggcctcttgtttgaccaacacattctgcattacataataggtttggagtaccattgtactgttaatcagcttcactcctcatttctttttggtgtaatcactttatatttactgcactagagataattagccatgcttctttcattatttttcttggagttttattgagatatggttagtgtattttttctagaataggttgctaatatttaatggaatctgctagttgctagtatgtaacttttgcagtatctgttaaatgaatatggccgcatgctgttcgatgta

SEQ ID NO: 12232 - DNA, 2404 bp, Trifolium pratense
ttaccaatttaagttgcttgatatggcaacgcacaccccaaaaaatatcctgattaccggggcagctggattcattgcatctcatgttgccaaccggctaatccggaattatcctgactacaaaattgttgtgctcgacaaacttgattactgttctaatctgaagaacctcattccttcaaaatcatctcctaacttcaagtttgtgaagggagacattgaaagtgctgatcttgtcaactaccttctcattaccgagtctatcgacacaattatgcactttgccgctcaaactcatgtggacaactcttttggtaatagttttgagttcaccaagaacaacatatatggtactcatgtcctattagaagcctgcaaggtaacaggacagatcaaaaggttcatccatgtaagtactgacgaggtctatggtgagactgatgaggatgccgttgttggaaaccatgaagcttctcagctacttccgacaaatccatactctgcaactaaagctggggcagaaatgcttgtcatggcctatggtaggtcatatggactacctgtgatcactacacgtggaaacaatgtgtatggcccgaaccagtttcctgaaaagctaattccaaagttcatccttttggcaatgcaaggcaaagttcttccgattcatggtgatggttcaaatgtgaggagttatttatattgtgaagatgttgcagaggcttttgaagttatccttcataagggagaggttggacatgtttacaatattggaacaaagaaggaaaggcgtgttattgatgtagccactgatatatgccgactcttctcgatagatccggagactaatataaaatttgtagagaacagaccgtttaatgatcagaggtactttcttgatgaccaaaagttgaaggttttgggttggtcggagagaacaacgtggcaagaaggcttgaagaaaaccatggattggtatatcaacaatcctaattggtggggtgatgtgagtggtgcattacttcctcatccaaggatgttgatgatgcctggtggtatggagagacattttgacggatctgaagaagaaaattctgcaaactatgtctcaagtacgaacactcgaatggtggttccaccaaccaagaaccttggctcatcgcagaaacctcctctcaagttcttgatctatggcagaacaggttggatcggtggtctgttggggaaactgtgtgagaagcaagggattccttatgagtatgggaaagggcgccttgaggaccgttcatcacttgtggctgatattcagaacgtgaagccaactcatattttcaatgcagcaggagtgactggaagacctaatgttgattggtgtgaatctcataaaactgaaaccatccgtgtcaacgttgctgggactttaacattggctgatgtaagcagagagcatgaccttttgatgataaactatgctactggatgcatattcgagtacgatgaagctcatccagacggttcaggcattggctttaaggaggaagacacacctaatttcaccggttctttctattccaaaactaaggctatggttgaagagctcttgaaagaatatgataatgtatgcacgcttagggttcgcatgccgatatcatctgacctaagcaatccacgcaacttcatcaccaagatttctcgttacaacaaagtagttaacatcccaaacagcatgactattttggacgaacttcttcctatttcaattgagatggcaaagaggaacttaaggggtatctggaacttcacaaatcctggtgccgtgagccacaacgagattctcgagatgtacagggattacattgatccaagcttcaagtgggctaacttcacacttgaagagcaagccaaagtgatagttgctgcaagaagcaacaatgaaatggatgcatccaaattgaagagtgagtttccagaactgctttccatcaaggaatcactgatcaagaatgtctttgagccaaacaagaaaagcgcttaaaaaagatcaagtaacttcaagttttaggacatcatttactaccaaatttttgtgtttggctacttagattatcactcattatttcattgttatagttccatcttgttattgtgtttagaggatgatattttctaaacagttttatgcagctttattatagtttagtgtactatgttaagagcatccttagggtcttgtttgttaccttgtgagcttgctatggaggataaacttggcatggaggacatgtattcttttattactcatatcttttttgtgacttatgtttgtatttgtattcttgtaattgacattcatttaaatttctcatatagagaaaaactagtgttattgagcactattaaagca

SEQ ID NO: 12233 - DNA, 2669 bp, Gossypium hirsutum
ttttctcttctcctctgaaatctcgctctaagatttcgtcgtttatctttctccatctggattttgattgagctctctcttctttcgtcttaattggtttcactatgtcttcttatacccctaagaacatcctcataactggggcagctggttttattgcgtcacatgtcgctaaccggctcataaggaactacccagactacaagattgttgtgcttgacaagcttgattactgctcgaacctgaaaaacctccttccttccaagtcatctccgaactttaagtttgtgaaaggtgacattggtagtgctgaccttgttaactacctccttattaccgagtctatcgacacaataatgcactttgcagcccagactcatgttgataactcgtttggaaacagctttgagtttaccaagaacaatatctatggcactcatgtcttgcttgaagcttgcaaagtcactggtcaaatcaggaggttcatccatgtcagcactgatgaggtttatggtgagacggatgaggatgctgttgtaggaaaccatgaggcttcccaacttctcccaacaaacccgtactctgctacaaaagctggtgctgaaatgcttgttatggcgtatggtaggtcatatgggctgcctgtgataacaacccgtggaaacaacgtttatggtcccaaccagttccctgaaaagttgattccaaagttcattctcctagcaatgaggggaaagactttaccaattcacggtgatggttctaatgtgaggagttatttatactgtgaggatgtggccgaggcatttgaagtcattcttcacaagggtgaagttggccatgtttataatattggaacaaagaaggagaggagagtgattgatgtggccaaagatatctgtaagcttttctcgatggatccagagaccagcatcaagtttgttgaaaacagaccattcaatgaccagaggtattttcttgatgatgagaagctgaagaacttgggatggtccgagcaaactgtatgggaagaggggctgaagaagaccattgaatggtacactcagaatcccgaatggtggggcgatgtgtctggtgcattgcttcctcaccctagaatgctgatgatgcctggtgggagacacttcgattctgaagagggaaaaggtacatcatttgcaagtggacctaatcagacccgaatggtggttccaaccttcaaaactagtagcagcacgcaaaaaccagccttgaagttcttgatctatggcaggactggctggattggaggtctgcttggtcagttatgtgagaaacaaggtattccctttgaatatggaagaggacgcttggaagatcgttcatcccttatggcagatattcagaatataaagccaacccatgtttttaatgctgctggtgtgactggtaggcccaatgttgattggtgtgaatctcacaaaacagaaacaattcgcaccaatgtggctggaaccttgaccttagcagatgtttgcagagaacatgggcttttgatgatgaattttgctacagggtgtatattcgagtacgatgcaggacatcctgagggctccggcattgggtataaagaggaagacaaacccaatttcactggttccttctattcaaaaaccaaggctatggttgaagagctgttgaaagaatatgacaacgtctgcactctcagagttcgaatgccgatctcatctgacctaaacaaccctcgtaactttattaccaagattgcacgctacaacaaggtggtcaacattcccaacagcatgacaatcttggatgaacttctgcctatttctatcgagatggctaaaaggaacttgaacggtatctggaactttacaaaccctggggttgtaagccacaatgagatcctggagatgtataaggcttacattgacccaaagtttcagtgggtgaacttcacattggaagaacaagccaaggttatagttgcccctcgaagcaataatgagatggacgcatccaagttgaagaacgagttccccgatctgctaccaatcaaggaatcactgattaagtatgtctttgaacccaacaagagaacctgagccttttgagcagcagtttacaggaatagaattcggtattatcctatgttttttcttcatttagttattgcctggaatatcttttcagtttaattcatttgttataatcttgtcttccaccttattagtttccactagataactcttaaggtgttactattagatttaaaccattcattgttagtagctgcaccaagcagtatcctagtctgtacgtccattcttgaagaaacaatctataggtgctttacaaattgtcatctgcaggctgacaggtgtattatttggcattacattagttgaatgttatgactttcaacagtcacctactggtctatgatggaggaaattccatctatctcttattactcagatgagtgaattatttatgtatttgagtctctcaattgtcctttgtgcaactacattatattactcagtataccagtcctttgactgaaataagagtatatatttcttttcacttttttgcaccttttcttgtttacttttccaaagttgcaattgcaatcatattattgatgtttatgcaattccgaa

SEQ ID NO: 12234 - DNA, 2998 bp, Glycine max
accagtcacatagtcaaagggagatcgtcagctaattccttaaaattaaaatcgatggagaactatttgcaattaattatcaataaattgttgaattttttttttccaaacaaaagaaattatggtgccacgattataaaaaactggtgccacaatcatgtgataaatcacatgggaatttaattaaaaaattaaatgaagaatgggtcccacgtaaatttgggagggtattttcgccacttgaaatgatcctctggctccccttaactgtctcagactcgtagttgatcaaatattcatacataaaaaccgcgtctatatatatatatatatatagaaagtgtgtagagtccaaatctaaatctgggaaccaccattttccatttcttctgtgtctgaaaaacctttctttcttgtcttcgtcttttctccctcttctctgcttcaccgcttgccaattcaaggctcttgacatggctacgcatacgccaaaaaatatcctcattactggagctgctggattcatcgcatctcatgttgcgaatcggcttatccggaattatccccagtacaaaattgttgttcttgacaagcttgattactgttcaaatctgaagaatctcattccttcaaaatcatctcctaacttcaagtttgtgaagggggatattggaagtgctgatcttgtcaactaccttctcatcactgagtccattgacacaataatgcactttgctgctcaaacccatgttgacaactcctttggcaacagctttgagttcaccaagaacaacatttatggtactcatgtcctattagaagcctgcaaggtaactggccagatcaagaggttcatccatgtgagcactgatgaggtctacggagagacagatgaagatgctgttgttggaaaccatgaggcttctcagttactccccacgaatccatactctgcaacaaaagctggggcagaaatgcttgtcatggcatatggcaggtcgtatgggttacctgtgatcacgactcgtgggaacaatgtttatgggcccaatcagttccctgagaagttaattccaaagttcattctcctggctatgcaaggcaagcctcttccaatccacggggatggttctaatgtgaggagttatttgtattgtgaagatgttgcagaagcttttgaacttatccttcacaagggagaggtcgggcatgtttacaatattggtactaagaaggaaaggagggttattgatgttgccaaagatatgtgcaggctttttaagatggacccagagactagtataaaatttgtggagaacagaccatttaatgaccagagatactttcttgatgatgaaaagcttaagatcttgggttggtctgagaggaccacttgggaagagggcttgaagaaaaccatggactggtatatcaacaatcctgattggtggggtgatgtcagtggtgcattgcttcctcatccaaggatgctgatgatgcctggtggattggagagacattttgatggatctgatgaagaaaaacctgcatcatatgtctcaactaatactcgaatggtggttccaacatccaagaatgttaactcctctcagaaacctgctctcaagttcttgatctatggcagaacaggttggattgggggtttgctggggaagttgtgtgaaaagcaaggaattccctatgaatatggaaaaggacgcctggaggaccgatcatcacttgtggctgatattcagaatgtgaagccaacacacatttttaatgcagctggagtaactggcagacccaatgtcgattggtgtgaatctcataagacggaaaccattcgcaccaacgttgctgggactttaacattggctgatgtcagcagagagcatggactcttgatgataaattatgctactgggtgcatatttgagtatgatgcagctcatccagagggttctggcattggctttaaggaggaagacagacccaacttctttggttctttctattccaaaactaaggctatggttgaggagctcttaaaagaatatgacaatgtgtgcaccctcagggttcgcatgccaatttcatctgacttgagcaatccacgcaatttcatcaccaagatttctcgttataacaaagtggtcaacattccaaacagcatgaccattttggatgaacttctgcctatttcaattgagatggcaaagcgaaacttgaggggcatctggaacttcacaaatcctggggccgtgagccacaatgagattcttgagatgtacagggattacatcgatccaagcttcaagtgggctaacttcaatcttgaagagcaagccaaggtgataattgctgcacggagcaacaacgagatggatgcatccaaactgaagaacgagttccctgagcttctttccatcaaggaatcactgatcaagtatgtctttgagccaaacaagaaaactgcttaaatatattaaagcggtttcatgttttagacatcacagattatgcatttttgtggcgggctacatagatcactcattatttcattgttattttgttgggttttgataagaaccatactacaaaagctagccatgtagttcttgttctcttagctataagcgattcctgtttcagcatatttccattatattaccgtgtttagagggtgacaagtattataactgggccagatatggttcctaagttaacatttctgtagctttattctagtttgtagtgtcctttgttaagagcagccttagatagggttttgttacctaaaagcttttgcatcctggaagacatgtattcttttattgctcatatattatatcctttttgtggggtatgcagttatgcatgtatcgtatttgcattgtatattatgcagtgaaatggatactactgaaatattcatttaatttccttttgttagagtacaaaaatattgttgtatagctcttgacgtggaaaatgc

SEQ ID NO: 12235 - DNA, 2739 bp, Cannabis sativa
aaaaaacggaggcgtatatatatcggatcaccattttccctctcgctgcaatcagagtcctctgattttctcattcatttctctgtctgagtcttatcatcttagatattcgttcgagattttttctctgctgtttctcccaatctggggttgatccgttttgatctccgtcaaatttaaactgcattgacatggctacatatacgccaaagaacatcctcattactggggctgcaggattcattgcgtcccatgttgccaatcggctgattcgcagttaccctgactacaagattgttgtccttgacaagcttgattactgctcaaatttgaaaaatctcctcccctcaaaatcatcaccaaatttcaagtttgttaagggggacattggcagcgctgatcttgtcaactttcttttaatcacagagaaaattgacacaataatgcattttgccgctcagactcatgttgacaattcctttggtaatagttttgagttcaccaagaacaacatctatggcactcatgttcttctcgaagcatgcaaagtcactggccagatcaggaggttcatccatgtaagcactgatgaggtatacggggagactgacgaggatgctgttgttggaaatcatgaagcttctcagctcctaccaacaaatccttactctgcaacaaaagctggagctgaaatgcttgttatggcatatggcaggtcttatggattacctgtgataacaacccgtgggaacaatgtgtatggtcctaaccaatttcctgagaagttgattccaaagttcatccttctagctatgaggggaaagcctcttccaattcatggtgatggctctaatgtgaggagctatttatactgcgaggatgttgctgaggcttttgaagtcattcttcacaaaggagaggttggacatgtttataatattggaactaagaaggaaaggagggttattgatgtggctaaggatatctgcagacttttctcagttgattctgatgcttgcattgagtttgtggagaacagaccttttaacgaccagaggtactttctggatgatcagaagcttacaaacttgggatggtcagaaagaactacctgggatgagggattaaagaagactattgaatggtacaccaagaatcctgaatggtggggtgatgtttcaggggccctgcttccacatccaagaatgctaatgatgcctggtggactcgagagacattttgatgggtctgaagaggacaaatctgaatcttatgtctcaagtaatactcggatgttggttccaccgaccaaaagcaccaactctcctcgcaaacccccactgaaatttttgatctatggtcggactggttggataggtggtctacttggaaagctatgtgagaaacaagggattccatttgaatatggaaaagggcgacttgaagatcgggcatcactcttggcagatcttcagaatgttaaaccaacccatgtattcaatgccgcaggtgtgactggtagacccaatgtcgattggtgtgaatcccataaaccagaagtgattcgtgccaatgttgctggaaccttgaccatagccgatgtttgtagagaacaagggctcttactgatgaattatgccactgggtgtatttttgagtatgatgctgcacatccagaaggttctggaattggattcaaggaggaggacaaaccgaatttcattggttcattttattcaaaaacaaaggccatggttgaagagcttttgagagaatacgacaatgtctgcaccctgagagttagaatgcctatatcatcagatctgaataatccccggaacttcattactaagattactcgttacaacaaggtggttaacattccaaacagtatgactatcttggatgaacttctacccatttccattgagatggcgaagcggaacctaaggggcatttggaacttcacaaatcctggagttgtaagccacaatgagattcttgagatgtaccaaaaatacattgaccctgatttcaagtggcaaaacttcactctagaagagcaagccaaggtgattgtggcccctcgaagcaacaacgagttggatgcatcaaagttgagcaacgagttccctgaaatgctgccaatcaaggaagcactgattaagtttgtttttgaaccaaacaagaaaacctctgcagagtgagcaacttttgcattttgcattagctgataatatatacttcatagtacacccacagtacaacattagtattacatattattagcttttatctcattatttttctgttgcttagaaggccatacggattaattctattgttagggttgtcatttttggttctggggcgcatactagttgctgtctattcctccttttgtatttttggaaacccaatattttgtaggttcttgtagtagatcacattggaccgcaacatgttttggatactttttctcaattcttttcgtactagttttatagaatatatatttaaacttgtcatctgctctcttattgcatctggaggcagatgaattagtttatgatgtctttattttaagcatttccattggttgtaccaagttttctttgttttcttctagtggatttgtaataactaataagtttctgtttcatatataaaaggttgagcagtaatatttatacgtttaaaattttaaataatacagtaatacatgactgaagcagccaa

SEQ ID NO: 12236 - DNA, 2328 bp, Cichorium intybus
ccaaagaacatcctcatcactggggcagctggcttcattgcttctcatgtagctaatcgactcatcagaagctaccctgattacaagattgtcgtccttgacaagcttgattactgttcaagtctcaagaacctcaatccctcaagatcatctcccaacttcaaatttgtcaagggtgacatcgggagtgcagatctagtcaactacctcctcataaccgaatcaatcgataccataatgcactttgctgcacaaactcatgtcgataactcattcggcaacagcttcgagttcacaaagaacaacatctatggcacccatgtccttctagaagcctgcaaagtcactggccaaatcagaaggttcatccatgtcagcacagatgaagtctacggtgaaacagaagaagatgccattgttggtaaccatgaagcttcacaacttcttcctactaacccttattcagccacaaaagctggtgctgaaatgcttgtaatggcatacggtagatcatacgggttacctgtaatcaccacaagaggtaacaacgtgtacggtccaaaccaattccctgaaaaactaatccctaaattcattctcttagccatgagaggaaaaccacttccaatccatggtgatggttcaaatgtaagaagttacctctactgtgaagatgtagctgaagcttttgaagtcattttacacaaaggtgaagttggccatgtgtacaatatagggacgaaaagggaaagaagagttatcgatgttgcaaaagacatgtgcaaacttttcaacatggatcctgattcaagcatcaagtttgttgaaaacagaccgtttaatgatcaaagatactttctagatgatgaaaagttaaaaagcttagggtggtccgaaaggacaatatgggaagaaggtttgaaaaaaacaatcgaatggtacacaagtaaccctaattggtggggtgatgtgtcaggtgcacttctccctcatccacgaatgttaatgatgccaggtggcgttgaccgcctcgttgacggaccggaaaacaccgaattcgacacaccccatgaagcaaacaacaattcccagatcggaatcagcgtttccgccccgaaaacaacttccattccctccaagaaaccttccttgaagttcttgatttatgggaaaacagggtggattggtggattactcggaaagatttgtcaaaaacaagggattcaatttgaatatggaaaaggacgtttacaggatcgatcacagcttttggttgatattcaaaatgttaaacctactcatgtgtttaatgctgctggtattacgggtagaccgaatgttgactggtgtgaatcacacaagactgaaacaattagtacaaatgtttcagggacacttaatttggcggatgtttgtagggaacatggtttgttgatgattaattttgctactggatgtatttttgaatatgattctgcacatccggaaggttctggaattggtttcaaggaagaagatacaccgaatttcactggatcgttttattccaagactaaagccatggtggaagaactcctaaaagaatacgacaacgtatgcacactccgagtccgcatgccgatttcctccgacctcacaaacccgcgaaacttcatcacgaaaatcgcgcgttacaacaaagtcgtcaacatccccaacagcatgacaattctcgacgaacttctaccgatttcaatcgaaatggcaaaacgaaacctcaaaggaatctggaacttcacaaaccccggtgtcgtaagccacaacgaaatcctcgaaatgtataaaaaatacataaatcccgaattcaaatacgtcaacttcacactcgaagaacaagctctcgtaatcgtggccccacgtagcaataacgaattggatgcttccaaattgaagaaggaatttcccgagttgatgtcgattaaggagtcgttgatcaagtacgtgttcgaacccaataaaaaacattaacaataataacaataaataacgaaatcaaatgaaaaatgaaatgaaatggaatgggattcttttttagaatttgtaaactcgagattcatgtaccatgttatcgggattttatgggaggaggttgttttgtctttaggtattttatattgatattgttttcgactttttgtgtcggtaagagttttagtttgtttaacggtgggtttatgagtattttagatttgttaaaagttgtactattggattctctacaagatttgttatgtttcttattatcaagtaaagtactttgttatttctttttagttaagtagttgtgcg

SEQ ID NO: 12237 - DNA, 2416 bp, Cichorium intybus
cataattgattgcatcttgccatcatattctttgccttcgctggattatacatgtacacacgctaacgctcacacaatcttcctgtactgtgtgtatatatagaagcaggcatcggtttccactcggtgaaattgtccgcggtttcttcataattttggtggaaatctgattttcatcactctcttcgctcaaattcatattggtcctggcacggatccggatcgaatttatatttctccagtatgaccacatatacaccaaagaacatcctcatcactggggcagctggcttcatcgcctctcatgtcgccaaccgccttatcagaagctatccagattacaagatcgtcgttctcgacaaacttgattactgctcaaatctcaagaacctcaacccctccaaatcatctcccaacttcaaattcgtcaaaggagacatcggaagtgccgatctggtcaactacctcttaatcaccgaatccatcgacaccataatgcacttcgctgctcaaacacatgtcgacaactcattcggaaacagcttcgagttcacaaaaaacaacatttacggcacccatgtgctcctcgaggcctgcaaagtcaccggccagatcagacgattcatccacgtcagcacagacgaagtatacggtgaaacagaggaagacgccatcgtcggcaaccatgaagcctcacaacttcttcccacaaatccatattccgccacaaaagccggcgcagaaatgcttgtgatggcttacggtaggtcatacgggttacccgtgatcacgacacgtggaaacaacgtgtacggcccaaatcaattcccggaaaaactcatccccaaattcattctcttagccatgagaggcaaaccacttccgattcacggcgacggttcgaatgtcagaagttacctctactgtgaagacgttgctgaagctttcgaagtcatccttcacaagggcgaagtgggacacgtgtacaacatcggaactaaaaaagaaaggcgagtcatcgacgtggctaaagacatgtgtcagcttttcaacatggatcctgaatcaagcatcaagttcgttgaaaacagacctttcaacgatcaacgatactttttagacgacgagaagctcaaaagcttagggtggtcagaaagaaccacgtggcaagaaggtttaaaaaagaccatggactggtacactagtaacccagattggtggggtgacgtgtccggagctctcctcccccatccacgtatgctaatgatgccaggtggcgttgaacgagtcgtcgacgtcccagaaaacattcaatccgattcacctcacgcggccgtcaactcttcccagttccgaaaagtctcaccggtccaaaaaaccatccccaataaacaatctctcaagttcttgatttacggaaaaaccggttggatcggcggtttacttgggaaactatgtgaaaaacaaggaattcaatacgagtacggaaaaggccgtttggaaaaccggtcacaacttctagaagacattcaaaaaaataaacccacccatgttttcaatgctgcgggtatcacgggtcgacccaatgtcgactggtgcgaatcgcataaaacagaaacgattcgcaccaatgtatccgggaccctcactttagcagatgtctgcaaagaacacggaattttaatgatcaatttcgccaccggttgcattttcgaatacgacaccgcgcatccggaaggttccggaatcggtttcaaagaagaagacacccccaatttcaccggatccttctactccaaaaccaaggccatggttgaggagctactgaaagaatacgacaacgtgtgcacattgagagtccggatgccgatttcatcagatctcaacaacccgcgaaactttatcacaaaaatcgcgcgatacgataaagtggtgaatattccgaacagtatgacgattttggacgagcttttaccgatatcgattgaaatggcgaagagaaatttaaaggggatttggaattttacaaatccgggggttgtgagtcataacgaagttttggagttgtataaaaagtatataaatccagagtttaaatggaagaattttacagttgaagaacaagcgcgagtgattgttgcaccaaggagtaataatgagttggatatgacaaaattgaagaaagagtttccggagttgctgtcgattaaggagtcgttgatcaagtatgtgtttgaacccaataaaaaggtttgatttttttttagttgttacttacatgtgtaatgtttaaatagtttgagattaaaatcatagggagctcgtatattgtttcgttacagatttgttaaagctgctaattgttaaagcagattggtattcttgatttctttacaggtttgttatcaattacaaa

SEQ ID NO: 12238 - DNA, 2576 bp, Panax ginseng
tatttccttgtttgagccatttctgtctctcctttattacaaagggctctgtttttctctctctctttgctttccttgattgatcgatcctgttccggacctggatcaaatttgtaagtttcgccttgatctctcttcttctgtaagaaactgctttggtatggctaactatacccccaagaatatcctcataaccggggctgctggatttatcgcatctcatgttgctaatcgtctcattcggagctaccctgactacaagattgttgtgcttgataagcttgattactgttcaaatcttaagaacctgaacccctctcgatcatctcccaactttaagtttgtcaagggggatattggcagtgccgatcttgtcaactaccttctcatcactgagtcgattgacacaataatgcactttgctgcccagacccatgttgacaattcctttggcaacagttttgagttcaccaagaacaacatttatggcacccatgtgcttttagaggcctgcaaagtgaccggccagatcagaaggttcatccatgtaagtactgatgaggtctatggggagacagaagaggatgctgttgtgggaaatcacgaagcttcgcaactcctccctacaaatccatattcagccacaaaagctggggctgaaatgcttgttatggcttatggtaggtcatatggtttgcctgtgataactactcgaggaaataatgtatatggccccaatcagtttcctgaaaagttaattccaaagttcatccttttagccatgagaggaaagcaactccctatccacggggatggtgctaatgtgcgtagttatctctactgtgaggacgttgctgaggcttttgaggtcattcttcacaggggagaagttggtcatgtttacaatatagggacaaagaaggagaggagagtgattgatgttgccaaagacatatgtaaacttttctctattgatcctgaagcaaacattaattttgtcgataacaggccatttaacgatcagaggtacttcctagatgatcagaagctgaaagacttgggctggtctgaacgcactacgtgggtagaggggcttaaaaagactatggattggtatattagcaaccctgattggtggggggatgtctctggagcattgcttcctcatcctagaatgctgatgatgcctggtggaattgagagacactttgacgggtcagataattgtgactctgaatcttcgcattttgcagataaatcttccaagtcccaaatggtggttccgagtcccaaaagcagcaactctcagaaaccatccattaagtttttgatttatggtaggtctgggtggattggtggtctacttggaaaattaagtgaaaaacaagaaattccatatgaatatggaaagggacgtctagaggatcgctcacagcttttggccgatattcagactgttaagcccacacatgtttttaatgctgctggtgtgaccggtagacccaatgttgattggtgtgaatctcacaagacagaaacaattcgtaccaatgttgctggtacactaaatttagcagatgtgtgcagagagaatggactcctgatgatgaattttgctactggatgtatatttgagtatgatgctgcacatcctgaaggttctggcattgggttcaaagaagaagacaagcccaattttcacggttctttctattcaaagaccaaggccatggttgaggaactcttgagagaatatgacaatgtctgcacactaagagttcggatgcctatatcttcagacctcagcaatccacgcaacttcatcactaaaattagtcattataataaggtggtcaatatacccaacagtatgaccgtcttggatgagcttctacctatttcaattgagatggcaaagcggaaccttaggggcatatggaactttacgaatcctggagttgttagccataatgagattttggagatgtacaagaaatatattgatccagctttccagtgggctaactttacactggaagaacaagcaaaggttatagtagcagctcgaagcaataatgagatggatgcatccaagttgaagactgagttccccgagttgctatcaatcaaagagtcattgatcaagtatgtctttgaaccaaacaaaaaatgctaagcagagtagagtggtaaatttcaggctgcctctgcattatcagttaggttgtatggtcttgattacgttggtaatgttactcatgtcattatttattcttagtttcattccattgttcttatcattacagatcttgatgtaggttggcatgattctgggagttttgttttccatttacaatcaaatatcagtgattttctgattgtcctccccctgatgaacttgttttgtaggcattctctctaagtgtatgttctcttctttaagcttgcaggctttgtaacatttgattctgtcaagttgatttgtttgtcacacctgcataataagctttcctttattttcttcccccagcttcaatttttcaaaacaaattttgcaatttaatagattgtgttaa

SEQ ID NO: 12239 - DNA, 2571 bp, Glycine max
gaaagtgtgtagagtccaaatctaaatctgagaactaccattttccatttcttctgtgtctgaaaaatttctctttcttgtcttcgtgttttctccttcttcttcgcttcatcgcttgccaattcaagttgcttgacatggctacgcatacgcccaaaaatatcctcattactggagctgctggattcatcgcatctcatgttgcgaaccgtcttatccggaattatccccagtacaaaattgttgttcttgacaaacttgattattgctcgaatctgaagaatctcattccttcaaaatcatctcccaacttcaagtttgtgaagggggatattggaagtgctgaccttgtcaactaccttctcatcaccgagtccattgacacaataatgcactttgctgctcaaacccatgttgacaactcgtttggtaacagctttgagttcaccaagaacaacatatatggtactcatgtcctattagaagcctgcaaggtaactggccagatcaagaggttcatccatgtgagcactgatgaggtctatggagagacagatgaggatgctgttgttggaaaccacgaggcttctcagttactcccaacaaatccatactctgcaacaaaagctggggcagaaatgcttgtgatggcatatggaaggtcatatgggttacctgtgatcacaacacgaggaaacaatgtttatgggcccaatcagtttcctgagaagttaattccaaagttcattctcctggccatgcaaggcaagcctcttccaatccacggggatggttctaatgtgaggagttatttgtattgtgaagatgttgcagaggcttttgaagttatccttcacaagggagaggtcgggcatgtttacaatattggtactaagaaggaaaggagggttattgatgttgccaaagatatatgcaggctttttaagatggacccagagactagtataaaatttgtggagaacagaccatttaatgaccagagatactttcttgatgatgaaaagctgaaaatcttgggttggtctgagaggaccacttgggaagagggcttgaagaaaaccatggactggtatatcaacaatcctgattggtggggtgatgtcagtggtgcattgcttccccatccaaggatgctgatgatgcccggtggactggagagacattttgatggatctgacgaagaaaaacctccatcgtatgtctcaactaatactcgaatggtggttccgacatccaagaatgttaactcctcacagaaacctgctctcaagttcttgctctatggcagaacaggttggattgggggtttgctggggaagttgtgtgaaaaacaagaaattccctacgaatatggaaaaggacgactagaggaccgatcatcacttgtggctgatattcagaatgtgaagccaacacacatttttaatgcagcaggagtaactggcagacccaatgttgattggtgtgaatctcacaagacagaaaccattcgcaccaacgttgctgggactttaacattggctgatgtcagcagagagcatggaatcttgatgataaattatgctactgggtgcatatttgagtatgacaaagctcatccagagggttctggcattggctttaaggaggaagacaaacccaacttcattggttctttctattccaaaactaaggctatggtcgaagagctcttgaaagaatatgacaatgtgtgcaccctcagggttcgcatgccaatttcatctgacttgagcaatccgcgcaatttcatcaccaagatttctcgttataacaaagtagtcaacattccaaacagcatgaccattttggatgaacttctgccgatttcaattgagatggcaaagcgaaacttgaggggcatctggaacttcacaaatcctggggccgtgagccacaatgagattctcgagatgtacagggattacattgatccaagcttcaagtggactaacttcaatcttgaagagcaagccaaggtgataattgctccacggagcaacaatgagatggatgcatccaaactgaagaacgagttccctgagcttctttccatcaaggaatcactgatcaagtatgtctttgagccaaacaagaaaactgcttaaaagtattgagcggtttcatgttttagaaatcaaagattatgcatttttgttgcgggctacatagatcactctttatttcattgttatttcgttgggttttgataagaaccttactagaaaagctagccatgtagttcttgttctcatagctacaagtgattccagtttcagcatagttccatcatgttactgtgtttagagggtgacaagtataataattgggccagatatggttcctaagttaacatttctgtagctttattctagtttgtagcgtcctctgttaagagcagccttagaaaatagggtcttgttacctaaaagcttttgcatcctggaaggcatgtattctttttattgctcatatattatatcctttttgtggggtattcagttatacttttatcgtatttgcattgtacaa

SEQ ID NO: 12240 - DNA, 2583 bp, Vitis vinifera
cctgactctggatcttcgtggtttcttctccattctgtccgaatccacccccttttatctctagagactttatattttctccctctaaagtttcaataatcccattggtcttgatctgagagcaatttattctgctttgatatggctacacacacacccaagaacatcctcattacgggggctgctggattcattgcatcccatgttgctaaccggcttatcaggaattacccagactacaagattgttgtgcttgacaagcttgattactgttcgaatctcaagaacctccttccctctaaatcatcccctaactttaagtttgtcaagggagacattggcagtgctgaccttgtcaacttccttctcatcactgagtccattgacacaataatgcactttgcagcccagactcatgttgacaactcctttggtaacagctttgagttcaccaaaaataatatctatggtactcatgtccttctagaagcctgcaaagtcactggccagatcaggagattcatccatgttagcacagatgaagtctatggagagacagatgaagatgctgttgtaggaaaccatgaggcttctcaactccttccgacaaacccatactcagcaacaaaagctggtgcagaaatgcttgttatggcctatggtaggtcgtatggcttacctgttataactacccgagggaacaatgtttatgggcccaatcaatttcctgagaaattaattccaaagttcatcctcttggcaatgagaggaaagcctcttccaatacatggggatggaagtaatgtgcgtagttatctctactgtgaggatgttgctgaggcttttgaagtcattcttcacagaggagaggttggccatgtgtacaacattgggactaagaaagaaaggagggtgattgatgtggccaaagatgtatgcaacctcttctcaatggacccagagacaagcataaagtttgtggagaatagaccatttaatgaccaaagatactttctagatgatcagaagctaaagatcttgggctggtcagagcggactacatggcaagaggggctgaagaagacaatggaatggtatatcaacaatcctaattggtggggtgatgtctctggagcattgcttcctcatccaagaatgctgatgatgcctggtgggattgaaagacattttgatggctccgaagatagtgattctacagcttctcctgtctcaagtaatcttaaccagaccagaatggtggtaccagttcccaaaagcgtcagttctccccgcaagccatccttgaagttcttgctttatggtaggactgggtggattgggggtctacttggaaagctgtgtgagaagcaagggattccatatgagtatggaagagggcgtctagaggatcgggcatctctcttggcggatattcagaatgttaagccaacacatgtttttaatgctgctggcgtgactggcagacccaatgttgattggtgtgaatctcataaaccagaaacaatccgcgccaacgttgctggaactctgaccttggcagatgtttgcagagaacatggactcctaatgatgaattttgctactgggtgtatatttgagtatgatgctgcacatccagagggttctggcatcggatttaaagaggaagacacaccaaattttgccggttctttctattcaaaaaccaaggccatggttgaggaactcttaaaagaatttgacaatgtttgcaccctcagagttcgaatgccaatatcatctgacctcaacaacccacgcaacttcattacaaagatctctcgttataacaaagtggttaacatcccaaacagcatgaccgtcctggatgagcttctacccatttcaattgaaatggcaaagcgtaattgcaggggtatatggaacttcacaaaccctggagttgtaagccataatgagattctcgagatgtacaagagttacatcgaccccaactttaagtgggccaacttcacactggaagagcaggccaaggttatagttgccgcccgaagcaataatgagatggatgcctccaagttgaaaaatgagttccctgagttgctcccaatcaaggactcattgatcaagtatgtatttgagcccaatcagaaaagccttgcagcataagcattttacagtagtagaccacaggtctgatctcatcaaatctcattaggtaatatggtttggattacatctatataatgtttatcagtttcagtcatattattcatttttagcttcatcccaatatttctattgctctagacagggattaggataaattcttctagtttttctcctttccagattctagttgagttttggtttgcttaatgttctcttctctatgggcaacttttgagtaggttctttatatattttagtcccatcctgtaaactttcaggtgtgtaactttggattctgttatatgaattagctgtcccatttatttttaataacttgcttcctgagggtagttttgttaaactttggctatgaaagtgtaatttcagaaatttgaaaattcatttgtaaaa

SEQ ID NO: 12241 - DNA, 2554 bp, Papaver somniferum
ataatatctctttccttaattgtctcaaaaatatatataaatttctcacctcctccttgtttctcattctcctcgtagatctggatcccaaaacattagactgactgataaatatggcgaattacacaccgaaaaacatcctcattactggtgctgctggtttcattgcatcacatgttgccaataggctaatcaggaattatcctgattataagattgttgtccttgacaaacttgattactgttccaatctcaagaacttacttccttctcggtcgtcacctaactttaagtttgttaagggagacattggaagtgctgatctggtcaacttccttcttattactgagtctattgatacaattatgcacttcgctgcccagactcatgttgacaattctttcgggaacagcttcgagttcaccaagaacaacatctatggaacccatgttcttctagaagcttgtaaggttactggtcagatcagaagattcatccatgtgagcacagatgaggtttatggagagacagacgaagatgcagtcgtgggaaatcatgaggcttctcagcttctcccaactaacccatactctgcaactaaggctggagcagaaatgcttgtgatggcttacgggaggtcatatggtttacctgtcataaccaccagaggaaacaatgtgtatgggccaaatcagttccctgagaaattgattccaaagctcatcctcttggcaatgaaaggcaaaccacttccaattcatggggatggatccaatgtgcgcagttatctttactgtgaagatgttgctgaggcttttgaggttgttcttcataaaggagaaattggccatgtctacaacatcggcacaaagaaggaaagaagagtgattgatgttgtcaaggatgtttgccaactgttctctcttgatccagaggcagttatcaagtttgtggagaacaggccattcaatgaccaaaggtacttcttggatgatcagaaactgaagaatttgggttggtcagaacgaacttcatgggaagaaggtttgaaaaagactatggactggtacttgaagaatcctgattggtggggtgatgtttctggagcattattgcctcatccaaggatgttgatgatgcccgggattgagagattttgtgatgggtctgaagatagcaatggcgtctcctccaatgcagacagccttgttcagaacaaaatggtggatccagttcaaaagaccaccaatccccctactgcagaaccatcattgaagttcttgatatatggtagaacagggtggattggaggcctccttggcaagatctgtgagaaacagggtatagcatatgagtacggaagcgggcgtctggaggaaaggtccacgctggtggctgatattcagaaggtcaagcctactcatgttttcaatgctgcaggtgtgactggtcgacccaatgttgactggtgcgaggatcacagaactgagaccataaaaaccaatgttactggtaccttgaccttggcagatgtttgtagacagaatggattgctgatgatgaactttgctactggctgtatatttgaatatgatgctgaacacccagagggatcaggtatcggattcaaggaggaagacacccccaatttcgctggttcattctattcaaagaccaaggccatggttgaagagctgttgaaggaatatgacaatgtttgcactctcagagtccgcatgcccatttcttcagaccttagcaacccacgtaacttcattacaaagatcagccgttacaacaaggttgttaatattccaaacagtatgacagtcttagatgaacttcttccaattgcagtagagatggccaagaggaatttgagaggtatttataactttacaaatcctggtgttgtgagccacaacgagatcttagagatgtacaaggaatatatcaaccaagactttaagtggagtaacttcacacttgaagaacaggctaaggtaattgttgccgctagaagcaacaacgagatggatgcgtctaaattgaagaatgagttccctgagttattgtcaatcaaggactctctgatcaagtatgtttttgaacccaacaagaagacatctgcttgatatctcaccgatctatggatgtgtctgcattttgtattagtttgtactttgtagggggtagttatattgcctatatcctaccacaaggcatccactgtttttcatcttcatcagttagtttttctgctcattattctctattattctgatcaagcccttggaacttagaataaactaggttatttctggttgttatcattccctgtgtttgttagttaattcggggcttgcttattgtttcttatattggcatgtaagaaaccttcatttatagattctttatatgttttcatatgaatttgaaagcttttaggggtggtggtttgtaatttacttgattttaattaatatgattctgtatttttcttcttttttaggatagtgattattctttacattaaaatggaatttttcagttg

SEQ ID NO: 12242 - DNA, 2767 bp, Gossypium raimondii
atccgcggagtctctgcaatttccctcttcttcaaagccttttctcttctcctctgaaatctcgctctaagatttcgtcgtttatatttctccatctggattttgattgagctctctctcctttcgtcttggttctgatattaggttgtggtgtttcttatttttgcagaattggtttcactatgtcttcttatacccctaagaacatcctcataactggggcagctggttttattgcgtcacatgttgctaaccggctcataaggaactacccagactacaagattgttgtgcttgacaagcttgattactgctcgaacctgaaaaacctccttccttccaagtcatctccgaactttaagtttgtgaaaggtgacattggtagtgctgaccttgttaactacctccttattaccgagtctatcgacacaataatgcactttgcagcccagactcatgttgataactcgtttggaaacagctttgagtttaccaagaacaatatctatggcactcatgtcttgcttgaagcttgcaaagtcactggtcaaatcaggaggttcatccatgtcagcactgatgaggtttatggtgagacggatgaggatgctgttgtaggaaaccatgaggcttcccaacttctcccaacaaacccgtactctgctacaaaagctggtgctgaaatgcttgttatggcgtatggtaggtcatatgggctgcctgtgataacaacccgtggaaacaacgtttatggtcccaaccagttccctgaaaagttgattccaaagttcattctcctagcaatgaggggaaagactttaccaattcacggtgatggttctaatgtgaggagttatttatactgtgaggatgtggccgaggcatttgaagtcattcttcacaagggtgaagttggccatgtttataatattggaacaaagaaggagaggagagtgattgatgtggccaaagatatctgtaagcttttctcgatggatccagagaccagcatcaagtttgttgaaaacagaccattcaatgaccagaggtattttcttgatgatcagaagctgaagaacttgggatggtccgagcgaactgtatgggaagaggggctgaagaagaccattgaatggtacactcagaatcctgaatggtggggcgatgtttctggtgcattgcttccacaccctagaatgctgatgatgcctggcgggagacacttcgattctgaagagggaaaaggtacatcatttgaaagtggacctaatcagacccgaatggtggttccaaccttcaaaactagtagcagcacccaaaaaccagccttgaagttcttgatctatggtaggactggctggattggaggtctgcttggtcagttatgtgagaaacaaggtattccctttgaatatggaagaggacgcttggaagatcgttcatcccttatggcagatattcagaatataaagccaacccatgtttttaatgctgctggtgtgactggtaggcccaatgttgattggtgtgaatctcacaaaacagaaacaattcgcaccaatgtggctggaaccttgaccttagcagatgtttgcagagaacatgggcttttgatgatgaattttgctacagggtgtatattcgagtacgatgcaggacatcctgagggctccggcattgggtataaagaggaagacaaacccaatttcactggttccttctattcaaaaaccaaggctatggttgaagagctgttgaaagaatatgaaaacgtctgcactctcagagttcgaatgccgatctcatctgacctaaacaaccctcgtaactttattgccaagattgcacgctacaacaaggtggtcaacattcccaacagcatgacaatcttggatgaacttctgcctatttctatcgagatggctaaaaggaacttgaagggtatctggaactttacaaaccctggggttgtaagccacaatgagatcctggagatgtataagacttacattgacccaaagtttcagtgggtgaacttcacattggaagaacaagccaaggttatagttgcccctcgaagcaataatgagatggacgcatccaagttgaagaacgagttccccgatctgctaccaatcaaggaatcactgattaagtatgtctttgaacccaacaagagaacctgagccttttgagcagcagtttacaggaatagaattcggtattatcctatgttttttcttcattgagttattgcctggaatatctttgcagtttaattcatttgttataatcttgtcttccacctcattaattttcactagataactcttaaggtattactattagatttaaaccattcattgttactagctgcaccaagctgtatcctagtttgtccgtccattcttgaagaaactatctataggtgctttacaaattgtcatctgcaggctgacaggtgtattatttggcattacattagttgaatgttatgactttcaacagtcacctactggtctataatggaggaaattgcatctatctcttattactcagatgagtgaattatttatgtatttgagtctctcaattgtcctttgtgcaactacattatattactcagtataccagtcctttgactgaaataagagtatatattttcttttcactttttagcaccttttcttgtttacttttccaaagttgcaattgcaatcatattattgatgtttatgcaattccataagaacatgtgttcttttac

SEQ ID NO: 12243 - DNA, 2783 bp, Glycine max
aattcatgcataaaaaccgcgtctatatatatacagagaaagtgtgtagagtccaaatctaaatctgagaactaccattttccatttcttctgtgtctgaaaaatttctctttcttgtcttcgtgttttctccttcttcttcgcttcatcgcttgccaattcaagttgcttgacatggctacgcatacgcccaaaaatatcctcattactggagctgctggattcatcgcatctcatgttgcgaaccgtcttatccggaattatccccagtacaaaattgttgttcttgacaaacttgattattgctcgaatctgaagaatctcattccttcaaaatcatctcccaacttcaagtttgtgaagggggatattggaagtgctgaccttgtcaactaccttctcatcaccgagtccattgacacaataatgcactttgctgctcaaacccatgttgacaactcgtttggtaacagctttgagttcaccaagaacaacatatatggtactcatgtcctattagaagcctgcaaggtaactggccagatcaagaggttcatccatgtgagcactgatgaggtctatggagagacagatgaggatgctgttgttggaaaccacgaggcttctcagttactcccaacaaatccatactctgcaacaaaagctggggcagaaatgcttgtgatggcatatggaaggtcatatgggttacctgtgatcacaacacgaggaaacaatgtttatgggcccaatcagtttcctgagaagttaattccaaagttcattctcctggccatgcaaggcaagcctcttccaatccacggggatggttctaatgtgaggagttatttgtattgtgaagatgttgcagaggcttttgaagttatccttcacaagggagaggtcgggcatgtttacaatattggtactaagaaggaaaggagggttattgatgttgccaaagatatatgcaggctttttaagatggacccagagactagtataaaatttgtggagaacagaccatttaatgaccagagatactttcttgatgatgaaaagctgaaaatcttgggttggtctgagaggaccacttgggaagagggcttgaagaaaaccatggactggtatatcaacaatcctgattggtggggtgatgtcagtggtgcattgcttccccatccaaggatgctgatgatgcccggtggactggagagacattttgatggatctgacgaagaaaaacctccatcgtatgtctcaactaatactcgaatggtggttccgacatccaagaatgttaactcctcacagaaacctgctctcaagttcttgctctatggcagaacaggttggattgggggtttgctggggaagttgtgtgaaaaacaagaaattccctacgaatatggaaaaggacgactagaggaccgatcatcacttgtggctgatattcagaatgtgaagccaacacacatttttaatgcagcaggagtaactggcagacccaatgttgattggtgtgaatctcacaagacagaaaccattcgcaccaacgttgctgggactttaacattggctgatgtcagcagagagcatggaatcttgatgataaattatgctactgggtgcatatttgagtatgacaaagctcatccagagggttctggcattggctttaaggaggaagacaaacccaacttcattggttctttctattccaaaactaaggctatggtcgaagagctcttgaaagaatatgacaatgtgtgcaccctcagggttcgcatgccaatttcatctgacttgagcaatccgcgcaatttcatcaccaagatttctcgttataacaaagtagtcaacattccaaacagcatgaccattttggatgaacttctgccgatttcaattgagatggcaaagcgaaacttgaggggcatctggaacttcacaaatcctggggccgtgagccacaatgagattctcgagatgtacagggattacattgatccaagcttcaagtggactaacttcaatcttgaagagcaagccaaggtgataattgctccacggagcaacaatgagatggatgcatccaaactgaagaacgagttccctgagcttctttccatcaaggaatcactgatcaagtatgtctttgagccaaacaagaaaactgcttaaaagtattgagcggtttcatgttttagaaatcaaagattatgcatttttgttgcgggctacatagatcactctttatttcattgttatttcgttgggttttgataagaaccttactagaaaagctagccatgtagttcttgttctcatagctacaagtgattccagtttcagcatagttccatcatgttactgtgtttagagggtgacaagtataataattgggccagatatggttcctaagttaacatttctgtagctttattctagtttgtagcgtcctctgttaagagcagccttagaaaatagggtcttgttacctaaaagcttttgcatcctggaaggcatgtattctttttattgctcatatattatatcctttttgtggggtattcagttatacttttatcgtatttgcattgtacaatatgcagtgaaatggatggtgctactgagatattcatttaacttcctcctgtttgagtaaaaaattagtgttggaggaaaatacaaagtatgacgttacagaaagaaattagattgggaatgaaccaagtaaaattaatacacgacaaggtcttgtgaagagaaatagacagaga

SEQ ID NO: 12244 - DNA, 2906 bp, Petroselinum crispum
tcatatacaaaaacataaatacattttactatacgtataattttcatttccttacatatataaacaatcattcaacaagtctctgggtggtctccttatagttcttttcctcaagtttttatttgcctgcttcctcccttcatttcaaactttataatcttttaaattggttcgatatgactagttataccccaaagaatatccttataactggagctgctggctttattgcatctcatgtcgccaatcgtctcgttcggagctaccctgattacaagatcgtggtgcttgataagcttgattactgctcaaatcttaagaatcttaatccctctcggtcagctccaaacttcaaattcgtcaagggtgatattggcagcgctgatcttgtcaactacctgctcatcacggagtccattgatactattatgcactttgctgcccagacccacgttgataattcttttggtaacagctttgagtttaccaagaacaacatttatggcactcacgtgcttttagaggcctgcaaagtgactggacaaatcagaaggttcatccatgtaagtacagatgaggtctacggggagacagaagaggatgctattgtgggtaatcatgaagcttcacaactcctccctactaatccatattcggccacaaaagctggggcggaaatgcttgttatggcttatggaaggtcatatggtctacctgtgataacaacccgaggaaataatgtatatggtcctaatcagtttcctgaaaaattaatcccaaagtttatcctcttagccatgagaggaatgcaacttcctattcatggtgatggcgccaatgtgaggagttatctctattgtgaggatgttgccgaggcctttgaggtcgtccttcacaagggagaagttggacatgtttacaacattgggacaaagaaggagaggagagttactgatgttgctagagacatctgtcaacttttttccatggatcctcaaaccaacatcaagtatgtggaaaacaggccattcaatgatcagaggtatttcctagacgatcagaagttgaaaaacttgggctgggctgagcgcactacatgggaagaagggttgaaaaagaccatggattggtatattactaaccctgattggtggggagatgtatctggagcgttgcttcctcatccaagaatgctgatgatgcctggtggaaacgagaaacactttgatggatctgaatcttctagttttgtaaataaatctgctgcatcacaggcgtcttctaaaaatccaaaaggcatcatccctcagaaagcagccgttaagttcttaatttatggtagaagtgggtggattggtggtctgcttggaaaattatgtgatgaacaaggaatccactatgaatacggaaggggacgtctagaaaatcgatcacagctattgtctgatatccagatagttaagcccacacatgtttttaatgctgctggtgtgaccggtagacccaatgttgattggtgtgaatcccataaaactgaaacaattcgtaccaatgttaccggcacactgaatttagcagatatatgcagagagcaagggcttctgatgattaattttgctactggatgcatattcgagtacgatgctgcacatccagaaggttccggcattggattcaaagaagaggacacacccaattttcatggatcattttattcaaagacgaaagccatggttgaagaactattgaaagaatatgacaatgtctgcacactcagagttcgtatgcccatatcatcagacctcagcaacccacgcaacttcatcacaaagattagtcgttacaataaagtggttaatattcccaacagtatgacagtcttggatgagctactacctatctcaatagagatggctaagcggaaccttagaggcatatggaactttaccaatcctggagttgtaagccataacgaaattctggagatgtacaaggaatacattgacccatcttttaaatgggcaaacttcacgctggaagagcaagccaaggtgattgttgcagctcgaagcaataacgagatggatggatccaagttgaaagcagagttccctgagttgctatcaattaaagaatcgttaatcaagtatgtttttgaacccaacaaaaaagcctagttgctcggacattatagaatagtaaacttcaggctacctctacagtctctattaccttactattattttattcataggttgagttcattatcattgtcattataaatttgttgcggattcggtgttccattttatttttgtttaaaaatatttgttttacaatcaatatcagttcctatccagaagtttattaggtgttccgtctggtaatagtttatgcttttttctggcttctagtagtacttttgtaatatctggttcagttatagttgaattatttgccattcttatcagtattggaattttcatcccatggcgccctctctttgtaaactctattcatatacatatatgtgaaatgactttctaaggctacacaatttttatgtgcttatatattctgtattatgacaattttcgttttggaagcaaaagtattaatacacttgaactactaatgtccagtttttattcaaagaaaaggggaagctcttgtgttcagctctttaaaaatatataaaatatgatcacaaatttctttttccaaaatacatagtctgaaacaccaatattcgggaaaagttttgggacaattttaagttacctaacaatttttcatattagaatgatatcaattttttcttctctctctagcattctaatatttacagaaattttcacagcaaagttcgaagtacctgcacacaaagtcatttgggtgtagagcag

SEQ ID NO: 12245 - DNA, 2488 bp, Panax ginseng
aagcagtggtatcaacgcagagtacatggggttacacattttgtatatttatttctgtgtataaataaatactatagtattgctgtagtgctctctgttcatcattctttctttgtccaagtcttttctatatctccttcctttcaaagggttctcccttttcaatctcctaaccgtgattgacctggatcaaatttaaactgctttggtatggctacttatactcccaaaaatatcctcataactggggctgctggcttcatagcatctcatgttgctaaccgtctcattcggagctaccccaattacaagattgttgtgcttgataagcttgattactgttcaaatcttaagaacctcaatccctctcgatcatctgccaacttcaagtttgtcaagggggatattggcagtgccgatcttgtcaactaccttctcatcaccgagtcgattgatacaataatgcacttcgctgctcagacacatgtcgataactcctttggtaacagttttgagtttaccaagaacaacatttatggtacccatgtgcttttagaggcctgcaaagtgactggccagatcagaaggttcatacatgtaagcaccgatgaggtctatggggagacagaagaggatgctgttgtgggaaatcatgaagcttcacaactcctccctacaaatccatattcagccacaaaagctggggctgaaatgcttgttatggcttatggtaggtcatatggattacctgtgataacaactcgagggaataatgtatatggccccaatcagtttcctgaaaaactaattccaaagttcatccttttagccatgagaggaaagcaactccctatccacggggatggtgccaatgtgcgtagttatctctactgtgaggacgttgctgaggcttttgaggtcattcttcacaggggagaagttggtcatgtttacaatatagggacaaagaaggagaggagagtgattgatgttgccaaagacatatgtaaacttttctctattgatcctgaagcaaacattaattttgtcgataacaggccatttaacgatcagaggtacttcctagatgatcagaagctgaaagacttgggctggtctgaacgcactatgtgggtagaggggcttaaaaagactatggattggtatattagcaaccctgattggtggggggatgtctctggagcattgcttcctcatcctagaatgctgatgatgcctggtggaattgagagacactttgacgggtcagataattgtgactctgaatcttcgcattttgcagataaatcttccaagtcccaaatggtggttccgagtcccaaaagcagcaactctcagaaaccatccattaagtttttgatttatggtaggtctgggtggattggtggtctacttggaaaattaagtgaaaaacaagaaattccatatgaatatggaaagggacgtctagaggatcgctcacagcttttggccgatattcagactgttaagcccacacatgtttttaatgctgctggtgtgaccggtagacccaatgttgattggtgtgaatctcacaagacagaaacaattcgtaccaatgttgctggtacactaaatttagcagatgtgtgcagagagaatggactcctgatgatgaattttgctactggatgtatatttgagtatgatgctgcacatcctgaaggttctggcattgggttcaaagaagaagacaagcccaattttcacggttctttctattcaaagaccaaggccatggttgaggaactcttgagagaatatgacaatgtctgcacactaagagttcggatgcctatatcttcagacctcagcaatccacgcaacttcatcactaaaattagtcattataataaggtggtcaatatacccaacagtatgaccgtcttggatgagcttctacctatttcaattgagatggcaaagcggaaccttaggggcatatggaactttacgaatcctggagttgttagccataatgagattttggagatgtacaagaaatatattgatccagctttccagtgggctaactttacactggaagagcaagcaaaggttatagtagcagctcgaagcaataatgagatggatgcatccaagttgaagactgagttccccgagttgctatcaatcaaagagtcattgatcaagtatgtctttgaaccaaacaaaaaatgctaagcagagtagagtggtaaatttcaggctgcctctgcattatcagttaggttgtatggtcttgattacgttggtaatgttactcatgtcattatttattcttagttgcattccattgttcttatcattacagatcttgatgtaggttggcatgattctgggagttttgttttccatttacaatcaaatatcagtgattttcttattgtcctccccctgatgaacttgttttgtaggcattctctctaaatgtatgttctcttct

SEQ ID NO: 12246 - DNA, 2390 bp, Pennisetum glaucum
cgacgccaccggccgcgccgcgcgtcgcctacggatttcaaaaataatcatacaggggatatggctacggcatataaacctaagaacattcttattacgggagctgctggctttatcgcctcccatgtcgcaatccgtattatcaagaagtaccctgattacaagatagttgtccttgacaagcttgactactgctctaatctgaagaacctgctccctgtgagctcctcgccaaacttcaagtttgtcaagggcgatattgcaagcgctgatcttgtcaacttccttcttgtcacggagaacattgataccataatgcactttgcagcccagacacatgtcgacaattcatttgggaattcctttgaatttaccaagaacaacatttatggtacccatgttcttcttgaggcctgcaagatcactggacagatcaagaggttcatccatgtcagcactgatgaggtatatggggagacagatgaggatgcagttgttggcaacaaggaagcatcacagctgctccccactaacccatatgcagccaccaaagctggagcagagatgcttgtaatggcatatgggagatcctatggcctgccggttatcactactaggggaaataatgtttatggtcctaatcagtttcctgagaagctcatcccgaagtttattctcttggccatgagaggggagccgctccctatccatggtgatggagccaatgtccgtagctacctctattgtgaggatgttgcagaggcatttgaagtaattcttcatcatggagaagttggccatgtttataatattggaacaaagagagagaggacggtcattgatgtggcaaaagatgtttgcaagcttttcaatttggaagctgacaaagtcatcatgtttgtcgagaacaggcctttcaacgatcagagatatttcttggatgatgagaagctcaagagccttggatgggctgagcgcacgccatgggaggaaggcttgaagaagacaatggaatggtatgtagcaaattccgattactggggtgatgtttctggtgcattgctgcctcatccgaggaccctaatgatgcctggatatgagggctctgaggaggttaaaggaatactcagtcagtttaataacattcatacaaaggtggcttcaacatcagatagtgctccagaaacgcatgccttcaagttcttgatatatggtaggacaggatggatcggtggacttcttgggaaaatatgtgaaaagcaaggaattccatatgaatatggaaaaggtcgcttgcaagagcgttcttcgctcatcctggatatccaaactattaaaccaacacatgtcttcaatgctgctggtgttactggcagacccaatgttgactggtgtgaatcacacaagccggacaccattcgtaccaatgttgtgggcaccttgactctggctgatgtctgtagggaacatggcttattgatgatcaattatgccactgggtgcatatttgaatatgatgcccttcatccagaagggtcaggtatcggcttcaaagaggaggatacacctaattttactggttcgttctactcgaagactaaggcaatggttgaggagcttttgaaggagtacgagaacgtctgcaccctacgagtccggatgccaatatcttctgacctcagcaaccctcgaaacttcgtgacaaagatcagccgttacaacaaggtggtgaacatccctaacagcatgacaatattggacgagctcttgcctatctcagtggagatggcgaagaggaacctgcggggcatctataatttcaccaaccctggcgtcgtcagccacaacgagatcctggagatgtacaagcagtacatcgaccccagcttcaagtggacaaacttcaaccttgaggagcaggccaaggtcatcatcgcgccccggagcaacaatgaaatggacgcaagtaagctgaaggaggagttccctgagctgctgtcaatcaaggactcgttgatcaagtatgtcttcgagcctaatcggaaggtgcccataaactgaagagcagcgcagctgataccatagaaaatacagcaaccattataagcaagcatgtaggagccattcattgcaaacgattcgttagaatgtttatttatcatacttagcagcatgtctccactataggttgattcacagctgaatagacgatatatatacatggcagtctgttgatgtcaacatggtgactgcccaatttgttgtagaggcctatccttgaggagttagaatgtttggtctgtttgtaccaccacttttgttctgtcaggaatgattatccacaccttaatcagctggctcgtatcaatctagagccactttcagttgtt

SEQ ID NO: 12247 - DNA, 2508 bp, Fragaria vesca
aaacacacacagaagctcatatcacctccttcccttttttcgctccgcggttatctcccccatttcctcccctgtctgaatttccctctcaagtctttctcctttcaaagccccttgaggcttcaatttgacccttaacttctcttccgtctgggtcttcgatcttgatcgttcaagtcaaatttaagttgccttgatatggcttcatatacgcccaaaaacatcctcattactggggctgctggcttcattgcttcccatgtggccaaccggctcgttcgcagtcaccctgagtacaaaattgttgtgcttgacaagcttgactactgttcgaatctgaaaaacctccttccctccaagtcatctcccaatttcaagtttgttaagggggacattggaagtgctgaccttgtcaactatctcctcatcactgagtcgatagatacaataatgcactttgccgcccagactcatgttgacaactcctttggtaacagctttgagttcacaaagaacaacatctatggcacccatgttcttctggaagcatgtaaagtcactggccaaatcaggaggttcatccatgttagcacagatgaagtctatggtgagactgatgaagatgctgttgtaggaaatcatgaggcatctcaactccttccgacaaatccatactctgctacaaaagctggagcagaaatgcttgttatggcatatggaaggtcatacgggctgcctgttataacgactcgtggaaacaatgtttatggaccaaatcaatttcctgaaaaattgattccaaagttcattctcctggctatgcaagggaaacctcttccaattcatggggatggtgctaatgtgaggagctacttatactgtgaggatgttgctgaggcttttgaactcattcttcacaaaggagaggttggccatgtctacaatattgggacaaagaaggaaaggagagttattgatgtggcacaagacatatgcaaacttttcaacattgacgcagaagcatgcatcaagtttgttgaaaacaggcctttcaatgaccagaggtacttccttgatgatcagaagttgacggtgttggggtggtcagagcgtactgcctgggaagaggggttgaagaagactatagaatggtacactaagaatcctaactggtggggtgatgtatctggggcactgcttcctcatccacgaatgttgatgatgcctggtgggatcgagagacattttgatgagcctgaagaggaaatatccgagtcttatgtctcaagtaatcctcgaatgttggttccccctaccaaatgcagtggttctcctcgtaaacctccctataagttcttgatctatggtaagactgggtggattggtggtgtacttgggaagctatgtgaaaaacaagggattccttatgaatatggaaaagggcgtcttgaggatcggtcttcacttgctgcagacattcagaatattaagccaactcatgtgttcaatgctgctggtgtgactggaagacctaatgttgattggtgtgaatctcataaagcagaaacaattcgaaccaatgttgctggaaccctaaccctagcagatgtttgcagagagcatgggctccttatgattaactttgcgactgggtgtatatttgagtatgatgctaaacatccggagggttcaggcattgggttcactgaagaagataagcccaacttctttggttctttctattcaaaaaccaaggccatggttgaggagctcttgaatgaattcgacaatgtttgcacacttagagttcgtatgcccatctcatcagacctgaacaacccacgtaacttcatcaccaagatttctcgttataacaaggtggttaacattcctaacagcatgaccatcttggatgaactactacccatttcaattgagatggcgaagcggaacttgaggggtatctggaacttcacaaatcctggggtcgtgagccataatgagatcctggagatgtacaagcagtacattgacccaagtttcaaatactccaattttacaattgaagagcaagccaaggttattgttgctgcccgaagcaacaatgaaatggatgcatccaagttgaagaaagagttccctgagttgctaccaatcaaggagtcactgataaagtatgtctttgaaccaaacaagaaaacttctgcaaaataagcagtattcagttatagacctcaggatgaactctctgccttttcaattagatgatatgctttagattacctcgatttagtttaatcagtaccagtcattattcattcttagccttgtttcattatttgtattgtgctagagggtggtgggtataattctactgatatttgttttcttggatgtatcttgatttccattgtgttccattttataagaaaatttcaacaggttgccatatagattatgtcatctgtaacttttgtattatgttcaatgaaagatgttttgttaata

SEQ ID NO: 12248 - DNA, 2267 bp, Brassica napus
ctgatccacgtgccatagcacctttctctttgcctgaccaacgaagatcccaagaattctcagagagatggcttcgtacacgcccaagaacattctcatcaccggagcagccggtttcatcgcctcccacgtggcgaacaggctcatcaggacctaccctcactacaagatcgtggtcctcgacaagctcgactactgctccaacctcaagaaccttaacccttcgaaaaactcccccagcttcaagttcgtgaaaggcgacatcgccagcgcggacctcgtcaaccacctcctcatcaccgaaggcatcgacaccatcatgcacttcgccgctcagacccacgtcgacaactccttcggcaacagcttcgagttcaccaagaacaacatctacggtacccacgtcctcctcgaggcctgtaaggtgacaggccaggtacggaggtttatccacgtgagtaccgacgaggtttacggggagactgacgaggatgcgctcgtgggtaaccacgaggcctctcagcttctccccacgaacccttactctgcgaccaaggctggcgcggagatgcttgtgatggcgtatgggcgatcttatggtttgccagttattactactcgtgggaacaatgtttatgggccgaatcagtttcctgagaagctgattccgaagtttattttgctggcaatgggagggaaggttcttccgattcacggagatgggtcgaacgtgaggagttatctttactgtgaggacgttgctgaggcctttgaggtgattctccacaagggtgaggttgggcatgtttataacattgggactaagaaggagaggagagtgaacgatgtggctagagatgtttgcaagctctttggcatggaccctgaggcgagtattaagtttgttgagaaccggccttttaatgatcagaggtactttcttgacgatgagaagctgaagaagctggggtggtcggagaggactacgtgggaggaagggttaaagaagactatggattggtatactcagaaccctgagtggtggggtgatgtctctggagctttgcttcctcatccgaggatgctgatgatgcccggtgggcgacatttcgatggatcagatgagatttcttcagcagcttcggtgtctgacaagccgagtcaaacccacatggtggttccaagcacaaggagcagtaccagcacgccgcagaagccttctctcaagttcttgatatatggtaaaaccggatggattggtggtctgcttgggaagctatgtgagaagcaagggattgcttacgagtatgggaaagggaggttggaggatagagcttctcttttgcaggatgttatgagtgttaagccgactcatgttttcaactcggctggtgtgactgggagacctaatgttgactggtgtgagtctcacaagacagagactatccgtgctaatgtagctgggactttgactctagctgatgtctgcagagagcatgggcttctcatgatgaacttcgctactggttgtatatttgagtatgatgagaagcatcctgaaggttcggggattgggttcaaggaggaagacactcccaacttcactggctccttctactcaaaaaccaaagccatggtagaggagctgctaaaggagtatgacaacgtatgcacattgagggtaaggatgccaatctcttcagatctaaacaacccgcgcaacttcatcaccaagatctcaaggtacaacaaagtagtcaacatcccaaacagcatgacagtgttggacgagctcttaccaatctccatcgagatggccaagagaaacttgaaagggatctggaacttcacaaatccaggtgtggtgagtcacaacgagatcctagagatgtacagagactacatcaaccctgagttcaaatgggcaaacttcacattagaggagcaagctaaagtcattgtggctccaagaagtaacaacgagatggatgcttctaagctcaagaaagagttccctgagctactctccatcaaggagtctttgatcaagtatgcgtttgagccaaacaagaagacttgaatgagagaaaagggttgtgattcttcattagattaatcactaataatatctactatatgttttgtttattgttcttgttatattgtttgatcacccttactactatcactagcttttctttaagggtgtgttatagtttgattattctatgtaatagagatttatttttttattcatactgtttatt

SEQ ID NO: 12249 - DNA, 2317 bp, Chrysanthemum coronarium
ccctcccgcttaacaataacacacaataacacatttctcgtgatctgatcataataataacaaactttctggtctgatctcgtttctcttgattcaattctacatccgggatggctacttacacgccaaagaatatcttaataaccggggctgctggcttcatcgcctctcatgtcgctaatcgcctcatcagaagctaccctgattacaagattgttgtgctcgacaagcttgattattgctcgaatcttaagaatcttaacccgtctagatcgtctcctaattttaagtttgttaagggggatattgggagtgctgatctggtgaattatcttttaattaccgagaatattgatacgattatgcactttgctgctcagactcatgttgataattctttcgggaatagttttgagttcactaagaataacatttacgggacgcatgtgttgttggaggcgtgtaaagtgactcgtggtcagattagaaggtttattcatgttagtacggatgaggtgtatggtgaaacggaggaggatgctgttgtggggaaccatgaagcgtcacagcttcttcctacgaatccgtattctgccacgaaagctggggcggaaatgcttgttatggcttatggtaggtcatatgggttgcctgtgattaccactagaggtaacaatgtgtatggcccaaatcagtttcctgaaaagttgatcccaaagttcattcttttggctatgagagggcagccacttccgattcatggtgatgggtcgaatgtgaggagttatctttactgtgaagatgttgctgaggcttttgaagtcgttctccacaagggtgaagtcggtcatgtttacaacattggaaccaagaaggaaaggcgagttaatgatgttgctcgtgatgtctgtaatctgtttaatatcgatcctgaatcaagcatcaagtttgtggagaacaggccgtttaatgatcagaggtacttcttggatgatgagaagcttaagtgtttgggttggtccgaaaggaccacatggcaagagggtctaaaaaagaccatggagtggtacaccagcaatcccgattggtggggtgatgtctctggtgcactgcttcctcatccacgaatgctgatgatgcctggtggagtcgagaaagtcattgacgtccctgaaaacgttcaatctgattcacctcatgcagctgttaactcttctcagtttcaaaaagtggttcctgctgcaaaaaccagtaccaactctgctactaaaccatctttcaagttccttatctatggtaaaacagggtggatcggtggtttacttgggaaaatatgtgagaaacaagggattcagtacgagtatggaaagggtcgtttggaggaccggtcatcaattgttgctgatattaagaatgttaagccaacccatgttttcaatgctgctggtgtcactggcagacccaatgttgattggtgtgaatctcacaagaccgaaaccatccgtacaaacgtctcgggcacactcactttagcagatgtttgcagagatcaagggattttggtgatgaacttcgccactggatgcatatttgagtatgatgctgcacatccagaaggttcagggatcggttttctggaagaggacacgcccaatttcactggttcattctactccaaaaccaaggctatggttgaggagctattgaaagaatacgacaatgtatgcaccctgagggtccgaatgccaatatcatcagacctcaacaacccacgtaactttgtcaccaagattgctcgttacgataaagtggtcaacattcccaacagcatgaccatcttggacgagcttctgcctatttccatcgaaatggcaaagagaaacctcaagggaatctggaactttaccaacccaggtgtcgtgagccacaacgaggtcctggagctgtacaaacaatacatcaacccagaattcaaatggaaaaacttcacactcgaagaacaagcccaagtgatagttgccccacgaagcaacaacgagttggatacatccaagttgaagaaagagttccctgaattgctatcgattaaagaatcattggttaagtacgtattcgcccccaacaaaaaagcttagtgagtgtcgaaatccccattggtgtgttatataggttctgatattattaatcgtgtcatatgtttaaacacgaaatttacttgtgatgtttgttcctagtagtaagtaaagacagaataccgattaccgagagagagattatagaaaggctgagagttgtcgattattacatttgttaaaac

SEQ ID NO: 12250 - DNA, 2580 bp, Cicer arietinum
taattttcatacacaatcgcgtatatatagatagatataatacagagaaagagtatagactccaaatctaaatctccgtaaattcctctttcaatttcttctttttctcaacattttctctttcacgttttctttttttcttcttctctaactaatttaaaatatggctacgcacacaccgaaaaacatcctcattaccggggcagctggattcattgcatctcatgttgccaaccggcttatccggaactatcccgactacaaaattgttgtcctcgacaaacttgattactgttctaatctgaagaatctcattccttcaagatcgtctcccaacttcaagtttgtgaagggagacattgaaagtgctgaccttgtcaactaccttctcatcaccgagtcaatcgacacaataatgcactttgctgctcaaactcatgttgacaactctttcggtaatagcttcgagttcaccaagaacaacatttacggtactcatgtcttattagaagcctgcaaggtaactggccagatcaaaagattcatccatgtaagcactgatgaggtctatggagagacagacgaggatgctgttgttggaaaccacgaggcttctcagctacttccgacaaatccatactctgcaacaaaagccggtgcagaaatgcttgtcatggcatatggtaggtcgtatggattacctgtaatcacaacgcgtggaaacaatgtctatggcccaaatcagtttcctgaaaagttaattccaaagttcatcctcttggcaatgcaaggaaaagttcttccgattcacggggatggttcgaatgtgaggagttatttatattgtgaagatgttgcagaggcttttgaagttattcttcacaagggagaggttggacatgtttacaatatcggaacgaagaaggaaaggagagttattgatgtagccaccgatatatgtaggctcttctcgatggacccggagactagtataaaatttgttgagaacagaccgtttaatgaccagagatattttctcgacgaccaaaagttgaagaacttgggttggtctgagaaaactatttgggaagaaggcttgaagaaaaccatggattggtatatcaacaatcccaattggtggggtgatgtgagtggtgcattgcttcctcatccgaggatgctgatgatgcctggtgggatggagagacttttcgatggatctgaagaagaaaattctgctcaatatgtttcaactaataatactcgaatgttggttccaacagccaagagtgttggttcttcgcagaaacctcctctcaagttcttgatctatggcagaacaggttggattggtggtttgctaggaaaactgtgtgaaaagcaagagattccttatgagtatggaaaagggcggcttgaggatcggtcatcgcttgtggctgatattcagaatgtgaagccaactcatattttcaatgcagcaggagtgactggtagacctaatgttgattggtgtgaatctcacaaaacagaaaccatccgcgtcaacgttgctgggactttaacattggctgatgttagcagagagcatgaccttttgatgatcaactatgctaccgggtgcatattcgagtacgatcaagctcatccagaaggttccggcattggttttaaggaggaagacacacctaatttcgctggttctttctattcgaaaactaaggctatggttgaagagcttttgaaagaatatgacaatgtatgtactcttagggttcgcatgccgatttcatctgacctaaacaatccgcgcaacttcattaccaagatttcgcgttacaacaaagtagttaacattccaaacagcatgactattttggatgaacttcttcctatttcaattgagatggcaaagaggaacttaagaggtatatggaacttcacaaatcccggggcagtgagccacaacgagattctcgagatgtaccgagattacatcgatccgaacttcaagtgggctaacttcacactggaagagcaagctaaggtgattgttgctgcaagaagcaacaatgaaatggatgcttccaaattgaagaatgagtttccagaattgctttccatcaaagaatcacttatcaagtatgtctttgagccaaacaagaaaagtgcttaaataaatatcaacttttaggacatcacttgctattgctaccaatttttgtgtttgcttacttagattattactcgttattattgtgtttagaggatgatattgataattcataagtatttaatttgataattaataagtatttaattggggtttgtttcgaggcttgaaaacggaggacaaaaattcatggagtttctaaattaacagttatgcaactttgcattctggaattggaagacatgtattttttactactcgtgtatttatatatctttttttttttttgtgagttatgcttgtattgtatgtgatattattgagatttatttaattccttatttaaagaaaattagtattatctagcacttgattatgtggaaaatacaaatataattttacaggca

SEQ ID NO: 12251 - DNA, 2592 bp, Gossypium hirsutum
ccttttctcttctcctctgaaatctcgctctaagatttcgtcgtttatatttctccatctggattttgattgagctctctctcctttcgtcttaattggtttcactatgtcttcttatacccctaagaacatcctcataactggggcagctggttttattgcgtcacatattgctaaccggctcataaggaactacccggactacaagattgttgtgcttgacaagcttgattactgctcgaacctgaaaaacctccttccttccaagtcatctccgaactttaagtttgtgaaaggtgacattggtagtgctgaccttgttaactacctccttattaccgagtctatcgacacaataatgcactttgcagcccagactcatgttgataactcgtttggaaacagctttgagtttaccaagaacaatatctatggcactcatgtcttgcttgaagcttgcaaagtcactggtcaaatcaggaggttcatccatgtcagcactgatgaggtttatggtgagacggatgaggatgctgttgtaggaaaccatgaggcttcccaacttctcccaacaaacccgtactctgctacaaaagctggtgctgaaatgcttgttatggcatatggtaggtcatatgggctacctgtgataacaacccgtggaaacaacgtttatggtcccaaccagttccctgaaaagttgattccaaagtttattctcctagcaatgaggggaaagactcttccaattcacggtgatggttctaatgtgaggagttatttatactgtgaggatgtggccgaggcatttgaagtcattcttcacaagggtgaagttggccatgtttataatattggaacaaagaaggagaggagagtgattgatgtggccaaagatatctgtaagcttttctcgatggatccagagaccagcatcaagtttgttgaaaacagaccattcaatgaccagaggtattttcttgatgatcagaagctgaagaacttgggatggtccgagcgaactgtatgggaagaggggctgaagaagaccattgaatggtacactcagaatcctgaatggtggggcgatgtttctggtgcattgcttccacaccctagaatgctgatgatgcctggcgggagacacttcgattctgaagagggaaaaggtacatcatttgaaagtggacctaatcagacccgaatggtggttccaaccttcaaaactagtagcagcacccaaaaaccagccttgaagttcttgatctatggtaggactggctggattggaggtctgcttggtcagttatgtgagaaacaaggtattccctttgaatatggaagaggacgcttggaagatcgttcatcccttatggcagatattcagaatataaagccaacccatgtttttaatgctgctggtgtgactggtaggcccaatgttgattggtgtgaatctcacaaaacagaaacaattcgcaccaatgtggctggaaccttgaccttagcagatgtttgcagagaacatgggcttttgatgatgaattttgctacagggtgtatattcgagtacgatgcaggacatcctgagggctccggcattgggtataaagaggaagacaaacccaatttcactggttccttctattcaaaaaccaaggctatggttgaagagctgttgaaagaatatgaaaacgtctgcactctcagagttcgaatgccgatctcatctgacctaaacaaccctcgtaactttattgccaagattgcacgctacaacaaggtggtcaacattcccaacagcatgacaatcttggatgaacttctgcctatttctatcgagatggctaaaaggaacttgaagggtatctggaactttacaaaccctggggttgtaagccacaatgagatcctggagatgtataagacttacattgacccaaagtttcagtgggtgaacttcacattggaagaacaagccaaggttatagttgcccctcgaagcaataatgagatggacgcatccaagttgaagaacgagttccccgatctgctaccaatcaaggagtcactgattaagtatgtctttgaacccaacaagagaacctgagccttttgagcagcagtttacaggaatagaattcggtattatcctatgttttttcttcattgagttattgcctggaatatctttgcagtttaattcatttgttataatcttgtcttccacctcattaattttcactagataactcttaaggtattactattagatttaaaccattcattgttactagctgcaccaagctgtatcctagtttgtccgtccattcttgaagaaactatctataggtgctttacaaattgtcatctgcaggctgacaggtgtattatttggcattacattagttgaatgttatgactttcaacagtcacctactggtctataatggaggaaattgcatctatctcttattactcagatgagtgaattatttatgtatttgagtctctcaattgtctcttgtgcaactacattatattactcagtataccagtcctttgactgaaataagagtatatatttacttt

SEQ ID NO: 12252 - DNA, 2562 bp, Lupinus angustifolius
taatatataagtattctctgcatttcactcttcacaataacacactgagaagaagagattcatcactccataatctatcaccttctcattcttcaatttcttgttccaaaattctcgctcttcttctctctggatctgcatccatattcagaacttgccaggtatgggttcatataccccaaagaacatccttattactggggcagctggatttattgcatctcatgttgcgaaccggcttgttcggagctaccctgactacaaaattgttgtccttgacaaacttgattactgttctaatctgaagaatctcattccttcaaaatcatctcccaacttcaagtttgtgaagggtgatattggtagtgctgatcttgtcaactaccttctcatcaccgagtccatcgacactataatgcactttgctgctcaaacccatgttgacaactcgtttggtaatagtttcgagttcacgaagaacaacatatatggtactcatgtcctattagaagcctgcaaggtaactggccagatcaggaggttcattcatgtgagcactgacgaggtctatggggagacagatgaggatgctgttgtcggaaaccatgaggcttctcaacttcttcccacaaatccttactctgcaacaaaagctggggcggaaatgcttgtcatggcatatggtaggtcatatgggttacccgttatcacaactcgtggaaacaatgtttacgggcccaaccagtttcctgagaagttaattccaaagttcatcctcctggcgatgcaaggaaagaatcttccaattcatggggatggttctaatgtgaggagttatttatattgcgaagatgttgcagaggctttcgaagttatccttcacaagggagaggttggtcatgtttacaatatcgggacaaagaaggaaaggagagttgttgatgtggccaaagatatatgcacacttttcaaaacagacccagaaactagtataaaatttgtagagaacagaccattcaatgatcagagatactttctcgatgatcaaaagctgaagatcttgggttggtctgagaggaccacttgggaagagggcttgaagaaaaccatggactggtatgcacagaatcctgattggtggggtgatgtaaccggtgcactgcttcctcatccaaggatgctgatgatgcctggtgggctggagagacactttgaaggatccgaagatgaaaaacctgcatccgttgtctcaagtagtactcgaatggtggtcccatcaaccaagaacactggcgcactgcagaaatctccttttaagttcttgctctatggcagaactgggtggattggtggtttgctagggaaattgtgtgaaaagcaagggattccatacgaatatggaaaaggtcgtcttgaggatcgcgcctcacttatcgctgatcttcggaatgtgaagccaacccatgtttttaatgctgcaggagttactggcagacccaatgttgattggtgtgaatctcataaaacagaaaccatccgcaccaatgttgccggcactctaacattggctgatgtgtgcagagagcgagggatcttggtgattaattatgctactggatgcatatttgagtatgatgcagcacatccagagggctccggaattggttataaggaggaagacaaacccaatttcattggctctttctattccaaaactaaagctatggttgaggagctcttgagagaatatgataatgtatgcaccctcagggttcgtatgccgatttcatccgacctgaagaacccacgcaacttcattacaaagatttcgcgttataacaaggtagttaacatcccaaacagcatgactattttggatgaacttctacctatatcaattgaaatggcaaagaggaacttgaagggcatctggaacttcacaaatcccggggttgtgagccataatgagatccttgagatgtatagggattacattgacccgaacttcaagtggactaacttcacacttgaagagcaagccaaagttatagttgctcctagaagcaacaatgaattggatgcatctaaattgaagaaagagttcccagaattgctttccatcaaggaatcacttatcaagtatgtctttgagccaaacaagaaataagaaattccatgcttcggacattgcaatttatgtgttggtgatacattgacaactcattgttcagttgtttgttccatttagttactgtgagtagaaagtgtgaggtattacaattgtgttaggagtgtttcctaagctttcatttctaaagctttattcatgtttgtggtgtcctttggtgttagaagaattagataggcattttggctatctcaaagtttgtggtgggaaagttctaaatcatgtaagtttgtattcttttgttatctataatgaaaatttaaaataagagattttaatttttgatattattgaatgtacttggatacttatctgcaatgttgaatgaaaattttgaaataagagaagctacttatcattattaaaaactaaaa

SEQ ID NO: 12253 - DNA, 2384 bp, Trigonella foenum-graecum
cggccgggggagagagtagatttcgatttcgatttcaccttcttctttgtctcaactatctctctttcaatttccttcttctcttgccaatttttgcttgatatggctacgcacaccccaaaaaatatcctcattacgggggcagctggatttattgcttctcatgttgccaacaggcttatccggaactatcccgactacaaaatcgttgtcctcgacaaacttgattactgttctaatctgaagaacctcattccttcaaaatcatctccaaacttcaagtttgtgaagggggacattgaaagtgctgaccttgtcaactaccttctcatcaccgagtctatcgacacaattatgcacttcgctgctcaaacccatgtcgacaactcttttggtaatagctttgagttcaccaagaacaacatatatggtactcatgtcttattagaagcctgcaaggtaactggccagatcaaaagattcatccatgtaagcactgatgaggtctatggagagacagatgaggatgctgttgttggaaaccacgaggcttctcagctacttccgacaaatccgtactctgcaacaaaagctggggccgaaatgcttgtcatggcatatggtaggtcatatggattacctgtgatcacgacacgtggaaacaatgtctatggcccgaaccagtttcctgaaaaaatgattccaaagtttatcctcttggcaatgcaaggaaaagttcttccgattcatggtgatggttcaaatgtgaggagttatttatattgtgaagatgttgcagaggcttttgaagttattcttcataagggagaggttggacatgtttacaatattggaactaagaaggaaaggagagttattgatgtagccaccgatatatgcaaactcttctcaattgatccggaaactagtataaaatttgtagagaacagaccgtttaatgatcagagatactttcttgacgatcaaaagttgaaggttttgggttgggcggagagaacaacgtgggaagaaggcttgaagaaaaccatggactggtatatcaacaatcctaattggtggggcgatgtgagtggtgcattgcttcctcatccgaggatgctgatgatgcctggttgtatggagagacatttcgatggatctgaagaagaaaattctgtaccggttgtctcaagtactaatactcgaatgttggttccaccaacaaagaacattagctcttcgcagaaacctcctctcaagttcttgatctatggaagaactggttggatcggtggtttgcttgggaaattgtgcgagaaacaagggattccttatgaatatggaaaagggcgtcttgaggatcgttcatcactcgtggctgatattcagaacgtgaagccaactcatattttcaatgcagcaggcgtgactggaagacctaatgttgattggtgtgaatctcataaagccgaaaccatccgcgctaacgttgctgggactttaacattggctgatgtaaccagagagcataaccttttgatgataaactatgctaccgggtgcatattcgagtacgatgaagctcatccagaaggttcaggcattggttttaaggaggaagacacacctaatttcgccggttctttctattccaaaactaaggctatggttgaagagctcttgaaagaatatgacaatgtatgcactctgagagttcgcatgccgattacatctgacctaagcaatccacgcaatttcatcaccaaaatttcgcgttacaacaaagtagttaacattccaaacagcatgactattttggatgaacttcttcctatttcaattgagatggcaaagaggaacctaagcggtatctggaacttcacaaatcctggcgccgtgagccacaatgagattctcgagatgtacagagattacattgatccaaacttcaagtgggctaacttcacacttgaagaacaagccaaagtgatagttgctgcaagaagcaacaatgaaatggatgcatccaaattgaagaacgagttcccagaattgcttccaatcaaagaatcacttatcaaatacgtctttgagccaaacaagaaaagtgcttaaaacaatatttagttgcttcacgcattcggacatcatttgctaccaagtttcttgtgttttggctacttagattatcactctcattatttcattgctagttccattctgttattgttgtgtttagaggatgatattgataatttatgcagctttgttatagttttttttatgttaagagaatccttagggtcttgtttgttaccttgtgagcttgctacggatgaactttctgatattgaagacatgtattctttcttgggtttgtctaa

SEQ ID NO: 12254 - DNA, 2430 bp, Arachis hypogaea
aattacttcaattctctcttctctatcttcaccgctcctcacctcattcgccaattcgtgttcaatatggcgacgcataccccaaagaatattctcattactggggcagctggatttattgcatctcatgtggccaaccggctcattcggaagtatcctgactacaaaattgttgttcttgacaagcttgattactgttctaatctgaagaacctcattccttcaaagtcatgccccaactttaagtttgtgaagggtgatataggaagtgctgaccttgtcaactaccttctcatcactgagtcaattgacacgataatgcactttgctgctcagacccatgttgacaactcctttggtaacagctttgagttcaccaagaacaacatctacggcactcatgtcctgttagaggcttgcaaggtgactggtcagatcaaaaggttcatccatgtgagcaccgatgaggtctacggggagacagaggaggatgccgtggttggaaaccatgaggcttctcagctgcttcctacaaatccatactctgccacaaaagctggggcagagatgcttgtcatggcatatggtagatcctatggtttacctgtgatcacaacacgtggaaacaatgtctatgggccgaaccagtttcctgagaagctaattccaaagttcatcctcctggccatgcaaggcaagcctcttccgattcatggagatggttctaacgtgaggagctatttatactgcgaagatgtcgctgaggcttttgaagttatccttcacaagggagaagttggtcatgtttacaacattgggaccaagaaggaaagaagagttattgatgtagccaaagatatatgcagactattctccatggacccagagacaagcataaaatttgtggagaacagaccattcaatgaccagagatactttcttgatgatcaaaagctgaaggacttggggtggtctgagaggaccacttgggaagagggcttgaagaaaaccatggactggtacatcaataatcctgattggtggggtgatgtcagtggtgcattgcttcctcatccaaggatgctcatgatgcctggtggtatggagagacattttgatggatctgaagaggaaaagcctgcatcatatgtctcgactaacactaaaatggtggttccaccaaccaagagcgccaccggcactccccagaagcctgctctgaagttcttgatctatggcagaacaggatggataggtggattgcttgggaagttgtgtgaaaagcaagggattgcgtacgaatatggaaaagggcgcctagaggatcgctcatcacttgttgctgatattcagaatatcaagccgacacatattttcaatgctgcaggagtgaccggcagacccaatgttgattggtgtgagactcataagactgaaaccatccgcaccaatgttgccgggactttaacgttggctgatgtcagcagagagcatggtctcttgatgataaattatgctactggttgcatatttgagtatgatgaagctcaccctctgggatctggcaaaggtttcaaggaggaagatacccctaattttgctggttctttctattccaaaactaaggctatggttgaggagcttttgaaagaatatgacaatgtatgcacactcagggtccgcatgcccatttcttctgatctgagcaacccgcgcaacttcattaccaagatttctcgctataacaaggtggttaacattccaaacagcatgactatcctggacgagctcctgcctatttcaatcgagatggcaaagcgcaacctgagcggcatctggaacttcacaaacccaggggccgtgagtcacaacgagatcctggagatgtacagggactacattgaccccaacttcaagtgggttaatttcacccttgaagagcaagccaaagtgattgttgcagcgcgaagcaacaacgagatggacgcatcaaagttgaagaaagaattcccagaacttctttccatcaaggaatcactgatcaaatatgtcttcgagccaaacaagaaaactggtttgaaaaattaagcagcttcatggcttaaagcatcatcttgcttattctctgcattttttcacatagcacactcattatttcattggtagtaccatctagtttctgtgtttagagggtcacaagtactacgttgttagctattgttccttcgttttcatttctatacctttgttctagttttctaatgttctctattatgagcatttagatgttgtcttgtgttacacctatatgacacgaattcttttattgctcatatcatatgtatcccttgaggtttatgattgtactgtgttcgcatttgtatatgcactgataaagaatgcaactgagatattcattcgatttttcca

SEQ ID NO: 12255 - DNA, 2497 bp, Musa acuminata
ctcaactccaactccaactccaactctgtgaaaactccgctatataaacctatcaattgcctcttctctttcccaccgccctttgtgtctggcgtcgttccctgcgctgcatctgctgtcgttcttctccggatcaagtcctctgctttagcttgggtcctcccgaggaaggcggcaagggaaggaacgcgaatggcgagctacacccccaagaacatccttatcactggggcggcgggcttcatcgcgtcccacgtcgccaatcgcctggtccgtaactaccctgactacaaggtggtggtgctcgacaagcttgactactgctctaacctcaagaacctccacccctccctctgctcccccaacttcaagttcgtcaagggcgacatcgcgagcgccgacctcgtgcacttcctcctcctcaccgaatccatcgacactatcatgcacttcgccgcccagacccacgtcgacaactccttcggcaactccttcgagttcactaagaacaacatctacggcacccacgtccttcttgaggcctgcaaggtcaccggccagatccgccgattcatccacgtcagcaccgatgaggtatacggagagaccgatgaagatgccgtcgtcggcaatcacgaggcgtcgcagttgctgccgactaacccctactccgccaccaaagccggggccgagatgctcgtcatggcctacggccgctcctacggcctgcccgtcatcacgacgcgggggaacaacgtctatgggcccaatcagttccccgagaagctcattcccaagttcatcctcctcgccatgcgggggctgcagctccccatccacggagatggatccaacgtcaggagctatctctactgcgaggatgttgcggaggccttcgaggttgtgcttcatcgaggcgaagtcggccatgtctacaacattgggacgaagaaagaaaggagggtgattgatgtggccaaggatatctgcgggctcttcaatctggatcccgactctgtcatcaagtgtgtggacaacaggcccttcaatgaccagaggtacttcctggatgatcaaaagctgaagaacctcgggtggtcggagcggacaacttgggaggagggactgaggaagacgatggagtggtacactagcaatcctggttggtggggcgatgtctccggtgcgttagttcctcatccacggatgctgatgatgcctggaatcgagaggcactttgatgcgtctgaagccacaaaggacatggcttctcatttcaccaacaatttgagtcagacaagaatggtggttcctgctccaagaaatgccgctgcttcccaaaagcctcctctcaagttcttgatctatggtaggactgggtggattggtggtctccttgggaagatatgcacaaaacagggcataccttttgagtatggaaagggtcgtctggaggagcgctcacaactcatattggatatccagtcagtgaagccaacgcatgtttttaatgctgccggtgtgactggcaggcctaatgtcgattggtgtgagtctcacaagacggagacaattcgcaccaacgttgtgggtactcttactttggcagatgtctgcagggagcatgggttgttgatgatgaactatgctactgggtgtatatttgagtacgatgatgcacatccagaaggttcaggcattggtttcaaggaggaagacaagccaaattttactggctcatactactcgaagacaaaggcgatggttgaagaacttctgagggaatatgataatgtatgcactctgagggttcgaatgccaatatcctctgacctgaacaacccacggaacttcatcacgaagatcagtcgttataataaagtggtaaacattcccaacagcatgactatcttagatgagcttctgccaatatctattgagatggcaaaaaggaactgcaggggaatatggaatttcacaaatcctggggtcgttagtcacaacgagatattggagatgtacaagaaatatattgatcccagctttaagtgggctaattttacgcttgaagagcaggctaaggtcattgttgctcctcgcagcaacaatgagatggatgcttcaaagttgaagaaagagtttcctgagttgtgttctataaaggaatcacttatcaagtatgtctttgaaccaaataggaaggtcccgcttggtggagaaaccaagtgaaactagataatgtagaaattagatctaatttctcaacctacattacctatgttgaaccttgttctctgccttactttagttgttctatttgctgtatgtctgatcttgtcaattagtgttcttcgcttaatgcattgtagtgaaggcaatgggtattttgccatttatgagaatcgttattgttaaaggtctagaatttgaatggtcctgtccaattaatattgtaggatatctattgaatcacagccgaattgttgtttctctatga

SEQ ID NO: 12256 - DNA, 2112 bp, Prunus persica
cagaattctttgagatatggctactgcgtataaaccgaagaacatcttgattactggagctgctggcttcattgcatcccatgtttgcaaccggcttatccggaactaccctgagtacaagattgtggtccttgacaagcttgattactgttcaaatttgaagaaccttcatccctcaaggtcatcatccaactttaagtttatcaagggagacattggcagtgctgaccttgtcaacttcatccttctcactgagtccattgatacaataatgcactttgcagcccagacccatgtcgacaattcttttggtaacagctttgagttcaccaaaaacaacatctatggtacgcatgttcttctagaagcatgcaaagtcactggtcaaatcaaaagattcattcatgtaagcacagatgaagtctatggagagacagatgaagatgctgtggtgggaaatcatgaggcttctcagcttcttccgacaaacccctactctgcaactaaagctggagcagagatgcttgtaatggcatatgggcgttcatatggattgcctgtcataactaccagaggaaacaatgtttatggccccaatcagttccctgaaaagatgattccaaaattcattctcttggctatgaaagggaagcctcttccaattcatggtgatggatcaaatgtcaggagttacctctactgtgaggacgtagcagaggcatttgaagtcattctgcataagggtgaggtaggccatgtgtacaacattgggacaaagaaggagaggagggtggttgatgtggctaaggaaatttgccaactcttctctttgaacccagatactcaaataaagtttgtcgaaaacaggccgtttaatgatcaaagatatttcttggatgaccagaagctgaaaaacttgggatggtctgaaaggacttcgtgggaggagggtttgaggaagacgatggactggtatgtcaagaatcccgaatggtggggagatgtttctggggcactgcttcctcatccaaaaatgctcatggttcctgggattgaaagaaaatttgatggtactgatactggcgcttctgccttctctttgtcagcaagtgattctagggagagccacatggttgttccacctccaaagaacaatccatctactcagaagccatctttgaagtttttgatttatggtaaaacggggtggattggaggccttcttgggaagatttgtgagaagcaggggataccctatgagtatggacaagggcgtcttcaggaacggtcacacctcttggctgatattcagagtgttaaaccaacccatgttttcaatgctgctggagtgactgggaggcccaatgtggattggtgtgaatctcataaaccagaaacaattcggaccaatgttgtcggtacattaaccttggctgatgtctgcagagatcacaacctcctgatgattaattatgctactggttgtatcttcgagtatgatgctgcccatccatcaagatcaggaatcgggttcaaagaggaagacacacccaatttcactggctcattttattccaaaaccaaagccatggttgaagagcttttgaaggaatatgacaatgtttgcactcttagagtccggatgccaatatcatctgatctcagcaatccccgcaacttcatcacgaagatctcgcggtacgacaaagtggttgacattccaaacagcatgaccattttggatgagcttctacccatttccgttgagatggccaagaggaacttgaggggcttatggaacttcacaaaccctggcgtcgtgagtcacaatgagattctggagatgtacaagaagtacattgaccccagtttcaagtggactaactttacacttgaagaacaagccaaggttattgttgcaccaagaagtaacaatgagatggatgcatctaagttgaagaaagagttccctgaattgcttccaatcaaggaatcactgattaaatacgtctttgaaccgaacaagaaggcattttctggctgagcagcaaatcaagtgtttcatgaagtagacctcaataccaattcatgcatattttatttatttatttt

SEQ ID NO: 12257 - DNA, 2418 bp, Gossypium hirsutum
tctctctctagatttgtgtgtttctcattctgtatctagattttgattgattccccttcatcttaattgattttgcgatggctacttataccccgaagaacatcctcataactggggctgctgggtttattgcgtcgcatgttgccaatcggcttgtccgcaactacccagactacaagattgttgtacttgacaagcttgattactgctcaaatttgaaaaacctccttccttctcagtcatcgcggaactttaagtttgtgaaaggggatattggtagtgctgaccttgtaaactacctcctcattactgaatctattgacacaataatgcactttgcagcccaaactcatgtcgataactcgtttgggaacagttttgagtttaccaagaacaatatctacggcactcatgtcctgcttgaagcttgcaaagtcactggccagatcaggaggttcatccatgtaagcacggatgaggtttacggggagacagatgaggatgctgttgtaggaaaccacgaggcttcccaacttctcccgacaaacccgtactctgcaacaaaagctggtgctgaaatgcttgtaatggcatatggtagatcatatggattacctgtgattacaacccgtggaaacaatgtttatggccccaaccagttcccagaaaagttgattcctaagtttatcctcttagcaatgagggggaaggttctcccaattcatggggatggtactaatgtgaggagttatttatactgcgaggatgtggctgaggcatttgaggtcattcttcacaagggtgaagttggtcatgtttataatgttggaacaaagaaggagaggagagtgattgatgtagccaaagacatatgcaaacttttttcaatggacccggagacaagcatcaagtttgttgaaaacagaccattcaacgaccagaggtattttcttgatgatcagaaattgaagaacttgggatggtctgagcaaactgtgtgggaagatgggttgaagaagactatagaatggtacacccaaaatcctgattggtggggcgatgtgtctggcgcactgcttccacacccgagaatgctgatgatgcctggtgggagacaatttgattcagaagagggaaaagatacatcgtatataagttctcctaatcagacccaaatggtagttccgacctccaaaagtagtgtctcttctcaaaaaccagccttgaagttcttgatttatggcaggactggctggatcgggggtctactaggtcagttatgtgataagcaaggtattccctttgaatatggaaaaggaaggttggaagatcgttcgtcacttacagcagatattcggaatataaaaccgacccatgtttttaatgctgctggtttgaccggtagacccaatgttgattggtgtgaatcccacaaaacagaaacaattcgcaccaatgtggccggaaccttgaccttggctgatgtttgccgagagcatgggcttttgatgttgaactttgctactgggtgtatattcgagtatgatgcaggacatcctcagggctctggcattggatttaaagaggaagacatacccaatttcactggttccttctattcaaaaaccaaggctatggttgaagagttgctgaaagaatacaacaatgtctgcaccctcagagttcgaatgccaatctcatccgacctaaacaaccctcgcaacttcatcaccaagatttcaagatacagcaaggtggtcaacattcccaacagcatgacaatcttggacgaacttctaccgatttctatcgagatggcaaagaggaacttgacaggcatatggaacttcacgaaccctggcgttgtgagccacaatgagatcctggagatgtacaagaagtacattgacccgaagttccagtgggcgaacttcacattggaagagcaagccaaggtgattgttgcccctcgaagcaataacgagatggacgcatccaagttgaaaaaagagttccctgagttgctaccgatcaaggaatcactgattaagtacgtattcgaacccaacaaaagaacctgacccttttaaacaggcttttcagctgtagtagtaccccatgattaacctctgcatatctgtttagtttcattcatttgttactgttattggcccactcattaattttactcgaaaactataggttttctttttccatctttcgtcattactagctgcagctgagttgtatcttagttttcttagcagtcgcttaatggagaagctctcatgagctacttcataatttgtgtcatctgcaggctgtcaggtgtattatttttacattacaattagttgaatatatggctttcaataatcatgcacttgtcttttatggaaaaactgcatttatctctta

SEQ ID NO: 12258 - DNA, 2530 bp, Gossypium raimondii
atatgcattcacacgtagacatgaactctccacaattccctcaagctgctttccttctccaaattttcttcctcagccatttctctctgtagatttgtgtgtttctcattctgtatctagattttgattgattcctcttcatcttaattgattttgcgatggctacttataccccgaagaacatcctcataactggggctgctgggtttattgcgtcgcatgttgccaatcggcttgtccgcaactacccagactacaagattgttgtacttgacaagcttgattactgctcaaatttgaaaaacctccttccttctcagtcatcgcggaactttaagtttgtgaaaggggatattggtagtgctgaccttgtaaactacctcctcattactgaatctattgacacaataatgcactttgcagcccaaactcatgttgataactcgtttgggaacagttttgagtttaccaagaacaatatctacggcactcatgtcctgcttgaagcttgcaaagtcactggccagatcaggaggttcatccatgtaagcacggatgaggtttacggggagacagatgaggatgctgttgtaggaaaccacgaggcttcccaacttctcccgacaaacccgtactctgcaacaaaagctggtgctgaaatgcttgtaatggcatatggtagatcatatggattacctgtgattacaacccgtggaaacaatgtttatggccccaaccagttcccagaaaagttgattcctaagtttatcctcttagcaatgagggggaaggttcttccaattcatggggatggtactaacgtgaggagttatttatactgcgaggatgtggccgaggcatttgaggtcattcttcacaagggtgaagttggtcatgtttataatgttggaacaaagaaggagaggagagtgattgatgtagccaaagacatatgcaaacttttttcaatggacccggagacaagcatcaagtttgttgaaaacagaccattcaacgaccagaggtattttcttgatgatcagaaattgaagaacttgggatggtctgagcaaactgtgtgggaagatgggttgaagaagactatagaatggtacacccaaaatcctgattggtggggcgatgtgtctggcgcactgcttccacacccgagaatgctgatgatgcctggcgggagacaatttgattcagaagagggaaaagatacatcgtatataagttctcctaatcagacccaaatggtagttccaacctccaaaagtagtgtctcttctcaaaaaccagccttgaagttcttgatttatggcaggactggctggatcggaggtctactaggtcagttatgtgataagcaaggtattccctttgaatatggaaaaggaaggttggaagatcgttcgtcacttacagcagatattcggaatataaaaccgacccatgtttttaatgctgctggtttgaccggtagacccaatgttgattggtgtgaatcccacaaaacagaaacaattcgcaccaatgtggccggaaccttgaccttggctgatgtttgccgagagcatgggcttttgatgttgaactttgctactgggtgtatattcgagtatgatgcaggacatcctcagggctctggcattggatttaaagaggaagacatacccaatttcactggttccttctattcaaaaaccaaggctatggttgaagagttgctgaaagaatacaacaatgtctgcaccctcagagttcgaatgccaatctcatccgacctaaacaaccctcgcaacttcatcaccaagatttcaagatacagcaaggtggtcaacattcccaacagcatgacaatcttggacgaacttctaccgatttctatcgagatggcaaagaggaacttgacaggcatatggaacttcacgaaccctggcgttgtgagccacaatgagatcctggagatgtacaagaagtacattgacccgaagttccagtgggcgaacttcacattggaagagcaagccaaggtgattgttgcccctcgaagcaataacgagatggacgcatccaagttgaaaaaagagttccctgagttgctaccgatcaaggaatcactgattaagtacgtattcgaacccaacaaaagaacctgacccttttaaacaggcttttcagctgtagtagtaccccatgattaacctctgcatatctgtttagtttcattcatttgttactgttattggcccactcattaattttactcgaaaactataggttttctttttccatctttcatcattactagctgcagcagagttgtatcttagtttgcttagcagtcgttcaatggagaaactctcatgagctacttcataatttgtgtcgtctgcaggctgtcaggtgtattatttttacattacaattagttaaatatatggttttcaataatcatgcacttgtcttttatggaaaaactgcatttatctcttatttatgagtgaataatttatgggtttgagtt

SEQ ID NO: 12259 - DNA, 2491 bp, Prunus mume
ctctcatatatccttttctctttcccagtcttttctcttcttcgttcttcttcccccctgtcttaaattcaccagaagatagaaggctgcaaattgagctcaagatccagtccaccccagaacttaattctttgagatatggctactgcgtataaaccgaagaacatcctgattactggagctgctggcttcattgcatcccatgtttgcaaccggcttatccggaactaccctgagtacaagattgtggtccttgacaagcttgattactgttcaaatttgaagaaccttcatccctcaaggtcatcatccaactttaagtttatcaagggagacattggcagtgctgaccttgtcaacttcatccttctcaccgagtccattgatacaataatgcactttgcagcccagacccatgtcgacaattcttttggtaacagctttgagttcaccagaaacaacatctatggtacgcatgttcttctagaagcatgcaaagtcactggtcaaatcaaaagattcattcatgtaagcacagatgaagtctatggagagacagatgaagatgctgtggtgggaaatcatgaggcttctcagcttcttccgacaaacccctactctgcaactaaagctggagcagagatgcttgttatggcatatgggcgttcatatggattgcctgtcataactaccagaggaaacaatgtttatggccccaatcagttccctgaaaagatgattccaaaattcattctcttggctatgaaagggaagcctcttccaattcatggtgatggatcaaatgtcaggagttacctctattgtgaggacgtagcagaggcatttgaagtcattctgcacaagggtgaggtaggccatgtgtacaacattgggacaaagaaagagaggagggtggttgatgtggctaaggaaatttgccaactcttctctttgaacccagatactcaaataaaatttgtcgaaaacaggccgtttaatgatcaaagatatttcttggatgaccagaagctgaaaaacttgggatggtctgaaaggacttcgtgggaggagggtttgaggaagacgatggactggtatgtcaagaatcccgaatggtggggagatgtttctggggcactgcttcctcatccaaaaatgctcatggttcccgggattgaaagaaaatttgatggtactgatactggcgcttctgccttctctttgtcagcaaacatgtttgttccacctccaaagaacaatccatctactcagaagccatctttgaagtttttgatttatggtaaaacggggtggattggaggccttcttgggaagatttgtgagaagcaggggataccctatgagtatggacaagggcgtcttcaggaacggtcacagctcttggctgatattcagagcattaaaccaacccatgttttcaatgctgctggagtgactgggaggcccaatgtggattggtgtgaatctcataaaccagaaacaattcggaccaatgttgtcggtacattaaccttggctgatgtctgcagagatcacaacctcctgatgattaattatgctactggttgtatcttcgagtatgatgctgcccatccatcaagatcaggaatcgggttcaaagaggaagacacacccaatttcactggctcattttattccaaaaccaaagccatggttgaagagcttttgaaggaatacgacaatgtttgcactctaagagtccggatgccaatatcatctgatctcagcaatccccgcaacttcatcacgaagatctcacggtacgacaaagtggttgacattccaaacagcatgaccatcttggatgagcttctacccatttcagttgagatggccaagaggaacttgaggggcttatggaacttcacaaaccctggcgtcgtgagtcacaatgagattctggagatgtacaagaagtacattgaccccagtttcaagtggactaactttacgcttgaagaacaagccaaggttattgttgcaccaagaagtaacaatgagatggatgcatctaagttgaagaaagagttccctgaattgcttccaatcaaggaatcactgattaaatacgtctttgaaccgaacaagaaggcattttctggctgagcagcaaatcaagtgtttcatgaagtagacctcaataccaattcatgcatattttatttatttatttattttattctgggaaatagagttattttcatgtggtgattcttgtcatgatccatctgtctcatcccattggttcaatttgtttctgtaatagctataagcttgcttcacaagttggtactgtaggttctagtttggataaggagctttggaattgcttcagaatatttaaattttaaaaggtcttctgtaagttgtggcatattgtaatttcggatatgtaataaagaacatgtaattttgaataaattattcatacaggtttatctatttctat

SEQ ID NO: 12260 - DNA, 2274 bp, Tabernaemontana elegans
atctactctcaatttttctctctcccctctcttgctttgcttcggcctggttgatcttgatctcaattctactcgaggccactaaaatggcaacacataccccgagaaatatccttattactggagctgcagggtttattgcatctcatgtagcaaaccggctaattcggaactaccctgagtacaagattgttgtcctcgacaaacttgactattgttcaaatctgaagaatctcattccttcccagtcatcccctaacttcaagtttgtgaagggggacattgctagtgccgatcttgttaactaccttctcatcacggagtcaattgacacaataatgcactttgctgcgcagacccatgttgataactcatttggtaatagctttgagttcaccaagaacaacatttatggcacacatgtgctgttagaggcttgcaaagttactggccaaatcaagaggtttatccatgtaagcacagatgaggtttatggagagacagatgaagatgccgttgtaggaaatcacgaagcttcacaactcctccctacaaacccatattcggccacaaaagcaggagctgaaatgcttgttatggcatatggtaggtcatatggattgcctgtaataactacgcgagggaacaacgtttatggtcccaatcagtttcctgaaaagttgatcccaaagttcatccttttggctatgagagggaagactcttcctattcatggggatggttctaatgtgcgcagctatctctattgtgaggatgttgcagaagcatttgaagttattcttcacaggggagaagttggtcatgtttacaacattgggacgaagaaggaaagaggagtaattgatgttgccaaagatatatgcaaaatttttaacatggatcctgaaaccagcattgagttcgtggagaatagaccatttaatgatcagagatatttcttagatgatcagaagctgaagaacttgggctggtcagagaggacaacttgggaagaaggactaagaaagactatggaatggtacactaaaaatcctgattggtggggggatgtttcaggagcattgcttcctcatcctagaatgttgatgatgcctggtgggatagaaaggcttcttgatggatctgataagtatgattctggatcttctgaattctcagggaaatccaatcaggaccgaatggttgtcccaccttctaagagcccaactaataaaccatccttgaaattcttgatatatggtaggactgggtggattggtggtctgcttgggaaattgtgtgagaaacaagggattccatatgaatatggaagggggcgactcgaggaccgctcacaacttttggcagacatccaaattgctaagcccacccatgttttcaatgctgctggtgtgactggtagacctaatgttgattggtgtgaatcacacaagactgaaacaattcgtacgaatgttgctggtactctaactttggcagatatctgcagagagcatggtctcctgatgatgaattttgcaactgggtgtatatttgaatatgatgctgcacatccagaaggatctggtactgggttcaaggaggaagacacacctaattttactggatctttctattcaaagacgaaggccatggttgaagagctattgaaggagtatgacaatgtttgcacccttcgggttcgaatgccaatatcttcagacctcagcaacccacgaaatttcatcaccaagattagccggtacaataaggtggttaacattcccaacagcatgaccatcttggatgaacttctgcctatttccattgagatggcaaagcgaaatctcaggggcatttggaacttcacaaatcctggggttgttagccataatgagattcttgagatgtacaagaaatacatagatccagaatttaaatgggccaacttcacacttgaggagcaagcgaaggttataattgccccccgaagcaataacgagttggatgccaccaaattgaagaacgaattccccgaattgctacctatcaaggagtcattgataaagtatgtctttgaacccaacaagaaaacatctgcttgaataagcgtttagagagtaaaactttggggctagattttgcatttttgtgtcagcctatacgattgcgtgttagtcagtactagttgttactgatgattagcctcagctcattcttttgtattgtttttagagtctggatagcgattagggtggcattactagattactt

SEQ ID NO: 12261 - DNA, 2756 bp, Silene vulgaris
ccttggtaggtctcagcatcacaagttgtgcatctaagatatcgaagtttggcattatagtcaaagaactcactaacaataccaccggccacattgtaatcgtacctcaactttttcgcgttggaatcgtagtcacagtaccagtcataataccctgaatgttagggtcattataagcacggaatgaagccttaaagctctgttgggcaaccactgaggcaacaagaacaactaagacggccaaataccgcatgatattagttgtctgtttttttctctcctcctttttttccgttatcatttttatccctgattttactctaaggtgatccactatgtcttcttacacgccgaagaacatccttattacgggtgcggctgggttcattgcatctcatgtcgcaaacaagcttattaggagttatcctgattacaagattgtcgtgctcgacaagcttgattattgttcaaacctgaaaaacttacgcccttcccaaaaatctcctaatttcaagtttgtcaagggggacattgctagtgctgaccttgttaactatcttttgatcaccgagtccattgatactattatgcactttgctgcgcaaacccatgtcgataattctttcggtaacagctttgagttcaccaagaacaacatttacggtactcatgttcttctagaggcctgtaaggtgacaggtcagatcaggagatttattcatgtcagtactgacgaagtttatggggagacggatgaggatgctgtggtgggaaaccatgaagcttctcagcttctcccgacaaacccatactcggctacaaaggcgggagctgagatgcttgtgatggcttatggccgatcatatggcttgcctgttatcacaacccgtggaaacaatgtttatggaccaaaccagtttcctgagaagttgatccctaagttcatccttttggccatgcaagggaagcctcttccgattcacggggatggttctaatgtgagaagttatctctattgtgaggatgtcgccgaggcctttgaggtcattctccacaagggagaagtaggccatgtgtacaacattgggacaaaaagggagaggagagtcattgatgttgctagagacgtatgcaaattgttctctgtggaccccgagactgtcatcaagtttgtcgagaaccgtccctttaatgaccagaggtacttcctcgatgacgagaagttgaaaattttgggatggtcagagaggaccccttgggaagagggtctaaagaagactatggagtggtatatcagtcaccctgagtggtggggtgatgtgtcaggagccctgcttcctcaccctagaatgttgatgatgccaggtggcattgagaggcattttgaggattctgacaatgataattccgcttcttcagaacttcccaactctcaaagtaagatggtggttcctgtcgcaaaaaccaccgcctcccctaagaagccatcgttgaagttcctgatctatggtagaacaggctggattggcggtcttcttggccagatgtgtgaaaagcaaggcattgcttacgagtacggaaagggccgtctccaagaccgggcatctcttatagcagatatccagaatgtcaagccaacccatgttttcaatgccgctggtgtaaccggtaggcctaatgtagactggtgtgaatctcacaaacccgagactattcgtaccaatgtcgttggtacattgaccttggcagatgtctgcagagaacatgggttgcttgtgatgaattatgctactgggtgcatttttgagtatgatgctgcacatccactcggctctggaattgggttcaaggaggaggacacacccaattttgcgggttcattctactccaagactaaagccatggtggaggagttgctcaaggagtttgacaacgtttgcacccttagagtccgcatgcccatatctggtgacctcaccaacccacgaaacttcatcacaaagatctctcgctacaataaggttgtggacatccccaacagtatgaccatcttggatgagctcctacccatctcgatagagatggccaagcgtaatctcagaggcatatggaacttcaccaaccccggagtcgtaagccacaacgagatcctcgagatgtacaagaactacattgacccaagcttcaaatgggctaacttcactgtggaagagcaagccaaggtcatcgttgctgcaagaagcaacaacgagatggatgcctccaaattgaagaaagaattccctgagctgctcagcattaaggaatcactgatcaaatacgcttttgagccaaacaagaaaacagattactctgcgtaagtcgacatttttcgagaatttcagagatgctgtagtctgcaggattggagtgggttcatcagggtaaaaagccattcttagtacttctgtacgttcctaataactagtttgggtttagaattcaattactttcgtcattagtatttaattttattctcttatttgatagttatatataacaatgccctttgcccacccatttgtaatttttataaacttattgctctaatttttgtcaaaaatgtcctgttttatttgttttattaattttgtgactggagtgtggtctctttggatcactccgaactcgaaattaaaactgttcagctctttggtttaagcttgaaattgttcattatttgatacagaagacatgcctctcaggcgtgaactctc

SEQ ID NO: 12262 - DNA, 2728 bp, Setaria italica
ccaccacagcacaagagcgcaaccaccaccgaccacgccggagccgtgcattgcgccgacccctcctccctcccttggccttccccccctcatgcgcgccaccaccaccgcccgcatttattagccacctcctcctctcctcccccactctcgctttctctctctttctctcatccatcgacgccacccgctcccgcgccgcgcgtcgcatacggatttcaaaagtaatcatacaggggatatggctacggcatataaacctaagaacattcttattacgggagctgctggctttatcgcctcccatgtcgcaatccgtattaccaagaagtaccccgattacaagatcgtcgtccttgacaagcttgactactgctctaatctgaagaacctgctccctgtgagctcttcaccaaacttcaagtttgtcaagggcgacattgcaagcgctgatcttgtcaacttccttcttgtcacggagaacattgataccataatgcactttgcagcccagactcatgtcgacaattcatttgggaattccttcgaatttaccaagaacaacatttatggtacccatgttcttcttgaggcctgcaagatcaccggacagatcaagaggttcatccatgtcagcactgatgaggtctacggggagacagatgaggatgcagttgttggcaacaaggaggcatcacagctgctccccactaacccatatgcagccaccaaagctggagcagagatgcttgtaatggcatacgggagatcctatggcctgccggttataactactcgaggaaataatgtctatggccctaatcagtttcctgagaagcttatcccaaagttcattctcttggccatgagaggggagcccctcccaatccatggtgatggaaccaatgtccgtagctacctctattgtgaggatgttgcagaggcatttgaggtaattcttcatcatggagaagttgggcatgtttataatattggaacaaagagagagaggacggtcattgatgtggcaaaagatgtttgcaagcttttcaatttggaagctgacaaagtcatcatgtttgtcgagaacagacctttcaacgatcaaaggtatttcttggatgatgagaagctcaagagccttggatgggctgagcgcaccccatgggaggaaggcttgaagaagacaatggaatggtatgtagcaaattctgattattggggagatgtttctggtgcattgctgcctcatccgaggacgctaatgatgcctgggtatgagggctctgaggagattaaaggaatactcagtcagttcaataacattcagacaaaggtggcttcaacatcagatagtgctccagaaacgcatgccttcaagttcttgatatatggtaggacaggatggatcggtggacttcttggaaaaatatgtgagaagcaaggaattccatatgaatatggaaaaggtcgcttgcaagagcgttcttcgctcatcctggatatccaaactattaaaccaacacatgtcttcaatgctgctggtgttactggcagacccaatgttgattggtgtgaatcacacaagccggacaccattcgtaccaatgtcgtgggcaccctgactctagctgatgtgtgtagggagcatggcttattgatgataaattatgccactgggtgcatatttgaatatgatgcatgtcatccagaagggtcaggtatcggcttcaaagaggaggatacaccaaattttactggttcgttctactcgaagactaaggcaatggttgaggagttattgaaggagtatgagaacgtctgcaccctacgagtccggatgccaatatcttctgacctcagcaaccctcgaaactttgtgacaaagatcagccgttacaacaaggtggtgaacatccctaacagcatgacaatattggacgagctcttgcctatctcagtggagatggcgaagaggaacctgcggggcatttataatttcaccaaccctggcgtcgtcagccacaacgagatcctggagatgtacaagcagtacatcgaccccagcttcaagtggacaaacttcaaccttgaggagcaggccaaggttatcatcgcaccccggagcaacaatgaaatggatgcaagcaagctgaagaaggagttccccgagctgctgtcgatcaaggactcgttgatcaagtatgtcttcgagcctaatcagaagctgcccataaactgaagagacagcgcagtcgatactatagaaaatacagcaaccattataagcaagcatgtaggagccattcattgcaaacaattcgttagaatgtttattcatcatacttagcagcatatctccactataggttgatccacagctgaatagaggatacatggcagtctgttgatggcaacatggtgagtgcccaatttgttgtagaggcctatcacttaggagttgaaatgtttggtccagtgtgtaccaccacttttgttctgtcaggaatgattctccactctttaatctgctggctcctatcaatttaaagctccttccagttgtttatctgaagaattcatccttagtaaaaggggaaaaccccaagattttaatatgtgtaacttgtacactgagagcacttggctgtcccttcccttctgttccctttagattattctcccacccagcagcttatgtaaaatgattatgctgccacttcctgtg

SEQ ID NO: 12263 - DNA, 2482 bp, Rosmarinus officinalis
gcttttcgccactcactcgcctctccttgtctaaaactttcattcttctctctgatttcaatcttttcccccttttcttgtagagggactcttccgaatctcttccctatttcctagctcgcccgtggactgatcccaattattatcggagaaaaatcatactaagcaacgatgtcgaacttcaccccgaaaaacatcctcatcaccggggctgccggattcattgcctctcatgtcgcgaaccgccttatccgaaactaccccgagtacaagattgtcgtgctcgataagcttgattactgctccaatctcaagaacctcctcccttccaaatcctccccaaatttcaagtttgtcaagggagacattggtagcgctgaccttgtcaactaccttctcatagctgagaacatcgacactataatgcatttcgctgcccaaacccatgtcgacaattcctttggtaacagtttcgagttcaccaagaacaacatttacggcacccatgtccttttggaggcctgcaaggtcacggggcagattagaaggtttatccatgttagcacagatgaggtgtatggagagaccgaggaggatgctgttgttgggaatcacgaggcctcgcagcttctgccgacaaacccttactcagcaacgaaagctggggcagagatgctcgttatggcatacggtagatcttatggattgcctgtcattaccacgagaggtaataacgtctacggccccaatcagtttcctgaaaagttgatccctaagttcatcctcttggccatgagagggaagactcttcccatccatggtgatggatcaaatgtgcgaagctacctctattgtgaggatgtggcggaggcatttgaggtcatcctccacaagggagaagtcgggcatgtttacaacatagggacgaagaaggagaggagggtaatcgacgttgccagagacatgtgcaaactgttcaacatggatccagacaagagcattcagttcgtggacaacagaccgtttaacgatcagaggtatttcctggacgaccagaagctgaagaatttgggttggtcagaaaggaccacatgggaggagggtctgaggaagacgatggagtggtacacgaacaaccccgattggtggggtgatgtagccggtgcattgcttcctcatcctcggatgctgatgatgccaggtggaatcgagaggcattttgacgatgctgagaagtacgagtctggaaaatccgaattcgctggtaattccactcagaagatggtagtgccgccttccaaaaccagccaatcaacggataaaccagccttcaagttcttgatatatggcaggaccgggtggatcggtggtttgctcggaaaattgtgcgagaaacaggggattgcatatgagtatggaaaggggcgtcttgagaatcgccaccaaattttggccgacattgttactgtgaaaccgacacatgtattgaatgcagctggtttaaccggcagacccaatgtcgattggtgtgaaagccacaagacagagacaattcgtgtcaatgttgctggcacgttgaccttggccgacgtatgcagagagaacgggctcctgatgctgaactttgccaccgggtgcatattcgaatacaacagtaaacacccagagggctctggcatcggatacaaggaggaagacacacccaatttcatcggatctttctactccaagacgaaggccatggtggaggagctcttgaaagaatacgacaatgtctgcacgctgagagcccggatgccaatatcgtcggacctgagcaacccacgcaatttcatcaccaagatctcaaagtacaacaaggtagttaacatccccaacagcatgacaatcttggatgagcttcttccgatcgcgattgagatggcaaaacggaacctcagaggcatctggaacttcaccaacccgggcgtcgtcagccacaacgagatcctggagatgtacaagcagtacatcgacccagatttcaaatataccaacttcaccctcgaggagcaagcgaaggtcatcattgcccccagaagcaacaacgagatggatgcatctaaactgaagaaggagttccccgagctgctctcgatcaaggagtcattgatcaaatacgtgtttgaaccgaacaggaagaccctggctaagtgaggcatcgttattcctccatcgctggcctgcattttggtctagattatctgtgaccagttgctctgtatgttaggtttagtttacacgagttcattattttggggtgatgtttgtgtttccctgtgttttagaatatgctcttcattttacttttgtggtcagatgcttagaatttggtctacaaaaggatatctgcttgtattgtttgtccatcactcttgctggatgcggccattatatggatttcataattccagaaaccccttgtgtaattccatgattatga

SEQ ID NO: 12264 - DNA, 2549 bp, Lotus japonicus
cgatttcacagctccaccatttttcctcttctcatcaactttcactcaacgagaggagacccacctttttctttccttccattttcctctcaaatctccttctattcctctctggattcgctaccaatttaagttgcctgacatggcttcatataccccaaagaatatccttattactggggctgctgggttcattgcctctcatgttgccaaccggcttgtcaggacctatccagactacaaaattgttgtgctcgataaactcgattattgttccaatctgaagaacctccttccttccaaatcatctcctaacttcaagtttgtgaagggggacattggtagtgctgatcttgtcaaccaccttcttatcaccgagtccattgatactataatgcactttgctgctcaaacacatgttgacaactcctttggtaatagctttgagttcaccaagaacaacatatatggaactcatgtcctattagaagcctgcaaggtaactggacaaatcagaaggttcattcatgtcagcacagacgaggtgtacggggagacagatgaggatgctgttgtgggaaaccatgaggcttcccaacttcttccaacaaacccatactctgcaacaaaggctggggctgaaatgcttgttatggcatatggtacgtcatatggtttacctgtcatcacaactcgtgggaacaatgtttacgggccaaatcagtttcctgagaagttaattccaaagttcatcctactggccatgcaaggaaagactcttccaattcatggggatggttcaaatgtgaggagttacttatattgtgaagatgttgcggaggcatttgaagttatccttcataggggagaggttggtcatgtctacaatatcgggacaaagaaggaaaggagagttattgatgtggccaaagatatatgcaatcttttctcaaaggatccagaaacaagtataaaatttgtagataatagaccatttaatgaccagaggtactttctcgacgatcaaaagctgaaggttttgggttggtctgagaggaccacttgggaagagggcctgaagaaaaccatggaatggtatacacaaaatcctgattggtggggtgatgtcacaggagcgttgcttcctcatccaaggatgctgatgatgcctggtgggatggagagacattatgaaggatctgaaggtgaaaaccctgcttccttggcttcaagtaatactcgaatggttgttccgtcatccaagagcaatggtactcagcagaaacctccttttaagttcttgatctatggtagaacagggtggattggaggtttgctggggaaactgtgcgataagcaaggaattccatatgaatatggaaaggggcgcctagaggatcgctcctcagtggtggctgacattaataatgtgaaaccaacccatgtttttaatgctgcaggcgtgactggtagacccaatgtcgattggtgtgaatctcacaaaacagaaaccatcagaactaatgtggctggcactttaacattggctgatgtttgcagagagaatgggatcttggtgataaattacgctactgggtgcatatttgagtatgatgcatcgcatcctgaaggctccggcattggttttaaggaggaagacaagcccaatttcattggctctttctattccaaaactaaagctatggttgaggagctcttgagagagtatgacaatgtatgcaccctcagggttcgcatgccgatttcatctgacctgagcaacccgcgcaacttcattacgaagatttctcgttataacaaggtagtaaacattccaaacagcatgactattttggatgagcttctgccaatttcaattgagatggcaaagaggaacctgaggggaatctggaacttcacaaaccctggagtggtgagccacaacgagatccttgagatgtacagggattacattgaccccaacttcaagtgggttaacttcaatctggaagagcaagccaaggtgattgttgctcctcgaagcaacaatgaactggatgcttccaaattgaatacggaattcccagaattgcttcccatcaaggagtcactaatcaagtatgtcttcgagccaaacaagaaataaacaggtttatgttttaggcatagcagtaatgtttccggtctacataggcattgcagtaatgttttaggcatggcagtattactattgtgttagtgtgtttcctagatttaaatttcaagtacttatagcatgttttaattgattataattgctttagtgagtgactcctttgtactagcagccttagatagatgcactggtatgaaagtttgtgatttggaacttctgcatctgtgtaaggcttgtattcttttatcatctagaatgaaaaattaaaataagagaccttgttgtcattttggacattattattgagatgtacttggatatttatctgtaatatgaagtgaaaaaactgttattttgaaagtgaaaatctgggaacaatagatgttatttatca

SEQ ID NO: 12265 - DNA, 2540 bp, Solanum phureja
ggtaaaaaatatgtagaaaagatgattcgatttttgcatgagagagggtagttccgtgtataaatacatacacaaaccggaagatacttgactctcatcaatacacgctttctctctctaaaaatcttttatgtttctcactctttgagaaactcaaaaatagtcaccatatttttacttattgggctctgaaacaaaaaaaaaaggggtttgagttgctgttaagctgttaatatatttgaaatttgacatcaaaatgtctaactatactccaaagaatatactcattactggggccgcagggtttattgcatctcatgttgccaaccgccttgttcggagttaccctgagtacaatattgtggtccttgacaagcttgattattgctcaaacctgaaaaatctttccccatctcgatcttcccctaatttcaagtttgttaagggagacattggcagtgctgatcttgttaactaccttctcatgaccgagaacattgacactataatgcactttgctgctcagacccatgtcgacaactcctttggtaatagctttgagttcaccaagaacaacatttatggcacacacgtgctattagaggcatgcaaagtttctggtcagatcagaaggtttatacatgttagcactgatgaggtttacggagaaactgatgaagatgctgttgtaggaaaccatgaagcctcgcaacttcttcccacaaacccatattcagccacgaaagctggggctgaaatgcttgttatggcatatggaagatcatatggattgcctattatcaccactagagggaacaatgtgtatggtcccaatcaatttcctgagaagctaatcccaaagttcatacttttatctttgcaagggaagcctcttcctattcaaggagatggttcaaatgttagaagttatctctattgtgaggatgttgctgaggctttcgaagttgttcttcaccgaggtgatgttggtcatgtttataacattgggactaagaaagagaggcgagtgattgatgttgccaaagatatatccaatctttttaacagggatccagacgcaagcattcagtttgtggagaacaggcccttcaatgaccagaggtatttcctagatgatcagaagttgaagaacctgggttggtcccagaagaccacctgggaagagggtctgaaaaaaacgatggattggtatgtcaataatcctgattggtggggagatgtctctggggcactgcttccccatcctagaatgccgatgatgcctggtggggtagagagaaattggtatggagctgaaaaagatgattctggatcatctgaggtctcaggaaacgccaaccataccagaatggtagttccagcttccaagatcagcaactcccctagtaaatcaccttataagtttttgatatatggtaggactgggtggattggtggtctcctaagcaaactgtgtgagaaacagggaattccttatgagtatggaaagggacgcctggaggatcgctcacaacttttgtcagacattcatgctgtgaagcccacacatgtattcaacgctgctggtgtcactggtaggcccaatgttgattggtgtgagagtcataagactgaaacaatccgtacgaatgttgctggaactctaaacttggcagatgtttgtaaggagaatggtttactaatgatgaattttgcaaccggttgcatattcgaatacaatgctgcacacccagaaggttctggcattggattcaaagaagaagactcacccaatttcaccggttctttctattcaaagaccaaggccatggttgaagagttgttgaaagagtaccccaatgtttgcaccctcagagtcaggatgccaatttcttcagacctcaacaacccccgtaacttcatcaccaagattagccgctacaataaagtggtcaacattcccaacagcatgacgattttggatgagcttcttccaatttcaattgagatggccaagcgtaatctcacaggcatatggaatttcacaaaccctggtgttgtgagccataacgagatcttggagatgtacaagaaatacataaacccagaatttaaatggtccaacttcacactggacgagcaggctaaggtacttgttgcacctcgcagtaacaatgaaatggacgcgtccaagttgaaaaaggagttccctgagttgctgtctattaaagaatcattgatcaaaaatgtgtttgaaccaaatagaaaaacttctgcataagaagccctcaggatgtggagagcagacttctggtttggatcaatatgctacttgttgtactctagtttagtgattattcatcattagtagccaacatatttaaaatattcaggttcttactggtgtctagaattcctagtctatgttgtcagtttatctatgagtttaatgtgctatgattccccatgcatcttttgtcagctcgggtcgatttgttggatcttaataaatatggaattatgaattgtttcttgctcca

SEQ ID NO: 12266 - DNA, 2688 bp, Lupinus angustifolius
attttgggtctgaacaagttctatttcttttcttcatcttttctcttctccatcagtgtcagataccagtttaagttgcttggcatggctacccataccccaaaaaatatcctcattactggggcagctggatttattgcatctcattttgcgaaccggcttgtccggaactatcccgagtacaaaattgttgtgcttgacaaacttgattactgttctaatctaaagaaccttattccttcgaaatcatctcccaacttcaagtttgtgaagggggatattggaagtgctgaccttgtcaactaccttctcatcaccgagtctatcgatacaataatgcactttgctgctcaaactcatgttgacaactcatttggtaatagctttgaattcactaagaacaacatctacggcactcatgtcttattagaagcctgcaaggtaactggccagatcaaaaggttcatccatgtgagcactgatgaggtttacggagagacggatgaggatgctgttgtcggaaaccatgaagcttctcagctacttcccacaaatccatactctgcaacgaaagctgctgcagaaatgcttgtcatggcatatggtaggtcttatggtttaccggtgatcacaacacgtggaaacaatgtctatgggcctaatcagtttcccgagaagttaattccgaagttcatcctcctggctatgcaaggcaagcctcttccaattcatggagatggttctaatgtgagaagctatttatattgtgaagatgttgcggaggctttcgaacttatccttcacaagggcgaggttgggcatgtttacaatattggaaccaagagggaaagaagtgtaattgatgtagcgcaagatatatgcagacttttctcaatggacccagagactagtataaagtttgtagagaacagaccatttaatgaccagaggtacttccttgatgatgaaaagctgaagatcctgggctggtccgagaggaccacttgggacgaggggttgaagaaaactattgactggtataccaagaatcccaattggtggggtgatgtcagtggtgcattgcttcctcatccaaggatgctgatgatgcccggtggtctagagagacattctgatggatccgaagacgaaaaacctgagtcatatgtctcaagtaatactcgaatggtggttccgccaacgaagaatgttgtcacatcacagaaacatcctctcaagttcttgatctatggtagaacaggatggattgggggtttgctggggaaattgtgtgaaagccaagggattctgtatgaatatggaaaagggcgcttagaggatcgctcatcacttgtggccgatattcaaagtgtgaagccaacacatatttttaatgctgcaggagtgactggcagacccaatgttgattggtgtgaaattcataaaacggaaaccatccgtgccaatgtcgctgggactctaacattggctgatgtgagcagagagcatggactgttgatgataaattatgctaccgggtgcatatttgagtatgatgcagctcatccagacggttctggcattggttttaaggaggaagacacacccaatttcatgggttctttctattccaaaactaaggccatggttgaggagctattgaaagaatatgacaatgtatgcaccctccgggttcgcatgccaatttcatcagacctgagtaatccacgcaatttcatcaccaagatttctcgctataacaaggtagttaacatcccaaacagcatgactattttggatgaacttctcccaatttcagtcgagatggcaaagaggaacctgaggggcatttggaacttcacaaatcccggagctgttagccataatgagattctcgagatgtacagggattacatcaatcccaacttcaagtggaataacttcacactcgaagaacaagccaaggtgatagttgcagcaagaagcaacaatgagatggatgcatccaaattaaagaatgagttcccggaattgctttccattaaggaatcactgatcaaatatgtctttgagccaaacaagaaaaccaattaaaaaaatcatggcagtttcatgctcaagacatcacagttattcgccgaacatttttgtctggctacacagatcactcattgtttcattggtagctccatctagttattttagagggtgacacgtattattacaattgtgttaggtacgatacctaagttttcatttctacagcttcatgatatagtttaagcttgtggtaagcaacttttatagttcatatatatcccttttgtgggttattgcttatattggattgcattgtttatgcaattgaaagcatgctattgatatattcattttattttagtgtctcttctgtttgcaccatttgggtctctcaggctttgattatctttgctctaagcaactttgtccaagagaattggtggtaccccacatggccataccatttttccttttcaccacccttccaagagagttggatttgcatttatacatagttattacatatttacattatctactattcatttgtatcatgatgataagttgtcgcaacctaattttcgattggaagaccgactctgcgactaacatgatagtagataatacaataatagtagataaaattta

SEQ ID NO: 12267 - DNA, 2568 bp, Lupinus angustifolius
gtctcacagagtacatacgtattctcagcgcttccattttctcatcaacacacagagagaagagattcatcactctataatccttatctaacatcttttcattcttccatttcttcttctaaaattctctcccttcttctctctggatctgtcacctttttaagttaccagacatgggttcatataccccaaagaatatcctcattactggggcagctggatttattgcatctcatgttgcgaaccgacttgtccggagctaccctgactacaaaattgttgtccttgacaaacttgattactgctcaaatttgaagaatctcattccttcaaaatcatcacccaacttcaagtttgtgaagggagatattggtagtgctgatcttgtcaactaccttctcatcactgagtcgatcgacactataatgcactttgctgcacaaactcatgttgacaactcgttcggtaatagctttgagttcaccaagaacaacatatatggtactcatgtgctgttagaagcttgcaaggtaactggccagatcaggaggttcattcatgtgagcactgatgaggtctatggagagaccgatgaggatgctgttgttggaaaccacgaggcttctcaacttcttcccacgaacccgtactctgcgacgaaagctggggcagaaatgcttgtcatggcatatggtagatcatatggtttaccagttatcacgactcgtggaaacaatgtttacgggcccaatcagtttcctgagaagttaattccgaagttcatactcctggctatgcaaggaaagaatcttccaattcatggggatggttctaatgtgaggagttatttatattgtgaagatgttgcggaggcttttgaagttatccttcacaagggagaggttggccatgtttacaatattgggacaaagaaggaaaggagagttattgatgtggccaaagatatatgcacactattcaaaaaggatccagaagctagcataaaatttgtagagaacagaccgttcaatgatcagagatactttctcgatgatcaaaagctaaagatcttgggttggtctgagaagaccacttgggaagaaggcttgaagaaaaccatggattggtatacacagaatcctgattggtggggtgatgtaaccggagcactgattcctcatccgaggatgctgatgatgcctggtggcttggagagacactttgaaggatctgaagatgaaaaatctgcatcctttggctcaactaatacccggatggtggttccatcaaccaagaacactggcactcagcagaaacccccttttaagttcttgctctatggtagaactgggtggattgggggtttgctgggaaagttgtgtgaaaagcaagggattccatatgaatatggaaaagggcgcctggaggatcgtaactcacttatcgccgatcttcagcatgtgaagccaacccatgtttttaatgctgcaggagtaacgggcagacccaatgttgattggtgcgaatctcataaaacagaaaccatccgcaccaatgttgccggtactctaacattggctgatgtctgcagagagcaagggatcttgatgataaatttcgccactggttgcatatttgagtatgatgcagcacatccagagggctctggaattggttataaagaggaagacaagcccaacttcattggctctttctattccaaaactaaagctatggttgaggagctcttgagagaatatgacaacgtgtgcacccttagggttcgcatgccgatttcatccgacttgaacaacccacgcaacttcattacaaagatttcccgttataacaaggtagttaacatcccgaacagcatgactattttggatgaacttctacccatttcaattgaaatggcaaagaggaacttgaagggcatctggaacttcacaaatcccggggttgtgagccataatgagatcctcgagatgtaccgggattacattgaccctagcttcaaatggactaacttcacacttgaagagcaagccaaagttatagttgctcctagaagcaacaatgagatggatggatccaaattgaagaaagagttcccagaattgctttccatcaaggaatcacttatcaagtttgtctttgagccaaacaagaaataaacaatttcatgttttggacattgcagtttatgtgttgaggatacattgatcacttattattccactgttctattcagttaatgtgtgtagtaagtggcctcagtattataattgtgttaggaatgtttcctaagctttcatttctagatctttatttaagttattggtatcattagcagcattagataggggtatatgttatctgaaagtttgtggtggccaacttttaaattatataagcttgtattcttttgttactcatctttaatggaaacttagaataagagatgtttaaattttttacattattgagatgtaacttgggtacttatctgtaatgtagaatgaaaattcaggaataagaaaagctttatcattagttaaactaaaa

SEQ ID NO: 12268 - DNA, 2431 bp, Olea europaea
ttaggatgaattgattgctgcaggggaaggtgcttcattctcatcgcttcacgacaatctctctaaaattttctttcagaggggggcttttgaattattattctcttcctttttcattggattcattgggtttggcggatcctgcttgaaaattaagtatatcatgacgaagcacacacccaagaatattcttattaccggtgcggctggattcattgcttctcatgttgcaaataggctcattcgaaactaccctgactacaagattgtcgttttagacaaacttgattactgttccaatcttaagaacctccttccctcaaattcgtcgcctaacttcaagtttgtgaagggtgacattggcagtgctgatcttgtcaactatctcctcatcgccgagtctattgacacgataatgcactttgctgcccaaacccatgtcgacaattcttttggtaacagctttgcgttcaccaagaataatatttatggcactcatgtcctattagaagcctgcaaggtcaccggccagatcaaaaggtttatccatgtaagcacggatgaagtctatggagagaccgacgaggatgctgtagtaggaaatcatgaagcctcacaactgctgcccacaaacccatattcagccacaaaagctggggctgaaatgcttgttatggcttatgggagatcttatggattgcccgtgattaccacccgaggaaataatgtttatggtcccaatcagttccccgaaaagttaattccaaagttcattcttttagccatgagagggaagccccttccaattcacggggatggttctaatgtgcgaagttatctttattgtgaggatgttgctgaggcatttgatgtcgttcttcacatgggagaagttggtcatatttacaacattggaacaaaaaaggaaaggagagtgattgatgttgccaaagatatatgcaaactgtttaacatagatccagacaaaagcattgaatgcgtggacaatagaccatttaatgatcaaagatacttcctagatgatcagaagttgaagaatttgggttggactgagaggaccacgtgggaagaagggttgaaaaagaccatggaatggtatatcagcaaccctggttggtggggtgatgtgtccggagcactgcttcctcatcctagaatgcttatgatgcctggtggaatagaaagaaatgttgacggacctgagaaatctgattctgggaagtctgagttttcaggcaaatctaatcaaacccgaatgttggttcctgcttctaagagcaatggtacatctcaaaaaccacccttcaagttcttgatctttggtaggactggatggattggtgggctgcttggaaagttatgtgagaaacagggaattccgtatgagtatggaaagggacgcctggaggatcgcccacagcttttggcagacatcctagctgttaagccaacacacgtgtttaatgctgctggtgtgactggtagacccaatgttgactggtgtgaaggtcacaaaacagaaacaattcgaaccaatgttgctggtacactaaacttagcagatgtatgcagagaacatgggctcttgatgattaactttggcactggctgtatatttgaatacaatgccacacaccctgaaggctctgggattggatttaaggaggaagataaacccaatttcagcggttctttctattctgagaccaaggccatggtggaagaactattgaaggaatacgacaacgtttgcacgctcagagttcgaatgccgatatcttcagacctgaacaacccacgcaatctcattactaagatttctcggtacaataaggttgtcaatattcccaacagtatgaccatcttggacgagcttcttcctatttcaatagagatggcaaagcggaacctgagaggcatatggaacttcacaaaccctggagttgtcagtcacaatgaggttttggagatgtacaaaaaatatattgatcagaatttcaaatgggcgaacttcacacttgaagagcaagctaaggtgatagttgctcctagaagtaataatgaaattgatgcctccaagttgaagaaagagttccccgagttgctgtcaatcaaggagtccttgatcaagtatgtttttgaacccaacaggaaaacccccgttgaataagcacctcaagactgtcaacacgagtgctggtgctggattttgcatcagttaatgtggtccccattacctttttctacgttcttagctttagccattgatagttcttggttacagcttatatttgtggcttttttgatttatagaggtttttactttgtcgtggataatgtttgctcctatatctcttttccattagcacgctggggtgtaacatacggtgtactattatgtgaaattttt

SEQ ID NO: 12269 - DNA, 2435 bp, Artemisia annua
agtattatttacacacactaaaaacacgcacacacacatacacaatctgtatatataaatacctcaacacattcattcttcattctccactcaacaacgccttcattctttctttctttctccattttttttatagtgttacaatatgactagttatacgccaaagaatatcctcataaccggggcagctggtttcattgcctctcatgttgctaatcggcttgtgagaagctaccctgattacaagattgtcgtgctcgacaagcttgattattgctcgaatcttaagaatcttaacccgtctagatcgtctcctaattttaagtttgttaagggggatattgggagtgctgatctggtgaattatcttttaattaccgagaatattgatacgattatgcactttgctgctcagactcatgttgataattctttcgggaatagttttgagttcactaagaataacatttacgggacgcatgtgttgttggaggcgtgtaaagtgactcgtggtcagattagaaggtttattcatgttagtacggatgaggtgtatggtgaaacggaggaggatgctgttgtggggaaccatgaagcgtcacagcttcttcctacgaatccgtattctgccaccaaagctggggcggaaatgcttgttatggcttatggtaggtcatatgggttgcctgtgattaccactagaggtaacaatgtgtatggcccaaatcagtttcctgaaaagttgatcccgaagttcattcttttggctatgagagggcagccacttccgattcatggtgatgggtcgaatgtgaggagttatctttactgtgaagatgttgctgaggcttttgaagtcgttctccacaagggtgaagtcggtcatgtttacaacattggaaccaagaaggaaaggcgagttaatgatgttgctcgtgatgtctgtaatctgtttaatatcgatcctgaatcaagcatcaagtttgtggagaacaggccgtttaatgatcagaggtacttcttggatgatgagaagcttaagtgtttgggttggtccgaaaggaccacatggcaagagggtctaaaaaagactatggagtggtacaccagcaatcccgattggtggggtgatgtctctggtgcactgcttcctcatccacgaatgctgatgatgcctggtggagtcgagaaagtcattgacgtccctgaaaacgttcaatctgattcacctcatgcagctgttaactcttctcagtttcaaaaagtggttcctgctgcaaaaaccagtaccaactctgctactaaaccatctttcaagttccttatctatggtaaaacagggtggatcggtggtttacttgggaaaatatgtgagaaacaagggattcagtacgagtatggaaagggtcgtttggaggaccggtcatcgattgttgctgatattaagaatgttaagccaacccatgttttcaatgctgctggtgtcactggcagacccaatgttgattggtgtgaatctcacaagaccgaaaccatccgtacaaacgtctcgggcacactcactttagcagatgtttgcagagatcaagggattttggtgatgaactttgccactggatgcatatttgagtatgatgctgcacatccagaaggttcagggatcggttttctggaagaagacacgcccaatttcactggttcattctactccaaaaccaaggctatggttgaggagctattgaaagaatacgacaatgtatgcaccctgagggtccgaatgccaatatcatcagacctcaacaacccacgtaactttgtcaccaagattgctcgttacgataaggtggtcaacattcccaacagcatgaccatcttggacgagcttctgcctatttccatcgaaatggcaaagagaaacctcaagggaatctggaactttaccaacccaggcgtcgtgagccataacgaggtcctggagttgtacaaacaatacatcaacccagaattcaaatggaaaaacttcacactcgaagaacaagcccaagtgatagttgccccacgaagcaacaacgagttggatacatccaagttgaagaaagagttccctgaattgctatcgattaaagaatcattggttaagtacgtatttgcccccaacaaaaaagcttagtgagtgtcgaaatccccattggcgtgttatataggtttggatattattacgcgtgtgatatgtttaaacacgaaatttacttgtgatgtttgttcctagtagtaagtaagatgaataccgagagagattatagaaaggccgcgagttcttcattacatttgttaaaactatagcatattgctattcttgattttattacagaaaatttgtttatcagttactaaaaaaaaaaaaaaaacatcttggatctagaatgacacgcgag

SEQ ID NO: 12270 - DNA, 3249 bp, Brassica rapa
cttcttccctctcaaatgagtcttgtctgtggtctttgatcgtcacaaagatcccaaaatttctcagagagatggcttcgtacacgcccaagaacattctcataaccggagccgccggtttcatcgcctcccacgtggcgaacaggctcatccgaacctaccctcactacaagatcgtggtcctcgacaagctcgactactgctccaacctcaagaaccttaacccttcgaaaaactcccccagcttcaagttcgtgaaaggcgacatcgccagcgccgacctcgtcaaccacctcctcatcaccgaaggcatcgacaccatcatgcacttcgccgctcagacccacgtcgacaactccttcggcaacagcttcgagttcaccaagaacaacatctacggtacccacgtcctcctcgaggcctgtaaggtgacaggccaggtgcggaggtttatccacgtgagtaccgatgaggtctacggggagactgacgaggacgcgctcgtgggtaaccacgaggcctctcagcttctccccacgaacccttactctgcgaccaaggctggcgcggagatgcttgtgatggcgtatgggcgatcttatggtttgccagttattactactcgtgggaacaatgtttatgggccgaatcagtttcctgagaagctgattccgaagtttattttgctggcaatgagagggaaggttcttccgattcacggagatgggtcgaacgtgaggagttatctttactgtgaggacgttgctgaggcctttgaggtgattctccacaagggggaggttgggcatgtttataacattgggactaagaaggagaggagagtgaacgatgtggctagagatgtttgcaagctctttggcatggaccctgaggcgagtattaagtttgttgagaaccggccttttaatgatcagaggtattttctcgacgatgagaagctgaagaagctggggtggtcggagaggacgacgtgggaggaagggttgaagaagactatggagtggtatactcagaaccctgagtggtggggtgatgtctctggagctttgcttcctcatccgaggatgctgatgatgcccggtgggcgacatttcgatggatcagatgagatttcttcagcagcttcggtgtctgacaagccgagtcaaacccacatggtggttccaagcacaaggagcagtaccagcacgccgcagaagccttctctcaagttcttgatatatggtaaaaccggatggattggtggtctgcttgggaagctatgtgagaagcaagggattgcttatgagtatgggaaagggaggttggaggatagagcttctcttttgcaggatgttatgagtgttaagccgactcatgttttcaactcggctggtgtgactgggagacctaatgttgactggtgtgagtctcacaagacagagaccatccgtgccaatgttgctgggactttgactctggctgatgtctgcagagagcatggccttttgatgatgaacttcgctactggttgtatatttgagtatgatgagaagcatcctgaaggttcgggtgttggattcaaggaggaagacactcccaacttcactggctccttctactcaaaaaccaaagccatggtcgaggagctgctaaaggagtatgacaacgtatgcacattgagggtaaggatgccaatctcttcagatctaaacaacccacgcaacttcatcaccaagatctcaaggtacaacaaaggagtcaacagcccaaacagcatgacagtgttggacgagctcttcccaatctccatcgagatggccaaaagaaacttgaaagggatctggaacttcacaaacccgggcgtggtgagccacaacgagatcctagagatgtacagagactacatcaaccctgagttcaaatgggcaaacttcacgttagaggagcaagctaaagtcattgtagctccaagaagtaacaacgagatggatgcttctaagctcaagaaagagttccctgagctactctccatcaaggagtcgttgattaagtatgcatttgagccaaacaagaagacttgaatgagagaatggtttgtgattcttcattagattaatcactaataatatctattatatgttttgtttattgtttcttgattatattgtttgatcactcttactacgatcactagcttttctttaagggtgtgttatagtttgattattctatgtaatagagatttaatttttattcatactgtttattcaacacaccattggttttgaaagagagaaaagggttgtgattcttcattagattaatcactaataatatctactatatgttttgtttattgtttcttgttatattgtttgatcatctcatactatcactagctttgctttacgggtgtgttatagttttgattattctatgtacttttattcatcacttgatctactctttattagattagaatcaaaaccactaaaaaagagtctggtaatggttacttattggggttacaagaactctcacagttcagacagtctaggaatctaagatgagttaggcgctgacgtgtcggcgagcttctcgaggaagcaaacaacgtcatcaggagagccaaggagatatctagcactggtgcgtgtacgaccaactgcacaagagaagtagttctctcctttaaggtcaagcacgttccaagatatcttctctggtgaaggacgtcttgagttccctaagctatggttgttggaaccgctttttgctgtctgaagagatctctgtgaagaggccttgttgttgtggtggttagagttagaggaggaagattttgaactgcttttgctgttgttgttgttgtggtgtgttgactttgaaggcggtcttctgtctcctcctcctgatgatgatctggttccaccactatcagatgatggtctggaccgtgagatggctgggatgatgtcagaagggagctctggttcaaagaaggtgtaaacatcttcgtccttccccaagaagtggccaatgcacaagacgtaatctattggtgtggtcattgacttgctatgcactatctctcctagaatgcgatctattgcagctcccttggtcacgcctaccgcacggacttcaacagagcggcttccttggacaacatcgactgatgcattagagattggtcctgtccataagtgttgtaacaggtctcttgcttgaagtctcccaaattca

SEQ ID NO: 12271 - DNA, 2303 bp, Chrysanthemum coronarium
tatataaatacctcaacacattcttcattctccactcaacgccttcattctttctttcttcttcattttttatagtgttacgatatgactagttatacgccaaagaatatcctcataaccggggcagctgggtttatcgcctctcatgttgctaatcggcttgtgagaagctaccctgattacaagattgttgtgctcgacaagcttgattattgctcgaatcttaagaatcttaacccgtctagatcgtctcctaattttaagtttgttaagggggatattgggagtgctgatctggtgaattatcttttaattaccgagaatattgatacgattatgcactttgctgctcagactcatgttgataattctttcgggaatagttttgagttcactaagaataacatttacgggacgcatgtgttgttggaggcgtgtaaagtgactcgtggtcagattagaaggtttattcatgttagtacggatgaggtgtatggtgaaacggaggaggatgctgttgtggggaaccatgaagcgtcacagcttcttcctacgaatccgtattctgccacgaaagctggggcggaaatgcttgttatggcttatggtaggtcatatgggttgcctgtgattaccactagaggtaacaatgtgtatggcccaaatcagtttcctgaaaagttgatcccgaagttcattcttttggctatgagagggcagccacttccgattcatggtgatgggtcgaatgtgaggagttatctttactgtgaagatgttgctgaggcttttgaagtcgttctccacaagggtgaagtcggtcatgtttacaacattggaaccaagaaggaaaggcgagttaatgatgttgctcgtgatgtctgtaatctgtttaatatcgatcctgaatcaagcatcaagtttgtggagaacaggccgtttaatgatcagaggtacttcttggatgatgagaagcttaagtgtttgggttggtccgaaaggaccacatggcaagagggtctaaaaaagaccatggagtggtacaccagcaatcccgattggtggggtgatgtctctggtgcactgcttcctcatccacgaatgctgatgatgcctggtggagtcgagaaagtcattgacgtccctgaaaacgttcaatctgattcacctcatgcagctgttaactcttctcagtttcaaaaagttgttcctgctgcaaaatccagtaccaactctgctgctaaaccatctttcaagttccttatctatggtaaaacagggtggatcggtggtttacttgggaaaatatgtgagaaacaagggattcagtacgagtatggaaagggtcgtttggaggaccggtcatcaattgttgctgatattaagaatgttaagccaacccatgttttcaatgctgctggtgtcactggcagacccaatgttgattggtgtgaatctcacaagaccgaaaccatccgtacaaacgtctcgggcacactcactttagcagatgtttgcagagatcaagggattttggtgatgaacttcgccactggatgcatatttgagtatgatgctgcacatcctgaaggttcagggatcggttttctggaagaagacacgcccaatttcactggttcattctactccaaaaccaaggctatggttgaggagctattgaaagaatacgacaatgtatgcaccctgagggtccgaatgccaatatcatcagacctcaacaacccacgtaactttgtcaccaagattgctcgttacgataaagtggtcaacattcccaacagcatgaccatcttggacgagcttctgcctatttccatcgaaatggcaaagagaaacctcaagggaatctggaactttaccaacccaggtgttgtgagccataacgaggtcctggagttgtacaaacaatacatcaacccagaattcaaatggaaaaacttcacactcgaagaacaagcccaagtgatagttgccccacgaagcaacaacgagttggatacatccaagttgaagaaagagttccctgaattgctatcgattaaagaatcattggttaagtacgtatttgcccccaacaaaaaagcttagtgagtgtcgaaatccccattggcgtgttatatatgtttggatattattacgcgtgcgatatgtttaaacacgaaatttacttgtgatgtttgttcctagtagtaagtaagatgaataccgagagagattatagaaaaggccgagagttcattacatttgttaaaactatagcatattgctattcttgattttat

SEQ ID NO: 12272 - DNA, 2293 bp, Chrysanthemum coronarium
cattgccttcattctttctttctttcttcaaattttcatagggttacgacatgactagttatacgccaaagaatatcctcataaccggggcggctggttttattgcctctcatgtcgctaatcgccttgtgagaagctaccctgattacaagattgtcgtgctcgacaagcttgattattgctccaatcttaagaatcttaacccgtctagatcttctcctaattttaagtttgttaagggggatattgggagtgctgatctggtgaattatcttttgattaccgagaatattgatacgattatgcactttgctgctcaaactcatgttgataattctttcgggaatagttttgagtttactaagaataacatttacgggacacatgtgttgttagaggcgtgtaaagtgactcgtggtcagattagaaggtttattcatgttagtactgatgaggtgtatggtgaaacggaggaggatgctgttgtggggaaccatgaagcgtcacagcttcttcctactaatccgtattctgccacgaaagctggggcggaaatgcttgttatggcttatggtaggtcgtatgggttgcctgtgattaccactagaggtaacaatgtgtatggcccaaatcagtttcctgaaaagttaatcccgaagttcattcttttggctatgagagggcagccacttcctattcatggtgatgggtcgaatgtgaggagttatctttactgtgaagatgttgctgaggcttttgaagtcgttctccacaagggtgaagttggtcatgtttacaacattggaaccaagaaggaaaggcgagttaatgatgttgctcgtgatgtctgtaatctattcaatattgatcctgaatcaagcatcaagtttgtggagaacaggccgtttaatgatcagaggtacttcttggacgatgagaagcttaagtgtttggggtgggccgaaaggaccacatggcaagagggtctaaaaaagaccatggagtggtacaccaacaaccccgattggtggggtgatgtctctggggcactgcttcctcatccacgaatgctgatgatgcctggtggagtcgagaaagttgttgaagtccctgaaaatgttcagtctgattcacctcatgcagctgttaactcttctcagtttcaaaaggtggttcctgctgcaaaaaccacaaccgactctgctactaaaccatctttcaagttccttatctatggtaagacagggtggatcggtggtttacttgggaaaatatgtgagaaacaagggattcagtacgagtatggaaagggtcgtttggaggaccgtttatcgattgttgctgatattaagaatgttaagccaacccatgttttcaacgctgctggtgtcactggcagacccaatgttgattggtgtgaatctcacaagaccgaaaccatccgtgcaaacgtctccggcacactcactttagcagatgtttgcagagagcaagggattttggtgattaactttgccactggatgcatatttgagtatgatgctgcacatccagaaggttcagggatcggttttctggaagaagacacacccaatttcactggttcattctactccaaaaccaaggctatggttgaggagctattgaaagaatacgacaatgtatgcaccctgagggtccgaatgccaatatcatcagacctcaacaacccacgtaactttgtcaccaagattgctcgttacgataaagtggtcaacattcccaacagcatgaccatcttggacgagcttctgcctatttccatcgaaatggcaaagagaaacctcaagggaatctggaactttaccaacccaggtgtcgtgagccataacgaggtcctggagttgtacaaacaatacatcaacccagagttcaaatggaaaaacttcacactcgaagaacaagcccaagtgatagttgccccacgaagcaacaacgagttggatacatccaagttgaagaaagagttccctgaattgctatcgattaaagaatcattggttaagtacgtatttgcccccaacaaaaaagcttagtgagtgtcgaaatccccattggcgtgttatatatgtttggatattattacgcgtgcgatatgtttaaacacgaaatttacttgtgatgtttgttcctagtagtaagtaagatgaataccgagagagattatagaaaaggccgagagttcattacatttgttaaaactatagcatattgctattcttgattttattacagaaaatttgttatcaattac

SEQ ID NO: 12273 - DNA, 2551 bp, Lippia dulcis
ggaattgcatgaaccgcgtatatatataggtagatacagagggtgatttgggtgcgtgtgtagggggggagacattgttcgactctccttgattatcgctctcccaataacctatctgtctgaataatttcctatttttctctgatttgccgtccttttttattgagagattttgttttcaaccgatttctttgctcgctggtggatcctcgttcaaagtcgagaaataattaagcaaaaatggcgacgttcacacccaagaacatcctcatcaccggagctgctggattcattgcttctcatgttgcaaacaggcttattagaagctaccctgaatacaagattgttgtgcttgacaaacttgattactgttccaatctcaaaaacctcctcccttcaaaatcttcagccaattacaagtttgtcaagggagacattgccagtgctgaccttgtcaactaccttctcattactgaggagattgacactataatgcactttgcagcccaaacccatgtcgacaattcgttcggtaacagctttgaatttaccaagaacaacatttatggcacccatgttcttctggaggcctgcaaagttactggccagattagacggtttatccatgtcagcacagatgaggtctatggagaaactgacgaggacgctgcggtaggcaatcacgaagcctcacagttgcttcccacaaatccttactcagccacgaaggccggtgctgaaatgcttgttatggcttacggtagatcatacgggttgcccgtaatcaccacaaggggaaacaatgtgtatggtccaaatcagttccctgaaaagttaattcccaaattcatccttttagcaatgagagggaaaagccttccaattcatggtgacggttcgaacgttcgtagttatctttattgtgaggatgttgctgaggcctttgaagttattctgcataaaggagaagtgggtcatgtctacaacattgggacgaagaaggagaggtgcgttctcgatgttgcgagggatgtatgcaaactattcaacatggatcctgataagagcattcagtttgtggagaatagaccgtttaatgatcagaggtatttccttgatgaccaaaagctgaagaaattgggttgggctgaacgaaccacgtgggaagaaggcttaaggaaaaccatggactggtacacgagccatcctgattggtggggtgatgtttctggtgcattgctcccacatccaagaatgctgatagtgccaggtggtgctgagaggcatcttgatggaggtgagaggtatgaatctggtaaatctgaattcaatggtaattctagtgggacaaaaatgttggtgccgccttctagaagcagccaatcatcatcaaataaaccggcgttcaagttcttggtctatggcaggaccggttggattggtggtttgcttggaaaattgtgtgagaaacaggggattgtgtatgaatatggaaggggccgtttggaggatcgtgcacagcttattgccgacattcatgctattaagcctacacatgtttttaatgctgctggtgtaactggtagaccaaatgttgattggtgtgagagtcacaagactgaaacgattcgtaccaatgttgctggtactttgaatttggcagatgtgtgccgagagcatgggctccttatgatgaactttgctactgggtgtatatttgaatatgatgctgcacatcctcagggttctggcattggatttaaagaggaagacaaacccaattttactggttctttctactcaaagaccaaggctatggtggaagagctcttgaaagaatacgacaacgtttgcacccttagagttcgaatgcccatatcttccgacctgacgaaccctcgcaatttcattaccaagatttcaaagtacaacaaggtggtcaatatccccaacagcatgaccatcttagacgaacttcttccaatttcaatcgaaatggcaaagagaaacctcagaggcatatggaacttcaccaacccaggtgttgtgagccacaatgaaatcttggagatgtacaagaaatatattgaccctgatttcaaatacaccaacttcactcttgaagagcaagcgaaggtcattgttgctcctagaagtaacaatgaaatggatgcgtctaagttgaagaacgagttccctgagttgctaccgatcaaggagtcgttgatcaagtatgtgtttgaacccaacaggaaaacccctaatgtgtaagtgtttgtttcctgcttggaatctcaggctgaatttgtattttggtgtcggcgatgtggtgctagttatcctctgtttagttttatacaagtgcttcaactcatttttgcgttggggtcttttttgttttaagggtatgctaggttgagggagatggttggcaggatgtgtttccaggatttaatgtaaggatatttgaattagaatgtttggatttgatgatgctagcgatgtattgtaaataatttgtgtttgccaagggttgtttttcagggtttat

SEQ ID NO: 12274 - DNA, 2478 bp, Spinacia oleracea
caaaaaaggtactcagtatattggcgttcctcaactgtcttctcttcgcacaaaaaatagcattataaatggtttcatctcaacctcctaactccactctataatctcgcaattctttctgggttttgcactctcccctatttttcctgtcgtctccgattttttctctctcttctatattatttcctccacttttgttgggagattttcctctgtcttgcaatcgcatccgatttaaagtggtgcattatgtcgtcttacaccccaaagaatattcttattactggtgcggctggattcattgcatcccatgtcgctaatcggctcattaggagttacccagattacaagattgtcgtgcttgacaagcttgattactgctcaaaccttaaaaatttgcgcccttcccaatcatcccctaatttcaaattcgtcaagggggatattgctagtgccgatcttgtaaactaccttctcatcaccgagtccattgatacgattatgcactttgcagcacaaacccatgttgacaattcttttggtaatagctttgagttcaccaagaacaacatttatggtacccatgtcctcctagaagcctgtaaggtcactgggcaaattaggagattcatccatgttagtacagatgaggtttatggggagacagatgaggatgctgttgtgggtaatcatgaagcttctcagcttcttccaacaaatccttactctgctacaaaagctggtgctgagatgcttgttatggcttacggcagatcttatggtttgccagttattacaaccagaggaaacaatgtgtatggacctaaccaatttcctgagaaattgatcccaaagttcattcttttggccatgaggggtaagccacttccaattcatggtgatggatctaatgtgagaagctatctctactgtgaggatgttgcagaggcctttgaggtcattctccacaagggagaagttggtcatgtgtacaacattggtacaaagaaggaaaggagggtcattgatgtggccacagatgtatgcaaactgttctcaaaggatccagatgcaagcatcaagtttgttgagaaccggccttttaatgaccagaggtacttccttgatgatgagaaattgaagattttaggatggtcagagcgtaccacatgggaagagggcctgaagaagacaatggagtggtataccagtaatcctgattggtggggtgatgtctcaggagcattgcttcctcacccaaggatgctgatgatgccaggtggcattgagaggcatgttgaagaagcagatgagaatggtgctgcttcttcagaatttaccaaaacccagactaggatggtggtacctattaccaagaatacggtcagttctcctcgtaagccgtgtttcaagttcttgatctatggtagaactggctggattggtggtgttcttgggcagttgtgtgaaaagcaagagattgcctttgagtatggaaaggggcgtttggaaaaccgagaatctcttattgctgatatccagaatgtgaagcctactcacgtgtttaatgctgctggtgtgaccggtagacctaatgttgactggtgtgaatctcacaaaccagagacgattcgtgccaatgttgttggtactttgaccttggctgatgtgtgtagagagtatgggcttctgatgatgaattttgccactggttgcatctttgagtatgatgctacacatcctatgggatctggaattggcttcaaggaggaggatacaccaaactttgctggttctttctactcaaagacaaaggctatggttgaggagctgctgaaagagtatgataatgtgtgcacccttagggtcagaatgcccatatcttctgacctgaacaacccacgaaacttcataacaaagatctctcgctacagtaaggtggtagacattcccaacagcatgactgttttggacgagcttctacccatttccattgagatggcaaagagaaatctcaggggtatttggaacttcacaaacccaggagtggttagccacaatgagattctagagatgtacaagaattacatggacccagaattcaagtgggctaacttcacaattgaagaacaagccaaagttattgttgctgcaagaagcaacaatgagatggatgcctccaagttgaacaaggaattccctgaattgctcagtattaaggattcattaatcaagtatgtttttgagccaaacaagaagactaactattctgcttgagagttgagactgattctggaaaatcccgctttcagtaatcaggattgcatttattttataccagtagccagtaggcaatgtgggttgcttagctatattcctttgcattcattattttagcttcatcttgtgttatttctttctattacctagattttctctagaattatttttattaggtgttcaatttttacacagctc

SEQ ID NO: 12275 - DNA, 2350 bp, Citrus clementina
acagatcaccccttgtcagtcgtctctgtactctctcaaggctcaagtctctactactctttctctgtttctcagctctgtctgagatttcacagctgaccccattacctaccaacaaaacaaatttcgaaggaagcaccaaaaaaacagaaaaaaaaaaagacaagctgttgttggaatggctactgtttacacgccgaagaacattcttattactggagctgctggcttcattgcatcccatgtatgcaaccgtctcattgggaactacccggagtacaagattgttgttcttgacaaacttgattactgttcaaacctcaagaacctgaacccctcgcgattgtctccgaactttaagttcatcaagggagatgtcgctagtgctgacttggttcacttcattctcctaaccgaaaagattgataccattatgcactttgctgctcagacccatgttgacaactccttcggcaacagctttgagttcactaagaacaacatttatggaacacatgttcttctcgaagcctgcaagatcacagggcaaatcaagaggtttatccatgtcagcactgatgaggtttatggggaaactgacgaggatgccgtggtggggaaccatgaggcttctcagcttttgccgacaaacccttattctgccactaaagctggggccgagatgcttgtcatggcctacgggcgttcgtatggcttgcctgtgattactactagaggaaacaatgtgtatgggcccaatcaatttcctgaaaagctgattccaaaattcatcctcttggctatgaaaggaaagcctcttcctattcatggggatggatcaaatgtgaggagttatctctactgtgaggatgttgctgaggcatttgatactattctccacaaaggagaagtaggccatgtgtacaatattgggacgaagaaagaaaggagagtgattgatgtggccacagacatctgcaaacttttctctttgaacccagatactcagattaagtttgtggagaataggccatttaatgaccagaggtatttcttggatgttcaaaagctgaaacaattaggttggtatgagcgggttacctgggaagagggtctgcaaaagacaatgaaatggtacatcagcaatcctgattggtggggtgatgttagtggtgctcttctccctcatccaagaacgtcaatggcacctgcaattgaagggaaagttgatggacatgatactactttcatgctcaagataaataattctagccagagccgaatggtggttagagcttccaagagcaattcctctagacagaagccatccctgaagttcttgatttatgggagaacggggtggatagggggccttctttcgaagatttgtgaaaagcaagggatacccttcgagtatggaaagggacgcttagagaacaggtcacaactcttggccgatattcaaaatgtgaagccaactcatgtcttcaatgcggctggagtgactggaagacccaatgtggattggtgtgaaactcataagcctgagacaattcgcaccaatgttgtaggcacattgaccttggcagatgtctgcagagagaatggcctacttatgatgaattacgctactggttgtattttcgaatatgatgctaagcatccagagggtacgggaattgggttcaaggaggaagacaaacccaatttcactggctctttctattctaaaaccaaagccatggttgaagagcttttgaaagaatatgataatgtttgtaccctcagagtccgaatgcctatttcgtctgatctcaacaatccgcgtaactttatcacaaagatttcacggtataacaaagtggtgaacattcctaatagcatgactatcttggatgagcttctaccaatttcagttgagatggcgaaaaggaatttgagtggtatatggaacttcacaaaccctggtgttgtgagtcacaatgagattctagagatgtacaaggcctacatagaccctggttttaagtggactaatttcacactcgaagaacaggctaaggttattgttgcccctcgaagcaacaatgaactcgatgcatctaagttgaagaaggagttccctgagttgttatctatcaaggagtcgctgataaaaaatgtcttcgaacccaacaagaaatccacttttggtagagtggcaaaataagcattccatgaatgcaaaaccctcagattgatccccgcgcacttctttgggtaatggtgtttctgatagactgaaccattattatttttgtaatcaatcatcagctttagtttaactttaacatctatgtgttccactctt

SEQ ID NO: 12276 - DNA, 2380 bp, Brassica oleracea
gggttctgacttttctttccttttgaagaccccccccccccccctttgaatttattccttcttcgtcgtcttcgtctcacatccaccccaaatctctagggctctgctcatcatcccatttcccaatcctcacagatccagaggaaacttgatggcttcttcatacactcccaagaacattctaatcaccggagcagccggtttcatcgcctcgcacgtcgccaacaggctcatccgaacctaccccgactacaagatcgtcgtcctcgacaagctcgactactgctccaacctcaagaacctcaacccctccaagcactcccccaacttcaagttcgtcaagggcgacatcgccagcgccgacctcgtcaactacctcctcatcaccgaaggcatcgacaccatcatgcacttcgccgctcagactcacgtcgacaactccttcggcaacagcttcgagttcaccaagaacaacatctacggaacgcacgtgctcctcgaggcgtgtaaagttactggccagatcaggaggtttatccacgtgagcactgacgaggtttacggcgagactgatgaggatgctgttgttggtaaccatgaggcttctcagcttctgccgacgaatccttactccgctaccaaggctggagctgagatgcttgtgatggcgtatggcagatcctatgggcttcctgttataaccacgcgtggtaataatgtttatgggcctaaccagtttccggagaagctgattcccaagtttatattgctggcgatgagggggaaggttcttcctattcatggagatgggagtaatgttcgtagctatctttactgtgaagacgttgctgaggcgtttgaggttattcttcacaagggggaagtgggccatgtttataatattggtactaagaaggagaggagggtgaatgatgttgcgcaagatatctgcaagctctttaatatggaccctgaggcaaacatcaagtttgtggagaacagaccttttaacgaccagaggtactttttagatgatgagaagcttaagatcttgggatggtcggagaggaccacttgggaagaagggttgaagaagacgatggagtggtacacgcagaacccggattggtggggtgatgtttctggagcgttgcttccccacccgaggatgctggtgatgcctggtgggagacactttgatgggtctgaagagaactctggatcagtcgctttgtctggaaactcaagccagagccagatggtggtcccgacaccaagaagcagtggcgccactcagaacccttcactgaaattcttgatatatggtaagacaggatggattgggggattgcttgggcagatttgtgagaagcagggaatcgcttttgagtatgggaaagggcggcttgaggatcggtcatccctcttgcaagatattctgaatgttaagcctacccatgtcttcaatgctgctggtgtgacagggagacccaatgtcgactggtgcgagtctcacaaaactgagacaatccgtgccaatgttgcaggcactttgactctggctgatgtctgcagagagcacagcctcctgttgatgaactttgctacaggttgtatattcgagtacgacgaaaaccatccgctaggttcaggcattggcttcaaagaagaagacacaccaaacttcactggttctttctactcaaaaaccaaagccatggttgaggagctgcttaaggagtttgataacgtatgcactctaagggttaggatgccgatctcctctgatctcaacaacccgagaaacttcatcaccaagatttcccggtacagcaaagtagtgaacatcccaaacagcatgaccgtgctggacgagcttcttccaatctcgatagagatggcgaaaagaaacctgaaagggatttggaacttcaccaaccccggtgttgtgagtcacaatgaggtcctggagatgtacagagactacatcgactcagacttcaaatgggcgaacttcacactagaggagcaagctaaggtcatcgtggctccaagaagcaacaacgagatggacgcatctaagctcaagaaagagttccctgaattactctcaatcaaggagtctctgatcaaatatgcatttgagcccaacaagagaacttgaggtaatataacttatctcagttttgtttaaactggtttgttattagtttctcccattgagtcgtaagccaaaagcaacttagctttgcctatatctagtttggattcttatatgctattgttttgttggtattgtgttctttcatgtcccacattttatagataaaaacatcatttctgtattatttgctgatattaatacgaacggttaaatcca

SEQ ID NO: 12277 - DNA, 2262 bp, Amaranthus tuberculatus
gatctgggctttcctttttaaggtaggtcaccatgtcttcgtatacaccaaagaacatacttattactggtgcggctggattcattgcatctcatgtcgcgaacagacttgttcggagttatcccgattacaagattgtcgtgcttgacaagctcgattactgctcaaaccttaaaaatttacgcccttctcaatcgtcccctaatttcaaattcgtcaagggggatattgctagtgccgatcttgtaaactaccttctcattactgagtccattgatacgattatgcactttgcggcacaaacccatgttgataattctttcggtaatagctttgagttcactaagaataacatttacgggactcatgtccttctagaagcctgtaaggttactggacagattaggagattcatccatgttagtacagatgaggtttatggggagacagatgaggatgctgttgtgggtaatcatgaagcttctcagctgcttccgacaaacccttactcagctacaaaggctggtgctgagatgcttgtcatggcttatggtcgttcatatggtttgccggttattacaacccgaggaaacaatgtgtatggtcctaaccagtttcccgagaagttgatcccaaagttcattcttttggccttgagggggaagcctcttccaattcacggtgatgggtctaatgtaagaagctatttatattgtgaggatgtcgcggaagcctttgaggtcattctccacaaaggagaagttggccacgtgtacaacatcgggacaaagagggaaagaagagtgattgatgtggctagggacgtatgtaaactgtttaatatggatccagaagcaagcatcaagtttgttgagaaccgaccatttaacgatcaaaggtactttcttgatgatgaaaaattgaagatcttagggtggtcggagcgcaccacatgggatgaagggctgaagaagacaatggagtggtatactagcaatcctgattggtggggtgatgtttctggtgcattgcttcctcacccaagaatgctgatgatgcctggtggcatcgagaggcatttcgaggaaacagacaatgagaaagctgcttcttcagatttccccaacacccaatctcatatggtggtacctgtttctcgtaccagcaacgcttcttctcctcgtaagccgtctcacaagttcttgatatatgggagaaccggttggatcggtggtctactcggccagttgtgtgaaaagcaaggtattgcttttgagtatggaaagggccgcttggaagatcgggcatctcttattgctgatattcagaatgttaagcctacccatgttttcaatgctgctggtgtcactggtagacctaatgttgactggtgtgaatctcataaaacggagaccattcgtgccaatgttgccggtactttgaccttagctgatgtctgcaaagagcatggacttcttatgatgaattttgccactggttgcatttttgagtacaatgattcacatcctttaggctctgggattggctttaaggaggaggataaaccgaacttcatcggttccttctactcaaaaacaaaggccatggtggaggagctgttgaaagagtatgataacgtatgcaccctgagggtccgtatgcctatctcttccgacctcaacaacccacgaaacttcatcacaaagatttctcgctacaataaggtcgtgaacattcccaacagcatgacagttttggacgagcttctacccatttccatcgaaatggcaaagcgaaacctcaggggcatttggaacttcacaaacccaggtgtggttagccacaacgagattctcgagatgtacaaaaactacatggacccagatttcaaatgggcaaacttcacactcgaagagcaagccaaagtcatcgttgctccaagaagcaacaacgagatggatgccaccaagttgaaaacagaattcccggaattgctgaacatcaaggactcactaatcaagtacgttttcgagccaaacaagaagacaaactattctgcttaagtgaatttttctacaccattaagagatgctatagtaatcagaattgcaatttatttatttttaccaagtaggctatgttgtttggtagcttatattcctccattgggggcttggggaaacatttattattattgtttagcttcatcttgtgttgtttctaatacctagatttgcactagaattgttttgttaggtgctc

SEQ ID NO: 12278 - DNA, 2305 bp, Brassica oleracea
atttattcctctcatctctacacatctcgagatcttcttcttcttcaagcttaggttgatattgatccgaatcgactcgatattatcataattttcacatcacaatggctacatataagcccaagaacatcctcatcaccggcgccgcgggattcatcgcctcccacgtggccaacaggctagtccgcacctaccccgactacaaaatcgtggtcctcgacaagctcgactactgctccaacctcaagaacctcaacccttccaaatcctcccccaacttcaagttcgtcaagggcgacatcgccagcgccgacctcgtcaactaccttctcatcaccgagaacatcgacaccatcatgcacttcgctgcgcagactcacgtcgacaactccttcggtaacagcttcgagttcaccaagaacaatatctacgggacccatgtgcttctcgaggcttgtaaagtcactgggcagatcaggaggtttattcatgtgagtactgatgaggtttatggagagactgatgaggatgcttccgtggggaatcacgaagcttctcagttgcttccgactaatccgtattcggctactaaggcgggtgctgagatgcttgtgatggcgtatgggagatcttatgggttgccggtgataactacccgtgggaataatgtttatggtcctaatcagtttcctgagaagttgattcctaagtttattttgttggctatgagtgggaagccgcttccgatccacggagatgggtctaatgttaggagttacctctactgtgaagatgttgctgaggcgtttgaggttgttttgcacaaaggggaggttaaccatgtgtataatattgggacgacgaaagagaggagagtgattgatgtggctaatgatatctccaagctctttgggattaaccctgactccaccatccagtttgtggagaaccggccgtttaatgaccagaggtacttccttgacgaccagaagctgaagaaactggggtgggctgaacgaaccacttgggaggaagggctgaagaagacgatggaatggtacactgcgaaccctgagtggtggggagatgtttctggagctttgctgcctcatccaaggatgctgatgatgcctggtgatagactctgtgatagtggtgacgagcacaaggatgctgatggtaatcagacgttcacggtggttactccccccaagactggtggttctggagacaacaaaacctccttgaagttcctcatctatggcaagactgggtggctcggtgggcttctaggaaagctctgtgagaagcaagggattgcgtacgagtatgggaaaggtaggctagaggacagagcttctcttgtggcggatattcgtagagtcaaacctactcatgtcttcaatgcagccggtttaacgggtagacccaatgttgactggtgtgagtcacacaaaacagagaccatccgagtcaacgtggctggtactttgactctcgcagatgtttgcagagagaatgggttgttgatgatgaactttgccaccggttgtatatttgagtatgacgctgcacatccagaaggttcagggattggcttcaaggaagaagacaaaccgaacttcaccggttccttctactcaaaaacaaaggcaatggtggaagagcttctaagagaatttgacaacgtctgcaccttgagagtgcgtatgccaatctcatccgacttgaacaacccacgaaacttcatcaccaagatctctcgttacaacaaagtggtgaacatcccaaacagcatgaccatactagacgaactcttaccaatctcaatcgagatggcgaagaggaacctgagggggatatggaacttcaccaatccaggagtggtgagccacaacgagatactagagatgtacaagagttacatcgagccgggtttcaaatggtccaacttcactttggaagaacaggctaaggtcattgttgcaccgcggagcaacaacgagatggatggtgctaagctcagcaaggagtttccggagttgctttccatcaaagattcgttgatcaaatacgtcttcgaacccaacaagagaacgtaagagcctctcgttaagaatacactacacacttcctctttctctgttcattgttatattatcctgcaggtagtttcactgtaatgattctactataatttgatttgatttatcatgtaattcatttactcctttttggtactctacgacaaaacacatctttgtttacattaatattattacagatttatctgagttttatttta

SEQ ID NO: 12279 - DNA, 2378 bp, Brassica napus
gctcgttagatccttcctcctcctcttcttcactcttatatttattcctctcatctctacacatctcgagatcttcttcttcttcttcttcttcttcaagcttaggttgatcttgatccgaatcgactcgatattattataattgttcacatcgcaatggctacatataagcccaagaacatcctcatcaccggagcggcgggattcatcgcctcccacgtggcaaacaggctagtccgcacctaccccgactacaagatcgtggtcctcgacaagctcgactactgctccaacctcaagaacctcaacccttccaaatcctcccccaacttcaagttcgtcaagggcgacatcgccagcgccgacctcgtcaactaccttctcatcaccgagaacatcgacaccatcatgcacttcgccgcgcagacacatgttgataactccttcggtaacagctttgagttcaccaagaacaatatctacgggacccatgtgcttttggaagcttgtaaagtcactgggcagatcaggaggtttattcatgtgagtactgatgaggtttatggagagactgatgaggatgcttccgtggggaatcatgaagcttctcagttgcttccgacaaatccgtattctgctactaaggcgggtgctgagatgcttgtgatggcgtatgggagatcttatgggttgccggtgataactactcgtgggaataatgtttatggtccgaatcagtttcctgagaagttgattcctaagtttattctgttggctatgagtgggaagccgcttccgattcacggagatgggtctaatgtgaggagttatctctactgtgaagatgttgctgaggcgtttgaggttgttttgcacaaaggggaggttaaccatgtttataatattgggacgacgaaagagaggagagtgattgatgtggctaatgatatctccaagctctttgggattaaccctgactccaccattcagtttgtggagaaccggccttttaatgaccagaggtacttcctcgatgaccagaagctgaagaaactggggtgggcggagcgaaccacttgggaggaagggttgaagaagactatggagtggtacactgcgaaccctgagtggtggggagatgtttctggagctctgcttcctcatccaaggatgctgatgatgcctggggatagactctgtgatagtggggacgagcacaaggatgctgatggtaatcagacgttcacggtggttacgccccccaagactggtggttctggagacaataaaacgtccttgaagttcctcatctatggtaaaactgggtggctcggtgggcttctagggaaactctgtgagaagcaagggattgcgtacgagtatgggaaagggagactggaggacagagcttctcttgtggcggatattcgtagagtcaaacctactcatgtcttcaatgcagccggtttaacgggtagacccaatgtagactggtgtgagtctcacaaaacagagaccatccgagtgaacgttgctggtactttgactctggcagatgtttgcagagagaatggtctgttgatgatgaactttgccaccggttgtatatttgagtatgacgctgcacatccagaaggttcagggattggcttcaaggaagaagacaaaccgaacttcaccggttccttctactcaaaaacaaaggcaatggtggaagagcttctaagagaatttgacaacgtctgcaccttgagagtgcgtatgccaatctcatccgacctgaacaacccacgaaacttcatcaccaagatctctcgttacaacaaagtggtgaacatcccgaacagcatgaccatactagacgaactcttaccaatctcaatcgagatggcgaagaggaacctgaagggaatatggaacttcaccaatccaggagtggtgagccacaacgagatactagagatgtacaagagctacatcgagccggatttcaaatggtccaacttcactttggaagaacaggctaaagtcattgttgcaccgcggagtaacaacgagatggatggtgccaagctcagcaaggagtttccagagttgctttccatcaaagactcgttgatcaaatacgtcttcgaacccaacaagagaacgtaagagcctctcgttaagaatacactacacacttcctctttctctgttcattgttatattatcctgcaggtagtttcactgtatctcatgattctactttaatttgatttgatttatcatgtaattcatttactcctttttggtactctacgacaaaacacatctttgtttacattaatattattacagatttatctgagttttattttatatcgactatagatacc

SEQ ID NO: 12280 - DNA, 2280 bp, Brassica napus
gatcttcttcttcttcaagcttaggttgatattgatccgaatcgactcgatattatcataattttcacatcacaatggctacatataagcccaagaacatcctcatcaccggagccgccggattcatcgcctcccacgtggccaacaggctagtccgcacctaccccgactacaaaatcgtggtcctcgacaagctcgactactgctccaacctcaagaacctcaacccttccaaatcctcccccaacttcaagttcgtcaagggcgacatcgccagcgccgacctcgtcaactaccttctcatcaccgagaacatcgacaccatcatgcacttcgccgcgcagacccacgtcgacaactccttcggtaacagcttcgagttcaccaagaacaatatctacgggacccatgtgcttctcgaggcttgtaaagtcactgggcagatcaggaggtttattcatgtgagtactgatgaggtttatggagagactgatgaggatgcttccgtggggaatcacgaagcttctcagttgcttccgactaatccgtattcggctactaaggcgggtgctgagatgcttgtgatggcgtatgggagatcttatgggttgccggtgataactacccgtgggaataatgtttatggtcctaatcagtttcctgagaagttgattcctaagtttattttgttggctatgagtgggaagccgcttccgatccacggagatgggtctaatgttaggagttacctctactgtgaagatgttgctgaggcgtttgaggttgttttgcacaaaggggaggttaaccatgtgtataatattgggacgacgaaagagaggagagtgattgatgtggctaatgatatctccaagctctttgggattaaccctgactccaccatccagtttgtggagaaccggccgtttaatgaccagaggtacttccttgacgaccagaagctgaagaaactggggtgggctgaacgaaccacttgggaggaagggctgaagaagacgatggaatggtacactgcgaaccctgagtggtggggagatgtttctggagctttgctgcctcatccaaggatgctgatgatgcctggtgatagactctgtgatagtggtgacgagcacaaggatgctgatggtaatcagacgttcacggtggttactccccccaagactggtggttctggagacaacaaaacctccttgaagttcctcatctatggcaagactgggtggctcggtgggcttctaggaaagctctgtgagaagcaagggattgcgtacgagtatgggaaaggtaggctagaggacagagcttctcttgtggcggatattcgtagagtcaaacctactcatgtcttcaatgcagccggtttaacgggtagacccaatgttgactggtgtgagtcacacaaaacagagaccatccgagtcaacgtggctggtactttgactctcgcagatgtttgcagagagaatgggttgttgatgatgaactttgccaccggttgtatatttgagtatgacgctgcacatccagaaggttcagggattggctttaaggaagaagataaaccgaacttcaccggttccttctactcaaaaacaaaggcaatggtggaagagcttctaagagaatttgacaacgtatgcaccttgagagtgcgtatgccaatctcatccgacttgaacaacccacgaaacttcatcaccaagatctcgcgttacaacaaagtggtgaacatcccaaacagcatgaccatactagacgaactcttaccaatctcgatcgagatggcgaagaggaacctgagggggatatggaacttcaccaatccaggagtggtgagccacaacgagatactagagatgtacaagagttacatcgagccgggtttcaaatggtccaacttcactttggaagaacaggctaaggtcattgttgcaccacggagcaacaacgagatggatggtgctaagctcagcaaggagtttccggagttgctttccatcaaagactcgttgatcaaatacgtcttcgaacccaacaagagaacgtaagagcctctcgttaagaatacactacacacttcctctttctctgttcattgttatattatcctgcaggtggtttcgctgtaatgattctactataatttgatttgatttatcatgtaattcatttactccttttggcactctacgacaaaacacatctttgtttacattaatattattacagatttattggagttttattttatattag

SEQ ID NO: 12281 - DNA, 2324 bp, Trifolium pratense
atacacacacactcacatcaaatatattttcttctttcttcaaatccgttaccattttagatagcctaacatggcttcatataccccaaagaatatcctcattactggggcagctggatttattgcatcacatgtagcaaatcggcttgtccgaagccatcccgagtacaaaattgttgtgcttgacaaactagattattgttctaatctaaagaatctccttccgtctaaatcatctcccaacttcaagtttgtgaagggagatattggtagtgctgatcttgtcaattacttgcttatcactgagtcgattgacacaataatgcactttgccgctcaaactcatgttgacaactcatttggtaacagctttgagttcaccaagaacaacatatatggaactcatgtcctattagaagcctgcaaggttactggccagatcagaaggttcattcatgtcagtaccgatgaggtttatggtgagaccgatgaagatgctgttgttggaaaccatgaagcttctcaacttctccctacaaatccatactctgctacaaaagcaggagcagaaatgcttgtcatggcttatggtaggtcatatggattacctgttatcacaacacgtggaaacaacgtttatgggccaaatcagtttcctgagaaattgattccaaagttcatcctccttgctatgcaaggaaagaatcttccaattcacggggatggttctaatgtgaggagttatttgttttgtgaagatgttgcggaggcatttgaagttgtccttcacaagggagaagttggccatgtttacaatattgggacaaagaaagaaaggggagttatcgacgtagccaaggatatatgcagactttttaaaatggatccagaaaaaagtattaaattcgttgagaacagaccatttaacgaccagagatactttctcgatgatcagaagctgaagaacatcggttggtccgagaggaccacgtgggatgagggcctgaagaaaaccatagaatggtataccaaaaatcctgattggtggggggatgtcagtggtgcattgcttcctcatccaaggatgttgatgatgcctggtggaatggagagacattttgaaggatctgaaggggaaaataccgcatcactcaattcatctaataatactcatatggtagttccatcaaccaagaacactggcggtcagcagaaacgtcctttgaagttcttgctctttggtagaacagggtggattggaggtttgctggggaaattgtgtgaaaagcaaggaattccatatgaatatgcaaagggtcgtctagaggatcgtgcatctctcattgctgatattcagaatgtgaagccaacccatgtatttaatgctgcaggtgtcaccggaagacccaatgttgattggtgtgaaactcataaaacagaaactatccgtgctaatgttgccggtactttaacattggctgatgtgtgcagagagaacggggtcttgatgattaattatgctactggctgcatatttgagtatgatgcagcacatccagaaggctctggcattggttttaaggaggaagacaagcccaatttcatgggatctttctattccaaaactaaagctatggttgaggaactcttgagagaatatgacaatgtatgcacccttagagttcgcatgccgatttcctctgatttgagcaacccacgcaacttcatcacaaagatttctcgttataacaaagttgtcaacattccaaacagcatgacagtattggatgaactactacctatttcaattgagatggccaagagaaacttgagtggaatctggaacttcacaaaccctggtgctgtgagccacaatcagatccttgagatgtatagggattacattgaccccagtttcaagtggcaaaatttcacgctcgaagagcaagccaaggtgattgtggctgctcgaagcaacaatgagatggatggtaccaaattaaagaaggaattcccagaattgctttccatcaaagaatcacttatcaagtatgtctttgagccaaacaagaaaaaataagcagttttatgttttagacatggcggtaatgtgttcgagctacataacatagttaacacatcattatcattccactgttgttagttccactcagttactgtgtgtagagtgtggctagtattacaattacattattattaggtaattttcctaagtattaatttcaatttcttagtgttctctggtacttgcagcctaagatagatgtcttgttatgaaaccaacttgtgatgagcaaactttt

SEQ ID NO: 12282 - DNA, 2504 bp, Trifolium pratense
ttaccattttatagcctgacatggcttcgtataccccaaagaatatcctcattactggggcagctggatttattgcatctcatgttgccaatcggcttgtccgaagccatcctgagtacaaaattgttgtgcttgacaaactagattattgttctaatctaaagaatctccttccgtctaaatcatctcccaacttcaaatttgtgaagggagatatcggtagtgctgatcttgtcaactacttgcttatcaccgagtcgattgacacaataatgcactttgccgctcaaactcatgttgacaactcatttggtaatagctttgagttcaccaagaacaacatatatggaactcatgtcctactagaagcctgcaaggttactggccagatcagaaggttcattcatgtcagtacggatgaggtctatggtgagactgatgaagatgctattgttggaaaccatgaagcttctcaacttctccccacaaatccatactctgcaacaaaagcaggagcagaaatgcttgtcatggcttatggtaggtcatatggactacctgttatcacaacacgtggaaacaacgtttatggaccaaatcagtttcctgagaagttgattccaaagttcatcctccttgctatgcaaggaaagactcttccaattcacggggatggttctaatgtgaggagttatttgtattgcgaagatgttgctgaggcatttgaagttgtccttcacaagggagaagttggccatgtttacaatattgggacaaagaaagaaaggggagttatcgacgtagccaaggatatatgcagacttttttcaatggatccagaaaaaagcattaaattcgttgagaacagaccatttaacgaccagagatactttctcgatgatcagaagctgaagaacattggttggtccgagaggaccacgtgggatgagggcctgaagaaaaccatagaatggtataccaaaaaccctgattggtggggggatgtcagtggtgcattgcttcctcatccgaggatgttgatgatgcctggtggaatggagagacactttgaaggatccgaaggggaaaatcccgcatcattcaattcatctaataatactcatatggtggtcccatcatccaagaacactggcggtcagcagaaacatcctttgaagttcttgctctttggtagaacagggtggattggaggtttgctggggaaattgtgtgaaaagcagggaattccatatgaatatgcaaagggtcgtctagaggatcgtgcatctctcattgctgatattcagaatgtgaagccaacccatgtttttaatgctgcaggtgtcaccggaagacccaatgttgattggtgtgaaactcataaaacagaaaccatccgcgctaatgttgccggtactttaacattggctgatgtgtgcagagagaacgggatcttgatgattaattacgctactggctgcatatttgagtatgatgcagcacatccggaaggatctggcattggttttaaggaggaagacaagcccaatttcatgggatctttctattccaaaactaaagctatggtcgaggaactcttgagagaatacgacaatgtatgcactcttagagttcgcatgccgatttcctctgatttgagcaacccacgcaacttcatcacaaagatttctcgttataacaaagttgtcaacattccaaacagcatgacagtattggatgaactactacctatttcaattgagatggcaaagagaaacttgagtggtatctggaacttcacaaaccctggtgctataagccataatcagatccttgagatgtatagggattacattgaccccagtttcaagtggcaaaatttcacgctcgaagagcaagccaaggtgattgtggctgctcgaagcaacaatgagatggatggtgccaaattaaagaaggaattcccagaattgctttccatcaaagaatcacttatcaagtatgtcttcgagccaaacaagaagacataagcagttttatgttttagacatggcggtaatgtgttcgagctacatagttaacacatcattatcattccactgttagttccactcagttactgtgcgtagagtgtggctagtattacaattgcattattattaggtaattttcctaagttttaatttcaatttcttagtgttctctggtacttgcagcccaagatagatgtcttgttatgaaaccaacttgtgatgagcaaaccttttttcatctttgtaagccttgtattcttttattgctcatcgagaatcaaaattgaaataagagaagctttataatttttgacattattattgagatgtactttggatatttatctgtaatactaatacatagtgaaaatcttgtaataagagaaattatttatcattttcttaaactaagaaatgttaatttcttatcttgtgactgggtgttaaatttcaggcatgtgtttctttata

SEQ ID NO: 12283 - DNA, 2396 bp, Chrysanthemum coronarium
tcgggcttctcaccattagcatttggcacacacacaaaatctgcatatataaatattctcctctttaacacattctttcactcattgccttcattctttctttctttcttcaaattttcatagggttacgacatgactagttatacgccaaagaatatcctcataaccggggcggctggttttattgcctctcatgtcgctaatcgccttgtgagaagctaccctgattacaagattgtcgtgctcgacaagcttgattattgctccaatcttaagaatcttaacccgtctagatcttctcctaattttaagtttgttaagggggatattgggagtgctgatctggtgaattatcttttgattaccgagaatattgatacgattatgcactttgctgctcaaactcatgttgataattctttcgggaatagttttgagttcactaagaataacatttacgggacacatgtgttgttagaggcgtgtaaagtgactcgtggtcagattaggaggtttattcatgttagtactgatgaggtgtatggtgaaacggaggaggatgctgttgtggggaaccatgaagcgtcacagcttcttcctactaatccgtattctgccacgaaggctggtgcggaaatgcttgttatggcttatggtaggtcgtatgggttgcctgtgattaccactagaggtaacaatgtgtatggcccaaatcagtttcctgaaaagttaatcccgaagttcattcttttggctatgagagagcagccacttcctattcatggtgatgggtcgaatgtgaggagttatctttactgtgaagatgttgctgaggcttttgaagtcgttctccacaagggtgaagttggtcatgtttacaacattggaaccaagaaggaaaggcgagttaatgatgttgctcgtgatgtctgtaatctattcaatattgatcctgaatcaagcatcaagtttgtggagaacaggccgtttaatgatcagaggtacttcttggacgatgagaagcttaagtgtttggggtgggccgaaaggaccacatggcaagagggtctaaaaaagaccatggagtggtacaccaacaaccccgattggtggggtgatgtctctggggcactgcttcctcatccacgaatgctgatgatgcctggtggagtcgagaaagttgttgaagtccctgaaaatgttcagtctgattcacctcatgcagctgttaactcttctcagtttcaaaaggtggttcctgctgcaaaaaccacaaccgactctgctactaaaccatctttcaagttccttatctatggtaagacagggtggatcggtggtttacttgggaaaatatgtgagaaacaagggattcagtacgagtatggaaagggtcgtttggaggaccgtttatcgattgttgctgatattaagaatgttaagccaacccatgttttcaacgctgctggtgtcactggcagacccaatgttgattggtgtgaatctcacaagaccgaaaccatccgtgcaaacgtctccggcacactcactttagcagatgtttgcagagagcaagggattttggtgattaactttgccactggatgcatatttgagtatgatgctgcacatccagaaggttcagggatcggttttctggaagaagacacacccaatttcactggttcattctactccaaaaccaaggctatggttgaggagctattgaaagaatacgacaatgtatgcaccctgagggtccgaatgccaatatcatcagacctcaacaacccacgtaactttgtcaccaagattgctcgttacgacaaagtggtcaacattcccaacagcatgaccatcttggacgagcttctgcctatttccatcgaaatggcaaagagaaacctcaagggaatctggaactttaccaacccaggtgtcgtgagccacaacgaggtcctggagctgtacaaacaatacatcaacccagaattcaaatggaaaaacttcacactggaagaacaagcccaagtgatagttgccccacgaagcaacaacgagttggatacatccaagttgaagaaagagttccctgaattgctgtcgattaaagaatcattggttaagtacgtattcgcccccaacaaaaaagcttagtgagtgtcgaaatccccattggtgtgttatataggttctgatattattaatcgtgtcatatgtttaaacacgaaatttacttgtgatgtttgttcctagtagtaagtaagacgaataccgattaccgagagagattatagaaaggcggagttgtcgattattacatttgttaaaactatagcatattgctattcttgatttcattacagaaaatttgttatcagttgcataaaatcttg

SEQ ID NO: 12284 - DNA, 2605 bp, Panicum virgatum
aggctacaaatataggagaccaaccacgcacacgcatgtgcgtcttctccgccgcagcgcagaccgaccaccgacccctcctcctcctccccctcctgcgcgccccaccaccaccgcctgcatttattagcctcctcctctcctccccggctctcgcgccctccctctcgctctctcatcaaccgacgccatccgctcccgcgccggcgcgccgcgcgtcgcatacgcaggatttcagaaataatcatacaggggatatggcgacgaattacaaacctaagaacatccttattacaggagctgctggctttatcgcctcccatgttgcgattcgcattaccaagaagtaccccgattacaagatcgtcgtccttgacaagcttgactactgctctaatctgaagaacctgcttcctgtgagctcgtccccaaacttcaagtttgtcaagggagatattgcaagtgctgatcttgtcaacttccttcttgtcacggagaacattgataccataatgcacttcgcagcccagacacacgttgacaattcatttgggaattcctttgaatttaccaagaacaacatttatggtacccatgttcttcttgaggcctgcaagatcactggccagatcaagagattcatccatgtcagcactgatgaggtctatggggagactgatgaggatgcacttgttggaaacaaggaggcatcacagctgctccccacaaatccatatgcagccaccaaagctggagcagagatgcttgtaatggcatatgggagatcctatggcctgccggttatcactactcggggaaataatgtctatggccctaatcagtttcctgagaagcttatcccaaagttcattctcttggccatgagaggggagcccctccctatccatggtgatggaaccaatgtccgtagctacctctattgtgaggatgtcgcggaagcatttgaggtaattcttcatcatggagaagttggacatgtttataatattggaacaaagagagagaggacggtcattgatgtagcaaaagatgtttgcaagcttttcaatttggaagctgacaaagtcattatgtttgtcgagaacagacctttcaacgatcagaggtatttcttggatgatgagaagctcaagagccttggatgggctgagcgcaccccatgggaggaaggcttgaagaggacaatggaatggtatgttgcaaattccgattattggggtgatgtttctggtgcactgctgcctcatccaaggacgttaatgatgcctgggtatgagggctctgaggagattaaagtaatactcagtcagtttaataacattaagacaaaggtggattcaacatcagatagtgcttcagaaacgcatgccttcaagttcttgatatatggtaggacaggatggatcggtggacttcttggaaaaatatgtgagaagcaaggaattccatatgaatatggaaaaggtcgcttgcaagatcgttcttctctcatcctggatattcaaactattaagccaacacatgtcttcaatgctgctggtgttactggcaggcccaatgttgactggtgtgaatcgcacaagccggacactatccgcaccaatgttgtgggcactttgactctagctgatgtgtgtagggagcatggcttattgatgatgaattatgccactgggtgcatatttgaatatgatgcacatcatccagaagggtcaggtatcggcttcaaagaggaggatgcaccaaattttactggttcgttctactcgaagactaaggcaatggttgaggagctattgaaggagtatgagaacgtctgcaccctacgagtccggatgccaatatcttcagacctcagcaacccccgaaactttgtgacaaagatcagccgttacaacaaggtggtgaacatccctaacagcatgacaatattggacgaactcctgcctatctcagtggagatggcgaaaaggaatctgcggggcatctataatttcaccaaccctggcgtcgtcagccacaacgagatcctggagatgtacaagcagtacatcgaccccagcttcaagtggacaaacttcactctcgaggagcaggccaaggtcatcatcgcaccccggagcaacaacgagatggacgcgagcaagctaaagaaagagttccctgagctgctgtcgatcaaagactctttgatcaagtatgtcttcgagcccaataggaaggtgcctgtaaactgaagagccagcacagccgatactatagaaaatacagcaactcattataagcaagcatgtagaagccatttgtcgcaaacaattcgttagaatgtttattcatcatacttagcagcatatctccactataggttgattcacagctgaatagacaatacatatatctggcaatctgttgatggcagtatgatgattgctcaatttgttgtagaggcttatcgcctattttacggagttcaaatgttcagtctgggtgtaccaccacttttgttctgtcaggaatgattctccactctttaatccgctggctcctactcgctcagttccaaattgttggtcgttttggcaaa

SEQ ID NO: 12285 - DNA, 2703 bp, Lupinus angustifolius
cacattttccattttccattttcaattttcaattttccatttctacttttctctgcaatacaagttatatttattgtcttcgctttttctcttcttcctcatttcgtgggtattcatcagagttaccaaattaaacgcttgatatggccactcataccccaaaaaatatcctcattactggggctgctggatttatagcatctcactttgccaaccggcttgtccggaactatcctgagtacaaaattgttgtgcttgacaaacttgattactgttctaatctgaagaaccttattccatcaaaatcatctcccaatttcaagtttgtgaagggggatattggaagtgctgaccttgtcaactatcttctcatcactgaatctatcgacacaataatgcactttgctgctcaaactcatgttgacaactcatttggtaatagctttgagttcactaagaacaacatatatggcacacatgttttattagaagcttgcaaggtaactggacagatcaaaaggttcatccatgtgagcactgatgaggtttacggagagacagatgaggatgctattgtcggaaaccatgaggcttctcagctacttcccacaaatccatactctgcaacaaaagctggggctgaaatgcttgtcatggcatatggtaggtcttatgggttacctgtgatcacgacacgtggaaacaatgtctatgggcctaatcagtttcccgagaagttaattccaaagttcatcctcctggctctgcaaggcaagcctcttccaattcatggggatggttctaatgtgagaagttatttatattgtgaagacgttgctgaggcttttgaagtcatccttcacaagggagaggttgggcatgtttacaatattggaaccaagaaggaaaggagagttattgatgtagcccaagatatatgcagacttttctcgatggacccagatgctagtataaagttcgtagagaacagaccatttaatgaccagagatacttccttgatgatgaaaagctaaagatcttgggctggtccgagaggaccacttgggaagaggggttgaagaaaaccttagactggtataccaagaatccagattggtggggtgatgttagtggtgcattgcttcctcatccaaggatgctgatgatgcctggtgggctagagaggcatctcgatggatctgaagacgaaaaacccgagtcatatgtctcaactaatactcgaatggtggttccaccgtccaagagtgttggggcctcacagaaacatcctctaaagttcttgatctatggtagaacaggatggatcggaggcttgctggggaaattgtgtgaaaagcaagggattccgtacgaatatggaaaagggcgcttagaggatcgctcatcactcgtggctgacattcaaagtgtgaaaccaacacatatttttaatgctgctggagtgactggcagacccaatgttgattggtgtgaaactcataaaacagaaaccatccgcgccaatgttgctgggactttaacgttggctgatgtgagcagagagcatggactcttggtgataaattatgcaactgggtgcatatttgagtatgatgcagctcatccagagggttctggcattggttttaaggaggaagacaaacccaacttcatgggttctttctattccaagacaaaggccatggttgaggagctattgagagaatatgacaatgtatgcaccctcagggttcgcatgccaatttcatcagacctgagtaatccacgcaatttcattaccaagatttctcgctataacaaggtagttaacattccaaacagcatgactattttggatgaacttctgccgatttcgattgagatggcaaagaggaacctgaggggcatatggaacttcacaaatccaggggctgttagccataatgagattctcgagatgtacagggattacattgatcccaacttcaagtggagtaacttcacactcgaagagcaagccaaggtaatagttgcagcaagaagcaacaatgagatggatgcctccaaattgaagaatgagtttccggagttgctttccatcaaggaatcactggtcaagtttgtctttgagccaaacaagaaaactgcttaaaaaggttaaggcactttcattcttgagagacatcacagttattctctgcatttttgtgtctggctacacagatcactggttgtttaattagtagctccatctagttattttaaagggtgaaaagtattatcatttgtgttaggcttggttcctaagttttcattgctacagctttattattatagttttctagtgtgctcttttaagcttgtagtgagcaacttttgcatcctgcaagacatttattcttttatggttcatatatatcccttttgtgggttatgcttgtattgtatttgcacttctctatgcaattgaaagcatgctacggatatattcattttatttcatccagttaaagaagttagtgtgtgatgtaaacacttgaaattgtgtgcaaaatacaattatgataacagtggggtttttggtccttgataaaaatatgaagtagcttcatgttcatgcagttttctcttctgtatgccctatttgggcctcaatgatgtgaaatattcaagtgaggcttgaaagaaaaatacaaacttga

SEQ ID NO: 12286 - DNA, 2392 bp, Mimulus guttatus
atcaagcaacaatgtcgacattcacaccgaagaacatcctaatcacaggtgctgctggattcatcgcatctcatgttgcaaacaggcttgtacgaacgtacccgggatacaaaatcgtcgtcctcgacaagctcgattactgctccaatctcaagaaccttctcccatcgaactcttctcccaacttcaagttcgttcagggtgacattggcagcgctgacctggtcaactaccttctcatcaccgaaaacatcgacactattatgcacttcgccgcccagacccacgtcgacaattcgttcggcaacagcttcgagttcaccaagaacaacatttacgggacccacgttcttctcgaggcctgcaaagtcaccggccagatcagaaggtttatccacgtcagcacagacgaggtctatggcgagaccgacgaagatgctgttgtgggcaatcacgaggcctcgcagcttctccctacaaacccgtactctgcgacaaaagcaggtgctgaaatgcttgttatggcttacggtcgatcttacgggttacccgtgattacgacccgtgggaacaatgtatacgggccgaatcagtttccggaaaagttaattcccaagttcatccttttggctatgaggggaaagactctcccgattcacggcgatggttcgaacgttcgaagctacctctactgcgaggatgtggcggaggcgttcgaagtgattctccacaagggggaagttggtcatgtttacaacattgggacaaagaaggagaggagggtgacagatgttgcgagagatgtgtgcaatctgttcaacatggatccggacaagagcattcagtttgtggagaacaggccgtttaatgatcagaggtacttcctcgatgatcagaagctgacgaatcttggttggtcggaaaggaccacgtggaccgagggtttgaagaagaccatggagtggtacaccagcaatcccgattggtggggtgatgtgtctggtgcactgctccctcatccaagaatgctgatgatgccaggtggactggaaaggcacaccgaagcagctgcgaagggcgaatctggaaaatccgatttttctcttagccagtcgaaaatgctggttccgagtcccaaaagcagcgcttcgcctcacaaaccggctttcaagttcttgatctatggcaggactgggtggattggtggtttgttgggtaaactgtgtgagaaacaggggatttcgtatgaatatggaaaggggcgtttgcaggatcgtgcgtcgattttggcggatcttgttgctgttaagccgacgcatgtttttaatgctgccggtgtgacgggtcgacccaatgttgactggtgtgagtctcacaagactgagactatacgcacaaatgttgctggtactttgaccttggctgatgtgtgcagagagcacgggctattggtggtcaacttcgccactggctgtattttcgaatacgatgctgctcatccggaaggttccggaatcgggtttaaggaggaagacacgcccaatttcattggctctttctattcaaagaccaaagccatggtggaagagctcttgaaagaatacgacaacgtgtgcacgctgagagttaggatgccgatttctgctgacctggacaacccgcgaaacttcatcacgaagatttcccgttacaataaggtggtcaacattcccaacagcatgacaatcttggacgagcttcttccgatttcaattgagatggcaaagaggaatctcagggggatttggaacttcacaaaccctggtgttgttagccacaacgagatcttggagatgtacaaggagtatattgacgccgatttcaaatggtcaaacttcacccttgaagagcaagcaaaggtcataattgcccctaggagcaacaacgagctcgatgcatccaagctcaagaaagagttccctgagctgctctcgatcaaggagtcactgatcaagaatgtgttcggaccgaacaggaaaacccccaaaactgctgcataagtgcgcgtgcgtttcgagattctcaacccgtgagcttctttatacattttgtgttagttgatatacaactggttgattatgtatgttagtttttactggcctaaatctttatttggtgccgtctttcgtttttttttcttagaaactacatcggtgaaatttgttctggtggcagatttttgccagatttttacagtttgataggctcatgcatatgtactgagcttatagtgttttaaaaactatcaagtgaagattattgcacatcatatgagtgcaattcttttccttttctttttatttatttcataattcttatttcttaattttaacttgttaagtgtttttcaaaa

SEQ ID NO: 12287 - DNA, 2408 bp, Brassica rapa
gttttctgagacgctcgttagatcctttctcctcctcctcttcttcactcttatatttattcctcttatctctccacatctcgagatcttcttcttcttcaagcttaggttgatcttgatccgattcgactcgatattattataattgttcacatcgcaatggctacatataagcccaagaacatcctcatcaccggagcggcgggattcatcgcctcccacgtggcaaacaggctagtccgcacctaccccgactacaagatcgtggtcctcgacaagctcgactactgctccaacctcaagaacctcaacccttccaaatcctcccccaacttcaagttcgtcaagggcgacatcgccagcgccgacctcgtcaactaccttctcatcaccgagaacatcgacaccatcatgcacttcgcagctcaaacccatgttgataactccttcggtaacagctttgagttcaccaagaacaatatctacgggacccatgtgcttttggaggcttgtaaagtcactgggcagatcaggaggtttattcatgtgagtactgatgaggtttatggagagactgatgaggatgcttccgtggggaatcatgaagcttctcagttgcttccgactaatccatattctgctactaaggcgggtgctgagatgcttgtgatggcgtatgggagatcttatgggttgccggttattactactcgtgggaataatgtttatggtccgaatcagtttcctgagaagttgattcctaagtttattctgttggctatgagtgggaagccgcttccgattcacggagatgggtctaatgtgaggagttatctctactgtgaagatgttgctgaggcgtttgaggttgttttgcacaaaggggaggttaaccatgtttataatattgggacgacgaaagagaggagagtgattgatgtggctaatgatatctccaagctctttgggattaaccctgactccaccattcagtttgtggagaaccggccttttaatgaccagaggtacttcctcgatgaccagaagctgaagaaactggggtgggcggagcgaaccacttgggaggaagggttgaagaagactatggagtggtacactgcgaaccctgagtggtggggagatgtttctggagctctgcttcctcatccaaggatgctgatgatgcctggtgatagactttgtgatagtggtgacgagcacaaggatgctgatggtaatcagacgttcacggtggttactccccccaagactggtggttctggagacaataaaacgtccttgaagttcctcatctatggtaaaactgggtggctcggtgggcttctagggaaactctgtgagaagcaagggattgcgtacgagtatgggaaagggagactggaggacagagcttctcttgtggcggatattcgtagagtcaaacctactcatgtcttcaatgcagccggtttaacgggtagacccaatgtagactggtgtgagtctcacaaaacagagaccatccgagtgaacgttgctggtactttgactctggcagatgtttgcagagagaatggtctgttgatgatgaactttgccaccggttgtatatttgagtatgacgctgcacatccagaaggttcagggattggcttcaaggaagaagacaaaccgaacttcaccggttccttctactcaaaaacaaaggcaatggtggaagagcttctaagagaatttgacaacgtctgcaccttgagagtgcgtatgccaatctcatccgacttgaacaacccacgaaacttcatcaccaagatctctcgttacaacaaagtggtgaacatcccaaacagcatgaccatactagacgaactcttaccaatctcaatcgagatggcgaagaggaacctgagggggatatggaacttcaccaatccaggagtggtgagccacaacgagatactagagatgtacaagagttacatcgagcctggtttcaaatggtccaacttcactttggaagaacaggctaaagtcattgttgcaccgcggagcaacaacgagatggatggtgccaagctcagcaaggagtttccagagttgctttccatccaagactcgttgatcaaatacgtcttcgaacccaacaagagaacgtaagagcctctcgttaagaatacactacacacttcctctttctctgttcattgttatattatcctgcaggtagtttcactgtatctcatgattctactttaatttgatttgatttatcatgtaattcatttactcctttttggtactctacgacaaaacacatctttgtttacattaatattattacagatttatctgagttttattttatacactatagattcctgttcctattgtaattctttttgttttca

SEQ ID NO: 12288 - DNA, 2485 bp, Gossypium hirsutum
ctcccatactctaaatttctctcttttccttcttctatcaaaacgttctatctctgtaattttgttttcgattgctgtatctggattttgattgatttctctccaacttaattgaatatggcttcttataaacccaagaatatcctgataactggggctgctgggtttattgcatctcatgttgccaatcggcttgttcggaactaccctgagtacaagatcgttgtacttgataagcttgattactgctcaaacacaaaaaacctctttccttccaagttatccccaagctttaagtttgtgaagggggacattgaaagtgctgatcttgttaactatcttcttatcacggagtctattgacacaataatgcactttgcggcacaaactcatgttgataattcatttgggaacagtttcgagtttacgaagaacaatatttatggcactcatgtcctacttgaagcttgcaaagtcactggtcagattaggaggttcatccatgttagcaccgatgaggtttacggggagacggacgaggatgcagttgttggaaaccatgaagcttcccaacttctcccaacaaacccatattctgcaacaaaagctggtgctgaaatgcttgttatggcatatgggaggtcatatggattaccagtaattacgacccgtggaaacaatgtttatggtcccaatcagtttccggaaaaattaattcccaagtttatcttattggcaatgagggggaagactcttccaattcatggggatggttctaatgtgaggagttatttatactgtgaggatgttgctgaagcatttgaagtcattcttcacaagggtgaagttggtcgtgtttataatattggcacgaagaaagaaaggagagtgattgatgtagccaaagatatatgcaaacttttctcgatggatcctgagacaagcatcgagtttgtcgaaaacagaccgttcaatgaccagaggtattttcttgatgatcagagattgaagaacttgggatggtccgagcgaactgtatgggaagacgggttgaagaagaccatagaatggtacactcaaaaccctgattggtggggtgacgtgactggtgcgttgcttcctcacccgagaatgttgatgatggctggaagtacacacttcgattccgaggacagcaaagagacatcatatgtaagtggtcccaatcagacccgaatggtggttccaacccccaagggtggtagctctccccaaaaacaatccttgaagttcttgatctatggcaggaccggctggataggtggtttacttggtcagttatgcgagaaacaaggtattgccttcgcatatggaaaaggacgcttggaagatcgttcatcactcaatgcagatattcaaaatataaagccgacccatgtgtttaatgctgctggtgttacaggcagacctaatgttgattggtgtgaatctcacaaaacagaaacaattcgtgccaatgtggctggtactttaaccttggcagatgtttgcagagaccatgggctgttgatgatgaattttgctaccgggtgtatatttgagtatgatgctgcacatcctcagggctctggcattggatttaaagaggaagataaacccaatttcattggttccttctattcaaaaaccaaggctatggttgaagagctgttcaaagagtatgacaatgtctgcacccttagagttcgaatgccaatctcatctgacctaaacaatccacgcaacttcatcaccaagatttcacgctacaacaaagtggtcaacattcccaacagcatgacagtcttggacgaacttctaccgatatcgatcgagatggcaaagaggaacttgaggggtatatggaacttcacaaaccctggggttgtgagccacaatgagatcctcgagatgtacaagacttacattgaccccaagtttaagtgggaaaacttcacattagaagaacaagccaaggtgatcgttgcaccccgaagcaataacgagatggatgcatccaagttgaagaaggagttccctgagttgttgtcaatcaaagaatcactgattaagtatgcctttgaaccgaacaggagaacctgagcttattaagcaggtttcagcttatagatcctatactttctgcacctaatattttatgaccgggaatatcttttaagcttcactcttttgctaccgttatcttccaccaaattagtttacttgagctacaaggtattaacctatgttgcttagactcttcgtttttttggagtatacatgtccaatccatattttgaagtataaatatctatgctcaatactcagatttgagttctgtaggtatcaggtcaggtgtactattttttgtattttgttagttgaattttttcggcttttaacactcttgtactggtttctaatggaagatattgctttattgcataaaatctgatatttcaatttc

SEQ ID NO: 12289 - DNA, 2512 bp, Lippia dulcis
actcctcctatatataaggcggagaggttgcttggggcatctcgctactcagtcatctcttttggtctaattgtttcccttctctctctgacttgaattcagttttctctttttggagagggaatatttgaattctctccgatttgtttcccttttggtggatcctgatccgagcaactggaaataatataacgtcccacaatgtcgacattccaacccaagaatatcctcattactggggctgctggattcattgcatcccatgttgcaaataggcttgtccgaaactatccccactacaaaattgttgtccttgacaaacttgattactgttccaatcttaaaaaccttcttccatctaactcttctcccaacttcaagtttgtcaagggcgacattggcagtgctgacctggtcaactatcttctcatcactgagaacatcgacactataatgcactttgctgcccagactcatgttgataattcttttggaaacagttttgagttcaccaagaacaacatttatggcacccatgttcttctcgaagcctgcaaagtcactggccagatcagaaggtttatccatgtcagcacagatgaggtctatggagagactgaggaggatgccgttgtgggaaatcatgaggcatctcagctattgcccactaacccatattctgccaccaaagcaggagctgaaatgcttgttatggcttatggtagatcttatgggttgcctgtgataacaaccagaggaaacaatgtttatggcccgaatcagtttcctgaaaagttgattcccaagtttatccttttggccatgagaggacaaactcttccaattcatggggatggttctaacgttagaagctacctgtattgtgaggatgttgctgaggcattcgaaacagtcctccacaagggagaagttggccatgtttacaacattggcacgaagaaggagcgaagagtcattgatgttgcaacagacatttgcaagctattcaacatggatcctgacaaaagcattaagtatgtggagaacaggccatttaatgatcagaggtacttccttgatgatcagaagctaaagaatttgggctggtttgaaaaaaccacatgggaagagggattgaaaaagaccatggaatggtataccagcaatcctgactggtggggtgatgtatctggtgcgttgattcctcatccaagaatgctgatgatgcctggtgggctggatagacattcagatggatccgagaagtctgctaaatgtgaagtctctgaaaatgcaaacctgacaaaaatggtggttccaacttccaaaaccaactcgtctcctcagaaacagggcttcaagttcttgatctatggtaaaaccggctggattggtggtttgcttggaaaattgtgtgagaaacagggtattgcttatgaatatggaaagggacgtttacaagatcgtgcttcgcttgttgcagatatccttgctgttaagccaacgcatgtctttaatgctgctggtgtaactggtagacctaatgtagattggtgtgaaactcacaaaactgaaactattcgtaccaatgttgttggcacgttgactttggcagacgtatgcagagaacatgggctcctgatgatgaactatgctactggttgtatatttgaatatgatgctgcacatcctgaaggttcaggtattgggttcaaggaggaagacacaccaaatttcgctggctctttctattcaaagaccaaggccatggtggaagatctcctgaaagaatatgataatgtttgcacactcagagtccgtatgccgatatcctctgatctcagcaacccacgcaatttcatcacaaagatctccaagtacaataaggtggtcaacatccccaacagcatgacaatcttggatgagcttctaccaatttcgatcgagatggcgaaacgaaaccttaggggaatatggaacttcacaaatcccggtgttgtcagccacaatgaaatcttggacatgtacaaggattatattgacccagattttaagtacaccaatttcactctggaagagcaagcaaaggtcatagttgccgccaggagtaacaatgaaatggatgcatccaaattgaagaaagagttccctgagttgctatccatcaaggaatcgttgatcaagaacgtttttgaaccaaacaggaaacccccgttgcataagtgtgagttttgtcaactcgtgggctgcttgcattttgtattctttacgtgtttaagttagtttaaaagcctcagctgatttttttaggtactgccctttacttgtttagaatccatattggtggaattggttgatagatgtcgctgtttgataagtaccttattcataagttgctggtgcatattttctgcatgcgtgctggggtgtaacatttttaaactattaaaagacgttgatacccgtttatatggcttagtgaatgcgattttagtcgttttcgtttcagtag

SEQ ID NO: 12290 - DNA, 2342 bp, Citrus sinensis
acagatcaccccttgtcagtcgtctctgtactctctcaaggctcaagtctctactactctttctctgtttctcagctccgtctgagatttcacagctcaccccattaccaaccaacaaaacaaatttcgaaggaagcaccaaaaaaacagaaaaaaaaaaagacaagctgttgttggaatggctactgtttacacgcccaagaacattcttattactggagctgctggcttcattgcatcccatgtatgcaaccgtctcattgggaactacccggagtacaagattgttgttcttgacaaactcgattactgttcaaacctcaagaacctgaacccctcgcgattgtctccgaactttaagttcatcaagggagatgtcgctagtgctgacttggttcacttcattctcctaaccgaaaagattgataccattatgcactttgctgctcagacccatgttgacaactccttcggcaacagctttgagttcactaagaacaacatttatggaacacatgttcttctcgaagcctgcaagatcacagggcaaatcaagaggtttatccatgtcagcactgatgaggtttatggggaaactgacgaggatgccgtggtggggaaccatgaggcttctcagcttttgccgacaaacccttattctgccacaaaagctggggccgagatgcttgtcatggcctacgggcgttcgtatggcttgcctgtgattactactagaggaaacaatgtgtatgggcccaatcaatttcctgaaaagctgattccaaaattcatcctcttggctatgaaaggaaagcctcttcctattcatggggatggatcaaatgtgaggagttatctctactgtgaggatgttgctgaggcatttgatactattctccacaaaggagaagtaggccatgtgtacaatattgggacgaagaaagaaaggagagtgattgatgtggccacagacatctgcaaacttttctctttgaacccagatactcagattaagtttgtggagaataggccatttaatgaccagaggtatttcttggatgttcaaaagctgaaacaattaggttggtatgagcgggttacctgggaagagggtctgcaaaagacaatgaaatggtacatcagcaatcctgattggtggggtgatgttagtggtgctcttctccctcatccaagaacgtcgatggcacctgcaattgaagggaaagttgatggacatgatactactttcatgctcaagataaataattctagccagagccgaatggtggttcgagcttccaagagcaattcctctagacagaagccattcctgaagttcttgatttatgggagaaccgggtggatagggggccttctttcgaagatttgtgaaaagaaagggatacccttcgagtatggaaagggacgcttagagaataggtcacaactcttggctgatattcaaaatgtgaagccaactcatgtcttcaatgcggctggagtgactggaagacccaatgtggattggtgtgaaactcataagcctgagacaattcgcaccaatgttgtaggcacattgaccttggcagatgtctgcagagagaatggcctacttatgatgaattacgctactggttgtattttcgaatatgatgctaagcatccagagggtacgggaattgggttcaaggaggaagacaaacccaatttcactggctctttctattctaaaaccaaagccatggttgaagagcttttgaaagaatatgataatgtttgtaccctcagagtccgaatgcctatttcttctgatctcaacaatccccgtaactttatcacaaagatttcacggtataacaaagtggtgaacattcctaatagcatgactatcttggatgagcttctaccaatttcagttgagatggcgaaaaggaatttgagtggtatatggaacttcacaaaccctggtgttgtgagtcacaatgagattctagagatgtacaaggcctacatagaccctggttttaagtggactaatttcacactcgaagaacaggctaaggttattgttgcccctcgaagcaacaatgagctcgatgcatctaagttgaagaaggagttccctgagttgttatctatcaaggagtcgctgataaaaaatgtcttcgaacccaacaagaaacccactttcggtggagtggcaaaataagcattccatgaatgcaaaaccctcagattgatccccgcacttctttgggtaatggtgtttctgatagactgaaccattattatttttgtaatcaatcatcagctttagtttaacatctatgtgttccactctt

SEQ ID NO: 12291 - DNA, 2486 bp, Phalaenopsis aphrodite
cgggttgggaggaaattggagctcggcgataaatctgttggcaatcgatccgtctcttcggtgaaatctggcttaattctttccctcggactcaagagagaatcggctgctctcttcattcgtgtggtacattttgatcgagtttagttccacactctcggtttgaaagacttggatctatttcagcaaccagaaagcaatggaatcctataagcctaaaagcatcctcattactggagctgctggtttcatcgcatcacatgttgccaacaggctcatccgcaactaccccgattacaaaattgtggtcctcgataaactcgactactgctccaaccttaaaaacctttccccttctggatattcccccaacttgaagtttgttaagggcgacatcgccagtgctgatcttctccactaccttctcatcacggagtccatcgacacaataatgcacttcgcagctcaaactcacgtcgacaattctttcggcaactcctttgagttcactaaaaacaacatctatggaactcatgttctgcttgaggcatgcaaggtctccggtcaaataaggagatttatccatgtcagcacagacgaagtttatggggaaaccgatgagaatgccattgtcggcaaccatgaagcctctcagctcctccctacgaacccgtattctgccaccaaagccggagctgaaatgcttgtgatggcttatggaaggtcctatggcttacccgtaataaccactcgtggtaacaatgtatacggaccaaatcaatttccggaaaagttgattccaaaattcatccttctagcaatgagaggacaaacccttccgattcatggagacggttcgaacgttcgaagctacctctattgtgaggatgttgccgaggcttttgaggttattcttcatagaggggagatcggccatgtttataatattgggacaaagaaagagaggagagtgattgatgtagcaaaagatatttgtaagcttttcgcgcgggataccaccaccgcaattaagttcgtcgacaacagaccgttcaatgaccaaagatactttctcgatgatcagaagctaaaaattttgggttggtcagaaagaactacttgggaagagggtctgaaaaagactatggattggtacacaaacaatccggattggtggggagatgtctcaggagcacttttaccacatccaagaatgctaatgatgccaggcactgaaagacattccgatggccctgaagagataataaagagcatgttgtctccgccaaacaatattaacattccaagccaattgataacaccacctgtctcagaaacctcatcttttggtatcaaaacacagtctttgaagtttttgatatacggcaaaaccggatggatcggcggccttctcgggaagatatgtgagaagcaagggatatcgttcgagtacggaaaaggcagattagaagatcgatctcagctccaatcggatattcataatgtgaagccgacacatgttttcaatgctgctggtgtcactggcaggccgaatgtcgactggtgtgaatctcatcgactagaaactatccgcaccaatgttgttggaactttgaccctagctgatgtttgctccgagaatagtttgttgctcattaattatgcgactggatgtatttttgaatacgatgctaatcacccagaaggctcaggctatggattcaaggaggaagatagcccaaacttcgttggttcctactactcaaaaacaaaggccatggttgaggagcttctgaaggagtacgacaacgtttgtactttaagagtccgaatgccaatatcatctgatctaaacaatccccgtaacttcatcacgaagatcagtcgatacgacaaggtggttaatatcccaaacagcatgactgtattggatgagttgcttccaatatcaatcgagatggctaagagaaattgcaggggaatatggaacttcaccaacccgggtgttgtgagccacaatgagatcttggagctttacaaggcttatgttgatcccggcttcagttgggtcaactttacactcgaagaacaggcgaaggtgatcgtcgcgcctcgcagcaataacgaactggatgcttcaaagttgaagaacgagtttccggagctgctgtcgattaaagaatctctcataaaatatgtgttcgagcccaacgggaagcaggtgaagtgacgctatggatgggataatcttttggcgagaaggttcttctttttcttttgaaataaaaggaaatactaattgttagaatgaatttggtagttagtcttatgttttgatcagcatgaccacaaagaccatgactttaataactatagaatttctttatgtttgaagaagtatttggtatagatttggttcaaatacactattgtttgatgtgggtatttctttttgtctatctgcaatttgttttaatgagaatgat

SEQ ID NO: 12292 - DNA, 2386 bp, Panicum virgatum
caggatttcagaaacaatcatacaggggatatggcgacaaattataaacctaagaacatccttattacaggagctgctggctttatcgcctcccatgttgcgatccgcattaccaagaagtaccccgattacaagatcgtcgtccttgacaagcttgactactgctctaatctgaagaacctgcttcctgtgagctcatcgccaaacttcaagtttgtcaagggagatattgcaagtgctgatcttgtcaatttccttcttgtcacggagaacattgataccataatgcacttcgcagcccagacacacgttgacaattcatttgggaattcctttgaatttaccaagaacaacatttatggtacccatgttcttcttgaggcctgcaagatcactggccagatcaagagattcatccatgtcagcactgatgaggtctatggggaaactgatgaggatgcagttgttggaaacaaggaggcatcacagctgctccccacaaatccatatgcagccaccaaagctggagcagagatgcttgtaatggcatatgggagatcctatggcctgccggttatcactactcggggaaataatgtctatggccctaatcagttccctgagaagcttatcccaaagttcattctcttggccatgagaggggagcccctccctatccatggtgatggaaccaatgtccgtagctacctctattgtgaggatgttgcggaggcatttgaggtgattcttcatcatggagaagttggacatgtttataatattggaacaaagagagagaggacggtcattgatgtagctaaagatgtttgcaagctgttcagtttggaagctgacaaagtcattatgtttgtcgagaacagacctttcaatgatcagaggtatttcttggatgatgagaagctcaagagccttggatgggctgagcgcaccccatgggaggaaggcttgaagaagacaatggaatggtatgttgcaaattctgattattggggtgatgtttctggtgcattgctgcctcatccgaggacgttaatgatgcctgggtatgagggctctgtggagattaaaggaatactcagtcagtttaataacattaggacaaaggtggattcaacgtcagatagtgctccagaaacgcatgccttcaagttcttgatatatggtaggacaggatggattggtggacttcttggaaaaatatgtgagaagcaaggaattccatatgaacatggaaaaggtcgcttgcaagatcgttcttcgctcatcctggatattcaaactattaagccaacacatgtcttcaatgctgctggtgttactggcaggcccaatgttgactggtgtgaatcacacaagccggacactattcgtaccaatgttgttggcaccttgactctagctgatgtgtgtagagagcatggcttattgatgatgaattatgccactgggtgcatatttgaatatgacgcacatcatccagaagggtcaggtatcggcttcaaagaggaggatacaccaaattttactggttcgttctactcgaagactaaggcaatggttgaggagctattgaaggagtatgagaacgtctgcaccctacgagtccggatgccaatatcttctgacctcagcaacccccgaaacttcgtgacaaagatcagccgttacaacaaggtggtgaacatccctaacagcatgacaatattggacgaactccttcctatctcagtggagatggcgaaaaggaacctgcggggcatctataatttcaccaaccctggcgttgtcagccacaacgagatcctggagatgtacaagcagtacatcgaccccagcttcgagtggacaaacttcactcttgaggagcaggccaaggtcatcatcgcgccccggagcaacaacgagatggatgcgagcaagctgaagaaagagttccctgagctgctgtcgatcaaagactcattgatcaagtatgtgttcgagcccaataggaaggtgcctgtaaactgaagagccagcacagtcgatactatagaaaatacagcaacccattataagcaagcatgtagtagccatttgtcgcaaacgattcgttagaatgtttattcatcatacttagcagcatatctccactataggttgattcacagctgaatagacaatatatatatatatcgggcaatctgttgatggcagtatggtgattgctcaatttgttgtagaggcttatcacctattttacggagttgaaatgttcagtctgcgtgtaccaccacttgtgttctgtcaggaatgatcctccactctttaatctgctggctcctatcaatttaacagctacattcagttctttagctcaagattt

SEQ ID NO: 12293 - DNA, 2359 bp, Eutrema halophilum
gttttggttgcagatattggtgataccaaatggctactacatataagccaaagaacattctcatcactggagctgctggattcattgcctctcatgttgccaacagactaatccgtagctatccagattacaagatcgttgtgttggacaagcttgattactgttcagatctgaagaatctcgatccttcattttcttcaccaaacttcaggtttgtcaaaggagatatcgcgagtgatgacctcgttaactaccttctaatcactgaaaacatcgacacgatcatgcatttcgctgctcagacccatgttgataactcttttggtaatagctttgagtttaccaagaacaatatttatggtactcacgtcctcttggaagcctgcaaagtaacaggacagatcaggaggtttattcatgtgagtaccgatgaagtctatggagaaaccgatgaggatgctgctgtaggaaaccatgaggcttctcagctgttacccacaaatccatactcagctactaaggctggtgctgagatgcttgtgatggcttatggtagatcatatggattaccggttatcacaactcgtgggaacaatgtttatgggcctaaccagtttcctgaaaaactgattcctaagttcatcttgttggctatgagtgggaagccgcttccgatccatggagatggatctaacgtgaggagttacttgtactgtgaagatgtagctgaggcatttgaggttgttcttcataaaggagaagttggtcacgtctacaatatcgggacaaagagagaaagaagagtgatcgatgtggctagagacatctgcaaactattcgggaaagatcctgagtcaagcatccagtttgtggagaatcgtccctttaacgatcaaaggtacttccttgatgatcagaagctgaaaaaattgggttggtcagagcgaaccgcgtgggaagatgggttgaagaagacaatggaatggtacactcagaatcctgagtggtggggtgatgtatctggagctttgcttcctcatccgagaatgcttatgatgccaggtggaagactttcttctgatgagaagaaagacgcgtcaagcaacacggtccagacatttactgttgtgacaccaactcacaacaagaccggtggttctagtgacaaagcctcgttgaagtttttgatctatggtaagactggctggattggtggtcttctagggaagctatgtgagaagcaagggattgcgtatgagtatgggaaaggacgtttggaggatagagcttctctcttggcggatattcgtagcatcaaaccgactcatgtctttaacgcagctggtttgactgggaggcctaatgttgactggtgtgaatctcacaaaccagagactattcgtgtcaatgtcgctggtactttgactcttgcagatgtttgtagagagaatggtctgttgatgatgaatttcgccaccggttgcatctttgagtacgatgctgcacatccagagggctccggtataggtttcaaggaagaagacaagcctaatttcactggttctttctactcaaaaaccaaagccatggttgaggagcttctgagagagtttgacaatgtatgtacattgagagtgaggatgccgatctcatcagacctaaacaacccacgaaacttcatcacaaagatctctcgctacaacaaagtggtgaacatccccaacagcatgaccatactggacgagcttctcccaatctccatcgagatggcaaagagaaacctaagagggatatggaacttcaccaacccaggggtggtgagtcacaacgagatactggagatgtacaagagttacatcgagccaggatttaaatggtccaacttcacagtggaagaacaagcaaaggtcattgttgctcctcgaagcaacaatgaaatggatgggtctaagctaagcaaggagttccctgagatgctacccatcaaagaggcactgatcaaatacgtctttgaaccaaacaagagaacctgagcactcaatgaacaacacactctttaccccgagtgcttacctatactgtttcttttctttctttctttttttcacttctttctacaaatttgtcattttatgtttaatcgtcgttttacaatccttgtaggtagtttcactatactgattctactaaaatatgatttatcattattatttataaagacgagagtttttccttttctcaaatcctacattttcccttctaagacattataaaaacgaagagtcacgtactggttgggaccattagggattccaccaaggcaggttcaaaacacttgaacttgatcgctaggctataa

SEQ ID NO: 12294 - DNA, 2277 bp, Chrysanthemum coronarium
tcactcattgccttcattctttctttctttcttcaaattttcatagggttacgacatgactagttatacgccaaagaatatcctcataaccggggcggctggttttattgcctctcatgtcgctaatcgccttgtgagaagctaccctgattacaagattgtcgtgctcgacaagcttgattattgctccaatcttaagaatcttaacccgtctcgatcttctcctaattttaagtttgttaagggggatattgggagtgctgatctggtgaattatcttttgattaccgagaatattgatacgattatgcactttgctgctcaaactcatgttgataattctttcgggaatagttttgagtttactaagaataacatttacgggacacatgtgttgttagaggcgtgtaaagtgactcgtggtcagattagaaggtttattcatgttagtacggatgaggtgtatggtgaaacggaggaggatgctgttgtggggaaccatgaagcgtcacagcttcttcctactaatccgcattctgccacgaaggctggtgcggaaatgcttgttatggcttatggtaggtcatatgggttgcctgtgattaccactagaggtaacaatgtgtatggcccaaatcagtttcctgaaaagttaatcccgaagttcattcttttggctatgagagagcagccacttcctattcatggtgatgggtcgaatgtgaggagttatctttactgtgaagatgttgctgaggcttttgaagtcgttctccacaagggtgaagtcggtcatgtttacaacattggaaccaagaaggaaaggcgagttaatgatgttgctcgtgatgtctgtaatctgtttaatatggatcctgaatcaagtattaagtttgtggagaacaggccgtttaatgatcagaggtacttcttggatgatgagaagcttaagtgtctgggttggtccgaaaggaccacatggcaagagggtctaaaaaagaccatggagtggtacaccagcaatcccgattggtggggtgatgtctctggtgcactgcttcctcatccacgaatgctgatgatgcctggtggagtcgagaaagtcattgacgtccctgaaaacgttcaatctgattcacctcatgcagctgttaactcttctcagtttcaaaaagtggtttctgctgcaaaaaccagtaccaactctgctactaaaccatctttcaagttccttatctatggtaaaacagggtggatcggtggtttacttgggaaaatatgtgagaaacaagggattcagtacgagtatggaaagggtcgtttggaggaccggtcatcaattgttgctgatattaagaatgttaagccaacccatgttttcaatgctgctggtgtcactggcagacccaatgttgattggtgtgaatctcacaagaccgaaaccatccgtacaaacgtctcgggcacactcactttagcagatgtttgcagagatcaagggattttggtgatgaacttcgccactggatgcatatttgagtatgatgccgcacatccagaaggttcagggatcggttttctggaagaggacacgcccaatttcactggttcattctactccaaaaccaaggctatggttgaggagctattgaaagaatacgacaatgtatgcaccctgagggtccgaatgccaatatcatcagacctcaacaacccacgtaactttgtcaccaagattgctcgttacgataaagtggtcaacattcccaacagcatgaccatcttggacgagcttctgcctatttccatcgaaatggcaaagagaaacctcaagggaatctggaactttaccaacccaggtgttgtgagccataacgaggtcctggagttgtacaaacaatacatcaacccagaattcaaatggaaaaacttcacactcgaagaacaagcccaagtgatagttgccccacgaagcaacaacgagttggatacatccaagttgaagaaagagttccctgaattgctatcgattaaagaatcattggttaagtacgtatttgcccccaacaaaaaagcttagtgagtgtcgaaatccccaatggcgtgttatataggtttggatattattacgcgtgtgatatgtttgaacacgaaatttacttgtgatgtttgttcctagtagtaagtaagatgaataccgagagagattatagaaaaggccgagagttcattacatttgttaaaactatagcatattgctattcttgattttattac

SEQ ID NO: 12295 - DNA, 2230 bp, Eutrema parvulum
atattatcgcatggctacatataagcccaagaacatcctcatcactggggctgctggattcatagcgtcccatgttgccaacagattagttcgcagctaccctgactacaaaattgttgtccttgacaagcttgattactgttccaacctgaaaaacctcaatccatctaaatcttcacccaacttcaagtttgtgaagggagacatcgccagtgctgacctcgtcaattaccttctcatcactgaaaacattgacacgattatgcattttgctgctcaaacccatgtcgacaattcttttggtaatagctttgagtttaccaagaacaatatttacggcactcatgtccttctggaagcttgcaaagtcactgggcagatcaggaggttcatccatgtaagtaccgatgaggtctacggagagaccgatgaggatgcttcggtgggaaatcacgaggcttctcagttgctcccgaccaatccatactctgctactaaagctggagctgaaatgcttgtgatggcatatggtagatcatatgggttgccggttataacgactcgtggtaacaatgtttatggtcctaaccagtttcctgaaaagttgattcctaagttcatcctattggccatgaatgggaagccactcccaatccacggagatggatctaatgtgaggagttacctatactgcgaagatgttgctgaggcatttgaggttgttctacacaaaggcgaagttaaccatgtctacaatatcgggacaacgagagaaaggagagtgattgatgtggccaacgacatctccaaactctttggaacagaccctgactccaccattcagtttgtggagaaccggccatttaatgaccagaggtacttcctcgatgaccagaaactgaagaaattgggatggtctgaacgaaccacttgggaagaaggactgaggaagacaatggaatggtacactgagaaccctgagtggtggggagatgtttctggagctctgctgcctcatccacggatgctgatgatgcccggtgatagactctctgatggctgcgacgagcacaaggatgcagatggtaatcagacattcacggtggtaactcccaccaagagtggtagttctggagataaagcatttttaaagttcctcatctatggcaagactgggtggctcggtggtcttctaggaaaactatgtgaaaagcaagggattctgtacgagtatggaaaagggagactagaggacagagcttctctcatggcggatattcgcagcgtcagacctactcatgtcttcaatgccgccggtttaaccggcagacccaatgttgactggtgtgagtcccacaaaaccgagactatccgagtcaactttgctggtactttgactctggcagatgtttgcagagagaatgatctgttgatgatgaactttgccaccggctgtatatttgagtatgacgctgcacatccagaaggttcaggaattggctttaaggaagaagacaaaccgaatttcaccggttctttctactcaaaaacgaaggcaatggtcgaagagctactaagagaatttgacaatgtatgcaccttgagagtgcggatgccaatttcatccgacttgaacaacccgcgaaacttcattacgaagatctcgcgatacaacaaagtggtgaacatcccaaacagcatgaccatactcgacgaactcttaccaatctctattgagatggcgaagaggaacctaaggggaatttggaacttcaccaatccaggagtggtgagtcacaacgagatactagagatgtacaagagttacatggagccgggtttcaaatggtccaacttcactttggaagaacaggctaaggtcattgtggcaccacggagcaacaacgagatggatggttcgaagctcagcaaggagtttcccgagatgctttccatcaaagattcgttgatcaaatacgtcttcgaacccaacaagagaacgtaaaagcctcgttaacacacacatttcctctttctctgttcattgttatattatcctgcatgtagtttcatcactataatgattctactgccataatttgatttgatttatcatatgattcatttactcttttttggcactctacgacgaaacacacctttgtttacattaatgttattacagaaatgaatttttttgagtttttttttcccaatcattattgattcc

SEQ ID NO: 12296 - DNA, 2617 bp, Hordeum vulgare
acaacaggattccagaaattacagtccgatatggcgacaccctacacacctaagagcatcctcattacaggagctgctggtttcatcgcttcccatgtcacaaaccgcattgtacggaactaccctgattacaagattgtcgtccttgacaagcttgattactgctccaatctgaagaaccttctccctgccagctcgtcaccgaacttcaagtttgtcaagggcgatattgcaagtgctgatcttgtcaacttcctcctggtcacagagaacatcgatacaataatgcactttgcagcccagacacatgttgacaattcttttggtaactcctttgaattcaccaagaacaacatttacggtactcatgttcttcttgaagcttgcaaggtcactgggcagatcaggaggttcatccacgttagcactgatgaggtctatggcgagactgatgaggatgcagtggttggcaaccatgaggcctcacagctgctccccacaaatccttattcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctattgtgaggatgttgctgaggcttttgaagtcattcttcatcgtggagaagttggacatgtttacaacattggaacaaagagagagaggacagtcactgatgttgcaaaggatgtctgcaggcttttcaatcttgaagctgataaagtaatccagtttgtcgataatagacctttcaatgatcagaggtatttcttggatgatgagaagctcaagagtcttgggtggtctgagcgcactagatgggaggagggcctgaggaagaccatggaatggtatgtagccaattctgactattggggtgatgtttctggtgcactgttgcctcatccgaggacactgatgatgcctgggtgtgagggctctgaggaaattaaaggaatgctaaatctgtttactaacaatcaaacgaagatggtggctccaacatcagaaggttcttcccaaactcgttcgctcaagttcttgatatatggccggacaggatggattggtggacttcttggcaaaatatgcgagaaacaaggaattccatatgaatatggaaaaggtcgcttggaagagcgcttttccattgtccttgatatccaaactgttaagccaacacatgtcttcaatgctgctggtgttactggcagacccaatgttgattggtgtgagtctcacaagccagacaccatacgtaccaatgttgtgggcaccttgactctagctgatgtttgtcgggagcatgggttattggtgataaactatgccactgggtgcatattcgaatatgatgcaaatcatcctgaaggatcgggcatcggcttcaaagaagagaataaaccaaacttcactggttcattctactcaaagaccaaggcaatggtcgaggaactgttgaaggagtacgagaatgtctgcactctgcgagtccggatgccgatatcgtctgacctcaacaatccccgaaacttcatcacaaagattagccgttacgacaaggtggtaaacatcccaaacagcatgactgtgttggatgagcttttgccgatttcagttgagatggcaaaaaggaacttgcggggcatctggaacttcaccaatcctggtgtggtcagccacaatgagattctggagatgtacaagatgtacatggatcccagctacaagtggacaaacttcacgctggaagaacaggccaaggtcatagttgcacctcggagcaacaacgagatggacgcggcaaagctgaagagagagttccccgagctgctatcgatcaaagactcattgatcaagtatgtctttgagcccaacaggaaggtcccagcaacttgaaagccagaacaggtaataatataggaaacatataccaagcaccaaaagattttaggaatcattcgtcgcggcgattcattagaatgtttttacgatacttggcagcatatctctgttacagattcacagcatcatttgaactatatatttggcagtctgctggtcgcagcaaagatatcttgtaccatgattctgtcaagaaacgaactaatgccgagcacctttaaatcctcttaccttttgtgtgtgaatgatcaggcggcctgtgctctgacaaaaagcatttgaacaagcattttaacttgcatttttttctctctgctcatcgtactgatgctggtgtgtttggtttgacccaagcttgggaaagaagttgcattggttaaccagagcaaagaggaagcactcagaatctattcctccctccgtaaagaaatataagggcgtttagatcactaaaatagtgatctaaacactcttataatttatttacagagggaatagttttcttctttccttctgtacatagaactttttttttcttcaaatgtactgtgcgctgtatgatactatcctcctattg

SEQ ID NO: 12297 - DNA, 2681 bp, Hordeum vulgare
ctccccctccccctcccctccgccgcgtgctgcctacggattccagaaattacagtccgatatggcgacaccctacacacctaagagcatcctcattacaggagctgctggtttcatcgcttcccatgtcacaaaccgcattgtacggaactaccctgattacaagattgtcgtccttgacaagcttgattactgctccaatctgaagaaccttctccctgccagctcgtcaccgaacttcaagtttgtcaagggcgatattgcaagtgctgatcttgtcaacttcctcctggtcacagagaacatcgatacaataatgcactttgcagcccagacacatgttgacaattcttttggtaactcctttgaattcaccaagaacaacatttacggtactcatgttcttcttgaagcttgcaaggtcactgggcagatcaggaggttcatccacgttagcactgatgaggtctatggcgagactgatgaggatgcagtggttggcaaccatgaggcctcacagctgctccccacaaatccttattcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctattgtgaggatgttgctgaggcttttgaagtcattcttcatcgtggagaagttggacatgtttacaacattggaacaaagagagagaggacagtcactgatgttgcaaaggatgtctgcaggcttttcaatcttgaagctgataaagtaatccagtttgtcgataatagacctttcaatgatcagaggtatttcttggatgatgagaagctcaagagtcttgggtggtctgagcgcactagatgggaggagggcctgaggaagaccatggaatggtatgtagccaattctgactattggggtgatgtttctggtgcactgttgcctcatccgaggacactgatgatgcctgggtgtgagggctctgaggaaattaaaggaatgctaaatctgtttactaacaatcaaacgaagatggtggctccaacatcagaaggttcttcccaaactcgttcgctcaagttcttgatatatggccggacaggatggattggtggacttcttggcaaaatatgcgagaaacaaggaattccatatgaatatggaaaaggtcgcttggaagagcgcttttccattgtccttgatatccaaactgttaagccaacacatgtcttcaatgctgctggtgttactggcagacccaatgttgattggtgtgagtctcacaagccagacaccatacgtaccaatgttgtgggcaccttgactctagctgatgtttgtcgggagcatgggttattggtgataaactatgccactgggtgcatattcgaatatgatgcaaatcatcctgaaggatcgggcatcggcttcaaagaagagaataaaccaaacttcactggttcattctactcaaagaccaaggcaatggttgaggaactgttgaaggagtacgagaatgtctgcactctgcgagtccggatgccgatatcgtctgacctcaacaatccccgaaacttcatcacaaagattagccgttacgacaaggtggtaaacatcccaaacagcatgactgtgttggatgagcttttgccgatttcagttgagatggcaaaaaggaacttgcggggcatctggaacttcaccaatcctggtgtggtcagccacaatgaaattctggagatgtacaagaagtacatggatcccagctacaagtggacaaacttcacgctggaagaacaggccaaggtcatagttgcacctcggagcaacaacgagatggacgcggcaaagctgaagagagagttccccgagctgctatcgatcaaagactcattgatcaagtatgtctttgagcccaacaggaaggtcccagcaacttgaaagccagaacaggtaataatataggaaacatataccaagcaccaaaagattttaggaatcattcgtcgcggcgattcattagaatgtttttacgatacttggcagcatatctctgttacagattcacagcatcatttgaactatatatttggcagtctgctggtcgcagcaaagatatcttgtaccatgattctgtcaagaaacgaactaatgccgagcacctttaaatcctcttaccttttgtgtgtgaatgatcaggcggcctgtgctctgacaaaaagcatttgaacaagcattttaacttgcatttttttctctgtgctcatcgtactgatgctggtgtgtttggtttgacccaagcttgggaaagaagttgcattggttaaccagagcaaagaggaagcactcagaatctattcctccctccgtaaagaaatataagggcgtttagatcactaaaatagtgatctaaacactcttataatttatttacagagggaatagttttcttctttccttctgtacatagaactttttttttcttcaaatgtactgtgcgctgtatgatactatcctcctattgattcctttcaaaagatacctgtttccgtgtcac

SEQ ID NO: 12298 - DNA, 2289 bp, Secale cereale
tggttcgcgtgagatctgggcgggcaggggcgcagcgacaccgcgtgagcgccttccccaccacctccccccgtcgtgctttccgccgacccccatcatctcgctctcacgcacacccacaccgccaccgccaccgccgacgccgccattttctccatttattgacgggaagccctctccgctctccccccatccaccgacgccaccgcccctcctcctctccgccgcctgctgcgcacggattccggaaattacagtccaatatggcgacaccctacacacctaagagcatcctcattacaggagctgctggtttcatcgcttcccatgtcacaaaccgcattgtacggaactaccctgattacaagattgtcgtccttgacaagcttgattactgctccaatctgaagaaccttctccctgccagctcgtcaccaaacttcaagtttgtcaagggcgacattgccagtgctgatcttgtcaacttcctcctggtcacagagaacattgatacaataatgcactttgcagcccagacacatgttgacaattcttttggtaactccttcgaattcaccaagaacaacatttatggtactcatgttcttcttgaagcttgcaaggtcactggccagatcaggaggttcatccatgttagcactgatgaggtctatggcgagactgatgaggatgcagtggttggtaaccatgaggcctcacagctgctccccacaaatccctactcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctattgtgaggatgttgctgaggcttttgaagtcattcttcatcgtggagaagttggacatgtttacaacattggaacaaagagagagaggacagtcactgatgtggcaaaggatgtctgcaggcttttcaatcttgaagctgataaagtaatccagttggtcgataatagacctttcaatgatcagaggtattttttggatgatgagaagctcaagagtcttgggtggtctgagcgcactagatgggaggagggcctgaggaagacaatggaatggtatgtagctaattctgactattggggtgatgtttctggtgcactgttgcctcatccgaggacactgatgatgcctgggtatgagggctctgaggaaattaaaggaatgctgaatctgtttactaacagtcatacgaagatggtggctccaacatcagaaggttcttcccaaactcgttcgctcaagttcttgatatatggccggacaggatggattggtggacttcttggcaaaatatgcgagaagcaaggaattccgtacgaatatggaaaaggtcgcttggaagagcgcttttccattgtccttgatatccaaactgttaaaccaacacatgtcttcaatgctgctggtgttactggcagacccaatgttgattggtgtgagtctcacaagccagacaccatacgtaccaatgttgtgggtaccttgactctagctgatgtttgtcgggagcatgggttgttggtgataaactatgccactgggtgcatatttgaatatgatgcaaatcatcctgaagggtcaggcatcggcttcaaagaagaggacaaaccaaactttactggttcattctactcaaagaccaaggcaatggttgaggaactgttgaaggagtacgagaatgtctgcactctgcgagtccggatgccaatatcatctgacctcaacaatccccgaaacttcatcacaaagattagccgttacgacaaggtggtaaacatcccaaacagcatgactgtgttggatgagcttttgccgatttcagttgagatggcaaaaaggaacctgcggggcatctggaacttcaccaatcctggcgtggtcagccacaatgagattctggagatgtataagaagtacatggatcccagctacaagtggacaaacttcacgctagaagaacaggctaaggtcatagttgcacctcggagcaacaacgagatggacgcggcaaagctgaagagagagttccccgagctgctatcgatcaaagactcgttgatcaagtatgtctttgagcccaacaggaaggtcccagcaacttgaagccagaacaggtaataatata

SEQ ID NO: 12299 - DNA, 2467 bp, Secale cereale
aggtggtggttgcgtgagatctgggcgggcaggggcgcagcgacaccgcgtgagcgccttccccaccacctccccccgtcgtgctttccgccgacccccatcatctcgctctcacgcacacccacaccgccaccgccaccgccaccgccgacgccgccattttctccatttattgacgggaagccctctccgctctcccccatccaccgacgccacccctccccctcctcctcctctccgccgcctgctgcgcacggattccagaaatcacagtccaatatggcgacaccctacacacctaagagcatcctcatcacaggagctgctggtttcatcgcttcccatgtcacaaaccgcattgtacggaactaccctgattacaagattgtcgtccttgacaagcttgattactgctccaatctgaagaaccttctccctgccagctcgtcaccaaacttcaagtttgtcaagggtgacattgccagtgctgatcttgtcaacttcctcctggtcacagagaacattgatacaataatgcactttgcagcccagacacatgttgacaattcttttggcaactccttcgaattcaccaagaacaacatttatggtactcatgttcttcttgaagcttgcaaggtcactggccagatcaggaggttcatccatgtcagcactgatgaggtctatggcgagactgatgaggatgcagtggttggcaaccatgaggcctcacagctgctccccacgaatccctactcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctactgtgaggatgttgctgaggcttttgaagtcattcttcatcgtggagaagttggacatgtttacaacattggaacaaagagggagaggacagtcactgatgtggcaaaggatgtctgcaggcttttcaatcttgaagctgataaagtaatccagttggtcgataatagacctttcaatgatcagaggtatttcttggatgatgagaagctcaagagtcttgggtggtctgagcgcactagatgggaggagggcctgaggaagacaatggaatggtatgtagctaattctgactattggggtgatgtttctggtgcactgttgcctcatccgaggacactgatgatgcctgggtatgagggctctgaggaaattaaaggaatgctgaatctgtttactaacagtcatacaaagatggtggctccaacatcagaaggttcttcccaaactcgttcgctcaagttcttgatatatggccggacaggatggattggtggacttcttggcaaaatatgcgagaagcaaggaattccatacgaatatggaaaaggtcgcttggaagagcgcttttccattgtccttgatatccaaactgttaaaccaacacatgtcttcaatgctgctggtgttactggcagacccaatgttgattggtgtgagtctcacaagccagacaccatacgtaccaatgttgtgggtactttgactctagctgatgtttgtcgggagcatgggttgttggtgataaactatgccactgggtgcatatttgaatatgatgcaaatcatcctgaagggtcaggcatcggcttcaaagaagaggacaaaccaaactttactggttcattctactcaaagaccaaggcaatggtcgaggaactgttgaaggagtacgagaatgtctgcactctgcgagtccgaatgccaatatcgtccgacctcaacaatccccgaaacttcatcacaaagattagccgttacgacaaggtggtaaacatcccaaacagcatgactgtgttggatgagcttttgccgatttcagttgagatggcaaaaaggaacctgcggggcatctggaacttcaccaatcctggcgtggtcagccacaatgagattctggagatgtataagaagtacatggatcccagctacaagtggacaaacttcacgctagaagaacaggctaaggtcatagttgcacctcggagcaacaacgagatggacgcggcaaagctgaagagagagttccccgagctgctatcgatcaaagactcattgatcaagtatgtctttgagcccaacaggaaggtcccagcaacttgaagccagaacaggtaataatataggaaatatataccaagcaccgaaagactttaggaaccattcgtcgcagcgattcattggaatgttttacgatacttgcagcatatctctgttatagattcacagcatcgtttgaactatatatttggcagtctgctggtcacagcaagatatcttgtaccat

SEQ ID NO: 12300 - DNA, 2380 bp, Triticum aestivum
ccaatatggcgacaccctacacacctaagagcatcctcattacaggagctgctggtttcatcgcttcccatgtcacaaaccgcattgtacggaactaccctgattacaagattgtcgtccttgacaagcttgattactgctccaatctgaagaaccttctccctgccagctcgtcaccaaacttcaagtttgtcaagggcgatattgccagtgctgatcttgtcaacttcctcctggtcacagagaacattgatacaataatgcactttgcagcccagacacatgttgacaattcttttggtaactcctttgaattcaccaagaacaacatttatggtactcatgttcttctcgaagcttgcaaggtcactggtcagatcaggaggttcatccacgttagcactgatgaggtctatggtgagactgatgaggatgcagtggttggtaaccatgaggcctcacagctgctcccaacaaatccttattcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctactgtgaggacgttgctgaggcttttgaagtcattcttcatcgtggagaagttggacatgtttacaacattggaacaaagagagagaggacagtcactgatgtggcaaaggatgtctgcaggcttttcaatcttgaagctgataaagtaatccagttggtcgataatagacctttcaatgatcagaggtatttcttggatgatgagaagctcaagagtcttgggtggtctgagcgcactagatgggaggagggcctgaggaagacaatggaatggtatgtagctaattctgactattggggtgatgtttctggtgcactgttgcctcatccgaggacactgatgatgcctgggtatgagggctctgaggaaattaaaggaatgctaaatctgtttactaacaatcaaacgaagatggtggctccaacatcagaaggttcttcccaaactcgtttgctcaagttcttgatatatggccggacaggatggattggtggacttcttggcaaaatatgtgagaagcaaggaattccatacgagtacggaaaaggtcgcttggaagagcgcttttccattgtccttgatatccaaactgttaagccaacacatgtcttcaatgctgctggtgttactggcagacccaatgttgactggtgtgagtctcacaagccagacaccatacgtaccaatgttgtgggcaccttgactctagctgatgtttgtcgggagcatgggttattggtgataaactatgccactgggtgcatatttgaatatgatgcaaatcatcctgaagggtcaggcatcggcttcaaagaagaggataaaccaaacttcactggttcattctactcaaagactaaggcaatggtcgaggaactgttgaaggagtacgagaatgtctgcactctgcgagtccggatgccaatatcgtctgacctcaacaatccccgaaacttcataacaaagattagccgttatgacaaggtggtaaacatcccaaacagcatgactgtattggatgagcttttgccaatttcagttgagatggcaaaaaggaacttgcggggcatctggaacttcaccaatcctggcgtggtcagccacaatgagattctggagatgtataagaagtacatggatcccagctacaagtggacaaacttcacgctagaagaacaggctaaggtcattgttgcacctcggagcaacaacgagatggacgcgacaaaactgaagagagagttccccgagctgctatcgatcaaagactcgttgatcaagtatgtctttgagcccaacaggaaggtcccagcaacttgaaagccagaacaggtaataatataggaaatatataccaagtactgaaagattttaggaaccattcgtcacagcgattcattagaatgttttactatacttcgcagcatatgtctgttatagattcacagcatcgtttggcagtctgctggtggcagcaagatatcttgtaccatgattgttccgaatgaatgtcgagtacacttgtataccttttaatctgattaccatttttggtgaatgatcgggcaacctgtgctctgacaaaagcatttggacaagcattttaactgtttaagctttacatttctctctcgctttgctcattgtgctgttgctctatgctgttgtgtttgggtttggcccaagcttgg

SEQ ID NO: 12301 - DNA, 2608 bp, Fragaria vesca
acactcaaatccccttcttttcttttccagtcttttctcttcttcttcttccccattgtcctaaattttttaccaccattaaacccacaaagcctccaaccaatttgggcaccaagatccactcccacccacaacttgtaactgaactctttcagatatggctaccacgtataaaccaaagaacatcctcattactggagctgctggtttcattgcatcccatgtttgcaatcggcttatcagaaactaccctgagtacaacattgtcgtccttgacaagcttgattactgttcaaatttgaagaaccttcatccctcaaggtcatccccaaacttcaaatttatcaagggagacattggaagtgctgatcttgtcaatttcatccttctcaccgagtccattgatacaataatgcacttcgcagcccagacccatgtcgacaactcatttggtaacagctttgagttcactaaaaacaacatctatggcacacatgttcttctagaagcatgcaaagtcactggtcaaatcaaaaggttcatccatgttagcacagatgaagtttatggggagacggatgaggatgctgtggtaggaaaccatgaggcttctcagcttcttcccacaaacccctactctgctactaaagctggagctgagatgcttgttatggcatatgggcgttcatatgggctacctgtgataactaccaggggaaacaatgtctatggccccaatcagttccctgaaaagatgattccaaagttcattctcttggctatgaaagggaagactcttcctattcacggcgatggatcaaatgtcaggagttatctctattgtgaggatgtagccgaggcatttgaagtcattctccataagggtgaggtaggccatgtctacaacattgggacaaagaaagagaggagagtgattgatgtcgccagggaaatttgccaactcttctcgttgaaccctgatacatatataaactttgttgagaatagaccttttaatgatcagagatatttcttggacgaccaaaagctgaaaaacttgggatggtctgaaagtactgcatgggaggagggtttaaggaagacgatggaatggtatgtcaagaatcctcattggtggggagatgtctctggggcactgctccctcatccaagaatgctcatggttcctggaattgaaagaaacttcgatgggcctgatacaagcaattccgattcccctttgccagcaactgattctagtcttagcgaagtggttgttccagctcctaggggcattccttctactcagaagccatctctgaagttcctgatttatgggagaacagggtggattggaggccttcttgggaagatctgtgagaagcaagggatactgtttgagtatggacgagggcgactccaggaatgttcccagctcctggctgatattcagagggtcaagccaacacatgttttcaatgctgctggagtgaccggcagacccaatgtggattggtgtgaatctcataaaccagaaacaattcggaccaatgttgtgggtacattgaccttggctgatgtctgcagagagcacaacctcctgatgatgaattatgcgactggttgtatcttcgagtatgatgctgctcatccattaagatcaggcattgggttcaaggaggaagacacaccaaatttcactggctcattctattccaaaaccaaagcaatggtggaagagcttttgaaagaatatgacaatgtctgcactcttagagtccgaatgccaatatcatctgatctgagcaatccgcgtaacttcatcacgaagatctcaaagtacaacaaagtggttgatattccaaacagcatgactatcttggatgagcttctaccaatttcagttgagatggccaagaggaacttgaagggtatttggaacttcacaaaccctggtgttgtgagtcacaatgagatcctggagatgtacaagaagtacatcgaccccagtttcaagtgggttaattttacattggaagaacaagccaaggttattgtggcaccaagaagtaacaatgagatggatgcatctaagctgaagaaagagttccctgaactattgtcaatcaaggagtcgctgattaaatacgtctttgagcccaacaagaaaacatctgctggtggagcagcaaattaagagtgtttgatgaacctctacacctcattaccatcctttcataatttatgcatatctttattcttttccctgttataagggcatgaattactgcatgttgtcattttagtcggtcattgtgtcatcctattagggcaactcatttctgtgatatgataactaggatcatttcatgagttgggagtattggtcttagtcttggctattgtgagataaggagcctttaaattgcttcatatatctagaaggtctaccttaatatcgtactttttcataagcaataaaaaaaaacatgtaattttgaaatctattatacaagttcttatgtatgacgtacaatccaagttaccttcttttttctttcctgcaagtctttctaatcaccattgtgatcgagttgcttctgcccta

SEQ ID NO: 12302 - DNA, 2643 bp, Populus trichocarpa
ttgtctcaattttttaatactagctaacagacatacactatatatacatgaactctccctaacatccttctctgtcacaccatttctgtcccgatttcatccacctgtctcttaaatttccatttcttttttcctgggatttgattgatcttcacgtgatttagatttttctaggatctatttttttggaagttgttttggcatggctacctatactccgaagaacatcctcattactggagctgctgggtttatcgcgtcccatgtttgcaatcggcttatccgtaactaccctgattataaaatagttgtgcttgacaagcttgactattgttcaaacctgaaaaatctcctcccttccaagtcatcccctaactttaagtttgtcaagggtgatgttggaagtgcagaccttgtcaacttcctcctgatcacggagtcgattgacacaattatgcactttgcagcccagacccatgtggacaactcttttggtaacagctttgagttcaccaagaacaacatatatggaactcatgtccttttagaagcttgcaaagtcactggtcagatcaggaggttcatccatgtgagcacagatgaagtatatggggagactgatgaagacgctgttgtaggaaatcatgaggcctctcaacttctcccaaccaacccctactctgcaaccaaagctggagcagaaatgcttgttatggcatatggaaggtcatatgggctgcctgtgataaccactcgtgggaacaatgtttatggtcccaatcagttccctgaaaaattaattccaaagtttattctcttagccatgcaagggaagcatcttcccatccatggtgatggttctaatgtgagaagttacttgtattgtgaggatgtcgctgaggcttttgaagtcattcttcacaagggagaggtaggccatgtttacaatatagggacaaagaaggaaaggagagtgattgatgtagccaaagatatttgcaaccttttctcaagggaccctgatacgagcatcaagtttgtagacaacagaccgttcaatgaccagaggtactttttggatgatcagaagctgaataatttgggatggtcagaacatactacatggcaggaggggttgagaaagactatggagtggtacactcaaaatcctgattggtggggtgatgtctctggagccctgcttcctcatccaagaatgctcatgatgcctggtgggagacattttgatgggtctgaagagaaagatgcttcttatgtctcaaataattcaaatcagacccggatggtgattccagtttcaaaaggaagcggctctggctctcctcgaaaaccttcgcttaagttcctgatctatggcaggactgggtggattgggggtttgcttgggaagttgtgtgagaaacaaggaatttcctatgaatatggaaaggggcgcttggaagatcgatcctcacttttgtcagatattcagaatgttaggcctacccatgtttttaatgctgctggggtcactggcaggcccaatgttgattggtgtgaatcccataagacagaaactatacgcaccaatgttactggaactctgacattagcagatctttgcagagagcacaacctcctgatgatgaattttgctacaggctgcatatttgagtataatgctggtcatccagagggttctggcattggtttcaccgaggaagacaagcccaatttcattggttcttactattcaaagactaaggccatggtcgaagagcttttgaaagagtatgacaatgtgtgcaccctcagagttagaatgccaatatcatcagacctaaacaacccacgcaacttcattacaaagatttctcgctataataaggtggtgaacattccaaacagcatgactatcctggacgaacttctacctatttcaattgagatggcaaagaggaacttgagaggcatatggaacttcacaaaccctggtgttgtgagccataatgagattttggagatgtacaagaactacattaacccggactttacatgggttaactttgacctagaggagcaagccaaggtgatagttgccccccggagcaacaatgagatggatgcgtccaagctgaagaacgagttccctgagttgctgccaatcaaagagtcattaatcaagtatgtctttgaacccaacaagagaacctaagccaaagattcaggtgcagaccctattttgcattgctttacctccgagtgtcctaattatattaaaaattttctggtctacctgccattcattattagattcatctcattgtttctgccatgttagagagtaaggaggttaattctatcactactttaggaacacttatctcagttacttatctcggtttgtatttttatttgcttagtatcatccctttccacaggaaactcttaataagttcttaaaatttgtggtcatatgctatcttgcatattagacaaatgttttgtgttttgattctttatcgctgagcttttcaatataagattggtactatgttgttgttatgctctcgggtttcaagaaatttgacaggaatcattactttccatccagttgggagtaagcaaataaacatgtggtag

SEQ ID NO: 12303 - DNA, 2744 bp, Cicer arietinum
aatcaatcataattttcgaagcacaatcaattatagtgaagggtgaacgcgtaattaagtgaaatagcgtgggggctattatgtaatttaagtgatcctctggccccccttaactgtctcggttgatacatataagacgcgtacatatatacgatttcattgctccaccattttcttcttctcattacacacagaaggagactcacatcaaatctccctccttattatttttctctaaactcaaaatctcttaattcaccttcttttttctggattcgttaccattttgtagcctgacatggcttcatatactcctaagaatatcctcattactggggcagctggatttattgcatctcatgttgccaaccggcttgtccgaagccatccagagtacaaaattgttgtgcttgacaaactagattattgttctaatctgaagaatctcctaccttctaaatcatcttccaacttcaagtttgtgaaaggggatattggtagtgctgatcttgtcaactaccttcttatcacagagtccattgacaccataatgcactttgctgctcaaactcatgttgacaactcatttggtaatagctttgagttcaccaagaacaacatatatggaactcatgttctattagaagcctgcaaggttactggccagatcagaaggttcattcatgtcagtaccgatgaggtctatggggagactgatgaagatgcgattgttggaaaccatgaggcttctcaacttcttccaacgaatccatactctgcaacaaaagcaggagcggaaatgcttgtcatggcatatggtaggtcatatgggttgcccgttatcacaacacgtggaaacaatgtttatggaccgaatcagtttcctgagaagttaattccgaagttcatcctccttgctatgcaaggaaagaatcttccgattcatggggatggtactaatgtgaggagttatttgtattgtgaagatgttgctgaagcatttgaagttgtccttcacaagggagaggttggccatgtttacaatatcgggacgaagaaggaaaggggagttatcgatgtagccaaggatatatgcagacttttttcaatggatgcagaaactagtattaaattcgtagaaaacagaccgtttaatgatcagagatactttcttgatgatcagaagctgaagaacctcggttggtccgagagaaccacatgggaagagggcttgaagaaaaccatagaatggtataccaaaaatcctgattggtggggagatgtcagtggagcattgcttccacatccaaggatgttgatgatgcctggtgggatggagagacattttgaaggatccgaaggggaaaatccggcatccttcaattcatctaatactcgtatggtggtcccaacatccaagaacactggtgctcagcagaaacatgctttgaagtttttgatctttggtagaacagggtggattggaggtttgctcgggaaattgtgtgagaagcaagaaattccttatgaatatgcaaagggtcgtctagaggatcgtgcatcacttattgctgatattcagaatgtgaagccaacccatgtttttaacgctgctggtgtcacgggaagacccaatgttgattggtgtgaaagtcataaaacagaaaccatccgcgccaatgtcgctggtactttaacattggctgatgtgtgccgagagagcagcatcttgatggtaaattatgctactgggtgcatattcgagtatgatgccgcacatcaggaaggctctggcattggttttaaggaggaagacaagcccaactttcatggatctttctattccaagaccaaagctatggttgaggaactcttgagagaatatgacaatgtatgcacccttagggttcgcatgccaatttcatctgacctaagcaacccacgcaacttcatcacgaagatttctcgttataacaaagttgtcaacattccaaacagcatgacaatattggatgaacttctcccaatttcaattgagatggcaaagagaaacttgagtggaatctggaacttcacaaatcctggtgctgtgagccacaatgagatccttgagatgtatagggattacattgatcccaactacaagtgggaaaatttcacgctcgaagagcaagccaaggtgattgtcgccgctcgaagcaacaatgagatggatgctactaaattaaagaatgaattcccagaattgcttcctatcaaagaatcacttatcaagtatgtcttcgagccaaacaagaaataagcagttttaatgttttagacatggaagtataacacatcattccactgttagttccactcagttacatgtgtgtagagtgtggctagtattacaattgcattattaggtaattttcctaagtattaattttaatttcttagtgtcctatggtactttgcagccttagatagatgtaaggcttcaattgaaagcttgtgatgagcaacttttttttcatctttgtaaggcttgtattcttttcttgctcatctagaatgaaaatttaaaataagtgaagtttttataatttttgagtttatgcagatgtactgggatatttatctgtattatatagtgaaaaatcttgtaataaaagaaaagttatttatcattttcttaaaaactaaaagaaatgttaatttcacacccgtgttaaacataaagcatgtgcttcttttaatag

SEQ ID NO: 12304 - DNA, 2222 bp, Flaveria ramosissima
tgttgctaatcggctgatcaggaactatcctgattacaagatcgtcgtgcttgacaagcttgattattgttcgaatcttaagaacctcaacccttcgagatcgtctcccaacttcaagtttgttaagggggacattgggagcgctgacctcgtcaactacctcctgattactgaatctattgataccatcatgcactttgctgcacagacccatgttgataactcattcggaaacagttttgagttcacgaagaataacatctatggaactcatgtgcttcttgaagcctgcaaagtcactggccagattaggagatttatccatgtgagcacagatgaggtctatggagaaacagaggaggacgctgttgttggtaaccatgaagcttcgcaacttcttcctacaaacccatattcagccacaaaagctggtgcagaaatgcttgttatggcttatggtaggtcatacgggttgcctgtgattactaccagaggaaacaatgtttatggcccgaatcaattcccagaaaaactgatccctaagttcattcttctggctatgagaggaaaaccacttccgattcatggtgatggttctaatgtaaggagttacctctactgtgaagatgttgctgaggcttttgaagtaattcttcacaagggagaagttggtcatgtttacaacatagggaccaaaaaggaaaggagagtgattgatgtcgcaaaagatatgtgcaagcttttcaatatggatcctgattcaagcatcaagtttgtggagaacagaccatttaatgatcagcgatacttcttagatgatgagaaattgaagagcttgggttggtcagaaagaaccacatgggaagagggtttgaaaaagacgatcgagtggtataccagcaaccccaattggtggggagatgtctctggagcacttctgcctcatccaagaatgttaatgatgccgggtggcgttgatagacatgttgatggacatgaaaatgctgaactggattcagctggtgtggcaatcaatacctctcagatcggtgtccagattcctagctcaaaaaccagtggcgtttctgctaagaaaccagctttgaagtttctcatttatgggaaaacagggtggatcggtggtttacttggaaagttatgtgacaaacaacaaattccatatgaatatggacgaggtcgtttggaagaccgttcacaacttttggctgatattcaaactatcaaacctactcatgttttcaatgctgctggtgtcactggcagaccgaatgttgattggtgtgaatctcacaagacagaaaccattcgtaccaatgtctcgggcacactcaatctagcagatgtctgtagagaacatgggctcttgatgatcaattttgctactggatgcatctttgagtatgatgctaaccaccctgaagggtctggaatcggttttaaggaagaagataagcccaatttcatcgggtccttctattcaaaaaccaaagctatggtggaggagcttttgaaagaatatgacaatgtgtgcacccttagagtccgaatgccgatatcatcagatctcaacaacccacgcaatttcatcaccaagatcgctcgttatgataaagttgtaaacatacccaacagcatgacaatcttggatgaacttttgccaatttcaatcgagatggcaaagcgtaatctaaggggaatctggaactttacaaatcctggggtcgtaagccacaatgagattcttgaaatgtacaagaagtacataaacccagagttcaagtgggtaaatttcacgctggaagaacaagcgaaagtgatagtggccccacgaagcaataacgagttggatgcatcaaagttgaagaaagagtttcccgagttgctatcaatcaaggagtcgttgatcaagtacgtattcgaacccaacaaaaaacagtaatgataatgatatgatgattctttatagaatttgtagaactcaagattcacttgtgtttggttactagttccttcttgtatggtttggattatacatctgtaatgtttaaagtcaactgagtcagtcacatttgttctagtatttgttttctagcatcatcacactgaggttataggaggcgagaccgatcgtctatggggtatctatcctatagtcatcatcgtttgtctcgactaaggtctaggtctatgattagtttgtt

SEQ ID NO: 12305 - DNA, 2214 bp, Centaurea maculosa
tcactggggctgctggattcatcgcctctcatgttgctaatcggctcatcagaagctaccctgattataagattgttgtgcttgacaagcttgattattgttcgaatcttaagaacctcaatccctccagatcgtctcctaacttcaagtttgttaagggggacattggcagtgccgatcttgtcaactaccttttgatcactgaatctattgataccattatgcactttgctgcacagacccatgttgataactcatttggcaacagctttgagttcactaagaataacatctatggcacccatgtgcttctagaggcctgcaaggtcactggccagattcggaggttcatccacgtgagtacggatgaggtctacggtgaaacggaggaggatgctgttgtgggtaaccatgaagcttcacaacttcttcccacaaacccgtattcagccacgaaagccggggctgaaatgcttgtgatggcttatggtaggtcgtatggactgcctgtgatcaccactaggggaaacaacgtttatggcccgaaccagttcccggaaaaactaatcccgaagttcattctcttggctatgagaggaaagccacttccgattcacggtgatggttctaatgtacgaagctacctctactgtgaggatgttgccgaggcttttgaagtgattcttcacaagggggaagttggtcatgtttacaacataggtaccaagagggagaggagggttatcgatgttgccaaagatatgtgtaagcttttcaatatggatcctgatgcaagcatcaagtttgtggagaacaggccgtttaacgatcagaggtacttcttggacgatgagaagctgaagagcctgggctggtcggaaaggaccagatgggaagatggtctgaagaaaaccatcgagtggtataccagcaatcccaattggtggggcgatgtctctggagcactgcttcctcatccgcgaatgctgatgatgcctggtggcgttgataggcttgttgacggacctgacaattctgaattcgattcagacaatgtggcacatagcggttctcagattggcattgtggttcccacttccaaaagcagtggcaacgctgccaagaagccgtccatgaagttcctcatctacggtaggacgggctggatcgggggcttactcgggaagctgtgcgagaagcaacaaatcccatatgagtatggaaggggtcgcttggaggaccgatcgcagcttttggctgatattcaggctattaaaccgactcatgttttcaatgctgccggtgtcactggcagacccaatgtcgattggtgtgaatcccacaagaccgaaacgattcggactaatgtttcgggcacactgaatctagcagatgtatgcagagatcacgggctcttgatgatcaattttgcgactggatgcattttcgagtacgatgctaaacacccagaaggctctggcattggttttaaggaagaagacaagcccaatttcacaggctccttttattcaaagaccaaagctatggtagaggagctgttgaaggaatacgaaaacgtctgcaccctgagagtccgaatgccgatatcatccgacctcaacaacccacgcaacttcataacgaaaatcgcccgttacgacaaagtcgtcaacatccccaacagcatgacgatcttggacgagctcctaccgatctcgatcgagatggccaagcggaagctgacgggaatctggaacttcacaaacccgggggtcgtcagccacaacgagatcctcgagatgtacaagaagtacataaacccggagttcaaatgggtcaacttcacactggaagaacaagcccaagtgattgtggccccacgaagtaacaacgagctcgatgcatcgaagttaaagaaggagtttccggagttgatgtcgatcaaggaatcgctgatcaagaatgtattcgaacccaacaagaagatatgaaaataaagattggtgatgatgattctttgttttgtttgtaaactggagaaattggggttagttggtgtatgggatttggattttatatacatttgtaatgtttaagtcaatttgtttccttttgttagcatgaggatgatcatgatgatgatgataggaagaggagggcatatttggtatttttataattttcactaccaaaaacttagtttgtttacgaata

SEQ ID NO: 12306 - DNA, 2575 bp, Gossypium raimondii
cttagtttgcagagctacctatatgtatacacatataaatgaagtctcctcaatttccctctccgtcaaaagattcatctcccctactctaaatttctctcttttccttcttctatcaaaacgttctatctctgtaatttttttttcgattgctgtatctggattttgattgatttctctccaacttaattgaatatggcttcttataaacccaagaatatcctgataactggggctgctgggtttattgcatctcatgttgccaatcggcttgttcggaactaccctgagtacaagattgttgtacttgataagcttgattactgctcaaacacaaaaaacctccttccttccaagttatccccaagctttaagtttgtgaagggggacattgaaagtgctgatcttgttaactatcttcttatcacggagtctattgacacaataatgcactttgcagcacaaactcatgttgataattcatttgggaacagtttcgagtttacaaagaacaatatttatggcactcatgtcctacttgaagcttgcaaagtcacaggtcagattaggaggttcatccatgttagcaccgatgaggtttacggggagacggacgaggatgcagttgtaggaaaccatgaagcttcccaacttctcccaacgaacccgtattctgcaacaaaagcaggtgctgaaatgcttgttatggcatatgggaggtcatatggattaccagtaattacgacccgtggaaacaatgtttatggtcccaatcagtttccggaaaaattaattcccaagtttatcttattggcaatgagggggaagactcttccaattcatggggatggttctaatgtgaggagttatttatactgtgaggatgttgctgaagcatttgaagtcattcttcacaagggtgaagttggtcgtgtttataatattggcacgaagaaagaaaggagagtgattgatgtagctagagatatatgcaaacttttctcgatggatcctgagacaagcattgagtttgtcgaaaacagaccgttcaatgaccagaggtattttcttgatgatcagagattgaagaacttgggatggtccgagcgaactgtatgggaagacgggttgaagaagaccatagaatggtacactcaaaaccctgattggtggggtgatgtgactggtgcgttgcttccacacccgagaatgttgatgatggctggaagtacacacttcgattccgaggacagcaaagagacatcatatgtaagtggtcccaatcagacccgaatggtggttccaacccccaagggtggtagctctccccaaaaacaatccttgaagttcttgatctatggcaggactggctggataggtggtttacttggtcagttatgcgagaaacaaggtattgccttcgaatatggaaaaggacgcttggaagatcgttcatcactcaatgcagatattcaaaatataacgccgacccatgtgtttaatgctgctggtgttaccggcagacctaatgttgattggtgtgaatctcacaaaacagaaacaattcgtgccaatgtggctggtactttaaccttggcagatgtttgcagagaccatgggctgttgatgatgaatttcgctaccgggtgtatatttgagtatgatactgcacatcctcagggctctggcattggatttaaagaggaagataaacccaatttcatcggttccttctattcaaaaaccaaggccgtggttgaagagctgttgaaagagtatgacaacgtctgcacccttagagttcgaatgccgatctcatctgacctaaacaatccacgcaacttcatcaccaagatttcacgctacaacaaggtggtcaacattcccaacagcatgacagtcttggacgaacttctaccgatatcgatcgagatggcaaagaagaacttgaggggtatatggaacttcacaaaccctggggttgtgagccacaatgagatcctcgagatgtacaagacttacattgaccccaagtttaagtgggaaaacttcacattagaagaacaagccaaggtgatcgttgcaccccgaagcaataacgagatggatgcatccaagttgaagaaggagttccctgagttgttatccatcaaagaatcactgattaagtatgcctttgaaccgaacaggagaacctgagcttattaagcaggtttcagcttatagatcctatactttctgcacctaatattatatgatcaggaatatcttttaagctccactcttttgctaccgttatcttccaccaaattagtttacttgagctacaaggtattaacctatgttgcttagactcttccattttttggagtatacatgtccaatccatattttgaagtataaatatctatgctcaatactcagatttgagttctgtaggtatcaggtcaggtgtactattttttgtattttgttagttgaaatttttttggcttttaacactcttgaactggtttctaatggaagaatttgctttattgcataaaatcttatatttgcaatttctttttctatt

SEQ ID NO: 12307 - DNA, 2327 bp, Silene vulgaris
cccgatttcctctcccttctttaaattaaatttccccaattttcgttcaatcatcaattcgatctgcgtttcactctaaggtgttccgcgatgactactcatacgccaaagaacattttaattaccggagcagccgggttcatcgcatctcatgttgcgaaccggctagttaggagctatcccgattacaagattgtcgtgctcgacaagcttgattattgctcaaacctcaagaacttgcgcccttcccaatcatcccctaatttcaagtttgtcaagggggacattgctagtgccgatcttgttaactaccttctcataaccgagtccattgatactatcatgcactttgctgcacaaacccatgttgacaactcttttggtaacagctttgagtttaccaagaacaacatttacggtactcatgtgcttctagaagcatgtaaggttacgggacaaatcaagaggtttattcatgttagtactgatgaggtttatggagagacagatgaagatgctgttgtcggaaaccatgaagcttctcagcttcttccaacaaacccgtattcggctacaaaggccggagctgagatgctcgtgatggcttatggccgatcttatggcttgccggttattacaacccgtggaaacaatgtgtatggacctaaccaatttcctgagaaattgatccctaagttcatccttttagccatgagagggaagcctctcccgatccatggagatgggtctaatgtgagaagttatctgtattgtgaggatgtggcagaggcctttgaggtcatcctccacaagggagtagtaggccatgtatacaatattggaaccaagagggagaggagagtccttgatgtcgctcaagacgtatgcaaacttttttccatggattccgagaaggtcatcaagtttgtcgagaatcgtccctttaacgaccagaggtacttcctggatgatgagaagttgaaggaattgggatggtcagagcgaaccccttgggaagagggtttaaagaagaccatggagtggtacattagcaatcccgagtggtggggtgatgtgtcaggagcgctccttcctcacccgaggatgctgatgatgccaggtggcattgagaggcattttgaggaagctgacaaggacaactccggggagctctccagcattcagagcaagacggtggtccctgttgccaaaagcaacgcctctcagaaagaatcatcttacaagttcttgatttacggtagaactggttggatcggtggtctccttggtcaaatgtgtgacaagcaaggcattgcttacgagtatggaaagggtcgtctgcaagacagagcatctctcattgccgatatccagaatatcaaacctacacatgtcttcaatgctgccggtgttaccggtaggcccaatgttgactggtgtgaatctcacaaaactgagacgatccgcactaatgtagttggtactttgacgttggctgatgtctgcaaagaacatgggttgcttatgatgaattatgctactgggtgcatttttgaatatgacgcaacacatccactgggttctggaatcgggtttaaggaggaagacacccccaatttcatgggttcctactactcgaagactaaagctatggtggaggagttgctcaaggaatttgacaatgtttgcacccttagggtccgaatgcctatatccggtgacctcagcaacccacgtaacttcgtcacaaagatatctcgctacaacaaggtagtcaatatccccaacagcatgaccattttggacgagctcctacccatttccatcgagatggccaaacgtaatctcagaggtatatggaacttcaccaacccgggtgtagtaagccacaatgaggttctcgagatgtacaagaattacattgacccgagttacacctatgctaacttcactttggaagagcaagccaaggtcattgtcgccgcaagaagcaacaatgagatggatgcctccaagttgaagggcgaattcccagagctcctaagcatcaaggattcattgatcaagtatgttttcgagccaaacaagaaaactaactactccgcttgagtttgaagttttctgctcgattcaaagatattggcattttttacctagtaggtgatgttgatgcatcatagctagtattgtgtgcccttccgggcaaaattcattcttagtctttgcgatgtttctaataactagtttcagacgagaattatttatttcgtaattaggtgttcagttttccgtctttttgtttttttaagcatacgatgttcatcgcc

SEQ ID NO: 12308 - DNA, 2561 bp, Phaseolus vulgaris
ataaatacatacaaagtgtgtagagtccaaatctaaatctgggaactaccattttccatctcttctctgtctgaagaatttctctttcttgccttcgtcttttctccttctacgcctcacggtctctaattcaagttggttgacatggctacgcacacaccaaaaaatatcctcattactggagctgctggattcattgcatctcatgttgccaaccggcttatccggaattatccccagtacaaaattgttgttcttgacaagcttgattattgttcaaatctgaagaacctcattccttcaaaatcatctcccaacttcaagtttgtgaagggagatattggaagtgctgatcttgtcaactacctactcattaccgagtccattgacacaataatgcactttgctgctcaaactcatgttgacaactcatttggcaacagctttgagttcaccaagaacaacatatatggaactcatgtccttttagaagcctgcaaggtaactggtcagatcaagaggttcatccatgtgagcactgatgaggtctatggagagacagatgaggatgctattgttggaaaccacgaggcttctcagttacttcccacgaatccttactctgcaacaaaagctggggcagaaatgcttgtcatggcatatggcaggtcatatggtttacctgtgatcacaacacgtgggaacaatgtttatgggcccaatcagtttcctgagaagttaattccaaagttcattctcctggctatgcaaggcaagcctcttccaatccatggggatggttctaatgtaaggagttacttatattgtgaagatgttgcagaggcttttgaacttatccttcacaagggagaggttgggcatgtttacaatattggtactaagaaggagaggagagttattgatgttgccaaagatatatgcaggctttttaagatggactcagaagctagtataaaatttgtggagaacagaccatttaatgatcagagatactttcttgatgatgaaaagctgaaggtcttgggttggtctgagaggaccacttgggacgagggcttgaagaaaaccatggactggtatatcaacaatcctggttggtggggtgatgtcagtggtgcattgcttcctcatccaaggatgctgatgatgcccggtggattggagagacattttgatggatctgaagaagaaatacatgcatcatatgtctcaactaatactcgaatggtggttccaacatccaagaatgttacctcttctcagaagcatcctctcaagttcttgctttatggaagaacaggttggattgggggtttgcttgggaaattgtgtgaaaagcaagagattccctatgaatatggaagagggcgcctagaggatcgttcatcacttgtggctgatattcagaatgtgaagcctacacacatttttaatgctgcaggagtgactggcagacccaatgttgattggtgtgaatcccacaaaacagaaaccattcgcaccaacgttgctgggactttaacattggctgatgtctgcagagagcatggtatcttgatgataaattatgctactgggtgcatatttgagtacgatgaagctcatccacagggttctggcattggctttaaggaggaagacaaacccaatttcattggttctttctattccaaaactaaggctatggttgaagagctcttgagagaatatgacaatgtgtgcaccctcagagttcgcatgccaatttcatctgacttgagtaatccacgtaacttcatcaccaagatttctcgttataacaaagtcgtgaacattccaaacagcatgaccattttggatgaacttctgcctatttcgattgagatggcgaagcgaaacttgaggggcatctggaacttcacaaatcctggggcagtgagccacaatgagattcttgagatgtacagggattacattgatccaagcttcaagtgggttaacttcaaccttgaagagcaagccaaggtgatcgtagctccacggagcaacaatgagatggatggagccaaattgaagaaagagttccctgagcttctttccatcaaggattcactgatcaagtatgtctttgagccaaacaagaaaactgcttaaaaacattttaagcagtttcatgttttagacatcacaggttatgcatttttgtggcgggctacatagatcactcattatttcattgttatgtcattgggtttcgataagaaccataccgcaaaacttgccgatgtagttcttgttgtcttagctataattggttccaatttcagcatagttgcatcatgttactttgtttagaaggtggcaagtattataattgggccagatgtggtttctaagttaacacttatgctgctttattatagtttgtagagtctcttcaagagcagctttttagataatagtggttttggtacctaaaaggcttattcgtgcatcttttccattggaagacatgtattcttttattgctcatatattatatcgtttttctgaggtatgca

SEQ ID NO: 12309 - DNA, 2537 bp, Brassica oleracea
cgaaactcaagcggacatggttgaaatttctgcgttgcctatattttcggttggtaaattaaagaaaaaaaaaccactaaaaattgaaccgtaactgttaaaagcgtagtaagggcagtttggtaatttgcgggagtccactggttctccgtaactgtctcaggggcttccctctctttcttcctcatttctcctattagtcttcactcttatattccattgttcccatttccctctcttaacatctcgagaccttctctttaactttagattgatctcgatcttgatcttgttcgacccgctataatagctctctcacatcacaatggctacatataagcccaagaacatcctcatcaccggagcagccggcttcatcgcctcccacgtcgccaacagactagtccgcacctaccctcactacaaaatcgtggtcctcgacaagctcgactactgctccaacctcaaaaaccttaacccttccaaatcctcccccaacttcaagttcgtcaagggcgacatcgccagcgacgacctcgtcagctaccttctcatcaccgagaacatcgacaccatcatgcacttcgccgctcagacccacgtcgacaactccttcggcaactccttcgagttcaccaagaacaacatctacggcacgcacgtccttttagaagcttgcaaagtcactggacagatcaggaggtttatccacgtgagtactgacgaggtctacggagagactgatgaggatgcttctgttgggaaccatgaagcttctcagctgcttccgactaatccttactccgctactaaagctggtgctgagatgcttgtcatggcgtatgggagatcgtatggtttaccggttataaccacgcgtgggaataatgtttatggtccgaatcagtttcctgagaagttgattcctaagttcatgttgttggctatgaacgggaagccgcttcctatccatggggatggatctaatgttaggagttacttgtattgtgaagacgttgctgaggcgtttgaggttgttctacacaaaggtgaagttaaccatgtttataatattgggacgacgagagagaggagagtgattgatgtggcgaatgacatctccaagctctttggaactgaccctgactctacaatccagtttgtggagaaccggccgtttaatgaccagaggtacttcctcgacgaccagaagctgaagaagttgggatggtctgaacggaccacttgggaagaagggctgaggaagacgatggagtggtacactgagaaccctgattggtggggagatgttactggtgctctgttgcctcatccaaggatgctgatgatgccaggtgatagactctgtgataactgtgacgacgaccacaaggatgttgcagatggtaatcagacgttcactgtggttactccttctggagacaacaaaacaccctttaagttccttatatacggcaagaccgggtggctcggtggtcttctagggaagctatgtgagaagcaagggatcccatacgagtatgggaaagggagactagaggacagagcttctgtaatggcagatattcgcagcgtcaaacctactcatgtcttcaatgccgccggtgtaacaggcagacccaatgttgactggtgtgagtctcacaaaaccgagactatccgagccaatgtcgctggtactttgactctagcagatgtgtgcagagagaatggtttattgatgatgaacttcgccaccggttgtatatttgagtacgacgctgcgcatccagaaggctcagggattggcttcaaggaagaggacaaacccaacttcaccggctccttctactcaaagacaaaggcgatggtggaagagcttctaagagaatacgacaacgtatgcacgttgagagtgcggatgccaatctcatcagacttgaacaacccaaggaacttcatcacgaagatttcgcggtacaacaaagtggtgaacatcccaaacagcatgacaatactcgacgagctcttgccaatctcgatcgagatggcgaagaggaacctgaggggggtttggaacttcaccaatccgggagtggtgagccacaacgagatactagagatgtacaagagctacatcgagccgagtttcaaatggtccaacttcactttggaggaacaggctaaggtcattgtggcaccgcggagcaacaacgagatggatggtgccaagcttagtaaggagtttcctgagatgcttcccatcaaagagtcgttgatcaaatacgtctttgaacccaacaagagaacgtaaaactctccacacatacacttcctctctttttttcatttctctgcactgttatattatactgcaggtagcttcactataatgattctactgttatttgatttgttttcatcatgtgattcatttactctcatttttggcactgtactacgaaacatatcttttcttttttaaatcatatctttgttacattaacattattacagaaatgaatttatttcagttt

SEQ ID NO: 12310 - DNA, 2585 bp, Vigna unguiculata
gagaactaccattttccatcttcctctttctgaagaatttttttcttgccttcgtcttttctcctttttcgcttcactggtctacaattcaagttggttgacatggctacgcatacaccaaaaaatatcctcattactggagctgctggattcattgcatctcatgttgccaacctgcttatcaggagttatccccagtacaaaattgttgttcttgacaagcttgattactgttcaaatctgaagaacctcattccttcaaaatcatctcccaatttcaagtttgtgaagggagatattgggagtgctgatcttgtcaactacctactcattaccgagtccattgacacaataatgcactttgctgctcaaacccatgttgacaactcgtttggcaacagctttgagttcaccaagaacaacatatatggcactcatgtccttttagaagcttgcaaggtaacgggccagatcaagaggttcatccatgtgagcactgatgaggtctatggagagacagatgaggatgctgttgttggaaaccacgaggcttctcaattacttcccacgaatccttactctgcaacaaaagctggggcagaaatgcttgtcatggcatatggcaggtcatatgggttacctgtgatcacaacacgtgggaacaatgtttatgggccgaatcagtttcctgagaagttaattccaaagttcatactcctggccatgcaaggcaagcctcttccaatccatggggatggttctaatgtaaggagttatttatattgtgaagatgttgcagaggcttttgaacttatcctgcagaagggagaggttgggcatgtttacaatattggtactaagaaggaaaggagagttattgatgttgccaaagatatatgcaggctttttaagatggactcagagactagtataaaatttgtggagaacagaccatttaatgaccagagatactttcttgatgatgaaaagctgaaggtcttgggttggtctgagaggaccacttgggaagagggcttgaagaaaaccatggactggtatatcaacaatcctaattggtggggtgatgtcagtggtgcattgcttcctcatccaaggatgctgatgatgcccggtggattggagagacacttggatggaactgatgaagaaaaacctgcatcatatgtctcaactaatactcacatggtggttccatcatccaagaatgttagctcttctcagaagcctcctctgaagttcttgatctatggaagaacaggttggattgggggtttgctggggaaattgtgtgaaaaacaagggatttcctatgaatatggaagagggcgcctagaggatcgtacatcacttgtggctgatattcagaatgtgaagcctactcacatttttaatgctgcaggagtgactggcagacccaatgttgattggtgtgaatcccataaaacagaaaccatccgcaccaacgttgctgggactttaacattggctgatgtcagcaaagagcatggaatcttgatgataaattatgctactgggtgcatatttgagtacgatgaagctcatccagagggttctggcattggctttaaggaggaagacaaacccaatttcatgggttctttctattccaaaactaaggctatggttgaagagctcttgaaagaatatgacaatgtgtgcaccctgagggttcgcatgccaatttcatccgacttgagtaatccacgtaacttcatcaccaaaatttctcgttataacaaagtcgtcaatattccaaacagcatgaccgttttggatgaacttctgcctatttcgattgagatggcgaagcgaaacttgaggggcatctggaacttcacaaatcctggggcagtgagccacaatgagattcttgagatgtacagggattacattgatccaagcttcaagtgggccaacttcaaccttgaagagcaagctaaggtgatcgtggctcaacggagcaacaatgagatggatggaaccaaattgaagacagagttccctgagcttctttccatcaaggaatcactgatgaagtatgtctttgagccaaacaagaaaactgcttaaaagcattaagcagtttcacgatttagacattacaggttatgcatttttgtagcgggctacatagatcactcattatttcattgttatgtcattgggttttgataaaaaccatattgcaaaactagccgatgtagttcttgttgtcttagctataagtgcttccagtttcagcatatagttgcatcacgttactttgtttagaaggtggcaagtattataattgtgccagatgtggtttctaagttaacatttcagctgctttattctagtttgtaggatttctattagagcagctttagataatatagaggttttggtacttaaaagcttattcgtgcaacttttgcatctggaaaacatgtattcttttattgctcatatattatatcgtttttctggggtatgtagttatgcttgtatggcatttgcatgtatattatgcagtgaaatggatgtttctgagatattcattt

SEQ ID NO: 12311 - DNA, 3027 bp, Brachypodium distachyon
ttgtagttggcccagctatacatacctctgccccatctcggtagccgagcgacccagccccctcgctccgtggatcttcttcctcctcgcgcgagcgccgccacccatcccgctgccgagcgtccgagccccctagctcgtcttcctcctggcgcgagcgcctccaccgcagttcagaggatatggcgacaccctacacacctaagagcattctcattacgggagctgctgggttcattgcatcccatgtcacaaaccggattgttcggaactaccctgattacaagattgttgtccttgacaagcttgattactgctccaatctgaagaatctgctccctgccagctcttcaccaaacttcaagtttgtcaagggcgatattgccagcgctgatcttgtcaacttcctactggtcacagagaacattgatactataatgcactttgcagcccagacacatgtcgataattcatttggaaactcctttgaattcaccaagaacaacatttacggtactcatgttcttctagaggcttgcaaggtcactggtcagatcaggaggttcatccatgtcagcactgatgaggtctatggggagactgatgaggatgctgtggttggcaaccatgaggcgtcacagctgctccccacaaatccctattcagccaccaaagctggagcagaaatgcttgttatggcttatgggagatcctatggtctgccggttatcactactcggggaaataatgtgtatggtcctaatcagtttcctgagaagcttatcccgaagttcattcttttggctatgagaggaaagcccctcccaattcatggtgatggatccaatgttcggagctatctgtattgtgaggatgtagctgaagcttttgaggtcattcttcatcgtggagaggttggacatgtttacaatattggaacgaagagagagaggacggttactgatgtggcaaaggatgtctgcaagctttttaatctggaagctgacaaagtcatccagtatgtggataatagaccttttaatgatcagaggtacttcttggatgatgcgaagctcaagagtcttgggtggtctgagcgcactagatgggaggagggcctaaggaagacgatggaatggtacgtagctaattctgactattggggtgatgtttctggtgcattgctgcctcacccaaggacattgatgatgcctgggtgtgagggctctgaggaaattaaaggaatgctaaatctgtttactaacaaccagacgaagatgaagactacaacatcaaatggttcttcccaaactcattctctcaagttcttgatatatggtcggacaggatggattggtggacttcttggaaaaatatgtgagaagcaaggaattccacatgaatatggaaaaggtcgcttggaagagcgctcttcgctcatcctggatatccaaactgtcaagccaacacatgtcttcaatgctgctggtgttactggcaggcccaatgttgattggtgcgagtctcacaagccggacaccatacgtaccaatgttgcaggcaccttgaccctggctgatgtgtgtagggaacatgggttattggtgatgaactatgctactgggtgcatatttgagtatgatgcaaatcatcctgaagggtcaggcatcggctttaaagaagaggataaaccaaattttactggttcattctactcaaagaccaaggcaatggttgaggaactgttgaaggagtatgataatgtctgcaccctgcgagtccggatgccaatatcctctgacctcaacaatcccagaaacttcatcacaaagattagtcggtacaacaaggtggtgaatattccaaacagcatgactgtattggatgagcttttgccaatttcagttgagatggcaaaaaggaacttgcggggcatctggaactttaccaatcctggtgtagttagccacaatgagattttggagatgtacaagaagtaccttgatcccagctacaagtggacaaacttcacgctagaagaacaggctaaggtcattgttgcacctcggagcaacaatgagatggacgcgacaaagctgaagaaagagttccctgaactgctatcgatcaaagactctttggtcaagtatgtttttgagcctaacaggaaggtcccagcaaattgaagcccgaaaggtaatatagaaaatacagcaagcaatgtaagcttgtagaaattcatcacagttattcattagaatgtttctccacgatacttcacagcgtatcccaactatagattcacagcagtgtttcgattatatatttggcaatctgttggcccagtttgttgtagaggcctactttatgagttcaattattcagtttgcgtgaaccatgtccgttgtgtcgagaaacgactccagcatcttgtatactctttgatctgctgacttttatgtgaatggcttttcctcctgggactgaagcatttggacaaaaagttgacagtttaaatctcccttttatgtttctcttttgctagacatcttatgttttgtcaggaggtttcaataaactcaggaagttgcagccttattttaatccaagtagatggaagcaatcagtttttccttctcattcctccccttattgtatgactctaactgcttctagaacaagatatcactttctgtttgtgtccactccagctgcatcatgatgatggcataaagactaagctcgagacttggaaggccaggcaacacccatgttccagattggccagtgatggtggcaacctcgtgtggagaaatgtgatagaactgacttgcacatgactcgtctcgtgtaatctcaacaactttcagtgccggtgttttcctctctttttcgaaggtggcggcttcagtttcttggaatagtatcctggtgcaacggtgcaggcgatgctgaagtgccaatgccgtgcaccagcactagtcataaaacacttaaaacttgaactcatacagggcctaaagtttt

SEQ ID NO: 12312 - DNA, 2516 bp, Secale cereale
agatctggggcgggcaggggcgcagcgacaccgcgtgagcgccttccccaccacctcccccgtcgtgctttccgccgacccccatcatctcgctctcacgcacacccacaccgccaccgccaccgccaccgccgacgccgccattttctccatttattgacgggaagccctctccgctctcccccatccaccgacgccaccgcccccctcctcctcctcctcctctccgccgcctgctgcgcacggattccagaaattacagtccaatatgtcgacaccctacacacctaagagcatcctcattacaggagctgctggtttcatcgcttcccatgtcacaaaccgcattgtacggaactaccctgattacaagattgtcgtccttgacaagcttgattactgctccaatctgaagaaccttctccctgccagctcgtcaccaaacttcaagtttgtcaagggcgacattgccagtgctgatcttgtcaatttcctcctggtcacagagaacattgatacaataatgcactttgcagcccagacacatgttgacaattcttttggtaactccttcgaattcaccaagaacaacatttatggtactcatgttcttcttgaagcttgcaaggtcactggccagatcaggaggttcatccatgtcagcactgatgaggtctatggcgagactgatgaggatgcagtggttggtaaccatgaggcctcacagctgctccccacaaatccctactcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctattgtgaggatgttgctgaggcttttgaagtcattcttcatcgtggagaagttggacatgtttacaacattggaacaaagagagagaggacagtcactgatgtggcaaaggatgtctgcaggcttttcaatcttgaagctgataaagtaatccagttggttgataatagacctttcaatgatcagaggtattttttggatgatgagaagctcaagagtcttgggtggtctgagcgcactagatgggaggagggcctgaggaagacaatggaatggtatgtagctaattctgactattggggtgatgtttctggtgcactgttgcctcatccgaggacactgatgatgcctgggtatgagggctctgaggaaattaaaggaatgctgaatctgtttactaacagtcatacgaagatggtggctccaacatcagaaggttcttcccaaactcgttcgctcaagttcttgatatatggccggacaggatggattggtggacttcttggcaaaatatgcgagaagcaaggaattccatacgaatatggaaaaggtcgcttggaagagcgcttttccattgtccttgatatccaaactgttaaaccaacacatgtcttcaatgctgctggtgttactggcagacccaatgttgattggtgtgagtctcacaagccagacaccatacgtaccaatgttgtgggtaccttgactctagctgatgtttgtcgggagcatgggttgttggtgataaactatgccactgggtgcatatttgaatatgatgcaaatcatcctgaagggtcaggcatcggcttcaaagaagaggataaaccaaactttactggttcattctactcaaagaccaaggcaatggttgaggaactgttgaaggagtacgagaatgtctgcactctgcgagtccggatgccaatatcgtccgacctcaacaatccccgaaacttcatcacaaagattagccgttacgacaaggtggtaaacatcccaaacagcatgactgtgttggatgagcttttgccgatttcagttgagatggcaaaaaggaacctgcggggcatctggaacttcaccaatcctggcgtggtcagccacaatgagattctggagatgtataagaagtacatggaccccagctacaagtggacaaacttcacgctagaagaacaggctaaggtcatagttgcacctcggagcaacaacgagatggacgcggcaaagctgaagagagagttccccgagctgctatcgatcaaagactcgttgatcaagtatgtctttgagcccaacaggaaggtcccagcaacttgaagccagaacaggtaataatataggaaatatataccaagcaccgaaagactttaggaaccattcgtcgcagcgattcattagaatgttttacgatacttgcagcatatctctgttatagattcacagcatcgtttgaactatatatttggcagtctgctggtcgcagcaagatatcttgtaccatgattgttctgccaagaaacgaactaatgccgagcatcctgtataccttttaatctgctta

SEQ ID NO: 12313 - DNA, 2439 bp, Triticum aestivum
caccgccgacgccgccattttctccatttattgacgggaaaccccctctccgctctccctcatccaccgacgccaccgcccctcctcctcctctccgccgcgtgccgcgcacggatttcagaaattacagtccaatatggcgacaccctacacacctaagagcatcctcattacaggagctgctggtttcatcgcttcccatgtcacaaaccgcattgtacggaactaccctgattacaagattgtcgtccttgacaagcttgattactgctccaatctgaagaaccttctccctgccagctcgtcaccaaacttcaagtttgtcaagggcgatattgccagtgctgatcttgtcaacttcctcctggtcacagagaacattgatacaataatgcactttgcagcccagacacatgttgacaattcttttggtaactcctttgaattcaccaagaacaacatttacggtactcatgttcttcttgaagcttgcaaggtcactggccagatcaggaggttcatccacgttagcactgatgaggtctatggcgagactgatgaggatgcagtggttggtaaccatgaggcctcacagctgctccccacaaatccttattcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctattgtgaggatgttgctgaggcttttgaagtcattcttcatcgtggagaagttggacatgtttacaacattggaacaaagagagagaggacagtcactgatgtggcaaaggatgtctgcaggcttttcaatcttgaagctgataaagtaatccagttggtcgataatagacctttcaatgatcagaggtatttcttggatgatgagaagctcaagagtcttgggtggtctgagcgcactagatgggaggagggcctgaggaagacaatggaatggtatgtagctaattctgactattggggtgatgtttctggtgcactgttgcctcatccgaggacactgatgatgcctgggtatgagggctctgaggaaattaaaggaatgctaaatctgtttactaacaatcaaacgaagatggtggctccaacatcagaaggttcttcccaaactcgtttgctcaagttcttgatatatggccggacaggatggattggtggacttcttggcaaaatatgtgagaagcaaggaattccatacgagtacggaaaaggtcgcttggaagagcgcttttccattgtccttgatatccaaactgttaagccaacacatgtcttcaatgctgctggtgttactggcagacccaatgttgattggtgtgagtctcacaagccagacaccatacgtaccaatgttgtgggcaccttgactctagctgatgtttgtcgggagcatgggttattggtgataaactatgccactgggtgcatatttgaatatgatgcaaatcatcctgaagggtcaggcatcggcttcaaagaagaggataaaccaaacttcactggttcattctactcaaagactaaggcaatggttgaggaactgttgaacgagtacgagaatgtctgcactctgcgagtccggatgccaatatcgtctgacctcaacaacccccgaaacttcatcacaaagattagccgttacgacaaggtggtaaacatcccaaacagcatgactgtgttggatgagcttttgccgatttcagttgagatggcaaaaaggaacttgcggggcatctggaacttcaccaatcctggcgtggtcagccacaatgagattctggagatgtataagaagtacatggatcccagctacaagtggacgaacttcacgctagaagaacaggctaaggtcatagttgcacctcggagcaacaacgagatggacgcgacaaagctgaagagagagttccccgagctgctatcgatcaaagactcgttgatcaagtatgtctttgagcccaacaggaaggtcccagcaacttgaaagccagaacaggtaataatataggaaatatacaccaagcaccgaaagattttaggaaccattcgtcacagcgattcattagaaatgttttacgatacttgcagcatatctctgttatagattcacagaatcgtttgaactatacatttggcagtctgctggtggcagccatatatatcttgtaccatgattgttccgaatgaatgtcgagcacacttgtataccttttaatctggttgccttttttggtgattgatcgagcaacctgtgctctgacaaaagcatttggacaagcattt

SEQ ID NO: 12314 - DNA, 2518 bp, Quercus alba
atggggaggcatatttataaatacctggatcgtaggactttccctcctcatcctatacacaatcttctgtctccgtgttctcattgtcaaaattcagatttttaaaaaaaatatattaaaaaattctataattttctttaatattttttatattctgggctttggttcaatctcaggactacctaagttagttggagatggccactacatatgaaccaaagaacatcctcatcacaggagccgctggcttcattgcatcccatgtctgcaatcggctcattaggaaccaccctaattataatattgttgtcctcgacaagcttgattactgttcaaatttgaaaaacctgcttccctcaaaatcgtcccctaacttcaagttcgtcaagggagatattggcagtgctgaccttgtcaacttcatcttgctttccgagtccattgataccattatgcactttgcagcccagactcatgttgacaactcctttggcaacagctttgaatttactaagaacaacatatatggcacccatgtccttctagaggcctgcaaagttactggccaaatcaagaggtttatccatgtgagcaccgatgaggtttatggtgagacagatgaggatgctgttgtggggaatcacgaggcttctcagctcctcccaacaaacccatattctgctactaaagctggggcagaaatgcttgttatggcatatgggcgatcatatggcttgcctgtgattactaccagaggtaacaatgtttatgggcccaaccagttccctgaaaaaatgattccaaaatttatcctcttggccatgaagggacagcctctaccaattcatggggatggatctaatgttaggagttatctctactgtgaagatgtggcggaggcattcgaagtcattctccacaggggtgaagtgggccatgtctacaacattgggacattgaaagaaaggagagtgattgatgtggccaaggaaatttgccaacttttctctttgaacccagatacctatattaagttagtagagaataggccttttaatgatcaaagatacttcttggatgaccaaaagctgaagagcttgggatggttcgaacgtacttcatgggaagagggtctaaagaagaccatggaatggtatgtcaacaatcctgactggtggggtgatgtctctggagcactgctccctcatccaagaatgctaatggtgcctggaattgaaagaaagtttgatgggcctgatatcagcaattctgattccacttttgtggtaaataattctaatcagagccatatgatagttccaactccaaagaacaacccctctattcagaagccagctctgaagttcttaatttatggtagaactgggtggattgggggccttcttgggaagatttgtgagaagcaaggtataccctttgagtatggaagggggcgcttgcaggagaggtcacagatcttggcagatattcaaactgttaagccaactcatgtttttaatgctgctggagtgactggcagacctaatgtggattggtgtgaaactcataagccagagacaatccggaccaatgttgttggtactttaaccttggcagatgtctgcagagagcataaccttctaatgatgaattatgctactggctgtatttttgaatttgatgcagcacatccgttggggtctggaattgggtttaaggaagaagacaaacctaatttcactggttcgttctattcgaaaaccaaagccatggttgaggagcttttgagagactatgacaatgtttgcacccttagagtccgtatgccaatatcatctgatctcagcaacccacgtaacttcatcacaaagattacacgctataacaaagtggttgacattcccaacagcatgactatcttggatgagctgctgcccatttcagttgagatggccaaaaggaattgcaggggcatttggaacttcacaaatcctggtgttgtgagtcacaatgagattttggagatgtacaagaactacattgactccaattttaagtgggttaatttcacactggaagaacaggccaaggttattgttgcccctcgcagcaacaatgagttggatgcatccaagttgaagaaagaattccctgaacttctgccaatcaaggattcactgatcaaatatgtctttgagcccaacaagaaaactagtgctggtggagtgtcaaaataagcatgtcatgagcaccaatttatgcattcttattttctgggttacagaatttgctttactatcatcttaccatttttattcatcattcagattcttcatttctatcagttcttgtaattttttatgatatctaggatggttcgacaagctgtattgtttgtaatttcagtttggtcattgttgaaaccagttttgactggcttccaattgtctaaatatgttttgtgagcttattgtcatgtaattttaaaataaatcaataaattaaaagatgtttagta

SEQ ID NO: 12315 - DNA, 2679 bp, Populus trichocarpa
aaattacttacctgatggtcctccttaattgactcagtttttttatacttacgtaaccccccctacacgcgcgcgcacacacacaaacacatatatgaactctccttaatatccttctctaccagaccatatctttgtaccaatttcccttctttctgtctcttaaatcttcatttcatatctgggatttccttgatcttaaccagttttggatttaagttgttttggcatggctacatatactccgaagaacatcctaatcaccggggctgctggttttattgcatcccatgtttgcaataggcttatccgcaactaccctgattacaaaattgttgtgcttgacaagcttgactattgctcgaacttgaaaaacctcctcccttctaagtcatctcctaactttaagtttgtcaagggtgacattggaagtgctgatctcgtcaacttccttctgatcactgagtcgatcgacacaattatgcactttgcagcccagacccatgttgacaactcttttggtaacagttttgagtttaccaagaacaatatttatggaactcatgtccttttagaagcttgcaaagtcactggtcagatcaggaggttcatccatgtgagcacggatgaagtatatggggagaccgatgaagatgctgttgtaggaaatcatgaggcctctcaacttctcccaaccaacccctactctgcaacaaaagctggagcagaaatgcttgttatggcatatggccggtcatatgggctgcctgtgataaccactcgtgggaacaatgtttatggccccaatcagttccctgaaaaattaatcccgaagtttatcctcttagccatgcaagggaaggatctccccatccatggggatggttctaatgtgaggagttacttgtattgtgaggatgttgctgaggcttttgaagtcatccttcacaagggagaggtgggccatgtttacaatgttgggacaaagaaggaaaggagagtgattgatgtagccaaagatatttgcaatcttttctccatggaccctgataaaagcatcaagtttgtagagaatagaccgtttaatgaccaaaggtactttttggatgatcagaagctgaagattttgggttggtcggagcacactacatgggaggaggggttgagaaagactatcgagtggtacactcaaaatcctgattggtggggtgatgtcactggagccctgcttcctcatccaagaatgcttatgatgcctggtgggagacactttgacgggtctgaagagaacagagatgcatcttatgtctcaaataattcaaatcaggcccgaatggtgattccagttacaaaagtaggcactggctctcctcgaaaaccttctcttaagttcctaatctatggcaggactggatggattgggggtctgctggggaagttgtgtgagaaacaaggaatttcctttgaatatggaaaggggcgcttggaagatcgatcttcacttttgtcagatattcagaacatcaggcctacccatgtttttaatgctgccggggtcaccggcagacctaatgttgattggtgtgaatctcacaagacagaaaccatacgcaccaatgttgctggaactctaactttagcagatgtttgcagagagcacaacctcctgatggtaaattttgctacaggctgcatatttgagtatgatgctggtcatccagagggttctggcattggtttcactgaggaagacaagcccaatttcattggttctttctattcaaaaactaaggccatggtcgaagagcttttgagagaatatgacaatgtgtgcacgctcagagttagaatgccaatatcatcagacctaagcaacccgcgcaacttcattacaaaaatctctcgctacaataaagtagttaacattccaaacagcatgactatcttggaggaacttctacctatttcaattgagatggcaaaaaggaacttgaggggtatatggaacttcacgaaccctggtgttgtgagccataatgagattctggacatgtacaagaactacattgacccgaacttcacatgggttaacttcaacctagaggagcaagccaaggtgatagttgccccccggagcaacaatgagttggatgcgtccaagctgaagaatgaattccctgagttgctgccaatcaaggagtccctaatcaagtatgtttttgaacccaacaagagaacctaagcgaaagattcagttgctgatcatatcttgcattgctgtgcctccgagtacactaattatattctaatatttttgttctacttgctattcattgttagattcatatcatggtttctgccatattagagagtaaggaggttctttctatcactacttagattgctcatcattcctttccaaagcaaacaattataggtttttaaaatttgtagtcatctgggagcttgcaggtgggcctcttattagacaaatgtttcgttgttcgattcttatcgctgagcttttcaattgaacacgtactgctaccttgttatgttcaagaattgcagaatttagtttgtcttccaacagccagttcaataataatattcccattgcagaaactgttgttaacatcatttcagctacttggaatggccagttttttatgctttaag

SEQ ID NO: 12316 - DNA, 2404 bp, Arabidopsis thaliana
attcgttttccttcgttccctctctttcttcacactcctttttttatttatttccattgatctctctcctctcctcgatttttccctcctttaatccatctctgcatattcttcaagcttgggttcatcttcatcttgatctgaatcgatccgatggctacatataagcctaagaacatcctcatcactggggctgctggattcatagcctctcatgttgctaacagactagttcgcagctaccctgactacaaaattgttgtgcttgacaagcttgattactgttctaatctgaagaaccttaatccttctaaatcctctcccaacttcaagtttgtgaaaggagatatcgccagtgctgatctcgtcaactaccttctcatcactgaagaaatcgacaccattatgcactttgctgctcaaacccatgttgacaattctttcggtaatagctttgagtttaccaagaacaatatttatggtacccatgtccttttggaagcttgtaaagtcactggccagatcaggaggttcatccatgtgagtactgatgaggtctatggagagactgatgaggatgcttcagtgggtaatcacgaggcttctcagttgctcccaactaatccatactccgccactaaagctggagctgagatgcttgtcatggcatatggtagatcatatgggttgccggttataacaactcgcgggaacaatgtttatggtcctaaccagtttcctgaaaagttgattcctaagttcatcctcttggccatgaatgggaagcctctcccaatccacggagatggatctaatgtgagaagttatctctactgcgaagatgttgctgaggcatttgaggttgttcttcacaaaggggaagttaaccatgtctacaatatagggacaacgagagaaaggagagtgattgatgtggctaatgacatcagtaaactctttgggatagaccctgactccaccattcagtatgtggaaaaccggccattcaatgaccagaggtacttcctcgatgaccagaagctgaagaaattaggatggtgtgagcgaaccaattgggaagaaggactgaggaagacaatggaatggtatactgagaaccctgagtggtggggcgatgtttctggagctctgcttcctcatccacggatgttgatgatgcccggtgaccgacactctgatggctctgacgagcacaagaatgcagatggtaatcagacattcacggtggttactcccaccaaggctggttgttccggagacaaaagatccttgaagttcctcatctatgggaagactgggtggctcggtggtcttctgggaaaactatgtgagaaacaagggattccttacgagtatggaaaaggaagactagaggatagagcttctctcatcgcagatattcgcagcatcaaaccaagtcatgtcttcaacgccgctggtttaactgggagacccaatgttgactggtgtgaatctcacaaaactgaaaccatccgagtcaacgttgctggaactttgactcttgcagatgtttgcagagagaatgatctgttgatgatgaactttgccactggttgtatattcgagtatgacgctgcacatccagaaggttcagggattggttttaaggaagaagataaaccgaatttcactggttctttctactcaaaaacaaaggcaatggtggaagagcttctaagagaatttgacaacgtatgcaccttgagagtgcggatgccaatctcatctgacttaaataacccgcgaaacttcatcacgaagatctcgcgttacaacaaagtggtgaacattccaaacagcatgaccatactagatgaactcttaccaatctcgatcgagatggcgaagaggaacctaaggggaatatggaacttcaccaatccaggagtggtgagccacaacgagatattagagatgtacaagagttacatcgagcctgatttcaaatggtccaacttcaatttggaagaacaggctaaggtcattgttgctccacggagcaacaacgagatggatggtgccaagctcagcaaggagtttccagagatgctttccatcaaagattcgttgatcaaatacgtcttcgaacctaacaagagaacgtaaaacacagacacacacacgcacttccccgctctgtgttcactataatgtttctactatagttttatctgattcatttactctctttttttgcattctacgacttgcatgtagctgtcttcactcattctacgtcacaacacatctttgttttccattaatgttattacacagatcgatttgttggagttgtctctcctttcattattggttcctcctactcctattctataatccctgttttgttttcatgttaagc

SEQ ID NO: 12317 - DNA, 2433 bp, Triphysaria pusilla
caaaataacaatcgcatgaaccgcgtatatatatagaccactcctcgcttctcgcattcagtctccaatctgtctgaattatttcaatctttatcctttttattattttttatttatttcttattgatcttcttcccgacttctttgctcgccggtggatcctgatttaactcatcggaaataaaaaaaaaattaatccacaaatgtcgacgtttacgcccaagaacatccttattactggtgctgctggtttcatagcctctcatgtcgcaaacaggcttatccgaaactaccctgattacaaaattgttgtgctcgacaagcttgattattgttccagcctgaaaaacctcttcccttcaaaatcctctcccaatttcaaatttgtaaagggcgacatcgcaagtgctgacctagtcaactacctcctaatcactgagaacatcgacactataatgcacttcgcagctcaaacacacgttgacaattcgttcggtaacagcttcgagttcaccaagaacaatatttatgggacccatgtccttctcgaggcctgcaaagtcacgggtcagattagaaggttcatccatgtcagcacagacgaggtttacggtgagaccgaggaggacgcagtggtaggtaatcacgaggcctcgcagttacttcccacaaatccttactcggccacgaaagctggggctgaaatgcttgtcatggcttatggccggtcatacgggcttcccgtaatcacaacccgaggaaacaacgtttacggcccgaatcaattcccggagaaattaattccgaagttcgtccttttagccatgagaggacaaacactcccgattcacggggatgggtcgaacgtgaggagttatttatactgtgaggacgttgccgaggcttttgaatgcgttcttcataagggtgaagtgggccatgtttacaatatcgggacgaagaaggaaaggagagttatcgatgttgctaaggacatatgcagacttttcaacatggattctgataaggacatcaaatttgtggataacaggccgtttaacgatcagaggtatttcctcgacgaccagaagctcaagaatttgggttggtctgagaagaccacgtgggaagacgggctgagaaagactattgactggtacaagagcaatcctgagtggtggggcgatgtttctggtgcgttgctccctcatcctaagatgctgatgatgccaggtggcatcgagaggaattttgacggggctgagaagtacgaatcgggtaagtctgagttcgatgggaaatcggaccagactaacaaaacagtggtcccggtttcgaaaaacagcccatcggtagaaaaaccaggcctgaagttcttgatctacggtaagacgggttggatcggtggtttgctcgggaaattatgtgagaaacaggggattgcttacgagtatggaaaggggcgtcttgagaatcgatctcagatcgtggctgatattcttgctgttaagccgactcatgtgtttaatgctgctggtgtaacgggtcgacccaatgtggattggtgtgaaacacacaagactgaaacgattcgagccaatgttgctggtacgttgaccttggcggatgtttgccgagaaaaagatctgctgatgattaattacgcgactgggtgcatatttgaatacgatgctacacacctggaaggttctggagtcgggtttaaggaggaagataaacccaatttccttggctctttttattccaagaccaaggccatggtggaggagctattgagagaatatgataatgtttgcacgctgagagtgcgaatgccgatatcttcagacctgagcaacccgcgcaatttcatcaccaagatttcgaagtacaacaaggtggttaatatcccaaacagcatgacggtcctggacgagcttcttcctatttcgatcgagatggcgaaacggaacctaaggggcatatggaacttcactaaccctggtgtggtcagccacaacgagattttggagatgtacaagaaatatattgacccggaattcaagtacagcaatttcacgcttgaagagcaagctaaggtcatagttgctcagaggagtaacaatgagatggatgcttccaaactgaagaatgagtttccggagttgatgtcgatcaaggaggcattgatcaaaatcgtatttgaacccaacaggaaaacccttgcataaataagtgattttgtgccgcagctattacctatgtatgttagcttttagttcacacaatgctcagcttcaatttctgttttttttggttggtttgtttttcttgctactttgagggagatgattgctcaggatatgttcagttacttatgtatgaaaacatgcgttaaatttttagaattgtgctatgaataatttattttta

SEQ ID NO: 12318 - DNA, 2251 bp, Euphorbia peplus
gtatttcgccctgtcttgacctaattttgttttaagttgtttcggcatggcttcttacagccctaagaacatcctcatcactggggctgctgggtttattgcatcccatgtttgcaatcgccttatccgtaactaccctgattacaagattgtcgtccttgacaaacttgattactgttccaatctgaaaaacctccttccctcgaaatcatcccctaactttaagtttgtcaagggtgacattggcagtgctgaccttgtcaacttccttcttatcactgaatccatcgacactattatgcactttgctgcccagacccatgtcgacaactcctttggaaacagctttgagtttaccaaaaacaacatttatggtacccatgttctgttagaggcatgcaaggtcactggtcagattagaaggttcatccatgtgagcacagatgaagtttatggggagacagatgaagatgctgttgtaggaaaccatgaagcatctcagctcctaccaactaatccatactctgctacaaaagctggtgcagaaatgcttgttatggcatatggtaggtcatatgggttacctgtgataacgacccgtgggaacaatgtgtatgggcctaatcagttccctgaaaaattaatccccaaattcatgctcttggctatggaggggaagcctctaccaatccatggagatggttctaatgtgaggagttatttatactgtgaggatgttgctgaagcttttgaagtcatccttcacaagggagaggtaggtcatgtttacaacattggaactaagagggaaagaagagtgattgatgttgctcaagatatatgcaatattttatcaaggaaccctgaaacaagcatcaagtttgtggagaacaggccgttcaatgaccagaggtactttcttgatgatgagaagctgaaaatcctgggatgggcagaacatactacatgggaagagggactgaggaagactatggagtggtacaagcaaaatcctgattggtggggtgatgtaactggagcattgctgcctcatccaagaatgctaatgatgcctggtggaagacactttgatggttctgaagagagtaaatctgcatcatacgtgtcaaatacttctactcagagcaaaatggtcattccaattcctagaagcaccagcagtggatctcctcgaaaaccctctttgaaattcttgatctatggtaggaccggatggattggaggtctccttgggaagctgtgtgagaaacaaggaattgcctatgaatatggaagggggcgcttggaagatcgatcatctcttttggcagatattcagaatgttaagccaacccatgtttttaatgctgctggtgtcactggtagacccaatgttgattggtgtgaatcccataaggcagaaaccatccgggcaaatgttgctggaaccctcactttagcagatgtttgcagagagaataacctcttgatgatgaattttgctactggctgtatatttgagtatgatgctgctcatccagagggttctggcattggatataaggaggaagacaaacccaatttcactggctccttttattcaaagaccaaggctatggttgaggagctcttgaaagaatatgacaatgtatgtaccctcagagttcgaatgccaatatcctcggatcttaacaacccaaggaatttcattacaaagatttctcgatacgacaaggttgttaacattccaaacagcatgtcagtcttggatgaacttctaccaatttctatagagatggctaagcggaacttgaggggtatttggaacttcacaaacccaggtgtggtgagccataatgagattctggaaatgtacaagaagtacattaaccctgagttcaaatgggctaacttcacactagatgaacaagcaaaggtgattgttgcacctcgaagcaacaacgagatggatgcatccaagttgaagaaagaattcccagagttattgtcaatcaaggagtccctgatcaagtatgtgtacgaacccaataagagaacctaaacaaaacagagagtctattttgcataaatatgttgccaaggatatgcttagttttacaagtctagtctactactagttatttttactgtaagattgtcgcattgttctttttaccatattagaaagtgaagtccttcccttcctattaggtatgattcctttgtccagagtcgtattttagcctgccta

SEQ ID NO: 12319 - DNA, 2304 bp, Phalaenopsis aphrodite
ccgaaacttccatatctctcttcaatccgctcctcccccacccgaaaccatccagaaaggagtttggttctgcactctcagtttggatatatttcaccaaccagaaagcaatggaatcctataagcctaaaagcatcctcatcaccggggctgctggtttcattgcatcgcatgttgccaataggctcatccgcaactaccccaattacaaaattgtggtccttgacaaactcgactactgctccaaccttaaaaacctttccccttctggatcctccaccaacttgaagttcgttaagggtgacatcgctagtgctgatcttctccattaccttctcatcacagagtacatcgacacgataatgcactttgcggctcagactcacgtcgacaattctttcggcaactcctttgagttcactaaaaacaacatctatggaactcatgttttgcttgaggcttgcaaggtctccggtcaaataaggagattcatccatgtcagcacagacgaagtttatggggagaccgatgagaatgccattgttggcaaccacgaagcctctcagctcctccctacgaacccatattctgccaccaaagccggagctgaaatgcttgtgatggcttatggaaggtcctatggcttacccgtcataaccacccgtggtaataatgtctacggaccaaatcaatttcccgaaaagttgattccaaagttcatccttctagcaatgagaggacaaacccttccgattcatggagatggttctaacgttcgaagctacctctactgtgaggacgttgccgaggcttttgaggttattcttcatagaggggagatcggccatgtttataatattgggacaaaaaaagagaggagggtgattgatgtagcaaaagatatctgcaagcttttcgcgcgggatcccaccaccgcaattaagtacgtcgacaacaggccgttcaacgaccaaagatactttctggatgatcagaagctaaaaattttgggttggtcagaaagaactacttggcaagagggattgaaaaagactatggattggtacacaaacaatccagattggtggggagatgtctctggagcacttttaccacatccaagaatgctaatgatgccgggcactgaaaggcattacgatggccctgaagtgataattaagagcatgttgtcttcgccaaacaatattaacatttcaagccaaatgataacaccacccgtttcagaaacctcatcttttggtaccaaaatgcagtctttgaagtttttgatatacggaaaaaccggatggatcggcggtcttctcgggaagatatgcgagaagcaagggataccgttcgagtacggaaaaggcagattagaatgtcgatcccagctccaatcggatattcataatgttaagccgacacatgttttcaatgccgctggtgtcaccggcaggccgaatgtcgactggtgcgaatctcatcgacaagaaactatccgcaccaatgttattggaacgttaactctggctgatgtttgctccgagaatggtttgttgctcatgaattatgcgactgggtgtatctttgaatatgatgctaatcaccccgaaggctcaggctatggattcaaggaggaagatagcccaaacttcattggttcctactactcgaaaacaaaggccatggttgaggagcttctgaaggagtacgacaacgtctgtactttaagagtccgaatgccgatatcatctgatctaaacaatcctcgtaacttcatcacgaagatcagtcggtacaacaaggtggttaatatcccaaacagcatgactgtattggatgagttgcttccaatatcgatcgagatggctaagagaaactgcaggggaatatggaacttcaccaacccaggtgttgtgagccacaatgagatcctggagttgtacaaggcttatattgatcccggcttcagttgggtcaactttacactcgaagaacaggcgaaggtgatcgtcgcgcctcgcagcaataacgaattggatgccttgaaattgaagagcgagtttccggagctgctgtctattacagaatctctcataaaatatgtgtttgagcccaacaggaagcagggaaaatgatgcattgtgttgagtgctatggagggggtaatctttttcttttgaaatgaaaggaaatatttattcttagaatgaatttggtagttagcctatgttttgatcagcatgacctcaaagatgatgactttattaactagagtatttgtttatgttttaagaaata

SEQ ID NO: 12320 - DNA, 2417 bp, Zea mays
gcaccgtgcattccgcctacccctcctcccttccatcaccgcttgcatttattaaccacctcccctccccagcgacatctcgtgtctctgttgggagctccttcaacatctcgtctctctcatcctccgacgccatccgctcccggcccggccgagccgcgcgttgtgtatggattccaaaagcaatcatacaggggctatggcgaggccttacaaacctaagaatatcctcattacaggagctgctggttttatcgcctcccatgtcgcaatccgcattaccaagaagtaccccgattacaagattatcgtccttgacaaacttgactactgctctaatctgaagaacctgcttcctgtgagctcatcaccaaacttcaagtttgtgaagggtgatattgcaagtgttgatcttgtcaacttccttcttgtcacagagaacattgataccataatgcacttcgcggcccagacacatgtcgacaattcatttgggaattctttcgaatttaccaagaacaatatttatggtacacatgtacttcttgaggcctgcaggattagtggccagatcaagaggttcatccatgtcagcactgatgaggtctatggggagactgacgaggatgcagttgttggcaaccatgaagcatcacagctgcttcctacaaacccatatgcagccaccaaagcgggagcggagatgcttgtaatggcatatgggagatcctatggactgccagttatcactactcggggaaacaatgtctatggcccaaatcagttccctgagaagcttatcccaaagttcattctcttggccatgagaggggagcccctccctatccatggtgatggagtcaatgtccgtagctacctctattgtgaggatgttgcggaggcatttgaggtcattcttcatcatggagaagttggacatgtttataatattggaacaaaaagggagaggacagtgcttgatgtggcaaaagatgtttgcagactcttcaatcttgaacctgacaaagtcatcatgtttgtcgagaacagaccttttaatgaccagaggtatttcttggacgatgagaagctcaagagccttggatgggctgagcgcaccccatgggaagaaggcttaaaaaagacaatggagtggtatgtagcaaattctgattattggggtgatgtttctggggccttactgcctcatccaaggacattgatgatgccagggtgcgaggggtctgaggagattaaaggaatactcagccggtttaataacattcaaacaaaggtcggttcaacatcagataatgctccagaaccgcatgccttcaagttcttgatatatggcaggacaggatggatcggcggacttcttgggaaaatatgtgagaagaaaggaattccatatgaatatggaaatggccgcttgcaagagcgttcttcactcgtcctagacatccaaactattaagccaacacatgtcttcaatgccgctggtgtgactggaaggcccaatgttgattggtgtgaatcgcacaagccggacaccatccgtaccaatgttgtgggcaccttgaatctagcagatgtatgtaggaagcatggcttattgatgatgaactatgccactgggtgcatatttgaatacgatgcacatcatcctgaagggtcaggtatcggcttcaaagaggaagatacaccaaattttactggttcgttctactcgaagacgaaggcaatggtcgaggagttattgaaggagtatgagaacgtctgcactctgcgagttcggatgccgatatcctctgacctcagcaacccgcggaacttcgtgacaaagatcagccgttacaacaaggtggtgaacatccccaacagcatgacgatattggacgaactcctgcccatctcagtggagatggcgaagaggaacctgcggggcatctataacttcaccaaccccggcgtcgtcagccacaacgagatcctagagatgtacaagcagtacatcgaccctagcttcaagtggacaaacttcaccctcgaggagcaggcgaaggtcatcgttgctccgcgaagcaacaacgagatggacgcaaccaagctgaagaacgagttccccgagctgctgtcgatcaaggactcgttgatcaagtacgtctttgagcccaacagaaaggtgcccacagactgaagcccgaagggctggcacagctgataccgtacaacacagcaaccattagtgttagactatgtgtgtgggccagcactactttacttttgggctgtcggtctattagggttagagtcctgtgagtctatatattgtacctcatctcttatacaatacatttttgggctgtgagtctatatattgtcgaacagcagaggaggtcgagggcggggctgtc

SEQ ID NO: 12321 - DNA, 2301 bp, Triphysaria pusilla
ttgatcttcttcccgacttctttgctcgccggaggatcctgatttaactaatcggaaataaaaaaaaaattaatccacaaatgtcgacgtttacgcccaagaacatcctcattacgggtgctgctggtttcatagcctctcatgtcgcaaacaggcttatccgaaattaccctgattataaaattgttgtgcttgacaagcttgattactgttcaagcctgaaaaatctctttccttcaaaatcctctcccaatttcaaatttgtaaagggcgatatcgccagtgctgacctagtcaactacctcctaatcactgagaacatcgacactataatgcactttgctgcccaaacccacgttgacaattcgttcggtaacagcttcgagttcaccaagaacaatatttatgggacccacgtccttcttgaggcctgcaaagtcactggccagattagaaggttcatccatgtcagcacagacgaggtctacggtgagaccgaggaggatgcagtggtaggcaatcacgaggcctcgcagttacttcccacaaatccttactcggccacgaaagctggggctgaaatgcttgtcatggcttatggccggtcatacgggcttcccgtaatcacaacccgaggaaacaacgtttacggcccgaatcaattcccggagaaattaattccgaagttcgtccttttagccatgagaggacaaacactcccgattcacggggatgggtcgaacgtgaggagttatttatactgtgaggacgttgccgaggcttttgaatgcgttcttcataaaggtgaagtgggccatgtttacaatatcgggacgaagaaggaaaggagagttatcgatgttgctaaggacatatgcagacttttcaacatggattctgataaggacatcaaatttgtggataacaggccgtttaacgatcagaggtatttcctcgacgaccagaagctcaagaatttgggttggtctgagaagaccacgtgggaagacgggctgagaaagactattgactggtacaagagcaatcctgagtggtggggcgatgtttctggtgcgttgctccctcatcctaagatgctgatgatgccaggtggcatcgagaggaattttgacggggctgagaagtacgaatcgggtaagtctgagttcgatgggaaatcggaccagactaacaaaacagtggtcccggtttcgaaaaacagcccatcggtagaaaaaccgggcttgaagttcttgatctacggtaagacgggttggatcggtggtttgctcgggaaattgtgtgagaaacaggggattgcttacgagtatggaaaggggcgcctcgagaatcgatctcagatcgtggctgatattcttgctgttaagccgactcatgtgtttaatgctgctggtgtaacgggtcgacccaatgtggattggtgtgaatcacacaagactgagacgattcgagccaatgttgctggtacgttgaccttggcggatgtttgccgagaaaaagatctgctgatgattaattacgcgactgggtgcatatttgaatacgatgctacacacctggaaggttctggagtcgggtttaaggaggaagataaacccaatttccttggctctttttattccaagaccaaggccatggtggaggagctattgagagaatatgataatgtttgcacgctgagagtgcgaatgccgatatcttcagacctgagcaacccgcgcaatttcatcaccaagatttcgaagtacaacaaggtggttaatatcccaaacagcatgacggtcctggacgagcttcttcctatttcgatcgagatggcgaaacggaacctaaggggcatatggaacttcactaaccctggtgtggtcagccacaacgagattttggagatgtacaagaaatatattgacccggaattcaagtacagcaatttcacgcttgaagagcaagctaaggtcatagttgctcagaggagtaacaatgagatggatgcttccaaactgaagaatgagtttccggagttgatgtcgatcaaggaggcgttgatcaaaatcgtatttgagcccaacaggaaaacccttgcataaataagtgattttgtgccgaagctattacctatgtatgttagcttttagttcacacaatgctcagcttcaatttctgtttttttttggttggtttgtttttcttgctactttaagggagatgattgctcaggatatattacttatgtgtgaaaacatgttaaattttcagaattgtgctatgaagaatttattt

SEQ ID NO: 12322 - DNA, 2356 bp, Arabidopsis lyrata
tcgttttcatccactctctttcttcttcactgttttatttatttccattgatctctcccctctcctcgaattttccctccttttaaaccatctctgcatatattcttcaagcttaaggtttgatcttcatctgaaatcgatccgatggctacatataagcccaagaacatcctcatcactggtgctgctggattcatagcctcacatgttgccaacagactagttcgtagctaccctgagtacaaaatcgttgtgcttgacaagcttgattactgttctaacctgaaaaaccttaatccttctaaatcctctcctaacttcaagtttgtgaaaggagatatcgccagtgctgacctcgtcaactaccttctcatcactgaagaaatcgataccattatgcactttgctgctcaaacccatgttgacaattctttcggtaatagctttgagtttactaagaataatatttatggtactcatgtccttctggaagcttgtaaagtcactggccagatcaggaggttcatccatgtgagtactgatgaggtctatggagagactgatgaggatgcttctgtgggaaatcacgaggcttctcagttgcttccgactaatccatactctgccactaaagctggagctgagatgcttgttatggcatatggtagatcatatgggctgccggttataacaactcgcgggaacaatgtttatggtcctaaccagtttcctgaaaagctgattcctaagttcatcctcttggccatgaatgggaagcctctcccaatccacggagatggatctaatgtgagaagctacctctactgcgaagatgttgccgaggcatttgaggttgttcttcacaaaggggaagttaatcacgtctacaatatagggacaacgagagaaaggagagtgatcgacgtggctaatgacatcagcaaactctttgggatagaccctgactccaccattcagtttgtggagaaccgcccatttaatgaccagaggtactttctcgatgaccagaagctgaagaaattgggatggtgtgagcgaaccaattgggaagaaggagtgaggaagacaatggaatggtacactgagaaccctgagtggtggggagatgtttctggagctctgcttcctcatccacggatgctgatgattcccggtgaccgacactctgacggctctgacgagcacaaggactcggatggtaatcagacattcacggtggttactcccaccaaggctggtgcttctggagacaaaagatccttaaagttcctcatctatgggaagactgggtggctcggtggtcttctgggaaaactatgtgagaagcaagggatttcatacgagtatggaaaagggagactagaagacagagcttctctcatggcggatattcgcagcatcaaaccaagtcatgtctttaacgccgctggtttaactgggagacccaatgttgactggtgtgaatctcacaaatgcgagaccatccgagtcaacgttgctggaactttgactctggcagatgtttgcagagagaatgatctgttgatgatgaactttgccactggttgtatattcgagtatgacgctgcacatccagaaggttcagggattggatttaaggaagaagacaaaccgaatttcactggttctttctactcaaaaacaaaggcaatggtcgaagagcttctaagagaatttgacaacgtatgcactttgagagtgcggatgccaatctcatccgacttaaataacccgcgaaactttatcacgaagatctcacgttacaacaaagtggtgaacatcccaaacagcatgaccatactagacgaactcttaccaatctcaatcgagatggcgaagaggaacttaaggggaatatggaacttcaccaatccaggagtggtgagccacaatgagatactagagatgtacaagagttacatcgagccggatttcaaatggtccaacttcaatttggaagagcaggctaaggttatcgtcgcaccacggagcaacaatgagatggatggttctaagctcagcaaggagtttccagagatgctttccatcaaagattcgttgatcaaatacgtcttcgaacctaacaagagaacgtaaaacacagacacacacatacttcccctctctctgttcactataatgtttctacaataacttgattttgatttttatcatatgattcatttactcttttttgcattctacgccttacatgtagctctcttcactcattctacttcactacacatctttgtttacattaatattataatacacagatcgatttattggagttgggttttttcctttcatt

SEQ ID NO: 12323 - DNA, 2491 bp, Eutrema parvulum
cctgtgctcaatttcgtccttccttctttgtcaaatccaggaagttttgtcatggcttcatatactccgaagaacattctaatcaccggagcagccggtttcattgcttcacatgtcgccaacaggctcataaggacctacccggattacaaaattgttgtccttgacaagctcgactactgttcaaacctcaagaacctcaacccctcgaagcaatcccccaatttcaagttcgtcaagggtgatatcgcaagtgcggatcttgttaactacctactcatcactgaaggcatcgacaccatcatgcatttcgccgctcagactcacgtcgacaactcgttcggtaacagtttcgagttcaccaagaacaacatctatggaacgcatgtccttctcgaggcctgcaaagttaccgggcagatcaggagattcatccatgtgagcacggatgaggtctatggcgagaccgatgaggatgctgttgttggtaaccatgaagcttcccagcttctcccaacgaacccttactctgcaacaaaagctggagctgagatgcttgttatggcgtacggtagatcttacgggcttcccgttataacaacgcgtgggaacaatgtctatggacctaaccagtttccggagaagctgattcctaagttcatcttgctggcaatgagagggaaagttcttcccattcatggagatggcacgaacgttcgtagctatctttactgtgaagatgttgctgaggcgtttgaggttattcttcacaagggagaagtaggccatgtttacaacattggtaccaagaaagagaggcgagtgaatgatgttgcccaagacgtctgcaaactcttcaacaaggaccctgaggcaaacatcaagtttgtcgagaacagaccttttaacgaccagaggtacttcctcgacgatgagaagcttaagatcttgggatggtcagagaggaccacctgggaagaagggttgaagaagacaatggaatggtacacgcagaacccggattggtggggcgatgtttctggagcattgcttccccacccgaggatgctggtgatgcctggtggaagacattctgatgggtctgaagagaactctggagcagtctctttatctggaaactcaaggcagagccagatggtggttccgacacccagaagcagtggctccacccaaaacccctcactcaaattcttgatatatggtaagacaggatggattgggggtttgcttggacagatttgtgagaagcaaggaattgcttttgagtatgggaaagggcggcttgaggatcgatcatccctcttgcaagatattctgaatgttaagcctacccatgtctttaatgctgctggagtgacagggagacccaatgtggactggtgcgagtctcacaaaacagagaccatccgtgccaatgtagcaggcactttgactctggctgatgtctgcagagagcacagcctcctgttgatgaactttgctactggttgtatattcgaatacgacgaaaatcatccgctaggttcaggcattggcttcaaagaagaagacacaccaaacttcactggttctttctactcaaaaactaaagccatggtcgaggagctgcttaaggagtttgataacgtatgcactctaagggtcaggatgccgatttcatctgatctaaacaacccgagaaacttcatcaccaagatttcccggtacagcaaagtagtgaacatcccaaacagcatgaccgtgctggacgagcttcttccaatctcgatagagatggcgaaaagaaacctgaaagggatttggaacttcaccaaccctggtgttgtgagtcacaatgaggtcctagagatgtatagagactacattgactcagacttcaaatgggcaaatttcacactagacgagcaagctaaggtcattgtggctcctagaagcaacaacgagatggacgcatctaagctcaggaaagagttccctgaattactttcaatcaaggagtctctgctcaaatatgcctttgagcccaacaagagaacttgaggtaatataacttttctcagttttgttttaaactggtttgtgattagtttctcccctgattcttaaaccaaaagcaactagctttacctttaggtttatccattaaggggtatatctagtttggattcttatatgttattgatttgttggtattgtattcctgttccacatttgatagataaaaactagatttctgtattatttgctgacactattacaaattcaaaacctaataaggtttacaaacggttaaatccaaagcatatcggtaaattgcaataactctttcggtggcagaaaactctctgtcgttatttcttttggtttctgtctctgtcaagaatagattggaacaactaagaaaatgggaaagctactaaggatcatgctcctacatttcagagcagtggactcctcttattatacacaa

SEQ ID NO: 12324 - DNA, 2542 bp, Cycas rumphii
ccaaaaaaatcagaatttttttgtctgtttttttttccccttcatctgtgcatctgggtttttctcggtctagatcttttcatttgggtttttgtttttttcccctggatctgcttaccgagcccggggtttagcccaagattcaattacagagcgaaatctgcaggcaaaagatggcttctgagaatgcaaagccaagcccaaataccaagtacacacccaagaacattctcatcactggtgctgctggattcattgcctctcatgtggccaacagattgatcagaaattatcctcaatacaagatagttgtgctagataagctagattattgctcaaatctgaagaatctcttgccttcgaaatcatcccccaacttcaaatttgtaagaggagatataggaagcgctgatctggtgaattatctcttaatcacggaaggcatagatacaatcatgcattttgcagcacagacccacgtggataactcctttggaaacagctttgaattcacgaagaacaatatctatggaactcatgtgctgttggaggcctgtaaggtcacagggcaaatcaggcggtttattcatgtcagtactgatgaagtatatggggaaactgaagaggatgcagtcgtgggaaatcacgaggcttctcaacttcttcctacgaatccttactctgcaacaaaggctggtgcagaaatgctcgtcatggcatatgggagatcctatggtttgcctgtaattaccaccagaggtaataatgtctatggacccaatcagttccctgaaaagctcattccaaaattcattcttctagccatgaaagggcatcctcttccaatacatggtgatggatctaatgttagaagctacctctactgtgaggacgtggccgaagcatttgaggtggttttgcacagtggagaagttggtcatgtgtataacattggtacgaagaaggagagaagggttattgatgtagctaaggatatatgcaagcttttttcccaagaccctgaaagggttattaaatttgttgaaaataggccttttaatgatcagaggtacttcttggatgatcaaaaactcaaggatttgggctggtctgaacggacaacgtgggaagatgggctgaaaaaaccgatggagtggtatactagccatccagattggtggggtgacgtttcaggtgctttgctgcctcatccaagaatgcttacgatggctggtgtagagaggcacagtgatgggtcagaagataatggtttgaatgtttctcctgttgctaataattctgtccagagccgaatggttgttccctcaaggagttcctctcagaaaccggccctaaagtttttgatttacgggcgtaatggatggattggaggccttctcggccagatctgtgagaagcagggtatctcttttgagtatggaaatggcagattggagaatcgtccccagcttcagcaggatatccagaatgtgaaaccaactcatgttttcaatgctgcaggtgtgactggcaggcctaacgtggactggtgtgaatctcacaagccagagaccattcggacaaatgttgtgggtactttgaatttggcagacatttgcagggagcaaggacttttgcttgtgaactttgctactggttgtatatttgagtatgattgtgctcaccctgaggggagcggtgttggattcaaagaagaggacaagcctaatttcgttggctcattctattcaaagacaaaggctatggttgaagagctgctgaatgaatatgagaatgtttgcactcttcgtgttcgaatgcccatctcttctgatctgaacaatcctcgcaatttcattacaaaaattagccgttacaacaaagtggttaatataccaaacagcatgacagttcttgatgaattgttaccaatttcagttgagatggcaaaaaggaattgcagaggcatatggaacttcacaaatccaggagttgtaagccataatgagattttggagatgtacagggagtacattgatcccagcttcaagtgggtgaacttcaaccttgaggaacaggccaaagtgatagttgctcctcgtagtaacaatgaattggatgcttccaaattgaagagagagttcccacagttattgtctatcaaagattcactattgaagtatgtctttgagcccaacaagaagagtagattagcgaatggatcataaattttggttggatttgtttgataaacattctggtttatgcaattcttcagtatatggatctcttattatgttgaactcgccctagaattggggggctaaccagcatagacctaggtggtggcaggacggcgttattatttggcctgactatattctttatgaaaatatcagacaattggcggtatttgcattgaaactcttctgctgcaggggattgtaagggaagggtttatttcaattcatttagatgttttcatggtttattgtcattgtttagtggaaaaattttgcagcattgagcattatgaaagttc

SEQ ID NO: 12325 - DNA, 2648 bp, Sorghum bicolor
gtgggcaccttctccaccactacacacttgtccttccttgccaaaaccaaaagccaaaaaagcctaaaccaaccccaacaccaccgtgccatgcattccgccttcccctcctcccttccaccaccaccaccgccttccctcctcccttccaccaccaccaccgtctgcatttattaaccacccctcatccacgacctctcagatctctcttcaaccgatgtcatctgctcctgccccggctgaggcacgcattgcgtacgcaggattctaaaagcaatcatacaggggacatggcgaggccttacaagcctaagaatatcctcattacaggagctgctggctttatcgcatcccatgtcgcgatccgtgttaccaagaagtaccccgattacaagatcgttgtccttgacaaacttgactactgctctaatctgaagaacctgctccctgtgagctcgtcaccaaacttcaagtttgtcaagggagatattgcaagcgctgatcttgtcaacttccttcttgtcacggagaaaattgacaccataatgcacttcgcagcccagacacatgttgacaattcatttgggaattctttcgaatttaccaagaacaatatttatggtacacatgttcttcttgaggcctgcaggattactggtcagatcaagaggttcatccatgtcagcactgatgaggtctatggggagactgatgaggatgcagttgttgggaaccatgaagcatcacagctgcttcccacaaacccatatgcagccaccaaagcgggagcagagatgcttgtcatggcatatgggagatcctatggacttccggttatcacctctcgaggaaacaatgtctttggccccaatcagtttcctgagaagcttatcccaaagtttattcttttggcaatgagaggggagccactccctatccatggtgatggaggcaatgtccgtagctacatctattgtgaggatgttgcggaggcatttgaggtcatcctacatcatggagaagttggacatgtgtataatattggaacaaagagagagaggacagtaattgatgtagcaaaagatgtttgtaagcttttcagtcttgaagctggcaaagtcatcatgtttgtcgagaacagacctttcaatgaccagaggtatttcttggacgatgagaagctcaagagccttggatgggctgagcgcaccccatgggaggaaggcttaaaaaagacaatggaatggtatgtagcaaattctgattattggggtgatgtttctggggccttactgcctcatccaaggacattgatgatgccagggtacgagggctctgaagagattaaaggaattctcagtcagttcaataacattcaaacaaaggtcacttcaacattggatactgctctagaaacgcatgccttcaagttcctggtatatggcaggacaggatggatcggtggacttcttggaaaaatatgtgagaagaaaggaattccatatgagtatggaaaaggccgcttgcaagaacgttcttcactcaacctggatatccaaactattaagccaacacatgtcttcaatgccgctggtgttactggaaggcccaatgttgactggtgtgagtcacacaaaccagacaccattcgtaccaatgttgtgggcaccttaaatctagcagacgtatgtagggagcatggcttattgatgatgaactacgcgactgggtgcatatttgagtatgatgcagatcatcctgaagggtcaggtattggtttcaaagaggaagatacaccaaattttacaggttcattctactcgaagacgaaggcaatggtcgaggagctattgagggagtatgagaatgtctgcactctgcgagttcgaatgccaatatcctctgacctcaacaacccccgaaactttgtgacaaagatcagccgttacaacaaggtggtgaacatccccaacagcatgacgatgttggacgagctcctgcctatctcagtggagatggcaaagaggaacctgcggggcatctataacttcaccaaccctggtgttgtcagccacaacgagatcctagagatgtacaagcagtacatcgaccctagcttcaagtggacaaacttcacccttgaggagcaggccaaggttattgtcgcgccacgaagcaataatgagatggatgcaaccaagctgaagaaagagttccccgaactgctatcgatcaaagactcgttgatcaagtttgtctttgagcccaataggaaggtgcctataaactgaagggacagcacagttattactgtacaacacagtaaccattataagcaagtatatagtaggagcaaattgccacaattgattcattagaatgttattcctcatacatagcagcatatcttaactatcgattgatttacagctgaataggcgatgtatataaatatggtaatcaacactgaccattgcccaatttgttggagacatcaccagcctatgtgtaccaccactttgtccaataggaagctggaatgattctatgatactactcaatctgatgtgtcctatcaattgaatagctccttgtcgacaaaagctggtcggcagtctaccttggggtatacccacggtagtagttta

SEQ ID NO: 12326 - DNA, 2575 bp, Amborella trichopoda
atctcaaaatcatctcgcccccccccccctcttctctctctctcgaataaaaaaacctgttcgttttctcagcaacagctcgacgagcaactaacgttctatctccatagatctcaatctgcgaaacctgatctggagaagatggcacaaagtggccaaacctcgcctggaagtgttggctacacccccaagaacatcctcatcactggtgctgctggttttatcgcttctcatgtggccaacaggctcattaggaactaccccaactacaaaatcgtagtccttgacaagctagactattgctccaatctcaagaaccttctcccttctcgatcttcacccaatttcaaatttgtcaagggagatattgctagtgctgatcttgttaactttcttttgattactgaaaaaattgacacaattatgcactttgctgcacaaacccatgtcgacaattcatttggaaacagtttcgagttcacaaagaacaatatctatggaacccatgtcctcttagaagcttgcaaggtcactggtcaggttacgaggttcatccatgttagcactgatgaggtctatggtgaaactgatgaagatgcagttgttggtaatcatgaggcctctcagctcctcccaactaatccttattctgcaactaaagcaggggctgagatgttggttatggcctatgggagatcttatggtctccctgtgatcacaactaggggaaacaatgtctatggacccaaccaatttcctgagaaactcattcccaagttcatactgttggccatgaaagggaaaccacttccgattcatggagatggatcgaacgtgaggagttatctttactgtgaggatgtggctgaggcttttgaggtgattttgcatagaggggaagtggggcatgtgtataatattgggaccaagaaggaaaggagagtgattgatgtggccaaggatatctgcaagcttttctctctcaaccctaatgaggtgatcaagtttgtggagaacagacccttcaatgatcagaggtactttttagatgatcaaaagttgacgaatttgggatggtctgagaggaccacatggcaagaagggcttagaaagaccatggagtggtacacgagccacccagattggtggggtgatgtgtcgggtgctcttttacctcacccaagaatgcttatgatgcctggtataaagacacagttcgatggctctgaagatactaatggtggggcttctcatgtggagaacagttctggccaaagccatatggtggttccaccttcaaagggaagtggctcttctactaagccatctcttaagttcttgatttatggtaggactggctggattgggggtcttttagggaagatttgtgagaaacaagggatagcttatgactatggaagagggcgattagaggagcgctcccaacttttagcagatattcaaaatgtgaagccaacacatgtttttaatgcggctggggtcactggcaggcctaatgtcgattggtgtgagtctcataagcctgagacaatacgcaccaatgtggtgggaacactaaatttagcagatgtttgccgagagcaggggctcttgatggtgaattttgcaactgggtgtattttcgagtacgatgttgagcaccctgagggttcaggcattgggttcaaggaggaggacaagcccaatttcactggttcgttctattcgcagaccaaggcaatggttgaagaacttctcagtgagtacgagaatgtgtgcaccctcagagttcggatgccgatatcatctgatctgaccaatccacgaaacttcattaccaagattgccaattacaacaaggtggttaacattccaaacagcatgaccatcttggatgagcttctgcctatatcaatcgaaatggcgaaaaaaaattgcaggggaatatggaactacacaaaccctggtgtggtaagccacaatgagatcttggaaatgtatagggattatattgatccatccttcaagtgggtcaattttaatcttgaagagcaagccaaagtgatagttgctccaaggagcaacaatgaattggatgcttccaagttgaagaaagagttcccagagcttctctctattaaagaatccctcatcaagtatgtatttgaaccgaacaagagggtctgaaatcctgagctcattagtcattttagagagagagaaagctaaccttgatagctacgatcatgaataggaatttaccaatgcgctcctagtacctttattgttttatttttttcaattttggggtaatcctggtggtttttttcgattatgttctctgttggttatgttttggtggctgtttctgtcatatgtaagggattgccctgtatttgtgattcttgcttccatggagctgtttgctagcagtcatgtcatttttgaggtgcagtatccgatttagatgtgtaatatcaatgagaatatttctcatttcactagtgtgatttgcaatgtttctctctcaatgctacttctatttattagaatattggtgcatatcaacatattt

SEQ ID NO: 12327 - DNA, 2299 bp, Flaveria ramosissima
ctaatcggctgatcagaaactatcctgattacaagatagtcgtgcttgacaagcttgattattgttccagtcttaagaacctcaacccctcgagatcgtctcccaacttcaagtttgttaagggggacattgggagcgctgacctcgtcaactacctcctgatcactgaatctattgataccataatgcactttgctgcacagacccatgttgataactcgttcggcaacagttttgagttcacgaagaataacatttatggaactcatgtgcttcttgaagcctgcaaagtcactggccagattaggagatttatccatgtgagcacagatgaggtctatggagaaacagaggaggatgctgttgttggtaaccatgaagcttcacaacttcttcctacaaacccgtattcagccacaaaagcgggtgcagaaatgcttgttatggcttatggtaggtcatacgggttgcctgtgattactaccagaggaaacaatgtttatggcccgaatcaattcccagaaaaactaatccctaagttcattcttctggctatgagaggaaaaccacttccgattcatggtgatggttctaatgtaaggagttacctctactgtgaagatgttgctgaggcttttgaagtaattcttcacaagggggaagttggtcatgtttacaacatagggaccaagaaggaaaggcgagtgattgatgtcgcaaaagatatgtgcaagcttttcaatatggatcctgattcaagcatcaagtttgtggagaacagaccatttaatgatcagaggtatttcttagatgatgagaaattgaagagcttgggttggtctgaaagaactacatgggaagagggtttgaaaaagacgatcgagtggtataccagcaacccgaattggtggggagatgtctctggagcacttctgcctcatccaagaatgttaatgatgccgggtggcgttgatagacatgttgatggacctgaaaatgctgaactggattcagctggtgtggcaatcaatacctctcaggttggtgtccagattcctagctcaaaaaccagtggcgtttctgctaagaaaccagctttgaagtttctcatttatgggaaaacagggtggatcggtggtttacttggaaagttatgtgacaaacaacaaattccatatgaatatggtcgaggtcgtttggaagaccgttcacaacttttggctgatattcaaactatcaaacctactcatgttttcaatgctgctggtgtcactggcagaccgaatgtagattggtgtgaatctcacaagacagaaaccattcgtaccaatgtctcgggcacactcaatctagcagatgtctgtagagaacatggactcttgatgatcaattttgctactggatgcatctttgaatatgatgctaaccaccctgaagggtctggaatcggttttaaggaggaagataagcccaatttcattggatccttctattcaaaaaccaaagctatggtggaggagcttttgaaagaatatgacaatgtgtgcacccttagagtccgaatgccgatatcatcagatctcaacaacccacgcaattttatcaccaagatcgctcgttatgataaagttgtaaacatacccaacagcatgacaatcttggacgagcttttgccaatttcgatcgagatggcaaagcgtaatctaaggggaatctggaactttacgaatcctggggtcgtaagccacaatgagattcttgaaatgtacaagaagtacataaacccagagttcaagtgggtaaatttcacactggaagaacaagcgaaagtgatagtggccccacgaagcaataacgagttggatgcatcaaagttgaagaaagagttccccgagttgctatcaatcacggattcattgatcaagtacgtattcgaacccaacaaaaaacagtaatgataatgatatgatgattctttatagaatttgtagaactcaagattcacttgtgtttggttactagttccttcttgtatggtttggattatacatctgtaatgtttaaagtcaactgagtcagtcacatttgttctagtatttgttttctagcatcatcacactgaggttataggaggcgaggccgatcgtctatggggtatctatcctatagtcatcatcgtttgtctcgactacggtctaggtctacggttagtttgttcaacagctgttacgaatatttccctttagttttgttgaaaccgcacgcaggcttgtactattggattctcattctctataat

SEQ ID NO: 12328 - DNA, 2327 bp, Zostera marina
aaatggcaacatatactcctaagaatattctcataactggagcagctggatttattgcttcacatgttgccaatcggctcgtccgtaatcatccagaatataagattgttgttcttgataaacttgattactgttccaatttgaagaacctacttccatcacggccatcacctaatttcacgtttgtaaaaggtgatattggcagtgcagaccttgttagctatcttctcataaccgagtccattgacactattatgcactttgctgcccagactcatgttgataattcctttggtaattcatttgagttcaccaaaaacaacatatatggaacccacgtccttcttgaagcctgcaaaaccaatggtcagattaagcgttttatccatgtgagtaccgatgaggtgtacggagagacagatgaggatgctgtagttgggaaccatgagacatctcagcttctgccaacaaacccctattctgcaaccaaggctggtgctgagatgcttgtcatggcatatggaagctcctacggtttgcctgtgattactactcgtggaaacaatgtctatggtccaaatcaattccctgaaaagcttattccaaagttcattcttttagccatgagtggaaaaccccttccaattcatggggatggatccaatgtaagaagttatctttactgtgaagatgttgccgaggcttttgaagttatccttcacaagggagaaattggtcaagtttataatatcggaactaaaaaggagaggagagtaattgatgtggccagggatatctgtaaacttttctcattagatacggattctgtcatcaaatatgttgaaaacaggccatttaatgaccagagatatttcctggatgatcagaaactggctgtcttgggatggtcagagcacaccacatgggaagaaggtctgaagaaaaccttggattggtacacaagtcatcctgattggtggggtgatgtttctggagcattgttgcctcatccaagaatgttaatgatggcaggaacagagagacaaaatgacgaaccagcagaacatgctaaagaaacaccatataaggaaacaaaccataacaatcagaatggtcatgtcgttcaatctttacaaaacacacttggtcagaaggatcagtctttgaaatttttgatttatggtaaaactggatggataggaggtcttcttggaaagatatgtgaaaaacaaggaatactttatgagtatggaagaggacgattgcaggaacgatcacagctcatagaagatgttaagagagtgaagccaagccatgtttttaatgctgctggagttactggaagacccaatgttgactggtgcgagtcacataaaccagagaccatccgaacaaatgtggttggtactctgaatctagctgatgtttgcaaggactatggtcttttgctcgtgaattatgctacaggttgtatatttgaatatgatctcgaacaccctgaaagatcaggaattggatttaaggaggaaaacactcccaacttcattggatcgttctattcaaagaccaaagctatggttgaagagctacttaaagaatatgacaatgtctgcactcttagagttcggatgccaatatcgtctgatcttaaaaaccaaaggaacttcattaccaagattgtcagctataacaaagtagtaaatattccaaacagcatgacaatcttggacgagcttctccccatttctgtcgaaatggcaaaacggaactgcagaggaatatggaacttcacaaacccaggggtggtcagccataatgaaatcctagagatgtacaagaaatatataaaccccaaattcacatggaaaaacttcacactggatgaacaggccaaggtcatagttgccccacgaagcaacaatgaattggatgcctccaaattgaagaaagaattccctgaattgctgtcaatcaaagatgccctcatcaagtttgtctttgaacccaaccagaccacatgttaagaaacagtagcaaacttttagaaattcatcttattcgcattatagctttagtttcttcttttgggatcacagttttattggtaggttcagcttctgcttttcctattactactcaattattttgttaaatagccaccattatagatattgacattggattgtcatagactcgtggtataaggctctacctattgtttgtatgtgccatattattgtttttgtttgtcttttgttgtattaactttctgaatttcacgcttgtttctttctaatttcttaataagtatcctaactaccttcaca

SEQ ID NO: 12329 - DNA, 2349 bp, Festuca arundinacea
ttcctcctctcactccgcgccgcgtgccgagtacggatttcagatattgcagtccgtacgatatggcgacaccctacacgcctaagagcatcctcattacaggagctgccggcttcatcgcttcccatgtcacaaaccgcattgttcggaactaccctgattacaagattgtcgtccttgacaagcttgactactgctctaatctgaagaacctgctccctgctagctcctcaccaaacttcaagtttgtcaagggcgatattgccagcgctgatcttgtcaactacctcctggtcacagagaacattgatactattatgcactttgcagcccagacacatgttgacaattcatttgggaactcttttgaatttaccaagaataacatctatggtactcatgttcttcttgaagcttgcaaggtcactggcggacagatcaggaggttcatccatgttagcactgatgaggtctatggggagacagatgaggatgcagtggttggcaaccatgaggcctcacagctgctccccacaaacccctattctgccaccaaagctggagcagagatgcttgttatggcttatgggagatcctatggtctgccagtaatcactacccggggaaataatgtgtatggtcctaaccagtttcctgagaagcttatcccgaagttcattcttttggctctgagaggaaagcccctcccaattcatggtgatggatccaatgtccggagctacctctactgcgaggatgttgccgaggcttttgaggtcattcttcatcgtggagaagttggacatgtttataacattggaaccaagagagagaggacagtcactgatgtggcaaaggatgtctgcaaccttttcaatcttgaagctgataaagttatccagtatgttgataatagacctttcaatgatcagaggtactttttggatgatgagaagcttaagagtcttgggtggtctgagcgcactagatgggaggagggcctgaggaagacaatggaatggtatgtggctaattctgactattggggtgatgtttctggtgcattgttgcctcatccgaggacattgatgatgcctgggtctgagggctctgaggaagttaaaggaatgctaaatcttttcactaacaatcagaccaagatggtgactccagtatcaaaaggttcttccaaaactcattctctcaagttcttgatatatggccggacaggatggattggtgggcttcttgggaaaatatgtgagaagcaaggaattccatatgaatatggaaaaggtcgcttggaagagcgctcttcaatcgtccttgatatccaatctgtgaagccaacacatgtcttcaatgctgctggtgttactggcagacccaatgtggattggtgtgagtcccacaagccggaaacaatacgcaccaatgttgtgggcaccttgactctagctgatgtgtgtagggagcatgggttattggtgatgaactatgccactgggtgcatatttgaatatgatgcaaatcatcctgaagggtcaggcatcggcttcaaagaagaggatacaccaaactttactggttcattctactcaaagaccaaagcaatggttgaggaactgttgaaggagtacgagaatgtctgcactctgcgagtccggatgccaatatcgtctgacctcagcaatccccgaaactttatcacaaagattagccgttacgacaaggtggtaaacatcccaaacagcatgacagtgttggacgagcttttgccaatttcagttgagatggctaaaaggaacttgcggggcatctggaacttcaccaatcctggtgtagttagccacaatgagatcttggagatgtataagaagtacattgactccagctacaagtggtcaaacttcacgctagaagaacaggccaaggtcattgtggcacctcggagcaacaatgagatggatggggcaaagctgaggaaggagttccctgaactgctatcaatcaaagactcattgatcaagtatgtttttgagcccaacaggaaggtcccagcaaattgaagccaaaacaggtgatatagaaatacgaagcactgtaagagtttaggagcaattccaccgtgattctttagatgttttatgatactacacaccatatctctattatagattcacagcatcgtttgaaccatatattcggcaatcttcttgtgatagcaagatatttgccttgcttgttgtagtgaccactcgatgagttataaattcttcaatgtgcgtgtaccatgtttgttctgtcaagaaaagaatttacagtaaaaaaaaaaaaaaaaaaaaaaaa

SEQ ID NO: 12330 - DNA, 2622 bp, Avena sativa
ttagtactagcaaatcaaagtcgtctcttgactctggtgagatttgtcacaggctcatctcacaagcacaactacctcacacccctccccggccgtgctttccgccgactgcatctccctctcacgcacaccgccaccgccaccattcctccatttatttaagggaaaacccccctcacctccgcaccgcaccccctcatcgaccgacgccaccacccatcccatccggcctccctgctcctgcgcgccgcgtgctgagtacggatttcagatattacagtctgtaggatatggcgacaccctacacacctaagagcatcctcattacgggtgctgctgggttcatcgcttcccatgtcacaaaccgcattgttcggaactaccctgattacaagattgtcgtccttgacaagcttgactactgctctaatctgaagaacctgctccctgccagctcatcaccaaacttcaagtttgtcaagggcgatattgccagcgctgatcttgtcaactacctcctggtcacagagaacattgatactattatgcactttgcagcccagacacatgttgacaattcatttggtaactcttttgaattcaccaagaacaacatctatggtactcatgttcttcttgaagcttgcaaggtcactggcggccagatcaggaggttcatccacgtgagcactgatgaggtctatggggagacagatgaggatgcagtggttggcaatcatgaggcctcacagctgctgccaacaaatccctattcggccaccaaagctggagcagagatgcttgttatggcttatgggagatcctatggtctgccagttatcactacccggggaaataatgtgtatggtcctaaccagtttcctgagaagcttatcccgaagttcattctcttggctctgagagggaagcccctcccaattcatggtgatggatccaatgtccggagctacctctattgtgaggatgttgctgaggcttttgaggtcattcttcatcgtggagaagttggacatgtttacaacattggaacgaagagagagaggacggtcactgatgtggcaaaggatgtctgcaaccttttcaatcttgaagctgataaagttatccagtatgttgataatagacctttcaatgatcagaggtacttcctggatgatgagaagcttaagggccttgggtggtccgagcgcactagatgggaggagggcctgaggaagacaatggaatggtatgtagccaattctgactattggggtgatgtttctggtgcattgttgcctcatccgaggacattgatgatgcctgggtctgagggctctgaggaagttaaaggaatgttaaatctgttcactaacaatcagaccaagatggtgactccaacatcaaaaggttcttccaaaactcattctctcaagttcttgatatatggccggacaggatggattggcggacttcttgggaaaatatgtgagaagcaaggaattccatacgaatatggaaaaggtcgcttggaagagcgctcttcaattgtcctcgatatccaatctgttaagccaacacatgtcttcaatgctgctggtgttactggcagacccaatgtggattggtgtgagtctcacaagccggagacgatacgtaccaatgttgcgggcaccttgactctagctgatgtgtgtagggagcatgggctattggtgatgaactatgccactgggtgcatatttgaatatgatgcaaatcatcctgaagggtcaggcatcggcttcaaagaagaggatacaccaaactttactggttcattctactcaaagaccaaggcaatggtcgaggaactgttgaaagagtatgagaatgtgtgcactctgcgagtccggatgccaatatcgtctgacctcaacaatccccgaaacttcatcaccaagatcagccgttacgacaaggtggtaaacatcccaaacagcatgactgtattggacgagcttttgccaatttcagttgagatggctaaaaggaacttgcggggcatctggaacttcaccaatcctggtgtagttagccacaatgagatcttggagatgtacaagaagtacatggatcccagctacaagtggtcaaacttcacgctagaagaacaggctaaggtcattgttgcacctcggagcaacaatgagatggatgcgacaaagctgagcagagagttccctgaactgctatcaatcaaagactcattgatcaagtatgtttttgagcccaacaggaaggtcccggcaaattgaagccaaagcaggtaagatagaaaaaccaagcactgtaagagtttagaagccattcggtctcgattcgttagatgttttatgatacgacgcagcatatctctattatagattcacagaattgtttgaactatgtatttggcaatcttgttgtggtagcaagatacttgcctggtttgttgtagagacctacttgatgagttcaattattcaatgtgtgtgtaccatgtttgttctgtcaagaaatgaatctccagtatcttgtactattattcaatctgctgatgcttttgtgaatgaccttgcgtcctgtgctggccaaagcttt

SEQ ID NO: 12331 - DNA, 2420 bp, Avena sativa
caccgccaccgccaccattcctccatttatttaagggaaaacccccctcacctccgcaccgcaccccctcatcgaccgacgccaccacccatcccatccggcctccctgctcctgcgcgccgcgtgctgagtaaggatttcagatattacagtccataggatatggcgacaccctacacacctaagagcatcctcattacgggtgctgctgggttcatcgcttcccatgtcacgaaccgcattgttcggaactaccctgattacaagattgtcgtccttgacaagcttgactactgctctaatctgaagaacctgctccctgccagctcatcaccaaacttcaagtttgtcaagggcgatattgccagcgctgatcttgtcaactacctcctggtcacagagaacattgatactattatgcactttgcagcccagacacatgttgacaattcatttggtaactcttttgaattcaccaagaacaacatctatggtactcatgttcttcttgaagcttgcaaggtcactggcggccagatcaggaggttcatccacgtgagcactgatgaggtctatggggagacagatgaggacgcagtggttggcaaccatgaggcctcgcagctgctcccaacaaacccctattcagccaccaaagctggagcagagatgcttgttatggcttatgggagatcctatggtctgccagttatcactacccggggaaataatgtgtatggtcctaaccagtttcctgagaagcttatcccgaagttcattctcttggctctgagagggaagcccctcccaattcatggtgatggatccaatgtccggagctacctctattgtgaggatgttgctgaggcttttgaggtcattcttcatcgtggagaagttggacatgtttacaacattggaacgaagagagagaggacggtcactgatgtggcaaaggatgtctgcaaccttttcaatcttgaagctgataaagttatccagtatgttgataatagacctttcaatgatcagaggtacttcctggatgatgagaagcttaagggccttgggtggtctgagcgcactagatgggaggagggcctgaggaagacaatggaatggtatgtagccaattctgactattggggtgatgtttctggtgcattgttgcctcatccgaggacattgatgatgcctgggtctgagggctctgaggaagttaaaggaatgttaaatctgttcactaacaatcagaccaagatggtgactccaacatcaaaaggttcttccaaaactcattctctcaagttcttgatatatggccggacaggatggattggcggacttcttgggaaaatatgtgagaagcaaggaattccatacgaatatggaaaaggtcgcttggaagagcgctcttcaattgtcctcgatatccaatctgttaagccaacacatgtcttcaatgctgctggtgttactggcagacccaatgtggattggtgtgagtctcacaagccggagacgatacgtaccaatgttgcgggcaccttgactctagctgatgtgtgtagggagcatgggctattggtgatgaactatgccactgggtgcatatttgaatatgatgcaaatcatcctgaagggtcaggcatcggcttcaaagaagaggatacaccaaactttactggttcattctactcaaagaccaaagcaatggtcgaggaactgttgaaggagtacgagaatgtgtgcactctgcgagtccggatgccaatatcgtctgacctcaacaatccccgaaacttcatcaccaagatcagccgttacgacaaggtggtaaacatcccaaacagcatgactgtattggacgagcttttgccaatttcagttgagatggctaaaaggaacttgcggggcatctggaacttcaccaatcctggtgtagttagccacaatgagatcttggagatgtacaagaagtacatggatcccagctacaagtggtcaaacttcacgctagaagaacaggctaaggtcattgttgcacctcggagcaacaatgagatggatgcgacaaagctgagcagagagttccctgaactgctatcaatcaaagactcattgatcaagtatgtttttgagcccaacaggaaggtcccgtcaaattgaagccaaagcaggtaatttagaaaaaccaagcactgtaagagtttaggagccatctggcctcgattcattagatgttttatgatacatgacacagcatatctctattatagattcacagaattgtttgaactatgtatttggcgatcttgttgtggtagcaagatacttgcctggtttgttgtagagacctacttgatgagttcaattattcaatgtgtgtgtaccatgtttgttctgtcaagaaatgaatc

SEQ ID NO: 12332 - DNA, 2023 bp, Vinca minor
ccatcttcattggcctgattgatcttgatcttgatctggattcaaatttaggcaactaaaatggcaactcacacaccaaagaatattcttattactggagctgctggatttattgcatctcatgttgcaaaccggctaatccggaactaccctgaatacaagattgttgtcctcgacaagcttgactactgctcaaatctgaagaacctccttccttccacttcatcccctaacttcaagtttgtcaagggggatattgctagtgctgatcttgtcaactaccttcttattactgagtcaattgacacaataatgcactttgctgcgcagacccatgttgataactcatttggtaatagctttgagttcaccaagaacaacatttatgggacacacgtgctattggaggcctgcaaagtgactggtcagataaaaaggtttatccatgtaagcacagatgaggtgtatggagagacagatgaagatgctgttgttggaaatcatgaagcctcacaactccttccgacaaacccatattcagccactaaagctggagctgaaatgcttgttatggcatatggtaggtcctatggattacctgtaataactactcgagggaacaatgtttatggtcccaatcagtttcctgaaaagttgatcccgaagtttatccttctggccatgagagggaagactcttcctattcatggggatggttctaatgtgcgcagctatctctattgtgaggatgttgcagaagcatttgaagttattcttcatagaggagaagttggtcatgtttacaatattggtacaaagagggaaagaggagtaattgatgttgccaaagatatatgcaaactttttaacatggatcctaaaactagcattgagtttgtggagaataggccatttaatgatcagagatatttcctagatgatgagaagctgaagaagttgggctggtcagagaggacaatatgggaagaaggtctaaaaaagactatggagtggtacaccaaaaatcctgattggtggggtgatgtttctggagcattgcttcctcatcccagaatgttgatgatgcctggggggacagaaaagcttcttgatggatctgataagtatgactccggatcttctgagttctcagcgaaatctaaacagaactatctggtcgtcacacctgctaagagctcacctaagccatccttgaaattcctgatctatggtaggactgggtggattggtggtctgctggggaaattgtgtgagaaacaggggattccatatgagtatggaagggggcggctggaggaccgctcacaacttctggttgacatccaaattgttaagcccacccatgttttcaatgctgctggcgtgactggtagacccaatgttgattggtgtgaatcacacaagactgaaacaattcgtacaaatgttgctgggactctgactttagcagatatctgcagagagcatggtctcctgatgatgaattttgcaacgggatgtatatttgaatatgatgctgctcatcccgaagggtctggtatcgggtataaggaggaagacacccctaatttcactggatctttctattcaaagaccaaggccatggttgaggagctattgaaggagtacggcaatgtttgcaccctacgggttcgtatgccaatatcttcagacctcagcaacccacgaaatttcatcaccaagattagccgttacaataaggtggttaacattcccaacagcatgaccgtcctggacgaacttctacctatttccattgagatggcaaaacgaaacctggggggcatttggaacttcacaaatcctggggttgttagccataatgagattcttgagatgtacaagaaatacatcgacccaaaatttaaatgggccaacttcacgctggaggaacaagcaaaggtgattgtcgccccccgaagcaataatgagatggatgcctccaaactgaagaaagagttccccgaattgctatcgatca

SEQ ID NO: 12333 - DNA, 3154 bp, Brassica rapa
aatagccttgggtgctgacttttccttccttctgaagaccccccctttgaatttattccttcttctccttcttcctctcacatctctaggccttcgctcatcatcccatttcctaatcctcacagattcaaaggaaacttgatggcttcttcatacactcccaagaacattctaatcaccggagcagccggtttcatcgcctcgcacgtcgccaaccggctcatccgaacctacccggactacaagatcgtcgtcctcgacaagctcgactactgctccaacctcaagaacctcaacccctccaagcactcccccaacttcaagttcgtcaagggcgacatcgccagcgccgacctcgtcaactacctcctcatcaccgaacgcatcgacaccatcatgcacttcgccgcccagactcacgtcgacaactccttcggcaactccttcgagttcaccaagaacaacatctacgggacccacgtcctcctcgaggcctgtaaagtcactggccagatccggaggtttatccacgtcagcactgacgaggtttacggcgagactgatgaggatgctgttgttggcaaccacgaggcttctcagcttcttcccacgaatccttactccgctaccaaggccggagctgagatgcttgtgatggcgtatgggagatcgtatgggcttccggttataaccacgcgtgggaataatgtttatgggcctaaccagtttccggagaagctgattcctaagtttatgttgctggcgatgagggggaaggttcttcctattcatggagatgggagtaatgttcgtagctatctttactgtgaagatgttgctgaggcgtttgaggttattcttcacaagggggaagtgggacatgtttataatattggtactaagaaagagaggagggtgaatgatgttgcgcaagatatctgcaagctctttaacatggaccctgaggctaacatcaagtttgtggagaacaggccttttaatgaccagaggtactttttagatgatgagaagcttaagatcttgggatggtcggagaggaccacttgggaagaagggttgaagaagacgatggagtggtacacgcagaacccggattggtggggtgatgtttctggagcgttgcttccccacccgaggatgctggtgatgcctggtgggaggcactttgatgggtctgaagagaactctggagcagtcgctttgtctggaaactcaagccagagccagagccagatgatggttccgacacccagaagcagtggctccactcagaacccttcactgaaattcttgatatatggtaagacaggatggattgggggattgcttgggcagatttgtgagaagcagggtattgcttttgagtatgggaaagggcggcttgaggatcgttcatccctcttgcaagatattctgactgttaagcctacccatgtcttcaatgctgctggtgtgacagggagacccaatgtcgactggtgcgagtcgcacaaaactgagacaatccgtgccaatgttgcaggcactttgactctggctgatgtctgcagagagcacagcctcctgttgatgaactttgctactggttgtatattcgagtatgatgaaaaccatccgctaggttcaggcattggcttcaaagaagaagacacaccaaacttcactggttctttctactcaaaaaccaaagccatggttgaggagctgcttaaggagtttgataacgtatgcactctaagggttaggatgccgatctcctctgatctaaacaacccgagaaacttcatcaccaagatttcccggtacagcaaagtagtgaacatcccaaacagcatgaccgtgctggacgagcttcttccaatctcgatagagatggcgaaaagaaacctgaaagggatttggaacttcaccaaccccggtgttgtgagtcacaatgaggtcctggagatgtacagagactacgtcgactctgacttcaaatgggcgaacttcacactagaggagcaagccaaagtcatcgtggctccaagaagcaacaacgagctggacgcatctaagctcaagaaagagttccctgaattactctcaatcaaggagtctctgatcaaatatgcatttgagcccaacaagagaacttgaggtaatataacttatctcagttttgtttaaactggtttgttattagttcctcccattgagtcgtaagccaaaagcaacttagctttgcctatatctagtttggattcttatatgttattgttttgttggtattgtgttctttcatgttccacattttatagataaaaaaaacatcatttctgtattatttgctgatattaatacgaacggttaaatccagaacctagatttatggtctctagttaaagcatttgatggtagaaaactctctacttttatttatttttgtttctatgaagaaaagattggtacaccaaagaaaatgagaaatccactaaggtcatgctcctacatttcagagcagtggactcctcttattatgcaaaataactaaacaaaagacttggaagaaacgattagagtttggtctcttggctctcgttggtcttcccgtctgtggagtgtttcaaattcgcgcttccattgcgagtctgatgtaattcgctatcagaaaatgggtgggccattgttgttgtatctgcaactgcaagactggagcaaatccacaacatcttgagatgagtcaatgacatagcgagcttttgagcgagtttgtccgatggccacagagaagtaattctcctttttgaggtcaaaaacattcggtgaaacctgcttcttctttagggagtgaatacttgaagaagacttcgacctagtttcatgagataacttggacggcacgatttctgattcgaagaaagtgtaaatatcttcgtcctgaaaaatataacatttagctagatggaattctgaatgagtcaggtagggatatgtaataatataggctttaccttctccaacaagtaaccactacaaaagacataatcaatgggtgtggtcattgatattttatgcatcatttctcccaaaatacgaccaattgctgctccctacataacaaagaaagaagatagaacacttagaatctcga

SEQ ID NO: 12334 - DNA, 4068 bp, Theobroma cacao
tcttctttttctcaacctttctatcacctctgactgaagcttcttcataggagtgcctaacaaaattaaagacaaaaaaaaaacaaaacccttttgcctttgacttccaactccatattttctaaagtattttagatggctactcggtacacaccaaagaacatcctcatcactggagctgctggcttcatagcttcccatgtctgcaaccggctcatccgtaactatccagactacaaaattgtagtccttgacaagcttgattactgctcaagcctaaagaacctcaaccccgcacggttatctccaaattttaagttcatcaagggagatattgcaagtgctgatctggttcagtttatccttcttactgagtccatcgatacaatcatgcactttgcagcccagactcatgttgacaactcctttgggaacagttttgagttcactaaaaacaacatttatggaacccatgttctcctagaagcatgcaaagtcactggccaagtgaagaggttcatccatgtaagcacagatgaggtttatggggagacggatgaagatgctgtagtgggaaatcatgaggcttctcagctccttccaacaaacccatattctgccactaaagctggagcagagatgctggtgatggcatacgggcgctcatacggactgcctgtgataaccactagaggaaacaatgtttatgggcccaatcaattcccagaaaagcttattcccaaatttatcctattggccatgaatggaaagcctcttccaattcacggggatgggtcaaatgtaaggagttatctctattgtgaggatgttgccgaggcctttgaagtcattctccacaagggtgaagtaggccatgtatacaacataggcacaaagaaagaaaggagagtgattgatgtggccaaggatatttgcaggcttttttccttggacccagacgcccagattaagtttgtggataatcgtcctttcaatgatcagagatatttcttggatgatcaaaagctgaaaagcttgggatggtatgaaaagacgacatgggaggagggtcttaagaagactatggaatggtatgttaggaatcctgattggtggggcgatgtttctggagcactgctaccccatccaaggatgctgatggtgcctggaatcgaaaggcaatttaatgcccctgatacgagcaataatgattccgctcctgttacaaacaatttcagtcagagcaggatgttggttccagctccaaaaaacaatttacctgctcaaaagccatcccttaagtttttgatttatggcagaacaggttggatagggggacttcttgggaagatatgtgagaagcaaggtataccctttgagtatggaaaagggcgtttggagcaacgttcacagcttttggctgatattcaaactgttaagccaacccatgttttcaatgcagccggagtgacaggtagaccaaatgtggattggtgtgaaactcataagcctgaaacaattagaaccaatgttgttggcacattaaccttggcagacatctgcagggaacatgacctcctaatggttaattatgctactggttgtatctttgaatatgatgctacacatcctctagggtcaggaattgggttcaaggaggaagacaagcccaattttactggttctttctattccaaaaccaaagccatggttgaagagcttctgagggagtatgacaatgtttgcactctcagagtccggatgcctatatcatcagatcttagcaatccacggaactttatcacaaagattgctcgatatagcaaggtggttgacattccaaacagcatgaccatattggatgagcttctacccatttcaattgagatggccaaaaggaacctgaggggaatatggaactttacaaatcctggtgttgtgagtcacaatgagattctgcaaatgtacaaggactatattgacccaaatttcaactgggttaatttcacactggaagaacaggccagggttattgttgcacctaggagtaacaatgaattggatgcatctaagctgaaggaggagttccctgagatactgtctatcaaggactcactgataaaatatgtcttcgaacccaacagcaacaggaaaaccttcactgggggactgccaaagtaagcctctcataaatataaacctcagaagcgatctctgcattctcatgggtaacatggttcggaattattatttaattacaattttttgtcattgactctgcctcttttcacccttatcatcaattcattatccaccagtcttgttcattaaattataatttggccatcatgataaggagctatgcaaacggattcagtatatctacagctatcctgcagcttatagcccatgtattctttggattttaagtcattgtcactcattcaataaagtttcattacagctttactgctactttaatgttgtgctcgtcaatattcaattcagtttccttgtgaatgttcagattttattatttgacagtcatgctttaatcatccatatgcctaaaagttgtttaacattatttacctttgtaacctttaacaatgaatatcagcaaattttccttttcccataatgggggaaaagagagccaacaccaattgttcctggaaaaaggtggcatatgtgcaaattggcaattttcacaagttactcttaatttattcaaacagatcaaaaaccttttttgtttctttaaccttattatatactctttcaatttcaaatggcatattcactatgccttttttagattaaatttaatcaattttcttatgagctggggggcatctactggtatcttgctcttgttttactatggaattaattccttgtcaacaatagatttgataaatgaaccctagcattgcattaattcacactaattcagtcatataaaggcatgttggtagaaactcaagcgagaaatagtgcaaataaggagtaagtagaaataatttgtaagcttgcatctttcttgttctgcttaatgctatacctgcttggaaggaatggggttgcctgaaatcaatccttatggacagccaagaaaaggaaaaacttttctaacttaccttgcaagtttgtaatgttagcaaattgaaacacatgaatactagatgtagcttatatttggtgacaatatttcaaatcattatagattctaagaacttctcacatacatgtcaaagtgaatcattatatattcctccatatcttcatgctctatttcacaatatttatgttaaagatctaatctgcaaccgataatgttcatcattcatttaaaacgcaagaagataattgaacaacacaagtatccaaatatttaatttttatgtttatatcattttctgcctgatttaaatcactaaattgggagcatatcacttacaattccttttaatataagtttaaaattatccaatcattttattaaaatttctgaggtccaccactatgggttttatattctttctcagcctactaattgaaacaatctgatatactaattcagcattctaatttaaactgtcagacattttttaccttcaacacaaagtgatatcatgaataaacttgatatatatatatttatatatatatatttatatccattggtaatatattgcattgtccatctgtatctatgcagtcaaaaatatgatactagcagaggaggcagtaacgatttgagtgacaatcatgaggcccctccaggctttggcagccagttccaaacagtcgatgagccagttgcattccctgtgaagagaaggccatgtggacgtctttcaatcactcttacttaaactgcccctcttcgtattccatgaagcaaaatttgttaagccaacaagaatattttcacgcatccgtagggggagcatctggcattttctaaaggtttagtccgaatttgtatgtgcctaagttcactctttttttctttcttgcatcaagttcataatgagtttatttattgaaaacactaatctcttt

SEQ ID NO: 12335 - DNA, 2526 bp, Arabidopsis lyrata
gagtttaatgtcggacgctagactcacgagaaatccgtaatatctaagagaagaaagggtaaattagtcaattggctcctacggttctccgtaactgtctcagaatataagaggcgcattgttgagagaagctccgtagaccgtagattccctcttcttcttcttcttcttcttcctctctactgttttttcttttcatatttctctctctattcttggtgaagtttctctctctatctctaagtactctcttacgatcttcttctctcttgggttatctgattctaacctgaattgtgtcggtacaaatggatgatactactacgtataagccaaagaacattctcattactggagctgctggattcattgcttctcatgttgccaacagattaatccgtagctatccggattacaagatcgttgtgttggacaagcttgattactgttcagatctgaagaatcttgatccttcattttcttcaccaaacttcaagtttgtcaaaggagatatcgctagtgatgatctcgttaactaccttctcattactgaaaacattgataccataatgcattttgctgctcaaactcatgttgataactcttttggtaatagctttgagtttaccaagaacaatatctatggtactcatgttcttttggaagcctgtaaagttacaggacagatcaggaggtttatccatgtgagtactgatgaagtctatggagaaaccgatgaggatgctgctgtaggaaaccatgaagcttctcagctgttaccgacgaatccttactctgccactaaggctggtgctgagatgcttgtgatggcttatggtagatcatatggattgccagttattaccacccgcgggaacaatgtttatgggcctaaccagtttcctgagaaaatgattcctaagttcatcttgttggctatgagtgggaagccgcttcccatccatggagatggatctaatgtccggagttacttgtactgtgaagacgttgctgaggcttttgaggttgttcttcacaaaggagaaatcggtcatgtctacaatatcggtacaaagagagaaaggagagtgatcgatgtggctagagacatctgcaaacttttcgggaaagaccctgagtcaagcattcagtttgttgagaaccgaccctttaatgatcaaaggtacttccttgatgatcagaagctgaagaaattgggatggcaagagcgaacaacatgggaagatggattgaagaagacaatggactggtacactcagaatcctgagtggtggggtgatgtttctggagctttgcttcctcatccaagaatgcttatgatgcccggtggaagactttctgatggatctagtgagaagaaagacgcttcaagcaacacggtccagacatttacggttgtaacacctaagggtggtggttctggtgacaaagcttcgttgaagtttttgatctatggtaagaccggttggcttggtggtcttctagggaaactatgtgagaagcaagggattacatatgagtatgggaaaggacgtttggaggacagagcttctcttgtggcggatattcgtagcatcaaacctactcatgtgtttaatgctgctggtttaactggcagacccaacgttgactggtgtgaatctcacaaaccagagaccatccgtgtaaatgtcgctggtactttgactctagctgatgtttgcagagagaatgatctcttgatgatgaactttgccaccggttgcatctttgagtatgatgctgcacatcctgagggttcgggtataggtttcaaggaagaagacaagccaaatttctttggttctttctactcgaaaaccaaagccatggttgaggagctcttgagagaatatgacaatgtatgtaccttgagagtccggatgccaatctcctcagacctaaacaacccgagaaacttcatcacgaagatctcacgctacaacaaagtggtggacatcccgaacagcatgaccatactggacgagcttctcccgatctccatcgagatggcgaagagaaacctaagagggatatggaacttcaccaacccaggggtggtgagccacaacgagatactggagatgtacacgaattacatcgagccaggctttaaatggtccaacttcacattggaagaacaagcaaaggtcattgttgctgctcgaagcaacaacgaaatggatggatctaaactaagcaaggagttcccagagatgctacccatcaaagagtcactgatcaaatacgtctttgaaccaaacaagagaacctaagccttcaatgaacatcacactcttgccacaagtgcttactttaaattgtttcttttacttttttttttctttttgccttttctttcaacagaaatatctttttatatttactcatcgtcttatgatccttgtaggtagtttcactatattgattctactaaaatatgatttaccattaatatttatatagacgagagtttttctttttctc

SEQ ID NO: 12336 - DNA, 2262 bp, Valeriana officinalis
cgcatgccatcgattcagaatgtaaaccgtaattaatctctcgctggactcactctctatatatacgcgtctctctcgcttaattctctctcacttctccatcttgtctgaatcaacctcggtatctatctcacaggtactgtggtgaaatggcctatactccgaagaatatcctcataactggggctgctggctttattgccggtcatgttgcaaaccggctcgtcaagaaccaccccgaatacaacattgtggtgcttgacaagcttgattattgttcgaatctcaagaacttgaatccatctcgttcatcccccaactacaagttcgtcaagggcgacattgccagtgccgatctggtcaactacattctcaagtctgaatctattgacacgatcatgcattttgcagcccagactcacgttgacaactctttcggcaacagctttgagttcaccaagaataatgttcttggaactcacgtgcttctagaagcctgcaaggtcactggccagatcaagaggttcatccacgtcagcactgacgaggtctacggggagactgatgaggacgccgttgttggaaaccatgaagcttcgcaacttcttccgacgaatccctacgccgccacaaaagctggtgctgaaatgcttgtgatggcttatcacagatcatatggtttacctgttataaccactagaggaaacaacgtgtatggccctaatcaatttcctgaaaaactaatccctaaatttatcttattagccatggcaggaagaactcttccgattcatggagacggttcaaatgtgaggagttatctttattgtgaggatgtagctgaggcttttgatgtagttcttcacaaaggagaagtgggccatgtttacaatatcggcacaaagaaggagaggagggttatcgacgttgcgaaagatatatgcaaactattctctagggatccggaatcatgcattaagtttgtcgagaacaggccgtttaatgaccagaggtactttttggatgacgaaaagttgaaaaaactcggctggtcagaaaaaactacttgggaagaaggcttgaaaaaaactatggagtggtatacaagcaatcctggatggtggggcgatgtttctggagcgttgcttcctcatcctcgaatgcttgttttgcccggagttgttgatcgtcattctgatgtgacggaaaatgaagtggcagcagtggcagctccggtggcggctgtggcagctccagtcaaatcatctttcaaattcttgatttacggtcgaaccgggtggatcggcggattacttgggaagatctgcgagaaacaggggattgtttatgagtatggaaaagggcgtttggaggatcgttcgacgcttgtagccgatattcgtaatgttaaaccaactcatgtttttaatgcagctggtgttactggtagaccaaatgttgactggtgtgagtcgcataagaccgaaactgttcggactaatgttgtcggcacattgactttagccgacgtttgccgagatgagggtctgattatgataaattttgcaactggttgcatatttgaatacgatgctgctcatccggaaggttctggaatcggatttaaggaggaagacactccgaatttccacggctcttactattcgtatacaaaagccatggttgaagatcttttgaaacctttcgaaaatgtttgcactctgagagtacggatgccaatatcgtcagatctgagcaacccgcgaaacttcgttaccaagatttctcgctacgacaaagtggtgaacattccaaacagcatgacgattttagacgaacttcttcctatttctatcgaaatggcaaagaggaacctaacaggcatatggaacttcacgaatcccggggttgttagccataatgaggttctggagatgtacaagaagtatattgacccggcgtacaaatattcaaacttcactcttgaagaacaggccaaggttatagtcgcagctcgaagcaacaacgagatggatgcttcgaaattgaaaaaggaatttccagagttgctggggattaaggaatctttggtcaagtatgttttcgaaccaaacaagagagtttaaggatgttttatgtttatgaagttgttaaacatgaggtggtgttatttgcattttgtgtaggattttactgtcgcgttttactctcttgtgtggatttataatgttcattgtgtgtgccttatataaaagctttagc

SEQ ID NO: 12337 - DNA, 2513 bp, Lactuca sativa
aaagacttttagcaaggcttgttcacatgtttgttaatgtcatattacaagaatggttgcaaggtgtgagtttttaacactcacacaatccacctgtaatgtgtatgtatatttaagctcaggcatcggcttctactcagtaaaattgtccgcggtttctttcttcataattttggtggaaatctgtttttcacccctctcttgtgttcatattcatatttataccgatagctcctgccatatgacgatgtacacaccaaagaacatcctcatcaccggagctgctggattcatcgcctctcatgttgccaatcgccttgtcagaagctacccagattacaagatcgttgttcttgacaaacttgattactgctcaaatttcaagaacctcaacccctccaaatcatctcccaacttcaaatttgtcaaaggagacatcgggagtgcagatctagtcaatcacatcctgatcaccgaatccattgataccataatgcattttgcggctcaaacccatgtagataactcattcggaaatagcttcgagttcacaaaaaacaacatcggtggcacccatgttcttcttgaggcatgcaaagtcactcgccagatccgaaggttcatccatgtcagcacagacgaagtgtatggtgaaacagagaaggacgcggtagttggcaaccatgaagcttcgcaacttcttcccacaaatccatattctgccacaaaagcaggtgcagaaatgcttgtgatggcttatggtagatcatatgggttacccgtgattacaacaagaggaaacaacgtttatggcccaaatcagtttccagaaaaattaatccctaaattcattcttttagccatgagagggaacccacttcccattcatggagatggatctaatgtcagaagttatctctactgtgaagatgttgctgaagcttttgaagtcattcttcacaaaggtgaagtgggacatgtttacaacattggaaccaaaaaagaaaggcgagtcattgatgttgctaaagacatgtgtacacttttcaatatggatcctgaatcaagcatcaagtttgttgaaaacaggcctttcaatgatcaaagatactttctagatgaagaaaaactcaaaagcttaggctgggccgaaagaacaacatgggaagaaggtttgaaaaagacaatggaatggtacattagcaaccccgattggtggggtgatgtatcaggtgcactccttcctcatccaagaatgctaatgatgccaggtggcgttgaacgagtggtcgatgtatccgaaaacatccaatcggattcccctcatgctgctgttaacgcttcccaattccgaaaagtgggccccgttgcaaaaacgagtaaaccatctttcaagttcttgatttatgggaaaacaggatggatcggtggattacttgggaagctatgtgaaaaacaaggaatcggatatgaatacggaaaagggcgtttggagaatcggtcacaaattgtagaagatgtccaaaaaatcaaacccacccatgttttcaatgctgcgggtatcacgggtcgacccaatgtggattggtgtgaatcgcataaaaccgaaacgatacgcaccaatgtctctgggacccttactttagcagatgtctgcaaagaatccggaatcttgatgatcaatttcgccaccggatgcatttttgaatacgatgagaagcatccggaaggttccggaatcggtttcaaagaagaagacactcctaatttcaccggatccttctattccaaaaccaaggccatggttgaggagctactaagagaatatgacaatgtgtgcacattgcgggtccggatgccgatttcatcggatctaaacaacccgcgaaacttcattacgaaaatcgcgcgatacgacaaagtggtgaatattccaaacagtatgacgattttggatgagcttttaccgctatcgattgaaatggcgaagagaaacttgagggggatatggaattttacaaatccgggggttgtgagtcataatgaagtattggagatgtataaggaatatataaatccggggtttaagtggacgaattttacgcttgaagagcaagcgctggtgattgttgcagcaaggagtaataatgagttggatgtgacgaaattgaagaaagagtttccggaattgctatcgattaaggagtcgttgatcaagtacgtgtttgggccgaataaaaaagaaattaagatgtgcaataatggatacacaatgccaacttaggctgttgaagacgtgttctaagagtttcactatggtgaatggcaaaaagccttatatttgaataatttctggaatacaggaaaatttagttagagagattgttatttggctggaaatgttgattgaatacgtgtctaaacgaataaaaaagaaactaaaatgtgaaatagtggatatatgatgccaatataggcctattggggacttcttatgccataacatattgagc

SEQ ID NO: 12338 - DNA, 2362 bp, Brassica oleracea
cggttctccgcagctgtctcaaaatataagaggcgagtgctcagagacgctccgtagaccgtagattccctcttcttctttctttctctgcactgttctttcttttcatctctctatctctcttaagatctttctgtcctaaggttacctgaattttgtcggtacttgatatcaaaatggctactgaatataagcccaagaacattctcattacgggagctgctggattcattgcttctcatgttgccaacagactcatccgtagctacccggattacaagatcgtcgtcttggacaagcttgattactgctcagatctgaagaacctcgatccttcgttttcttccccaaatttcaggttcgtgaaaggagatatcgctagtgatgacctcgttaactaccttctcatcactgaaaacatcgatacgatcatgcactttgctgctcaaacccatgtcgataactctttcggtaacagctttgagtttaccaagaacaatatttacggtactcatgttcttttggaagcctgcaaagtaactggacagatcaagaggtttatccatgtgagtaccgatgaagtctatggagaaacagatgaggatgctgctgttggaaaccatgaagcttctcagcttttaccgacgaatccatactcagctactaaggctggcgcggagatgctggtgatggcttatggtagatcatatggtttaccggttatcacaactcgtggcaacaatgtttatgggcctaaccagtttcctgagaagatgattcctaagttcatgttgttggctatgagtgggaagccgcttccgatccatggagatggatctaatgtcaggagttacttatactgtgaagacgttgctgaagcctttgaggttgttcttcacaaaggagaagtcggtcacgtctacaatattggaacaaagagagaaagaagagtgatcgatgtggctagagacatctgcaaactcttagggaaagatcctgaagcaagcattcagtttgtagagaatcgaccctttaatgatcaacgatacttccttgatgatcagaagctgaagaatcttggatggtctgagcgaaccgggtgggaagatggattgaagaagacaatggaatggtacactcagaaccctgagtggtggggtgatgtctctggagctttgcttcctcacccgaggatgcttatgatgcccggtggtagagtttctgacgagaagaaagacgcatcaagcaacactgtccagacatttacagttgtaacaccaaacaacaagactagtgatcctaaagacaaagcctcgttgaagtttctgatctatggcaagactggttggatcggtggtcttctagggaaactatgtgagaagcaagggattacatatgagtatgggaaaggacgtttggaggatagagcttctcttgtggcggatattcgtagcatcaaacctactcatgtctttaacgctgctggtttaactgggagacctaacgtggactggtgtgaatctcacaaaccagagactattcgtgtcaatgtcgctggtactttgactctagcagatgtttgcagagagaatggtctcttgatgatgaacttcgccaccggttgcatctttgagtatgacgctgcacatcctgagggttcgggtataggtttcaaggaagaagacaagcctaacttcaccggttctttctactcaaaaaccaaagccatggttgaggagcttttgagagagtttgacaatgtatgtaccttgagagtgcggatgcccatctcatcagacctaaacaacccacgaaacttcatcaccaagatttcgcgctacaacaaagtggtgaacatccccaacagtatgaccatactggacgagcttctcccaatctccatcgagatggccaagagaaacctgagagggatatggaacttcaccaacccaggggtggtgagtcacaacgagatactcgagatgtacaagagctacatcgagccaggttttaaatggtccaacttcacagtggaagaacaagcaaaggtcattgttgctcctcgaagcaacaatgaaatggatggtgctaaactaagcaaggagttcccagagatgttacccattaaagaggcactgatcaaatacgtctttgaaccaaacaagagaacctgagccctcaataaacaacacacaagacgccacaagtgcttatctataactgttttttttatattaaaatgtctttttatgtttgctcgtcatcttacatccttgtaggtagtttcactatattgattctactaaaatatgattttatcattcttatttaatatttatagagacgagaatttttctttttc

SEQ ID NO: 12339 - DNA, 2095 bp, Daucus carota
tctcgttcggagctaccctgattacaagattgttgtgcttgataagcttgactactgttcaaatctgaagaaccttaatccatctcggtcagctccaaacttcaaatttgtcaagggcgatatcggcagtgctgatcttgtcaactaccttcttatcactgagtccattgatactattatgcactttgctgcccagacccatgttgataattcttttggtaacagctttgagtttaccaagaacaacatttatggcactcacgtgcttttagaagcttgcaaagtgactggacaaatcagaaggtttatccatgtaagtacagatgaggtctatggcgagacagacgaggatgctgttgtgggtaatcatgaagcttcgcaactcctccctaccaatccatattcagccacaaaagctggggcggaaatgcttgttatggcttatggcaggtcatacggcctacctgttataacaactcggggtaataatgtgtatggtcctaatcagtttccggaaaaattgattccaaagttcatccttttagccatgaggggaatgcaacttcctattcatggggatggtgccaatgtgcgcagttatctctactgcgaggatgttgctgaggcctttgaggttgttcttcacaagggagaagttggccatgtttataatattgggacaaagaaggaaaggagagttactgatgttgccaaagacatctgtaaacttttttctgtggacccagaaacaaatattaactatgtggagaacaggccattcaatgatcagaggtactttctagatgatcagaagttaaaaaacttgggctgggctgagcgcactacatgggaagaagggctaaaaaagactatggactggtacactagcaaccctgattggtggggagatgtatctggagcattgcttcctcatccaagaatgctgatgatgcctggtggaattgagagacactttgacggatctgaaaaccgtgacgctgaatcaactcgtttcgtcgataaatctgccccatcacaggtttcttcctcagatcccaaaagcacagtgcctcagaaattagctcttaagtttttaatttatggtaggactgggtggattggtggtctgctcggaaaattatgtgaaaaacaaggtattccatatgaatatggaagggggcgcctagagtatcgatcacagctagtgtctgatctccagatagttaaacccacacatgtttttaatgctgctggtgtgactggtagacccaatgtcgattggtgtgagtcccacaaaacagaaaccattcgtacaaatgtcacgggtacactgacactagctgatgtatgcagagagcaaggacttctgatgattaattttgctactggatgcatatttgagtatgatgctgcacacccagaaggttctggcattgggttcaaagaagaagacacgcccaattttcatggatcattctattcaaagacaaaggccatggttgaagaactcttgaaagagtttgacaatgtttgcaccctcagagttcggatgcccatatcatcagacctcagcaacccccgcaacttcatcacaaagattagtcgttataataaggtggttaatattcccaacagcatgacagtcttggatgagttgctacctatctcaatcgagatggccaagaggaaccttaaaggtatatggaacttcaccaaccctggagtcgtaagccacaatgagattttggagatgtacaagcaatatatcgacccatcttttaaatactcaaacttcacactagaggagcaagccaaagtaattgtagcagctagaagcaataatgagatggatggggcgaagttgaaggccgagttccctgagttgctgtcaatcaaggaatcattgatcaagtatgtttttgaacccaacaaaaaagtttagctgctggttgagcactgtagaatagtaaacttcaggcgacctctacagtcttgatttaccttactattattaccctgaggtcattattactgtcatagtagatttcctgctgattcctgtgttttcttaatattgttataatatatttccttt

SEQ ID NO: 12340 - DNA, 2226 bp, Eutrema halophilum
tgttttctgatgttgcagatattatatttcacatcaaatggctacgtataagcccaagaacatcctcatcactggggctgctggattcatagcgtcccatgttgccaacagactagttcgcagctaccctgactacaaaattgttgtccttgacaagcttgattactgttcaaacctgaagaatctcaatccttccaaatcatctcccaacttcaagtttgtcaagggagacattgccagtgctgacctcgtcaactaccttctcatcactgaaaacatcgacacaattatgcactttgctgctcagacccatgtcgacaactctttcggtaatagctttgagtttaccaagaacaacatttacggtactcatgtccttctggaagcttgcaaagtcacaggacagatcaggaggtttatccatgtgagtactgatgaggtctatggtgagactgatgaggatgcttcagtggggaatcacgaggcttctcagttgctcccgaccaatccatactctgccactaaggctggagctgagatgctcgtgatggcatatggtagctcgtacgggttgccagttataacaactcgcgggaacaatgtttatggtcccaaccagtttcctgaaaagttgattcctaagttcatactgttggccatgaatgggaagccactcccgatccacggagatggatctaatgtgaggagttacctctactgcgaagatgttgctgaggcatttgaggttgttctacacaaaggggaagttaatcatgtctacaatatagggacaacgagagaaaggagagtgattgacgtggccaacgacatctccaaactctttggaatagaccccgactccaccattcagtttgtcgagaaccgcccttttaatgaccagaggtacttcctcgatgaccagaagctgaagaaattgggatggtctgaacgaaccacttgggaagaaggactgaggaagacaatggaatggtacactgagaaccctgagtggtggggagatgtttctggagctctactgcctcatccacggatgctgatgatgcccggtgatagactctctgatggctctgacgagcacaaggatgcaggtggtaatcagacattcacagtaattactcccaccaagactggtagttccggagacaaaacatccttaaagtttctcatctatggcaagactgggtggcttggcggtcttctaggaaagctatgtgagaagcaaggtattccatacgagtatggaaaagggagactagaggacagggcttctctctcccccggatattcgcagcatcaaacccactcatgtcttcatgccgccggtttaaccggcagacccaatgttgactggtgtgagtctcacaaaaccgagactatccgagtcaacgttgctggtactttgactctagcagatgtctgcagagagaatgatctgttgataatgaactttgccaccggttgtatatttgagtatgacgctgcacatccagaaggttcaggaattggctttaaggaagaagacaaaccgaatttcaccggttctttctactcaaaaacgaaggcaatggtcgaagagctactaagagaatttgacaatgtatgcaccttgagagtgcggatgccaatttcatccgacttgaacaacccgcgaaacttcattacgaagatctcgcgatacaacaaagtggtgaacatcccaaacagcatgaccatactcgacgaactcttaccaatctcaatcgagatggcgaagaggaacctaaggggaatatggaatttcaccaatccaggagtggtgagtcacaacgagatactagagatgtacaagagttacatcgagccaggttttaaatggtccaacttcactttggaagaacaggctaaggtcattgtcgcaccacggagcaacaatgagatggatggctctaagctaagcaaagagtttccagagatgctttccatcaaagattcattgatcaaatacgtcttcgaacccaacaagagaacgtaaacgccctcaataacatacatttcctctttctctgttcattgttatagtatcctcgcaggtagtttcactataatgattctactataaatttgatttgttttgtcatatgattcatttctctttcttgacacattctacgtcacgacacaactttgtttacattaatattattacacatgaatgagttctttttt

SEQ ID NO: 12341 - DNA, 2432 bp, Gossypium raimondii
cgctcacctctacgaagggtccctcacacattctcttctttcttttctctacctacctcctttcctctctcactcaacaccttcaccaaaaaaggaaaatcactcacttttgcatggctaataaatacacgccgaagaacatcctcataaccggagctgctggcttcattgcctcccatgtctgcaaccgtctcatccgcaactacccggactacaaaattgtggtccttgacaagcttgattactgctcaagcttgaagaacctggacccttcacgctcatctcccaacttcaagttcatcaagggagatattgcaagtgctgatctggttcattttatcctacagactgaattcattgataccatcatgcactttgcagcccagactcatgttgacaactccttcggtaacagttttgagttcaccaaaaacaacatttatggaactcatgttctcctggaagcttgcaaagtcactggccaaatcaagaggttcatccatgtaagcacggatgaggtttacggcgagacggatgaagatgctgtggtgggaaaccatgaggcttctcagctcctcccgaccaacccatattccgccactaaagccggagcagagatgctggtgatggcttatggacgctcatatggtctgcctgtgataactacacgagggaataatgtttatgggaccaatcagttccctgaaaaactgattcccaagttcatcctactggcaatgaatggaaagattcttccaattcatggggatggatcaaatgtgaggagttatctgtattgtgaggatgttgcagaggcctttgaagtcattctacacagaggtgaagttggccatgtgtacaatataggcacaaagaaagaaagaagagtgtttgatgtggccagggatatttgcaggctgtttaacttggatcctgaaagccagatcaagtttgtggagaatcgtcctttcaatgaccaaagatatttcttggatgatcaaaagctgaaaagcttgggatggtatgaaagaaccacatgggaggaaggtctcaagaaaactatggaatggtatgttagcaaccctgattggtggggtgatgtctctggtgcgctgctaccccatcctagaatgctcatgctgcctggaattgaaaggcaattcaatgcccctgatacgagcaattcaggtttaggttcggcccctgtgacaaacaagttcaatcaaagcaggatgttggttccatctccaaagcacaatataccatctcaaaagccatctctcaagtttttgatttacggcagaacaggttggatagggggacttcttgggaagctctgtgagaaacaaggcatacctttcgagtacgggaaaggtcggttggagcaacgttcacagcttttggatgatatccaaactgttaagccaacccatgtgttcaatgcagctggtgtgacgggtagaccaaatgtggattggtgtgaaactcataagcccgaaaccataagaaccaatgttgttggtacattaaccttggctgacatctgtagggaacatgacctcctcatgatcaattatgctactggttgtatctttgaatatgatgccactcatcctttaggaaccggagtcggtttcaaggaggaagataagcccaatttcactggttccttctattcaaaaaccaaagccgtggttgaagagcttttgagggaatttgacaatgtatgcacactcagagtccggatgcctatatcctcagatctgagcaacccacggaactttatcacaaagatcactcgatacaacaaggtggttgacatttccaacagcatgaccatattagatgagcttctaccagtttcaatagagatggccaaaaggaacttgaggggcatatggaacttcacaaaccctggtgttgtgagccacaatgagatactgcaaatgtacaaggactacattgacccaaatttcaactgggttaatttcagcttgcaagaacaggccaaggtcattgttgcacccaggagcaacaatgaactcgatgcatctaagctaaagaatgagttccctgagttactgtctatcaaggactcactcatcaaatatgtctttgaacccaacaggaaaacctttgcttgggaactctcaaactaagaaccataaccataagcctcctcatccaggtggtgttgtttgttattattataatttggccattgtctaaggtggcttgttacaccccccccatgtacttggggttttatgttgttgtcgaccactgaataaagttactttattattgtactccataccattcagttcactgtgcttccacatgttcatagtcataagaaaaccaatgagtttttctggtttgttgctattacatctgagaattcatatttgttatgttatgcagaatttttt

SEQ ID NO: 12342 - DNA, 2213 bp, Eutrema parvulum
tgcagatactttgatttcaacaatggcgactacatataagcctaagaacattctcattactggtgctgctggattcattgcttctcatgttgccaacagactaatccgtagctatccagattacaagatcgttgtcttggacaagcttgattactgttcagatctgaagaatctcaatccttcgaattcttctccaaacttcaagtttgtcaaaggagatattgcgagcgatgatcttgttaactaccttctcatcaccgaaaacatcgataccatcatgcactttgctgctcagacccatgttgataactcttttggtaatagctttgagtttaccaagaacaatatttatggtactcatgttcttttggaagcctgcaaagtaacagggcagatcaggaggtttatccatgtgagcaccgatgaagtctatggagaaaccgatgaggatgctgcagttggaaaccatgaagcttctcagctgttacccacaaatccatactcggcaactaaggccggtgccgagatgcttgtcatggcttatggtagatcatatgggttgcctgttattacaactcgtgggaacaatgtttatgggcctaaccagtttcctgagaaactgattcctaaattcatcttgttggctatgagtgggaagccgcttcccatccacggagatggatctaatgtcaggagttacttatactgtgaagacgttgctgaggcgtttgaggttgtccttcacaaaggagaagttggtcatgtctacaatattggaacaaagagagaaagaagagtgattgatgtggccacagacatctgcaaacttttcgggaaagatcctgagtcaagcattcaatttgtggagaatcgaccatttaacgatcaaaggtacttccttgatgatcagaagctgaagaatttgggatggtcagagcgaaccgcatgggaagatggattgaagaagacaatggaatggtacactcagaatcctgagtggtggggtgatgtttctggagctttgcttcctcatccgagaatgcttatgatgcccggtggaagactttctgatgtttcagatgagaaaaaagatgcatcaagcaacactgtccagacatttacggttgtaacacctaacaacaagactggtggttctaatgacaaagcttcgttgaagtttttgatctatggtaagactggttggattggtggtctactagggaaactatgtgagaagcaaggcattacatacgagtacgggaaaggacgtttggaggacagagcttctctcattgcagatatatgtagcatcaaaccgactcatgtgttcaatgctgctggtttaactgggagacctaacgttgactggtgtgaatctcacaaacccgagacaattcgtgtcaatgtagctggtactttgactcttgcagatgtttgcagagagaatgatctcttgatgatgaatttcgccactggttgcatatttgagtatgacgctgcacatcctgagggttcgggtataggtttcaaggaagaagacaagccaaatttcactggttctttctactcaaaaaccaaagccatggttgaggagcttttgagagaatttgacaatgtatgtaccttgagagtgcggatgcctatctcttcagacctaaacaacccacgaaacttcattacaaagatctcgcgttacaacaaagtggtgaacatcccgaacagcatgaccatactggatgagcttctcccgatctccatcgagatggcaaagagaaacctaagagggatatggaacttcaccaacccaggggtggtgagccacaacgagatactggagatgtacaagagttacatcgacccagtatttaaatggtccaacttcacagtggaagaacaagcaaaggtcattgttgctcctcgaagcaacaatgaaatggatgggtctaaactaagcaaggagttcccagagatgttacccattaaagaggcactgatcaaatacgtctttgaacctaacaagagaacctgagccctcactctatgccacaagtgcctacctatactgtttctttttgttcttgccttttcattttacaaaaatgtcttttactgtttgctcgtcatcttacatccttgtaggtagtttcattatattgattctactaaaatatgatttatcattattatttatagagacgagagtttatcttttt

SEQ ID NO: 12343 - DNA, 2341 bp, Brassica rapa
gtggaccgtagattttccttctttctcttcttcctcttcttcctccatactgttctttctttttgatctctctctctatctcttaggatctttcgtcctaaggttatctgacttgtgtcggtatttcattttaaaatggctactacatataagcccaagaacattctcataactggagctgctggatttattgcttctcatgttgccaacagactaatccgtagctatccagattacaagatcgttgtcttggacaagcttgattactgttcagatctcaagaatctcaacccttcgcattcttctccaaacttcaagtttgtcaaaggagatatcgctagtgatgacctcgttagctaccttctcatcactgaaaacatcgataccatcatgcactttgctgctcaaacccatgttgacaactccttcggtaacagctttgagtttaccaagaacaatatatacggtactcatgttcttcttgaagcctgtaaagtaacaagacagatcaggaggtttatccatgtgagtaccgatgaagtctatggagaaacagatgaggacgctgctgttggaaaccatgaagcttctcagcttttaccgacgaatccatactcagctactaaggctggtgctgagatgcttgtgatggcttatggtcgatcatatggattgcctgttatcactacccgtgggaacaatgtttatgggcctaaccagtttccggagaaaatgattcctaagttcatgttgttagctatgagtggtaagccgcttccgatccatggagatggatctaacgtcaggagttacttgtactgtgaagacgtagctgaagcctttgaggttgttcttcacaaaggagaagttggtcacgtgtacaacatcggaacaaagcgagaaagaagagtgattgatgtggcgagagacatctgcaaacttctagggaaagatcctgaatcaagcattcagtttgtggagaatcgaccttttaatgatcagaggtacttccttgatgatcagaagctgaagaatctgggttggtcggagagaaccgggtgggaagatgggttgaagaagacaatggaatggtacactcagaaccctgagtggtggggtgatgtctctggagctttgcttcctcatccgaggatgcttatgatgcctggtggaagactctcggatgtttcggatgagaagaaagacgcgtcgagcaacaccgttcagacattcacggtcgtaacacctaacaacaagactgctggttctaatgacaaagcctcgttaaagtttttgatctatggtaagactgggtggatcggtggtcttctagggaaactatgtgagaagcaagggattacatatgagtatgggaaaggacgtttggaggacagagcttctcttattgctgatattcgtagcatcaagccgactcatgtgtttaacgctgctggtttgaccgggagacctaacgttgactggtgtgaatctcacaaagccgagaccattcgtgtcaatgtcgctggtacgttgactcttgcagatgtttgtagagagagtggtctcttgatgatgaatttcgccaccggttgcatctttgagtacgatgctgcacatcctgagggttctggtcttggcttcaaggaggaagacaagcccaacttcactggttctttctactccaaaaccaaagccatggtcgaggagcttttgagagagtttgacaatgtatgtactttgagagtccggatgccaatctcatcagacctaaacaacccacgaaacttcatcaccaagatatcacgctacaacaaagtggtgaacatcccgaacagcatgaccatactagatgagctacttccaatctccatcgagatggcaaagagaaacctgagagggatatggaacttcaccaacccaggggtggtgagccacaacgagatactggagatgtacaagagttacatcgagcctggatttaaatggtccaacttcacagttgaagaacaagctaaggtcattgttgcacctcgaagcaacaatgaaatggatggtgctaaactaagcaaggagttcccagagatgctacctattaaagaggcactgatcaaatacgtttttggaccaaacaagagaacctgagccctcagtgaacaatacactatttgccacaagtgcttacctataactgtttttttttggctttctttttacaaaaatgtctttttatatttgctcgcatcttacatccttgtaagtagtttcactatattgattctactaaaatatatgatttatcattactatttatagagacgagagttcttcaatttctcaaata

SEQ ID NO: 12344 - DNA, 3011 bp, Capsicum annuum
gttttgctttctcactatctgcctatgcaggatattttttctcgtagatgttgagggttggttgattgctgaatacttttgttggtttatatttagttgtcgactcggacattttgcggtgttttgtgctgttagctgcacaaacattggcttgacgaatctgtttttatgcttttcttttcgagcatacctgctggctgttaaatttgatgaaattaatcttttcgctgctcgatccgagtttagtattaaacgttaacgtttatctggaatttgtcatctgtagaagctgcctcaagatgtcaacatacacacctaaaaatatacttattactggagctgccggatttattgcatgtcatgtagccaacaggcttgtccatagctacccagactacaagattgttgtcctcgacaaacttgattattgttcaaatttgaagaaccttattccttcccgatcttccgctaatttcaagtttgttaagggagacatcgccagtgcagatcttgtgaactaccttctcatcaccgagtccattgatactataatgcactttgctgctcagactcatgttgataactccttcggtaatagctttgagttcaccaagaacaacatctatggtacgcatgtgctattagaggcctgcaaagttactggtcagatcagacggtttatccatgtcagtacggatgaggtttacggggaaactgatgaggatgctgttgtcggaaaccatgaagcctcacaactccttcccactaacccgtattcagccacaaaagccggagctgaaatgctagttatggcttatggtagatcgtacgggttacctgttataaccactagaggtaacaacgtctatggtcctaaccaatttcctgagaaactgatcccgaagtttatacttttagccatgaggggaaagccgcttcctattcacggtgatggttgtaacgttcgtagttatctctattgtgaggatgttgctgaggcttttgaagtcattctgcataagggagaggtcggtcatgtttacaacattggaactacgaaagagagaagagtgattgatgttgcccaagatatatgcaaactctttaacatagatgccgacaaaagcattcagtttgtggagaacaggccgtttaatgaccaacggtactttctggatgatcagaagttgaaggacttgggctggtcggagaggaccgtatgggaagacggtctgagaaagactattgagtggtataccaataaccctgattggtggggcgatgtcaccggagcattgcttcctcatcctagaatgctgatgatgcccggtgggatagaaagaaatttggatggagctgagaaattcgatttaggatctaacaaattctcagggaagtccaacgaaaccaaaatggtaactccagcttcaaagaccagcaacgtgcctccgaaatcaccttttaagttcttgatctatggtaagactgggtggatcggcggtgtgctagggaaattgtgtgagaagcagggaattccttacgagtacggcaggggacgtttggaggatcgctcaaagcttttggcagacattaacactatcaagcctacacacgtattcaatgctgccggtgtcactggtagacccaacgttgattggtgcgagagtcataaaccagaaacaattcgtacaaatgttgctggaactctaaacttggctgatgtttgcagagagaaaggcctcctaatgattaactttgccaccggttgcatatttgagtatgacgctgcacatccagaaggctccggtattgggttcaaagaggaagatacgcccaatttccacggttctttctattcaaagaccaaggccatggtcgaagagctgctgaaaaactatgacaacgtttgtacactcagggttcgcatgccaatatcttccgacctcaacaacccccggaatttcatcaccaagatcagccgctacaataaggtagtcaatattcctaacagtatgaccatactagatgagcttctgccgatctcaatcgagatggcaaaacgtaacctcaaaggcatatggaacttcactaaccctggcgtagtgagccacaacgagatcttagaaatgtacaagaagtacatcgatccaacatttacttacgccaacttcacattggaagagcaagccaaggtaatcgttgcagcacgtagcaacaacgagatggatgcatcaaaattgaagaaagagttccctgagttgctgtcaatcaaagagtccttgatcaagtatgttttcgaaccaaacaagaaaacctctgcataaaaagtttgttgttgttaaggattttgtatgctattttagtgcccttccccggacaccgtgcatagcggtagctttagtgcactgggctgtccttttatagagttcactattattccttgttatttttgtatgaatgaatttataatatttgtgttctatgtatctttggtcaaatgagtatgcaaaatgtcaggtgaaatttgttgaatctcatatatgaaaatttatgaactttttcttgttgtagtataacctttttgcgagtttcatctttgaattattaggtgttcatctctgaattattaggtgttcgtgtttgtgtcttttacctgccgtcgaagttgagtgtttgaatacaatagtcaaaaggcgtgtaacggcttatttgcccataaaatttttaatttacatggttgttgggtcattaatttcgacttgtgttttaatataattggtgatagttcaggtatgaataatttgttgaatctcatatatgaaattatgaactctttcttgtaaagtataaactttttgcgagtttcatctctgaactatcaggtgtcaatcagatgttcgtgtttgtgttcttacctgtcctattaacaacaactatttattattaaaatactagccatcaaagtttattagactgaatacaatcgtcaaaaggcgtgtaacggcttaatt

SEQ ID NO: 12345 - DNA, 2488 bp, Brassica oleracea
cacaaaaaaaagagacatgagtttctttatgtcggacgctaagctcacgtgaaaactgtaataagtaagacaacttagggtaaaaccgtcaattcgctcgtacggttctccgtaactgtctgagaatataagaggcgcagtgtccagagaagctccgtggaccgtagattttccttcttcctcttcttcctccatactgttctttctttttgatctctctctatctctaaggatcattcgtcctaaggttatctgaattgtgttggtatttcattttaaaatggctactacatataagcccaagaacattctcataactggagctgctggatttattgcttctcatgttgccaacagactaatccgtagctatccagattacaagatcgttgtcttggacaagcttgattactgttcagatctcaagaatctcaacccttcgcattcttctccaaatttcaagtttgtcaaaggagatatcgctagtgatgacctcgttagctaccttctcatcactgaaaacatcgataccatcatgcactttgctgctcaaacccatgttgacaactccttcggtaacagctttgagtttaccaagaacaatatatacggcactcatgttcttcttgaagcctgtaaagtaacaggacagatcaggaggtttattcatgtgagtaccgatgaagtctatggagaaacagatgaggatgctgctgttggtaaccatgaagcttctcagcttttaccgacgaatccatactcagctactaaggctggtgctgagatgcttgtgatggcttatggtcgatcatatggattgcctgttatcactacccgtgggaacaatgtttatgggcctaaccagtttcctgagaaaatgattcctaagttcatgttgttagctatgagtggtaagccgcttccgatccatggagatggatctaacgtcaggagttacttgtactgtgaagacgtagctgaagcctttgaggttgttcttcacaaaggagaagttggtcacgtgtacaacatcggaacaaagagagaaagaagagttattgatgtggcgagagacatctgcaaacttctagggaaagatcctgaatcaagcattcagtttgtggagaatcgaccttttaatgatcagaggtacttccttgatgatcagaagctgaagaatctgggttggtcggagagaaccaggtgggaagatgggttgaagaagacaatggaatggtacattcagaaccctgagtggtggggtgatgtctctggagctttgcttcctcatccgaggatgcttatgatgcctggtggaagactctcggatgtttctgatgagaagaaagaggcgtcgagcaacaccgttcagacattcacggtcgtaacacctaacaacaagactgctggttctaatgacaaagcctcgttaaagtttttgatctatggtaagactgggtggatcggtggtcttctagggaaactatgtgagaagcaagggattacatatgagtatgggaaaggacgtttggaggacagagcttctcttattgctgatattcgtagcatcaagccgactcatgtgtttaacgctgctggtttgaccgggagacctaacgttgactggtgtgaatctcacaaagccgagaccattcgtgtcaatgtcgctggtacgttgactcttgcagatgtttgcagagagagtggtctcttgatgatgaatttcgccaccggttgcatctttgagtacgatgctgcacatcctgagggttctggtcttggcttcaaggaggaagacaagcccaacttcactggttctttctactccaaaaccaaagccatggtcgaggagcttttgagagagtttgacaatgtatgtactttgagagtccggatgccaatctcatcagacctaaaaaacccacgaaacttcatcaccaagatatcacgctacaacaaagtggtgaacatcccgaacagcatgaccatactagacgagctacttccaatctccatagagatggccaagagaaacctgagaggaatatggaacttcaccaacccaggggtggtgagccacaacgagatactggagatgtacaagagttacatcgagccaggatttaaatggtctaacttcacagttgaagaacaagctaaagtcattgttgctcctcgaagcaacaatgaattggatggtgctaaactaagcaaagagttcccagagatgctacctattaaagaggcgctgatcaaatacgtctttggaccaaacaagagaacctgagccctcagtgaacaatacactatttgccacaagtgcttacctataactgtttctttttttccctttatttttacaaaaatgtcttttttatatttgctcgtcatcttacatccttgtaagtagtttcactatattgattctactaaaatatatgatttatcattactatttatagagacgagagttcttcaatttctcaaa

SEQ ID NO: 12346 - DNA, 2444 bp, Brassica rapa
tttaatgtcggacgctgagatcacgtgagacccgtaataagtacgacaggttagggtaaaactgtcaatttgctccgacggttctccgcagctgtctcaaaatataagaggcgagtactcggagacgctccgtagaccgtagattccctcttcttctttctttctctgcactgttctttcttttcatctctctatctctcttaagatctttctgtcctaaggttacctgaattttgtcggtacttgatatcaaaatggctactgaatataagcccaagaacattctcattacgggagctgctggattcattgcttctcatgttgccaacagactcatccgtagctacccggattacaagatcgtcgtcttggacaagcttgattactgctcagatctgaagaacctcgatccttcgttttcttccccaaacttcaggttcgtgaaaggagatatcgctagtgatgacctcgttaactaccttctcatcactgaaaacatcgacaccatcatgcactttgctgctcaaacccatgtcgataactctttcggtaacagctttgagtttaccaagaacaatatttacggtactcatgttcttttggaagcctgcaaagtaactggacagatcaagaggtttatccatgtgagtaccgatgaagtctatggagaaacagatgaggacgctgctgttggaaaccatgaagcttctcagcttttaccgacgaatccatactcagctactaaggctggcgctgagatgctggtgatggcttatggtagatcatatggtttaccggttatcacaactcgtggcaacaatgtttatggtcctaaccagtttcctgagaagatgattcctaagttcatgttgttggctatgagtgggaagccgcttcccatccatggagatggatctaacgtcaggagttacttatactgtgaagacgttgctgaagcctttgaggttgttcttcacaaaggagaagtgggtcacgtctacaatattggaacaaagagagaaagaagagtgattgatgtggcgagagacatctgcaaactcttagggaaagatcctgaagcaagcattcagtttgtggagaatcgaccctttaatgatcaacgatacttccttgatgatcagaagctgaagaatcttggatggtgtgagcgaaccgggtgggaagatggattgaagaagacgatggaatggtacactcagaaccctgagtggtggggtgatgtctctggagctttgcttcctcacccgaggatgcttatgatgcccggtggtagagtttctgacgagaagaaagacacatcaagcaacaccgtccagacatttactgttgtaacaccaaacaacaagactcatgatcctaaagacaaagcctcgttgaagtttctgatctatggcaagactggttggatcggtggtcttctagggaaattatgtgagaagcaagggatcacatatgagtatgggaaaggacggttggaggatagagcttctctcatggcggatattcgtagcaacaagcctactcatgtctttaacgctgctggtttaactgggagacctaacgtggactggtgtgaatctcacaagccagagactattcgtgtcaatgtcgctggtactttgactctagcagatgtttgcagagagaatggtctcttgatgatgaacttcgccaccggttgcatctttgagtatgacgctgcacatcctgagggttcgggtataggtttcaaggaagaagacaatcctaacttcaccggttctttctactcaaaaaccaaagccatggttgaggagcttttgagagagtttgacaatgtatgtaccttgagagtgcggatgcccatctcgtcagacctaaacaacccacgaaacttcatcaccaagatttcgcgctacaacaaagtggtgaacatccccaacagtatgaccatactggacgagcttctcccaatctccatcgagatggccaagagaaacctaagagggatatggaacttcaccaacccaggggtggtgagtcacaacgagatactcgagatgtacaagagctacatcgagccaggttttaaatggtccaacttcacagttgaagaacaagcaaaggttattgttgctcctcgaagcaaacatgaaatggatggtgctaaactaagcaaggagttcccagagatgttacccattaaagaggcactgatcaaatacgtctttgaaccaaacaagagaacctgagccctcaataaacaacacacaagacgccacaagtgcttatctataactgttttttttttatattaaaatgtctttttatgtttgctcgtcatcttacatccttgtaggtagtttcactatattgattctactaaaatatgattttatcattcttatttaatatttatagagacgagaatttttctttttctc

SEQ ID NO: 12347 - DNA, 1988 bp, Phalaenopsis aphrodite
tcacatgttgccaacaggctcatccgcaactaccccgattacaaaattgtggtcctcgacaaactcgactactgctccaaccttaaaaacctttccccttctggatattcccccaacttgaagtttgttaagggcgacatcgccagtgctgatcttctccactaccttctcatcacggagtccatcgacacaataatgcacttcgcagctcaaactcacgtcgacaattctttcggcaactcctttgagttcactaaaaacaacatctatggaactcatgttctgcttgaggcatgcaaggtctccggtcaaataaggagatttatccatgtcagcacagatgaagtttatggggaaaccgatgagaatgccattgtcggcaaccatgaagcctctcagctcctccctacgaacccgtattctgccaccaaagccggagctgaaatgcttgtgatggcttatggaaggtcctatggcttacccgtaataaccactcgtggtaacaatgtctacggaccaaatcaatttccggaaaagttgattccaaaattcatccttctagcaatgagaggacaaacccttccgattcatggagacggttcgaacgttcgaagctacctctattgtgaggatgttgccgaggcttttgaggttattcttcatagaggggagatcggccatgtttataatattgggacaaagaaagagaggagagtgattgatgtagcaaaagatatttgtaagcttttcgcgcgggataccaccaccgcaattaagttcgtcgacaacagaccgttcaatgaccaaagatactttctcgatgatcagaagctaaaaattttgggttggtctgaaagaactacttgggaagagggtctgaaaaagactatggattggtacacaaacaatccggattggtggggagatgtctcaggagcacttttaccacatccaagaatgctaatgatgccaggcactgaaagacattccgatggccctgaagagataataaagagcatgttgtctccgccaaacaatattaacattccaagccaattgataacaccacctgtctcagaaacctcatcttttggtatcaaaacacagtctttgaagtttttgatatacggcaaaaccggatggatcggcggccttctcgggaagatatgtgagaagcaagggataccgttcgagtacggaaaaggcagattagaagatcgatctaagctccaatcagatattcataatgtgaagccgacacatgttttcaatgctgctggtgtcactggcaggccgaatgtcgactggtgtgaatctcatcgactagaaactatccgcaccaatgttgtaggaactttgaccctagctgatgtttgctccgagaatggtttgttgctcattaattatgcgactgggtgtatttttgaatatgatgctaatcacccagaaggctcaggctatggattcaaggaggaagatagcccaaacttcgttggttccttctactcaaaaacaaaggccatggttgaggagcttctgaaggagtacgacaacgtttgtactttaagagtccgaatgccgatatcatctgatctgaacaatccccgtaacttcatcacgaagatcagtcgatacgacaaggtggttaatatcccaaacagcatgactgtattggatgagttgcttccaatatcaatcgagatggctaggagaaattgcaggggaatatggaacttcaccaacccgggtgttgtgagccacaatgagatcttggagctctacaaggcttatgttgatcccggcttcagttgggtcaactttacactcgaagaacaggcgaaggtgatcgtcgcgcctcgcagcaataacgaattggatgcttcaaagttgaagaacgagtttccggagctgctgtcgattaaagaatctctcataaaatatgtgttcgagcccaacaggaagcaggtgaagtgacgccatggatggga

SEQ ID NO: 12348 - DNA, 2577 bp, Panicum virgatum
ggcgccgtgctactactactactacagtactagctacctctctgccggctcagtacaaagcccccctcgcccattccttcccatcagcccagggcgtctgctactctgcattgttcctactcgctagtccctccgctcccgaagtaggatttctaaagcataaacacggaggacatggcgacaccgtacaaacctaagaacatcctcatcactggagctgctgggtttatcgcctcccatgtcgcgacccgcatcgtgaagaattaccctgactacaagatcgtcgtcctcgacaagcttgactactgctcgaacctgaagaatctgctccccgtgagctcattgccaaacttcaagtttgtcaagggagacatcgcaagcgccgaccttgtcaacttcatccttgtcacagagaacattgacactgtgatgcactttgcagcccagacacatgttgacaattcctttgggaactctttcgagttcaccaagaacaatatttatggtacacatgtccttcttgaggcctgccggcagatcactggtcagatcaagaggttcatccatgtcagcactgatgaggtttatggagagacagatgaggatgcagttgttggcaaccatgagatgtcacagctgctccccacaaacccctacgcagccaccaaagccggagcggagatgcttgtcatggcctatgggagatcctatggtcttccagtcatcactactcggggcaacaatgtctatggccctaaccaattcccagagaagctcatcccaaagtttattctcttggccatgagaggggaaccccttccaatccatggtgatggatccaatgtccggagctacctctattgtgaggatgtcgccgaggcatttgaggtcattcttcatcgtggagaagttggacatgtttataacattgggacaaagaaagagaggacggtcatgaatgtggcaaaagatatatgcaagcttttcaatctggaagcagacaaagctatcaagtttgttgacaacaggcctttcaatgatcagaggtacttcctcaacaatgagaagctcaagagccttggatggtccgagcgcactcactgggaggagggcctgaggaagactatggaatggtatgtggccaattccgactactggggtgatgtttctggggcattgctgcctcatccaaaggcaatggtgatgcctggagggttcgagggctctaaggagattaaaggaatgctttctcagtttaataacattcagacaaaggtagctccaacatcagatagcgttctagaaacgcatcccttcaaattcttgatatatggtaggactggatggattggtggacttcttggaaaaatatgtgagaagcagggaatcccatatgaatatggaaaaggccgcttgcaagaccgttcttcactcatccttgacatccaaactattaagccgacacatgtcttcaatgctgctggtgtaactggcagacccaatgttgactggtgtgaatcacacaaaccagacaccatccgtaccaatgttgtgggtaccttgactctagctgatgtgtgtagggagcatggcttattgatgataaactatgccacagggtgcatattcgaatatgatgcacaacatcctgaaggatcaggtatcggcttcaaagaggaggacacaccaaattttactggttcattctactcgaagaccaaggcaatggtcgaggagctactgaaggaatatgagaatgtctgcaccctgcgtgtccggatgccaatatcttctgaccttagcaacccccggaatttcgtgacaaagatcagccgttacgacaaggtggtgaacatcccaaacagcatgacaatattggatgagctcctgccgatctcagtcgagatggcgaagaggaacctgcggggcatctataatttcaccaaccctggcgtcgtcagccacaacgaggtgctggagatgtacaagcagtacattgaccctagctacaagtggacaaacttcaccctcgaggagcaagccaaggtcatcgtcgcgccccggagcaacaacgagctggacaccaccaagctgaagaaggagttccccgagttgctgtcaatcaaagactcactgatcaagtacgtcttcgagccaaacaggaaggtggcagcaaactgaaggctagcagagccgatacagcagaaaatgcagcaaccgttattagcttgtagcgcatccatttgtcgtgagcgatttcattagaatgtttacttgttatttttagcagcatatccccgctataggtgattttctcgcttgcatccgccacggtcaaatgcatgatttctagttatgctacttatgttgagttgagtacttatgtgtgggttaatagcccgctctatccgtgttcccgttcaatattaatgtttgcaaaggtgcaagtactattcttatttctttaagccaggcaagcaaatatgcccagcattgcactgcaaagacaatatgaatcactattacactataaggtaaatatgatcttacaaaaatatgatatactatacactgcaa

SEQ ID NO: 12349 - DNA, 2526 bp, Arabidopsis thaliana
gagtttaatgtcggacgctagactcacgagaaatccgtaatatctaagacgatcaagggtaaattagtcaatttcctcctacggttctccgtaactgtctcagaatataagaggcacattgctgagagaagctccgtagaccgtagattccctcttcttcttcttcctcttcctctctactgttttttcttttcatatttctctctctctctctctctatagttggtgaagtttctatctttatctctcttaagatctctttctctcttgggttatctgactctaaccagaattgtgtcgatttcaaggatggatgatactacgtataagccaaagaacattctcattactggagctgctggatttattgcttctcatgttgccaacagattaatccgtaactatcctgattacaagatcgttgttcttgacaagcttgattactgttcagatctgaagaatcttgatccttctttttcttcaccaaatttcaagtttgtcaaaggagatatcgcgagtgatgatctcgttaactaccttctcatcactgaaaacattgatacgataatgcattttgctgctcaaactcatgttgataactcttttggtaatagctttgagtttaccaagaacaatatttatggtactcatgttcttttggaagcctgtaaagttacaggacagatcaggaggtttatccatgtgagtaccgatgaagtctatggagaaaccgatgaggatgctgctgtaggaaaccatgaagcttctcagctgttaccgacgaatccttactctgcaactaaggctggtgctgagatgcttgtgatggcttatggtagatcatatggattgcctgttattacgactcgcgggaacaatgtttatgggcctaaccagtttcctgaaaaaatgattcctaagttcatcttgttggctatgagtgggaagccgcttcccatccatggagatggatctaatgtccggagttacttgtactgcgaagacgttgctgaggcttttgaggttgttcttcacaaaggagaaatcggtcatgtctacaatgtcggcacaaaaagagaaaggagagtgatcgatgtggctagagacatctgcaaacttttcgggaaagaccctgagtcaagcattcagtttgtggagaaccggccctttaatgatcaaaggtacttccttgatgatcagaagctgaagaaattggggtggcaagagcgaacaaattgggaagatggattgaagaagacaatggactggtacactcagaatcctgagtggtggggtgatgtttctggagctttgcttcctcatccgagaatgcttatgatgcccggtggaagactttctgatggatctagtgagaagaaagacgtttcaagcaacacggtccagacatttacggttgtaacacctaagaatggtgattctggtgacaaagcttcgttgaagtttttgatctatggtaagactggttggcttggtggtcttctagggaaactatgtgagaagcaagggattacatatgagtatgggaaaggacgtctggaggatagagcttctcttgtggcggatattcgtagcatcaaacctactcatgtgtttaatgctgctggtttaactggcagacccaacgttgactggtgtgaatctcacaaaccagagaccattcgtgtaaatgtcgcaggtactttgactctagctgatgtttgcagagagaatgatctcttgatgatgaacttcgccaccggttgcatctttgagtatgacgctacacatcctgagggttcgggtataggtttcaaggaagaagacaagccaaatttctttggttctttctactcgaaaaccaaagccatggttgaggagctcttgagagaatttgacaatgtatgtaccttgagagtccggatgccaatctcctcagacctaaacaacccgagaaacttcatcacgaagatctcgcgctacaacaaagtggtggacatcccgaacagcatgaccgtactagacgagcttctcccaatctctatcgagatggcgaagagaaacctaagaggcatatggaatttcaccaacccaggggtggtgagccacaacgagatattggagatgtacaagaattacatcgagccaggttttaaatggtccaacttcacagtggaagaacaagcaaaggtcattgttgctgctcgaagcaacaacgaaatggatggatctaaactaagcaaggagttcccagagatgctctccatcaaagagtcactgctcaaatacgtctttgaaccaaacaagagaacctaagccttcaatgaacatcacactcttccacaagtgcttactttaaactgttttgttttgtttttttttctttttgccttttcttccaacagatatatcttttttatatttactcatcgtcttatgatccttgtaggtagtttcactatattgattctactaaaatatgatttacgattattaatatttatatagacgagagtttttcttttcctc

SEQ ID NO: 12350 - DNA, 2481 bp, Malus domestica
ctccttctctctttttttctagtcatttctcgtctttcttcttcaacttgtcttaaatccagcacaggacaaaaggctgcgaattgtactcaagatccactccaaaccaggatttaagtcctttggatcaatatggatactgcgtataaaccgaagaacatcctccttactggagctgctggcttcattgcttcccatgtttgcaaccggcttatccggaactaccctgcctacaagattgtggtccttgacaagcttgattactgttcaaatttgaagaaccttaatccttcaaagtcgtcccccaagtttaagtttatcaaaggagacataggcagtgctgatcttgtcaacttcatccttttgaccgagaacattgacacaataatgcactttgcagcccagacccatgtcgacaactcttttggtaacagctttgagttcaccaaaaacaacatctacgggacacatgttcttctagaagcttgcaaagtcactggtcaaatcaaaagattcattcatgtaagcacagatgaagtctatggggagacagatgaggatgctgtggtgggaaatcatgaggcttctcagcttcttccgacaaacccctactctgcaactaaagctggagcagagatgcttgtcatggcatatgggcgttcatatggattgcctgtgataacgaccagaggaaacaatgtttatggccccaaccagttccctgaaaagatgattccaaaattcattctcttggctatgcaagggaagcctcttccgattcatggtgatggatccaatgtcagaagttatctctattgtgaggatgtagcagaggcatttgaagtcattctccataggggtgaggtaggccatgtgtacaacattgggacgaagaaagagaggagggtggtcgatgtggccagggaaatttgccaactattttctctgaacccagatacatatgtaaagtttgtagagaacagacccttcaatgatcagagatatttcttggatgaccagaagctgaaaagcttgggatggtcggaaaggactttgtgggaggagggtttgaggaagaccatggaatggtatgtcaagaatccccaatggtggggagatgtttctggggcactgctccctcatccaaaaatgctcatggttcccggaattgaaagacaatttgatggttccgatactggcgattctgcttaccctttgtcagcaagtgattctagtcagagcaaaatggttgttccagctccaaggaacatccaatctactgagaagccatctctgaagtttttgatttatggtaaaacagggtggatcggaggccttcttgggaagatttgtgagaagcaagggttaccctatgagtatggacgagggcgtcttcaggaacggtcacagctcatggctgatattctgagtgttaaaccaacccatgtttttaatgctgctggagtgactggcagacccaatgtggattggtgtgaatctcataaaccagaaacaattcggaccaatgttgttggtacattaaccttggctgatgtctgcagagatcacggcctcctaatggtgaattatgccactggttgcattttcgagtatgatgatgcccatccaccaagatcgggaattgggttcaaggaggaagacacaccgaattttgcaggctcattttattccaaaaccaaagccatggttgaagagcttctaaaggagtatgagaatgtttgcactcttagagttcgaatgccaatatcatctgatctcagcaacccacgcaacttcatcacaaagatctcgcgctacaacaaagtggtcgacattccaaacagcatgacaatcttggacgagcttctacccatttcagttgagatggccaagaggaacttgaggggcatatggaacttcacaaaccccggggtggtgagtcacaacgagattctggagatgtacaagaactacattgaccccagtttcaagtggactaattttactgtggaagaacaagccaaggttatcgttgcagcaagaagtaacaatgagatggatgcatcaaagctgaagaaagagttcccagaactgctcccgatcaaggaatcgctgattaaatacgtgtttgaacccaacaagaaaacatttgcaggtggagcagcaatttaagtgtctcatgaagtagacctcggtaccgttcctatgcatttgtttatttatttatttatttatcctgtgggaattagctagggttgtagtaattctcatgttgtggttccatcagtctcatcctatgaattaagtcaaatttgtttctgtgatagattaggatagttaaataagttggtggtattggttctggtttgtttagttattctcatgttttgataagaagctatggaattgctgggtctactgtaagttggggcattgtaattttcagatatgtaaccaataaaattatttttatttaaacaa

SEQ ID NO: 12351 - DNA, 2372 bp, Manihot esculenta
gaacatcctcattactggggctgctggctttatcgcgtcccatgtttgcaatcggctcatccgtaactaccctgattacaaaattgttgtccttgacaagcttgattattgttcaaacctcaaaaacctcctcccttctaaatcatccgccaactttaagtttgtcaaaggtgacattggcagtgctgatctcgtcaactttcttctcatcactgaatccattgacacaattatgcactttgctgctcagacacatgtggacaactcctttggtaacagctttgagtttaccaagaataacatatatggtacccatgtacttttagaagcctgcaaagtcactggccagattaagagattcatccacgtaagcacagatgaagtttatggggagacagatgaggatgctgttgtaggaaaccatgaagcttctcaactcctcccaacaaatccatactctgcaacaaaagctggtgcagaaatgcttgttatggcgtatgggagatcatatgggttaccagttataacaacccgtggaaacaatgtttatggtcccaatcagtttcctgagaaattaattccaaagtttatcctcttggctatgcaagggaagcctcttccaatccatggggatggttctaacgtgaggagttatttatattgtgaggatgttgctgaggcttttgaagtcattcttcacaagggagaggtgggtcacgtttacaatattgggacaaagaaggaaagaagagtgatagatgtggctaaggacatatgcaaacttttttcaatggaccctgagacaagcatcaagtttgtagagaacaggccattcaatgaccagaggtactttcttgatgatcagaagctgaagatcttaggatggtcagaacgcactatttgggaggagggcttgaagaagactatggagtggtacattcaaaatcctgattggtggggtgatgtaactggggccttgcttcctcatccaagaatgctgatgatgcctggtgggagacactttgatggatctgaagaaaacaaatctgcaccttatgcttcaaataattctaatcagacccgaatggttatccctgtttctagaaccagcaccagtggctcccctcgaaaatcctctcttaagttcttgatctatggcaggaccgggtggattgggggtctacttgggaagttgtgcgagaaacaagggattgcctatgaatatggaagggcccgcttggaagataggtcatctgtactgtcagatattcagaatgttagaccaacccatgttctcaatgctgctgggattactggtagacctaatgttgattggtgtgaatctcacaagacagaaacaattcgcaccaatgtggctggaactttaacattagcagatgtttgcagagaacataacattctaatggtgaattatgctactggctgcatatttgagtatgattctactcatccagagcattccggcattgggtttactgaggaagagaaacccaatttcattggttctttttactcaaagaccaaggcaatggtggaggagctcctgaaggaatatgacaacgtatgcaccctcagacttagaatgccaatatcatcagatctaaacaacccacgcaacttcatttataagatttctcgatataacaaagtggtcaatattccaaacagcatgactgtcttggatgaactcctacccatttcaattgagatggcaaagcggaacttgaggggtatatggaacttcacaaaccctggtgtggtgagccataatgagattttggagatgtacaagagtcacgtgaaccccaacttcacatgggttaacttcacactcgaggagcaatctaaggtgatagtggcaccacgaagcaacaacgagatggatgcttccaagttgaaaaaggagttccctgagttgctgtcaatcaaggagtctttgctcaagtacgtttttgtaccaaataagaaagtatgaactaaagcagtattaattgaccctatgttccattacaagtgcctccagtattgctagtgtttcaattctactagtcattcactgtgaggttttctcattgtttctaccaacgctagaaagtgaagtattaggcattatgcttctgtggtttctttacctgggttgtattttagtctcatcctagtgttcctttgagtaggtccttgatatgtgcaatagtcatgcgggtgttagagtcctacaatttattagatattgtggtttattgcttaaattctttgttacttggcttaactgtcttgttggccgttggattgaaagaaacatgagaggattgttattgaattccaagtttgtgcttggtaaaatttttatt

SEQ ID NO: 12352 - DNA, 2544 bp, Fagus grandifolia
gaaaggaaaggaaagggcattttcgtcattggcgctggtttaatggttcgccttaactgtctcaatgatttacagaatcgtgtatatatatgccacctccatcttccctctctcaagggcccaaatctacatgctctatctactctttcaattcattgtctgaaaaatcattctcttttacctcttctttcctggactggtttcgtaggtgtttgatctcaacaaaattgacattggtttgagatggcttcttacacccctaaaaacatcctcataactggagctgccgggttcattgcgtcccatgttgccaaccggctcatccgtaactaccctgactacaagattgttgtgcttgacaagcttgattattgctcgaatttgaaaaacctcctgccctcaagatcatctcccaatttcaagtttgtcaagggggacattggcagtgctgaccttgtcaacttcctcttaatcactgagtctatcgacactataatgcactttgctgcccagactcatgttgacaactcatttggtaacagctttgagtttaccaagaacaatatttatggtacccatgttcttttagaagcctgcaaggtcactggccagatcaggaggttcatccatgtgagtacggatgaggtttatggggagacagatgaagatgctgttgtgggaaaccacgaggcttctcaactcctccctactaacccatactctgcaacaaaagctggagcagaaatgcttgttatggcgtatggaaggtcatatgggttacctgtgataacaacacgtgggaacaatgtgtacgggcccaatcagtttcctgaaaaattaattccaaagttcatcctcttggccatgcaagggaaacctcttccaattcatggtgatggttcgaatgtgaggagttatttatattgtgaggacgttgccgaggcttttgaagtcattcttcacaagggagaggtgggtcatgtgtacaatatcgggacaaagaaggaaaggagagttattgatgtggccgaagatatatgcagactcttctcgatggacccagagaaaagcatcaagttcgtagagaacagaccatttaatgaccagaggtactttctagatgatcagaagctgaagatcttggggtggtcagagcaaactaggtgggaagaggggctgaagaagactatggaatggtacattaacaatcctgattggtggggcgacgtcactggggcactgcttcctcatccgagaatgctgatgatgcctggtgggattgagagacactttgatgggtctgaagagggcaaatctgcatcttatgtctcaaataatacccggatgctggttccaacttccaaaagctgtggttctcctcgaaaaccttccttgaagttcttgatctatggtaggactggttggcttggtggtctgcttgggaagatatgtgagaaacaagggattccatatgaatatggaagaggacgtctagaggaccggtcatcactcttggcagatattcagaatgttaagccaacccatgttttcaatgctgctggtgtgactggtagacccaatgtagattggtgcgaatctcacaaaactgaaacgattcgcgcgaatgttgctggaaccttaaccttagctgatgtttgccgagagcatgggctattgatgatgaattttgctacaggatgcatatttgagtatgatgctgaacatcctgagggttctggcattggctataaagaggaagacaaacccaatttcattggttctttctattccaaaaccaaggctatggttgaagagctgttgaaagaatatgacaatgtctgcatcctcagagttaggatgccaatatcatctgatctaaataacccacgcaacttcataaccaagatttctcgttataacaaagttgtcaacattccgaacagcatgaccatcttggatgagcttctacccatttcagttgagatggcaaagcggaacttgaggggtatatggaacttcacaaaccctggggttgtgagccataatgagattctggagatgtacaagcaatacattaaccctgaattcaagtgggctaacttcacacttgaggagcaagccaaggtgatagtagcccctgaagcaacaatgagatggacgcgtcaaagttgaagaacgagttccccgagttgctatctattaaggagtctctgattaagtatgtatttgaaccaaacaagaaaaactgagcagaataagcagttttgagttgtagacctcaggatcgacctcttttgctgattggagtaggtatcatttttcagctttcccctataaggctccccccaattattcattgttagcttcatatcattaattccactgttgtagagggtcgtgaggataattctattagttcatggttcttttatttgtaatttagttttgcttttcagcaaggaactttcaatagcttctttataatggatgtaagtcatctagaagcctgggagtgtataactttgcagtctatgtaatgaaata

SEQ ID NO: 12353 - DNA, 2603 bp, Panicum virgatum
ttcctcgtgctgcagaagccgagatggagacaaccgggttgccagggcgtgggcgcgcgtctttattttcgaccacgccgcgtaccaacctcgccgtcgccgtgctactactacccctccgccggctcagtagaaaagccccccctcgcccattccttcccatcagccccggccgtttgccactctgcattgctccctcaggatttcgaaagcacaaacacggaggacatggcgacaccgtacaaacctaagaacatcctcatcactggggctgctgggtttattgcctcccatgtcgcgacccgcatcgtgaagaagtaccctgactacaagatcgtcgtcctcgacaagcttgactactgctccaacctgaagaacctgctctccgtgagctcgtcgccaaacttcaagtttgtcaagggcgacatcgcgagcgccgaccttgtcaacttcatcctcgtcacagagaacattgacactgtgatgcactttgcagcccagacacacgtcgacaattcctttgggaactccttcgagttcaccaagaacaatatttatggtacacatgtccttcttgaggcctgccggcagatcaccggtcagatcaagaggttcatccatgtcagcactgatgaggtttatggagagacagatgaggatgcagttgttggcaaccatgagatgtcacagctgctccccacaaacccctatgcagccaccaaagccggagcagagatgcttgtcatggcctatgggagatcctatggtcttccagtcatcactactcggggaaacaatgtctatggccctaaccaattcccggagaagctcatcccaaagttcattctcttggccatgagagggcaaccccttccaatccatggtgatggatccaatgtccggagctacctctattgtgaggatgtcgccgaggcatttgaggtcattcttcatcgtggagaggttggacatgtttataacattgggacaaagaaagagaggacggtcatgaatgtggcaaaagatatatgcaagcttttcaatctggaagccgacaaagctatcaagtttgttgacaacaggcctttcaatgatcagaggtacttcctcaacaatgagaagctcatgagccttggatggtccgagcgcactcactgggaggagggcctgaggaagacaatggaatggtatgtgtctaattccgactactggggtgatgtttctggggcattgttgcctcatccaaaggcaatggtgatgcctggagggtatgagggctctaaggagattaaaggaatgcttgctcaatttaataacattcagacaaaggtagctccaacatcagatagtgttctggaaacacatcccttcaaattcttgatatatggtcggactggatggattggtggacttcttggaaaaatatgtgagaagcagggaatcccatatgaatatggaaaaggtcgcttgcaagagcgttcttcactcatcctagacatccaaactattaagccaacacatgtcttcaatgctgctggtgttactggcagacccaatgttgactggtgtgaatctcacaagccagaaaccatccgtaccaatgttgttggtaccttgactctagctgatgtgtgtagggagcatggcttattgatgataaactatgccacagggtgcatattcgaatatgatgcacaacatcctgaaggatcaggtatcggcttcaaagaggaggacacaccaaattttactggttcattttactcgaagaccaaggcaatggtcgaagagctactgaaggaatatgagaatgtctgcaccctgcgtgtccggatgcccatatcttctgaccttagcaacccccggaatttcgtgacaaagatcagccgttacgacaaggtggtgaacatcccaaacagcatgacaatactggatgagctcctgccgatctcaatcgagatggccaagaggaacctgcggggcatctataatttcaccaaccctggcgtcgtcagccacaacgaggtcctggagatgtacaagcagtacattgaccctagcttcaagtggacaaacttcaccctcgaggagcaggccaaggtcatcgtcgcgccccggagcaacaacgagttggacaccaccaagctggagcaggagttccccgagttgctgtcgatcaaagactcgttgatcaagtacgtcttcgagccaaacaggaaggtgccagcaaactgaaggccagcagagccgatacaacagaaaatgcagcagccattattagcttgtagcgcatccattcgtcgtgaacggttcatcagaatttgtacttgttatactcggcagcatatctccgctatagtttgattcagagctgctttgtagtttttggcaacatggcgattccccaatttgctgcagagaccatatgtactacttgctgagttcaaatgttcagtatgtgtatttggtttcaattcactgctgacatatgtatttggcaacctgttctatcatgaataattctctaatattcaaccttctggctcctatttatttaaaaggtagccgctagtaatctgattcgatcaaaccaaagaagaaaa

SEQ ID NO: 12354 - DNA, 2500 bp, Medicago truncatula
ctggttccccttaactgtctcgttttttctacatatatacattgtacgatttcatagcttcaccattttcttttcttcttcaaggtaggagactcactcacacccaaatctctctctctctctctctctctatctcattcatcaccattttgtaagcctgacatggcttcgtatacaccgaagaatatcctcattactggggcagctggatttattgcatctcatgttgccaaccggcttgtccgaagtcatcccgagtacaaaattgttgtgcttgataaactagattattgttctaatttaaagaatctccttccttcgaaagcatctcccaactttaagtttgtcaagggggatatcggtagtgctgatcttgtcaactacttgcttattaccgagtcgattgacacgataatgcactttgctgctcaaactcatgtcgacaactcatttggtaatagctttgagtttaccaagaacaacatatacggaactcatgtcttattagaagcctgcaaggttactggccagatcagaaggttcattcatgtcagtaccgatgaggtctatggggagaccgatgaagatgctgttgttggaaaccatgaggcttctcaacttcttcccacaaacccgtactctgcaacaaaagcaggagcggaaatgcttgtcatggcatatggtaggtcatacggattacctgttatcacaacacgtggaaacaatgtttatgggccaaatcagtttcccgagaagttgattccaaagttcatccttctggctatgcaaggaaagactcttccgattcatggggatggttctaatgtgaggagttatttgtattgtgaagatgttgctgaggcatttgaagttgttcttcacaagggagaggttggccatgtttacaatatcgggacaaagaaggaaaggggagttattgacgtagccaaggatatatgcagacttttctcgattgatccagaagctaacattaaatttgttgagaacaggccgtttaatgaccagagatattttctcgatgatcagaagctgaaaaacctcggttgggcagagaggaccacatgggatgaaggactgaagaaaaccatagaatggtataccaaaaatcctgattggtggggggatgtcagtggtgcattgcttcctcatccgaggatgttgatgatgcctggtggaatggagagacattttgaaggatccgaaggcgaaaatcccgcatcagtcaattcatctaatactcgtatggtggtcccatcaaccaagaacactgccactccgcagaaacatcctttcaagttcttgctgtttggtaggacagggtggattggaggtttgctggggaaattgtgtgaaaagcaaggaattccatatgaatatgcaaagggtgtcaccggaagacccaatgttgattggtgcgaaactcataaaacagaaaccatccgcgctaatgttgctggcactttaacattggctgatgtgtgcagagagcacgggatcttgatgataaattatgctactggctgcatatttgagtacgatgcagcacatccagaaggctccggcattggttttaaggaggaagacaagcccaatttcatgggatctttctattccaaaacaaaagctatggttgaggaactcttgagagaatatgacaatgtatgcacccttagggttcgtatgccgatttcatctgatctgagcaacccacgcaatttcatcacaaagatttctcgttataacaaagttgtcaacattccaaacagcatgacagtattggatgaacttctacctatttcaatcgagatggcaaagagaaacttgagtggaatctggaacttcactaaccctggtgctgtgagccacaatgagatccttgagatgtatagggattacattgaccccagtttcaagtggcagaatttcacgcttgaagagcaagccaaggtgattgtcgctgctcgaagcaacaatgagatggatggtgccaaattaaagaaagaattcccagaattgctttccatcaaagaatcacttatcaagtatgtcttcgtgccaaacaagaagaaataagcagatttgtgttttagatatggaggtaaatgtgttcgagctacatagataacacatcatccactgttatttccactcagttactgtgtagagtgtggctagtattacaattgcataattattaggtaattttccataattattaatttcaatttcttagtgttgtctggtacttgcagcctaagatagatgtcttgttatgaaagcttgtgatgagcaaccttttttttcatctttgtaaggcttgtattcttttattgctcatctagaatgaaaaattgaaataagagatgttttataatttgacgttattattgagatgtacttctgtaatacatcatagtgaagatcttgtaataagagaaattatttatcattttcttaaactaaaagaaatgttaatttc

SEQ ID NO: 12355 - DNA, 3545 bp, Conyza canadensis
tggatcatattcaacgtaagttcattcattattcccaaaacatatttcatttccttcctatatttgccgacatttatgttgtgtttattagatagatctgatgtttataattttgtaagaatatgtaatactaaaatttatgttataatgtttcacatttttatgctgttcgatctacttgatttcaagtagagtaagtctagattagttattttcgacttttttaaaacccaattattaagctcattatcagagattatttagccgtaagcccggaatataagctaatccaaatagctcattagcttgttttagcccccatgatttatttattttagtaaaatgaaactagcattttgccttcacaatgctgcaataaaatgagtataaattttatatattttaggaccctgtttggtaagttggaatggagtgatccattctaatggaatttagaaaagttgtttgtttttatttttggaatagcatagttaattctatcgttattccgttcaggccaaccaaacataagattttaataaaatgggtgttttggttacaaaaataagacagatccaatggctaatccagaaaaaattagtggtaaagttagtaactttttgttatcatgtcaactactttaatagttattatatggcgcaaaatatcgaaatttcatcattttttagaaagtcacattatatggcggaaagtttgtgacgctgccatcgagttgtctctgcccctgttcatgtttatgtatgatttgctaaaatgtgtttttgatatctcatgttggtatattcagttttaaaaatgaaatgtttgtagcatgtggatgttaagtaacatttgtttaacttgtttatgtttagagagttcaaggatgagtacatatacaccaaagaacattctcattaccggggcggctggttttattgcctctcatgtcgctaaccggcttgttagaacctatccggattacaagattgtcgtgctcgacaaactagattactgctcaaatcttaagaacttaaacccctctagatcatcacctaattttaagtttgttaagggggatattggtagtgctgatctggtgaattaccttttgatcaccgaaaatattgatactataatgcattttgctgctcaaacccatgttgataactcattcggaaacagttttgaatttaccaagaacaacatttatggtacccatgtgcttcttgaggcgtgcaaagtcacacgtcaaatcagacggttcatccatgtcagtacggatgaggtttatggtgaaaccgaagaggatgcagttgtgggtaaccatgaagcttcacagcttcttcccacgaatccttattctgccacgaaagctggtgcagaaatgcttgttatggcttatggcaggtcttacgggttgcctgtgattaccacaagaggaaacaacgtttatggcacaaatcagtttcctgaaaaactgatcccgaagttcattctattagcaatgagaggtgaaccacttccgattcatggtgatggttctaatgtaaggagttatctttactgtgaagatgttgcggaggcttttgaagttgttcttcataaaggagaggtgggtcatgtttataacataggaactaaaaaggaaaggcgtgttattgatgttgctagagatgtttgtaaacttttcaacagggatcctgaagcaagcattaagtttgtggagaacagaccatttaacgatcaaaggtacttcttggatgatgagaaacttaagggtttgggttgggccgaaaggactacatgggaagagggtctgaaaaagaccatggaatggtacacaagcaatcccgaatggtggggagatgtctctggtgcacttcttcctcatccaagaatgctgatgatgccaggtggcaccgagagagttgttgatgtacctgaaaacgttcaatctgattcacctcatgccgcggttaatccttctcagtttcgaaaggtggtttctgctccaaaaagtaactgttctgctaataagccatcttttaagttccttatctatggtaaaactgggtggataggtggtttacttgggcaaatatgtgaaaaacaaggaattcaatacgagtatgggaagggtcgtatggaggatcgggcccaaattgttgctgatattcagaagatcaaaccaacccatgttttcaatgctgctggtgtcacgggtcgacccaatgttgattggtgtgaatctcacagggctgaaacaatccgtaccaatgttgctggcaccctaactttagcagatgtttgcagagaatctgggatcctgatgattaactttgctactggatgtatatttgaatatgatgatgcacatccagaaggttcaggcattggtttcaaggaagaagacacacccaatttcaccggttctttctattctaaaaccaaggctatggttgaggagctattgaaagaatttgacaatgtgtgcacacttagagtccgaatgccaatctcatctgatctcaacaacccgcgcaactttgtcaccaaaatatctcgctatgataaggtggtcaacattcccaactcaatgaccattctggacgagcttctgcctatttctattgaaatggctaagagaaacctcaagggaatatggaactttacaaacccgggggtggtcagtcataacgaggtcttggagctatataaagaatacataaaccccgaattcaaatggaaaaacttcacgcttgaagaacaagcacgagtgattgtcgccccacgaagcaataacgagttggacacatccaagttgaagaaagagttccccgagttgctatcaataaaggaatcgttaatcaaatacgtatttgctcccaataaaaaagtttgattagcatttggggtatactcagagagacagaaatatgtttgcttgggatattattagttatttatgtgtaataatctttaaagtttaaactgggaaattgattacttatgaggtttacttggtaagtaaaatgaaaagattacaggaaaggccaaaagtttgtactatgtagttggtttttgttggtcctatatatcattggttctcatcacatttgttaaatactattagcatattgctaattttgattttgctttacacaatctttgtatttctatatatatatttttataagtgactaagtgtgcgcctcgcgtacaaaaagctcaccgcttttgtgcttccgaaatggaccctgtcggttttgtacgcctatcttctttttaaaaccaacataaccaagcaactatcgccctgtcggtctaacacgcccttgcccatgtagtaacatgcataaaatcacctgttttgacgctaacccactttcatctgtcgcctgaccaaccctatcttacacactaatccatatgaatgttttacatttcttattgtctatttatccatattttattaattggacattacgattataaatatcatggatctattttgtaggctgaagatagtgagttgtcaaagg

SEQ ID NO: 12356 - DNA, 2461 bp, Malus domestica
tctccttctccctttttttctggtcttttctcttctttcttcttcaatctgtcttaaatccagcacagacaaagggctgcgaattaaactcaagatccagtccaacccagaattaactcttttggatcgacatggatactgcgtataaaccgaagaacatcctccttactggagctgctggcttcattgcttcccatgtttgcaaccggcttatccagaactaccctggctacaagattgtagtccttgacaagcttgattactgttcaaatttgaagaaccttaatccttcaaagtcatcccccaaccttaagtttatcaagggagacataggcagtgccgatcttgtcaacttcatccttttgaccgagaacattgatacaataatgcactttgcagcccagacccatgtcgacaactcttttggtaacagctttgagttcacccaaaacaacatctacggtacacatgttcttctagaagcatgcaaagtcaccggtcaaatcaaaagatttattcatgtaagcacagatgaagtctacggggagacagatgaggatgctgtggtgggaaatcatgaggcttctcagcttcttccaacaaacccctactctgcaactaaggctggagcggagatgcttgttatggcatatgggcgttcatatggattgcctgtgataacgaccagaggaaacaatgtttatggccccaaccagttccctgaaaagatgattccaaaattcattctcttggctatgcaagggaagcctctcccgattcatggtgatggatccaatgtcagaagttatctctattgtgaggatgtagcagaggcatttgaagtcattcttcataggggtgaggtaggccatgtgtacaacattgggacgaagaaagagaggagggtggttgatgtggccaaggaaatttgccagctattttctctgaacccagatactcatgtcaagtttgtagagaacaggcctttcaatgatcagagatatttcttggatgactcgaagctgaaaagcttgggatggttggaaaggactttgtgggaggagggcttgaggaagaccatggaatggtatgtcaagaacccccaatggtggggggatgtttctggggcactgctcccgcatccaagaatgctcatggttcctggaattgaaagacaatttgatggttccgatactggcgattctgcttaccctttgtcagcaagtgattctagtcacagcaaactggtcgttccagctccaaggaacatcccatctactgagaagccatctctaaagtttttgatttatggtaaaacagggtggatcggaggccttcttgggaagatttgtgagaagcaagggatatcgtgtgagtatggacgagggcgtcttcaggaacggtcacagctcatggctgatattctgcgtgtcaaaccaacccatgttttcaatgctgctggagtgacaggcagacccaatgtggattggtgtgaatctcataaaccagaaacaattcgcaccaatgttgttggtacattaaccttggctgatgtctgcagagatcacggcctcctagtggtgaattatgccactggttgcattttcgagtatgatgatgcccatccaccaagatcaggaattgggttcaaggaggaagacacacccaatttcgcgggctcattttattccaaaaccaaagccatggttgaagagcttctgaaggagtatgacaatgtttgcactcttagagttcggatgccaatatcatctgatctcagcaatccacgcaacttcatcacaaagatctcgcgctacaataaagtggtcgacattccaaacagcatgaccatcttggacgagcttctacccatttcagttgagatggccaagaggaacttgaggggcatctggaacttcacaaacccgggcgtggtaagtcacaatgagatcctggagatgtacaagaagtacattgaccccagtttcaagtggaccaattttacagtggaagaacaagccaaggttattgttgcagcaaggagtaacaatgagatggatgcatcaaagctgaagaaagagttccctgaactgcttccgattaaggaatcgctgattaaatacgtgtttgaacccaacaagaaaacatttgcaggtggagcagcaatttaagagtctcatgaagtggacctcgataccgatcctatacatttatttatttatttttcttgtgggaaatcgctaggggtttagttattctcatgttgtgattccatcagtgtctgtgatagcttaggttaatttcataagttggtgctattggttctggtttggctattgtgatataagaagctttggaattgcttcggaaatatttgaagggtctactgtaagttggggcatcgtaattttcagatatgtaataaattaattatttttatttatacaagttctttttagtc

SEQ ID NO: 12357 - DNA, 2570 bp, Eucalyptus grandis
gctttccctcttccgaaattcgatgattctctctcctcgcttccgcaactccccgaccctctgcacccgccgcccgatcaggcattgatcttcggtcaaacccccgatccccgccaagtcaattcgcgagaagccttcttctttcggggctgctgccggaatcaccgggttcgtgccgcgcggtgtcgtctgttcgaatctgcatcgagatgacgagttatacccccaaaaacattctcattaccggggctgctggtttcatagcatgccatgtcgccaatcggctcactcgcaactttacagagtacaagattgtcgtgcttgacaagctcgattactgctcgaacctgaaaaacctcctcccatctaaatccgcccccaatttcaagtttgtgcagggagacattgccagcgcggaccttgtcaaccatctcctcataacagaatccattgatacgataatgcacttcgccgcccagacccatgtcgacaattctttcggtaacagctttgagttcaccaagaacaacatttatggcactcatgtccttctagaggcatgtagggtcactggccagattaggaggttcatccatgtcagcaccgacgaagtttatggagagacagatgaggatgctgttgtaggaaaccatgaggcctctcaacttctccctacgaacccctactctgcaacgaaagctggagcagaaatgctcgtcatggcatatggcaggtcctatgggctaccggtgataacgacccgagggaacaatgtctacggtccgaatcagtaccctgaaaaatcaatcccgaagtttatccttttggccatggcaggaaagcctcttccaattcatggagatggttgtaatgtgaggagttacctctactgcgaagatgtcgcagaggcttttgaggtaattctacaccaaggtgaggtgggtcatgtatataatatcgggacaaagaaggagaggagggtgattgatgtggcgaaagacatatgcaagcttttctccatgaacccggagatcagcatccagtttgtggagaatagaccgttcaatgatcagaggtacttcttggatgatgagaagctgaagaacttgggttggtctgaacggactagttgggaagaagggctgaagaggaccatggagtggtacgtcaagaatcctgactggtggggagatgtctctggcgctctgcttcctcatccgaggatgttgatgatggctggtggggtcgagaggcattatgatgggcctgaagaaggcgaagcattgcctcttccatctaattctgatcagaccaacatggcagtttcaggcgagaaaccatccttcaagttcctgatttatggtagaagtggctggattgggggcttacttggaaagctctgcaagatgcaagggattccgtttgaatatggaagagggcgtctcgaggaccggtcacagctcttggcagacattgcaaatgttaaaccgacgcatgtctttaatgctgctggtgtgactggtagacccaatgtcgattggtgtgaatcccacaaaactgaaacaatccgcacaaatgtcgccggaacgctgacattggctgatgtctgccgggaacgcagactccttgtgattaactttgccaccggctgtatatttgagtacgatgcttcccatccagagggctctggcattggctttaaggaagaggacaagcccaatttcactggctccttttactccaaaaccaaggccatggtggaagagctcttgaaggagtatgacaatgtctgtaccctcagagtccgtatgcctatctcgtcggacctcaacaacccccgcaatttcatcaccaagatatctcgttacaacaaggtggttaacatccccaatagcatgaccgtcttggacgaagtcctcccagtttccatagagatggcgaagcggaacctgaggggtatatggaactttacgaaccccggagctgtgagccacaatgagatcctggagatgtacaagagctacattgaccctgatttccagtgggttaactttactttggaagagcaagcgcaggtgatcgtcgccccgcgaagcaacaacgagttggatgcgaccaaattgaagaacgagttccccgacttgctatcaatcaaggactcgctcatcaagtacgtattcgagccaaacaagaaaaatgtcacggagtaactggctttcagggtaggtatccggatcggtttcctgcttaagttacacgaaacggcctcttacacttcttttagctttctttagagttatcgttgttcgtaattatcagcatcaggtgctcctcctgtcaaagaaattgaagttgaatctgttagggagttctttctctgtttatttgattctagctcaccccatgtgacggtggtagaagctgactttggagatgccacattgtattttaataagatttaaccattttttgagcgttcatcctgtgtgtcatcctatgtacttagcgtactacaatgtatggtagggacatttttctgtcttaatcaatgtttggtgtcgttgttctcc

SEQ ID NO: 12358 - DNA, 3108 bp, Pinus taeda
atataacacacgctttctctgcataacacggcccggcccgcctctctctgcataacgaagaccataatcgtgaaagctgaaaaaagttacgtgtgttgaagaaacgatgaaggggatcgtaacttgttttttaactacaaatcaggcttttcaaaggctgtgattgcggggcaggtaaacacccgattcaaacctgactactcctgctgcttctcatcatcttcctcggcgacccttcaaatagttaaaatgtgccttttaacacaactgccaggcgtccgggctatataggtaatatctatccattcattcgttcaaggcatccgaagttctgcttgagagacgcacaaaaatcgaattgttgacctctgaagggtccacaagaaaacacccgttacttcattcgagtatttcctgcattttccgcagcaagatctaagcctaaacatcatttgggtattttttaccctggatctgcgcacttgggtttgtttcaggggagatctggttgtgtccttgacctaataaactgaataaaaatggctcctgagagctatacccccaagaacattctcatcacgggtgctgctggatttattgcttctcatgtagcgaataggctggtcagaaaatacccccagtataagattgttgtgcttgataaactggattattgctccaatttgaagaatctgttgccttcaaaatcatcccccaatttcaaatttgtgaggggagatattgcgagtgcagatctggtgaattatcttctaatcacagaaggaatagacacgatcatgcattttgcagcacaaacccacgttgacaattcgtttgggaacagcttcgagttcacgaagaataatatctacggaactcatgtcctattggaggcttgtaaagttacggggcagattaggcggttcattcatgtcagtactgatgaagtttatggagagactgagcaggatgctcttgtgggtaaccacgaggcctcccagcttcttcctacgaatccttactctgctaccaaggctggagcagaaatgcttgtcatggcctacggaagatcttatggcttgccggtgattactaccagaggtaacaatgtctatgggcccaatcagttccctgagaagctcattccaaaattcattcttttggccatgcagggtaaaccccttcccattcatggagatggatcgaatgttcgaagctatctctactgtgaggatgtggcagaagcctttgaggttgttttgcacagtggcgaagtaggaaatgtttataacatcggtacaaagaaagagaggagagttattgatgtggctaaggatatatgcaaactcttttccctcaatcatgaaaaggttattaaatttgttgacaacaggcctttcaatgatcagagatacttccttgatgatcagaagctgaaggatctgggttggtcagagcggacgacttggcaagatggactgaagaaaacaatggactggtatataagtcatccagattggtggggtgatgttactggtgctctgctacctcatcctcgaatgcttacgatggctggagttggaagactctctgatggcctagagatgatggccggagttgggagactctctgatagcttggatgagaatgcctcggctatttctcccgaggttaataattcgaaacaggaccgaatgctcattccctcgaaaagtatctctcagaaaccagccttgaaatttttgatttatggtcgcactggatggattgggggccttcttggtcagatatgtgagaagcaaggtatttcctttgagtatggaaatggcagattggaaaatcggtctcagattcagatggatatccagaatgtgaagcccacccatgtttttaatgctgcaggtgtgactggtaggcctaatgttgactggtgtgaatctcacaagccagagactattcgtaccaatgtagtaggaactttgaatctggcagatgtctgcagggaacaagggcttttactcatgaactttgctactgggtgtatatttgaatataatgatgctcacccagagggcagtggtattggattcggggaggaagacagtccaaacttcactggatcattctattctaagacaaaggccatggttgaagagcttctgaaagagtttgagaatgtttgcacccttcgagttcgaatgcctatctcatctgatctgagcaaccctcgcaattttattacaaaaatcacccgttacaataaagtagttaacataccaaacagcatgactgtacttgatgagttgttgccaatctcaattgagatggcaaaaaaaaattgcaaaggcatatggaactttacaaatccaggcgttgtcagccataatgagattttggagatgtacagagattacattgatccgaacttcaagtgggtaaattttaaccttgaagaacaggctaaagtgatagttgcccctcgaagcaacaatgaactggatacgttcaaattgaaggaagcatttccagagctgttgccaatcaaggattcacttttgaagtatgtatttgagcctaacaagaagagcagtcttgcaaatggcgcatagtcattagttggtatttgtttagtaccaatttatgtagtttatttggcttcttatttcattgagcttcataatttttctcagtttagatccaggcatcaagagggcagcatttttcttggcctgaatatattctttatgagaatattggacagtcggcagtatttgtgtcaaagctatttatctgtcgaggaacatcactgcagatgttgcttcaattcattcgttcattgaaagttgtaggataatctgctgatgaagctgccatgtgatactatttaccctgtaagtccaatactgataaagttgtagtttcggcagtattacttgtatgcggggaatggtaccaagtttctcctttccattgtctttgcaagattacaggaattaattcaattcttacaacttttatattgcttaaaataaatacgctggataaactgagagagctgtgatttgccacaattttttgtaagatttgtgctgattaatgtgattcagg

SEQ ID NO: 12359 - DNA, 2415 bp, Chenopodium quinoa
cttcaactttcaatctccatctccttcatcttccttttcatctccttctctctcctccctttcctttaaacgaatttccttcacctttaactttcccagatcgtcgaattcaagatctcaaaatagcgattaaggcaatacacacagaaaatacaggggaaaaaacgtacgttttctctttatcgtgttcttgaatctagcatgctctgaaattctccattgaagcggcttttcagctttcaatcctccattgaagcagcttctaagaaggtggtgcatcatgtcttcatacaccccaaagaatattcttattactggtgctgctggattcattgcgtctcatgtcgcaaaccgactcattaggagttaccctgattacaagattgtcgtgcttgacaagcttgattactgctcaaaccttaaaaatttacgtccctctcaatcatcccctaattttaagtttgttaaaggggatattgctagtgccgaccttgtaaactaccttctcatcactgagtccattgatacgattatgcactttgctgcacaaacccatgttgacaattcttttggtaatagctttgagttcaccaagaacaacatttatgggacccatgtcctcctagaagcctgtaaggtcaccgggcaaattaggagattcatccatgttagtaccgatgaggtttacggagagacagatgaggatgctgttgtgggtaatcatgaagcttctcagcttcttccaacaaatccatactctgctacaaaagctggtgctgagatgcttgtcatggcttatggcagatcatatggtttgccagttattacaacccgtggaaacaatgtgtatggccctaaccagtttcctgagaaattgatcccaaagttcattcttttggccatgagagggaagcctcttccaattcacggagatggatctaatgtgagaagctatctctactgtgaggatgttgcagaggcctttgaggtcattctccacaggggagaggttggccacgtgtacaacattggaaccaaaaaggagaggagagtcattgatgtggccacagatgtatgcaaactgttctcgatggatccagatgcaagcatcaagtttgttgagaacaggccgtttaatgaccagaggtacttcctagatgatgagaaattgaagatcttagggtggtcagagcgcaccacttgggaggagggtttgaggaagacaatggagtggtataccagtaaccccgattggtggggtgatgtctcaggagcattgcttcctcacccaaggatgctgatgatgcctggtgggatcgagaggcattttgaagaagcagacaatgagaatgctgcttcttctgaattttccaacacccagtctaaaatggtggtaccccctaccaaaagtgtcagttctcctcgtaagccatctttcaagttcctgatctatggtagaactgggtggattggtggtcttcttggccagttgtgtgagaagcaaggtattacatttgagtatggaaagggccgtttggagaaccgagcatctcttattgctgatatccagaatgtcaagcctactcacgtctttaatgctgctggtgtgactggtaggccgaatgttgactggtgtgaatctcacaaagcagagacaattcgcgccaatgttgctggtactttgactttggctgatgtctgcagagagcatgggcttttgatgatgaattttgctactggttgcatctttgagtatgatgctgcacatcctttgggctctgggattggcttcaaggaagaggatacaccaaacttcactggttctttctactcaaagaccaaggctatggtggaggagcttttgaaagagtttgataatgtgtgcacccttagggtccgaatgcccatttcttctgacctcaacaacccacgaaacttcatcacaaagatctctcgctacagtaaggtggtcgacattcccaacagcatgactgttttggacgagcttctacccatttccattgagatggcaaagaggaatctcaagggcatctacaacttcacaaacccaggggtggttagccacaatgagattctcgagatgtacaagaattacatggacccagaattcaagtgggcaaacttcacacttgaagagcaagccaaggttattgttgctccaagaagcaacaatgagatggacgcctcccaagttgaaaaaggaattccctgaattgctgcatattaaggactcgctaatcaagtatgttttcgagccaaacaagaagacaaactattctgcttgagcgaacttttctgcagaattaagagatgccgtagtaagcaggattgcaatttttttccagtaggcattgcggttgcatagcgttactccattgggtcttgggcaaaaca

SEQ ID NO: 12360 - DNA, 2724 bp, Pseudotsuga menziesii
acctgtatgcattgaattattgacttctgaagggtccacaagaaaacatcccttgctccagtcgagtatttcctatattttaccccagcaagatccgaggcaaaacatcatttgggtattcttttgcctggatcggtgcacttgggtttgttttaggggagatctggttgtgcccttgatccaataaattgaataaaaatggctcctgagagatatacccccaagaacattcttatcaccggtgctgctggatttattgcttctcatgtagcgaataggctggtcagaaaataccctcagtataagattgttgtacttgataagctggattattgctccaatttgaagaatctgttgccgtcaaattcatcccccaacttcaaatttgtgaggggagatattgcaagtgcagatctggtgaattatcttttaatcacagagggaatagacacgatcatgcattttgcagcacagacccacgttgacaattcgtttggaaacagctttgagttcacgaagaacaatatctatggaacccatgttctattggaggcttgtaaagttacagggcagattaggcggttcattcatgtgagtactgatgaagtctatggagagactgaacaggatgctcttgtgggtaaccacgaggcttcccagcttcttcctacaaatccttactctgcaacgaaggcaggagcagaaatgcttgtcatggcctatgggagatcttatgggttgccggtgattactaccagaggtaacaatgtctatgggcccaatcagttccctgagaagctcattccgaaattcattcttttggccatgcaggggaaaccccttcccattcatggagatggatcgaatgttcgaagctatctctactgtgaggatgtggcagaagcctttgaggttgttttgcacaatggcgaagttggaaatgtttataatatcggtacaaagaaagagaggagagttcttgatgtggctaaggacatttgccaacttttttccctcgatcatgaaaaggttattaaattggtcgacaataggcccttcaatgatcagagatactttttggatgatcagaaactaaaggatttgggttggtctgagcgcacgacttggcaggatggactgaaaaaaacaatggactggtacataggtcatccagattggtggggtgatgttacaggtgctctgctacctcatcctcgaatgctcacgatggctggtgttgggagactctctgatggcctagagatgatggctggagtggggagattccctgatggcctagatgagaatgtctcagctttgtctcccgaggttaataaatcgaaacaggaccgaatgctcattccctccaaaagtttctctcagaaaccagccttaaaatttttgatctatgggcgcactggatggattggagggcttcttggtcagatatgtgagaagcagggtattccatttgagtatgcaaacggcagattggagaatcgggcccaaattcagatggatatccagaatgtgaagcccactcatgtttttaatgctgcaggtgtgacgggcaggcctaacgttgactggtgtgaatctcacaaaccagagactattcgtgccaatgtagtaggaactttgaatctggcagatgtctgcagggagcaagggcttttactcatgaactttgctactgggtgtatatttgaatataatgatgcttacccagaggggagtggtattggattcaaggaggaagacagtccaaactttactggatctttctattctaagactaaggccatggttgaagagctgctgaagcaatttgagaatgtttgcatccttcgagttcgaatgcctatctcatctgatctgagcaaccctcgcaattttattacaaaaatcacccgttacaataaagtagttaatataccaaacagcatgactgttcttgatgagttgttgccaatttcaattgaaatggcaaaaagaaattgcagaggcatatggaacttcacaaatccaggcgttgtcagccacaatgagattttggagatgtacagggactacatcgatccaaacttcaaatgggtaaattttaacctggaagaacaggctaaagtgatagttgcccctcgaagcaacaatgaactggatacgtccaaattgaagggagagttcccagagctgttgtcaatcaaggattcacttttgaagtatgtatttgagcctaacaagaagaacaagtttgcaaatggagcatagtcattagttgatatttgtttagtgctgatttatttagtttatttggcttccttatttcattgagcttccaagattagaagtttcccaacttagatccagacatcaggagggcagaatttttcttggcctgaatattttctttatgagaatattggacagtcagcagtatttgtgtcaaagctatatttcagccgaggaacatcactacaaatgatgcttcaatttatttgttaattgaaagttgtaggacacaattttccgataaagatgccatgtaatactatttgccctgcaagttcaatactgataaagttgtattttcggcagtatttacttgtatgtgggaaatgataccgaatttctcctttccattgtctttgcgagattacaggaattaattcaattcttttgacatttctattgtttcaaagaaatatgctggcaaactgataaagc

SEQ ID NO: 12361 - DNA, 2473 bp, Zea mays
aacacacctcacctcgcccggcccccaacccctccgctgccgagtcccgagtagtattctattgcatcccctccggggagggctgaaccaattcaacacgctgtgcctgtgcgtgcgcttgtgtcggggcggggtcgcagcagccagccaggatataatccccgcgcgcgccgctcgtaaacagaggagggcgagagggagggcgaggtgagccagtcctccgatcacgcgcccgcacacacgcacggagcgcggcagccggcagggaggaagagcttacagggccacagcaggcaggcaggcaggcagggcacggagaggctatccaccaccgctgccgcacatgcgagcgggcgcagcagcgcgcggggactctcctcgtgcaatgagcgccgccgcgacgccgcgccaccggctcggggtcgcgcttcttctcctgctggtcctcggtggcgccgacgcgaaggcgcacagctacgaggacgcgctgcggaagagcctgctctacttcgaggcgcagcgctcgggccggctcccgcacagccagcgcgtcacctggcgccaccactccggcctcaccgacggcctcgagcaaggggtggacttggtcggcggatactacgacgccggggatcacgtcaagttcgggctccccatggcgttcaccgtcaccatgctgtcgtggagcctgatcgagtacggcgccgacgtcgcggcggccggcgagctcggccacgcgctcgaggccgtcaagtggggcaccgactacttcgtcaaggcgcacaccaggcccgatgagctgtgggctgaggtgggcgacggcgacacggaccactactgctggcagcggccggaggacatgacgacgtcgcggcaggcgtacaaggtcgaccgggaccacccgggctccgacgtcgccggcgagaccgcggcggccatggcggccgcgtccatcgtcttccgcgactccaacccgcactacgcgcacctgctcctgcaccacgcccagcagctgttcgagttcgccgacaagtacaggggcaaatacgacagcagcatcgctgaggtgaagagctactacgcgtccgtgagcgggtacaaggacgagctcctgtgggccgccctgtggctccaccgcgccaccggcagggctgactacctcgactacgtcgtcgacaatgccgacagcttcggcggcaccggctgggccatcaacgagttcagctgggacgtcaagtacgccggcgtccagatcctagcagcaaggttgctgctgagaggggagcacgcgacgcgccaccggagcacgctggagcggtacagggccaaggcggagcgctacgtgtgcgcgtgcctgggccggaacacggaaggcggcgcggacgccaacgtggagcgcagccccggcgggatgctctacgtccggcagtggaacaacatgcagtacgtgaccagcgccgcgttcctgctctccgcctactccgactacctggccgaggccggcgtccggaccgtgtcgtgcgcgggcggcgagaccgtggcggcccgggaggtggccgcgctcgccagggcgcaggtggactacgtgctcggcaccaaccccaggggcgtcagctacctcgtcggctacggccccaagtaccccagccgggtgcaccaccgcgccgcgtccatcgtgccgtacaagcacagcaaggagttcatcggctgcacgcagggcttcgaccactggttcggccgccggagctccaaccccaacgtgctcgtcggcgccatcgtcggcgggccggaccggcgggacaggttcagggacaaccgggagaactacatgcagacggaggcctgcacgtacaacacggccccgatggtcggcatgttcgccaagctgcaccggttggcgcggcaggagcgggaacaggggccgacgccggcgccggcgccggcgcccgtcacgtctgcagcggccgatgtgtaaatagataggaatgtagagggggggctgtacaattttccccattctttggttcattttttgttgggctctgaatttcattttacacagatccaggttattgtatacaaaagaaaaggtagaggcatcgacatgtgcaaatgtaaatccactaccagtacatacgagggaaagaaatggcattcttaacttattggtcgttcttgtctgtacctttccgtcggagattcttcattcgtgcagtccagcttgacaaagagcacgttatcttcggctaaccgggcgctgccgagttttcaatgccaatctggcaccataaggtcactagaccagctgcataacacgaagcacaggcataaaacacatggttagacctcaaaagaatggaaataatgatgctttcacatgattgctgtcctttctctaagagcagcaacataaaacaacaaatcttggcccgcctttgattacagctttcttaatcatatatatagtaaacta

SEQ ID NO: 12362 - DNA, 2550 bp, Panicum virgatum
acgcatgcttcttcaccgcgcggcgtcgtctgtgctgtgcagccgtgcaggtcgcgtgtccggcctcaacccatgcccaccaatccagccgagctcccaaacctctccggccggcgcccggtcaaaatctgccccggctcttgcttgcttgctttcgtcgccaagggcagcaaagcgaggccaaacccaccctaccccagtccccaaccattacctcgccaccaaaccaaacccgaacaagtccaccccctcccctccaaccccaccccacgccacggcacccgaacgcgacgcgccccccgctcgcctcgctcgcctattagctagctttgctgccgccgcgcccggcccccaactcctccgcgctcccgagtattctattccgttcccccgggcggggggagtcgaaccatttcaacacggcgcgcgcgtcccgtgtcgggcggggtcgcgtcgcggatataagcccgcgcgtgagccgcgagtcacggtggtggacggggagggggaggccagaccagttgatctctctcgctcgctcgctcgcgcgcgcgcgcgaacacagaggcggcggcagaggaaagaggcgcgcggcgcaggcggcgtggcagcagagcacggcgcggcgcggaggcagcagccgcatgcgaaggcgccgggcggggggctctcctcttgcaatgagcggcgtgggcaccgcgtcatcgtgccggcggcggcggcggcagctcgggggcgcgcttctgctggtgctggttgctctcgcggcgggtgttctcgaaggtgccgaggggaaggcgcacaactacgaggacgcgctgcagaaaagcctgctctacttcgaggcgcagcggtcggggcggctcccgcacagccagcgcgtcacctggcgccaccactccggcctcaccgacggcctcgagcaaggggtggacctggtgggcggctactacgacgccggggaccatgtcaagttcggcctgcccatggcgttcacggtgacgatgctgtcgtggagcctgatcgagtacggcggcgacgtcgcggcggccggcgagctcggccacgcgctcgaggccgtcaagtggggcaccgactacttcatcaaggcgcacacccagcccgacgagctctgggccgaggtgggcgacggcgacacggaccactactgctggcagcggccggaggacatgacgacgtcgcggcaggcgtacaaggtcgaccgggaccatccgggctccgacgtcgccggcgagaccgcggcggccatggccgccgcctccatcgtcttccgcgacgccaacccgcactacgcgcacctcctcctgcaccacgcccagcagctgttcgagttcgccgacaagtacaggggcaaatacgacagcagcatcgcggaggtgaagagctactacgcgtcggtgagcgggtacaaggacgagctcctgtgggccgccctctggctccaccgcgccaccggcagggccgagtacctcgactacgttgtcgacaacgccgactctttcggcggcaccggctgggccatcaacgagttcagctgggacgtcaagtacgccggcgtccagatcctcgccacaaggctgctgctgcgaggggagcatgcgtcgcgccaccggagcacactggagcggtacagggccaaggcggagcgctacgtgtgcgcgtgcctgggccggaacgcggacgccaacgtggagcgcagccccggcgggatgctctacatccggcagtggaacaacatgcagtacgtgaccagcgcggcgttcctgctctcggcctactccgactacctggccgaggccggcgtcggggccgtgtcgtgcggggagggcgccgtggcggcggcggaggtgttcgcgctcgccagggcgcaggtggactacgtgctgggcaccaaccccaggggggtcagctacctggtcgggtacggccccaagtaccccaaccgggtgcaccaccgcgccgcctccatcgtgccgtacaagcacagcaaggagttcatcggctgcacgcaggggttcgaccactggttcggccgccggagctccaaccccaacgtgctcgtcggcgccatcgtcggcgggccggaccgccgggacaggttcagggacaaccgggagaactacatgcagacggaggcgtgtacgtacaacacggcgcccatggtcggcatgttcgccaagctgcaccggatggcgcggcaggagcgggagcagggcccgacgccggcggcggctgaggtgtaaatagataggacgtagaggggggcctgtacaattttccccattctttggttcaattcttttgggctttggattccattttacacagatcggagatggttgtacgtatacagaaaaagaaaagaaaaaggtggaggcattgacatgctaatgtaaattcgctaccagtacatacgaggaaaaggaaatgacacgcttaatttattggtggtgcttgtctgtaccttccgtcgggtgatccttcgttcgtgcgctccagttcagcaacgagcaggtcatcttcggtcgc

SEQ ID NO: 12363 - DNA, 2711 bp, Sorghum bicolor
gtccagcagtacttacgtgcccggccccaaccgatgcactcgctccgcccaatccaaacccacacccctcgctccggccggccgtccgccgggtcaaaatctgccccgccttgtgcttgcttgcgcgcgtcgccaaggccaaatccaccccaacccatccattacctcaccaaccaaacccgaacaagcccggtcctcgccctccaaacccacgctgacgccacggcaccgccggaacgcgacgctcgaatcgcccgcttatatttttcctggcctcgtctcctcctcgcgcgcccgcccggccccagcccagaacccctccgctgccgagtattctattccatcctccccgggggggctgaaccaattcaacacgctgtgcgcttgtgtcgggcgggttcgcggcagccaggatataagccgcgcgcgcgcgccgctggtaacagaggaaggtcgggagacggagcgcgaggccaggccagtcagtcctccgatcacgcacacacagacgcgcgcgcggagcgcggcagggaggaagacagccgacagcccacagcaggcaggcaggcaggcggaggcaggggcacggagcggccgcgcgccggccatccaccgccgcacatgcgagagggcgcagcggcgcggaggcagcagccgcggcgcgcacatgccaaggcgccgcgcggggactcccctcgtgcaatgagtagcgccgccgcgaccgcgacgtcgtgtcaccgcctcggggtcgcgctgccgctcttgctgctgcttgctgctgccgcggttctgggtggagccgaggggaaggcgcacagctacgaggacgcgctgcagaagagcctgctctacttcgaggcgcagcgctcgggccgcctcccgcacagccagcgcgtcgcctggcgccaccactccggcctcaccgacggcctcgagcaaggggtggacttggtggggggatactacgacgccggcgaccatgtcaagttcggcctgcccatggcgttcaccgtgacgatgctgtcgtggagcctgatcgagtacggcggcgacgtcgcggacgccggcgagctcggccacgcgctcgaggccgtcaagtggggcaccgactacttcatcaaggcgcacaccaggcccgatgagctgtgggctgaggtgggcgacggcgacacggaccactactgctggcagcggccggaggacatgacgacgtcgcggcaggcgtacaaggtggaccgggaccacccaggctccgacgtcgccggcgagaccgcggcggccatggccgccgcgtccatcgtcttccgcgactccaacccgcactacgcgcaccttctcctgcaccacgcccagcagctgttcgagttcgccgacaagtacaggggcaaatacgacagcagcatcgcggaggtgaagagctactacgcgtcggtgagcgggtacaaggacgagctcctgtgggccgccctgtggctccaccgcgccaccggcagagctgactacctcgactacgtcgtcgacaacgccgacagcttcggcggcaccggctgggccatcaacgagttcagctgggacgtcaagtacgccggcgtccagatcatagcagcaaggttgctgctgagaggggagcacgcgacgcgccaccggagcacgctggagcggtacagggcgaaggcggagcgctacgtgtgcgcgtgcctgggccggaacacggaaggcggcgcggacgccaacgtggagcgcagccccggcgggatgctctacatccggcagtggaacaacatgcagtacgtgaccagcgccgcgttcctgctctccgtctactcagactacctggccgaggccggcgccccgaccgtgtcgtgcgcgggcggcgagaccgtggcggccgaggaggtgttcgcgctcgccagggcgcaggtggactacgtgctgggcaccaaccccaggggcgtcagctacctcgtcggctacggctccaagtaccccaaccgggtgcaccaccgcgccgcgtccatcgtgccgtacaagcacagcaaggagttcatcggctgcacgcaggggtttgaccactggttcggcaggcggagctccaacccgaacgtgctcgtcggcgcgatcgtcggcgggccggaccggcaggacaggttcagggacaaccgggagaactacatgcagacggaggcctgcacgtacaacacggccccgatggtcggcatgttcgccaagctgcaccggatggcgcggcaggagcgggaacacgggtcgccggcgccggtgcccgtgacgtccactgcggctgaggtgtaaatagataggatgtagagcggggggctgtacaattttccccattctttggttcattcttttttgggctttgaatttcattttacacagatcgaggttattgtatacaagaaagaaaaagaaaaagggttggaggcatcgacatgtgcaaatgtaaattcactaccagtacatatgaggaaaaaaaatgacattgttaacttattggccattcttgtttgtacgtacctttccgtcggtgattcttcattcgtgctcgtgcagtccagcttaacaaagagcacgttatcttcgctaacctggcgctctcgagttttcaatgccaatctggcaccataaggtcactagatcagctgcagaacatgaaacaaaggcacaaacacatggtcagacctcaaaagagc

SEQ ID NO: 12364 - DNA, 2453 bp, Zea mays
gcccagtccagaggccccctcgcctccggtcgtccggcgcccagtcaaaatctgccttgcttgcgcgcgtcgccaatggcaaggccgagtccacatccaccccaaaccatgacctcaccaaagcccgaacgaatccaccccctccaaaccccacggcaccgtctagctattccatcggggacccaaccaattcaacattccgcgcgcgggcgcttgtgttgtgtgtcgtgtcgggcaggggtcgcagtcgcagcaggcactaggcaggcaggttataagacgcgcgcgcgcgcgcgccgctcggaacagaggaggactggatcaggagtcgagagggaagaagacagcccacaaagcagccggcgccgcgcggggactctccccgcccaatgagtagcgccgcttcgtccccgtgccaccggctccgccgcgtcgcgctgctgctgctcgttgccgcggtcctcgccggtggaaccgaggggaaggcgcacgactacggggacgcgctgcgcaagagcctgctctacttcgaggcgcagcgctcgggccgcctcccgcacagccagcgcgtcgcatggcgccaccactccggcctcaccgacgggctcgagcaaggggtggacttggtgggaggatactacgacgccggggaccacgtcaagttcggcctgcccatggcgttcaccgtcaccatgctgtcgtggagcctgatcgagtacggcggcgacgtcgcggacgccggcgagctcggccacgcgctcgaggccgtcaagtggggcaccgactacttcatcaaggcgcacaccaggcccgacgagctctgggctgaggtgggcgacggcgacacggaccactactgctggcagcggccggaggacatgacgacgtcgcggcaggcgtacaaggtcgaccgggaccacccgggctccgacgtcgccggcgagaccgcggcggccatggcggccgcgtccatcgtcttccgcggctccaacccgcactacgcgcacctcctcctgcaccacgcccagcagctgttcgagttcgccgacaagtacagggggacatacgacagcagcatcgcggaggtgaagagctactacgcgtcggtgagcgggtacaaggacgagctactgtgggccgccctgtggctccaccgcgccaccggcagagatgactacctcgactacgtcgtcgacaacgccgacagcttcggcggcaccggctgggccatcaacgagttcagctgggacgtcaagtacgccggcgtccagatcctagcggcaaggctgctgctgagaggggagcacgcgccgcgccaccggagcacgctggagcggtacagggccaaggcggagcggtacgtgtgcgcgtgcctgggccggaacacggagggcggcgcggacgccaacgtggagcgcagccccggcgggatgctctacgtccggcagtggaacaacatgcagtacgtgaccggcgccgcgctccttctctccgcctactccgactacctggcggccgccgaggccggcggcgccgcccgggccgtgtcgtgcgcggcggcggccgaggaggtgttcgcgctcgccagggcgcaggcggactacgtgctgggcaccaacccccggggcgccagctacctcgtcggctacggctccaggtaccccggccgggtgcaccaccgcgccgcgtccatcgtgccgtacaagcacagcagggagttcatcggctgcacgcaggggttcgaccactggttcggccggcggggctccaaccccaatttgctcgtcggcgcgatcgtcggcgggccggacaggcgcgacaggttcagggacagccgcgacaactacatgcagacggaggcctgcacgtacaatacggccccgatggtcggcgtattcgctaagctgcgccggatggcgtggctggagcgggaacaggggtccacgtcggtgcccgtcaccgtcacgtccacggcggccgaggtgtaaatagataggatgtagaggaagggggctgtacaattttccccattctttagttcatttttttcgagctttgaatttcattttacacagatcgaggttattgtatacgagaaagaaaaaaaagagaaaagggtggaggcgcctacatgcatgtgcaattctgcaaaatgtaaattcactactggtacatatggagaaatttgacattatgaaacacggagggttcggcttcgacgaaatggaggtctaggagagagtttcttccttatgaaacagctggacatagccaacactttaaaatggacatgactaaaccattaacaggtaacgacgatcttatactcacgccgtcattttgccgttaccaggagactatacgtgagcccttcttctctctctagctgccgttcacgcccaaccaaaacaagttctcaaccaaaccctatccgccgccgcaccctagccgcc

SEQ ID NO: 12365 - DNA, 2160 bp, Triticum aestivum
tctgcgcggcccggccgccgaaccggttcaacgcggtgcgcgtgcgtgtgctggacccggacgccggccgcgaatataagcgcgccagcccacggcctcaggtcggaggacactgccccgccctgctcgccacacagcacgcaacgcacaaccgcgggagagagatcacacacacacctacgctcgcacacaggcaaagctagcagagccggcagagggcggcgcagcggtgatcacagggcgcgcccggggcacgcacaagcgaaggcacaccaacaatccgaggagcatcttcttgcgcaatgagatcagggggcgccaccgccgtaatcttgtctcgccgtctcggggccgtgtcgctgctggtgctgcttctgatcgcggcggcggcggaggggagcaagagcgggagcggcgacggcaaggcgcacaactacgaggaggcgctgcggaagagcctgctctacttcgaggcgcagcggtcggggcggctgccgcacgggcagcgcgtgccgtggcgcgaccactcgggcctcaccgacggcctggagcagggggtggacctggtgggcggctactacgacgccggcgaccacgtcaagttcggcctgcccatggccttcaccgtcaccatgctgtcctggagcatgctcgagtacggcgacgacgtcgcggcggccggcgagctcgcgcacgcgctcgaggccatcaagtggggcaccgactacttcatcaaggcgcacacacagcccgacgagctatgggccgaggtgggagacggcgacacggaccactactgctggcagcggccggaggacatgacgacgtcgcggcaggcgtacaaggtcgaccgcgaccaccccggctccgacgtcgccggcgagacggccgccgccatggccgccgcctccatggtcttccgcaagtccaacccgcactacgcccacctcctcctgcaccacgcccagcagctgttcgagttcgcggacgggtacaggggccagtacgacagcagcatcgcggaggtgaagagctactacgcgtcggtgagcgggtacaaggacgagctgctgtgggccgccctgtggctccaccgcgccaccggcaaggccgcctacctcgactacgtcgtcgacaacgcccacgacttcggcggcaccggctgggccatcaccgagttcagctgggacgtcaagtacgccggcgtccagatcctcgccgcaagactgctgctgaggggagagcacacggcggagcagaagaggacgctggagcggtaccaggccaaggcggagcactacgtgtgcgcgtgcctgggccggaacgcgcaggccggcggcgaggacgccaacgtggagcggagcccgggcgggatgctctacatccggcagtggaacaacatgcagtacgtgaccaacgcggcgttcctgctgtccacctacgccgactacctggccgaggccggcgtggagacggtgacctgcgccggcggcgagacggcgggcgccggcgaggtggcggcgctggccagggcgcaggtggactacgtgctgggcaccaaccccaggggcgtcagctacctcgtgggctacggcgccaagtaccccgccagggtgcaccaccgcgccgcctctatcgtgccgtacaagcacagcaagcagttcatcgggtgctcgcaggggttcgaccactggtacggccgccgcagctccaaccccaacgtgctcgtcggcgccatcgtcggcgggcccgaccggagggacaggttccgggacaaccgggagaactacatgcagacggaggcgtgcacctacaacaccgcgcccatggtggggatgttcgccaagctcaaccggatggcgagggaggagagggagcagagagctgccacggcgagaagcggcacggcgccgagatgtaaatggattagataggttataggtctcgagggggctgtacaattttccccattcttttgttcatttcttctccttctttggaggtttcttgatacacaggaaggatggagatgggtgtagtatatgagggaaaaaaaagggctggaggcattgacgtgcaaatgtaaattcgctgcctgtacatacgagaaaaggaaaatgagaatttatatatcggtgattctagtttgtttaagcttgc

SEQ ID NO: 12366 - DNA, 850 bp, Oryza sativa
gtgaaaaagaggaggggggaaagatggggttggcgttcgggaagctgttcagccggctgttcgcgaagaaggagatgcggatcctgatggtcggtctcgacgccgccggaaagaccaccatcctctacaagctcaagctcggcgagatcgtcaccaccatccccaccattgggttcaacgttgaaactgttgagtacaagaacattagcttcactgtttgggatgtcgggggtcaggacaagatcagacctctttggaggcattacttccagaacacacagggtcttatctttgttgttgatagcaatgatcgggaccgtgttgtggaagctagagatgagctccacaggatgctgaatgaggatgagttgcgtgatgctgttttgcttgtgtttgccaacaagcaagatcttccaaatgctatgaatgctgctgagatcactgataagcttggactgcactcccttcgccagcgacactggtacatccagagcacttgtgccacaactggtgagggtctgtacgagggcctggattggctgtccagcaacattgctagcaaggcttgaggcttggaactccgaccgtaaaacttcgagctgactaggagctatgcatgtatctcattcatacgtaggacgaacactgtttcaatcttgttaggtgtcttcggcaagcccaatatttttgtaatgatacctcactccatcgttatcttctccgtattatttgtacctaccccaacctgtggtcgttttgcacaaggatttgcagtatgatgttcccgtgggcatgttgtgatgaacctgtccaataccttactacacattctaccagctttttgctacaa

SEQ ID NO: 12367 - DNA, 859 bp, Oryza sativa
cccaaatccatccgcttccaccccccagcccccgaattccatcgcagatcagatcaggtgaaaaaagaggagagaggaggggggaagatggggttggcgttcgggaagctgttcagccggctgttcgcgaagaaggagatgcggatcctgatggtggggctcgacgccgccggaaagaccaccatcctctacaagctcaagctcggcgagatcgtcaccaccatccccaccattgggttcaatgttgaaactgttgagtacaagaacattagcttcactgtctgggatgtggggggtcaagacaagatcagacctctttggaggcattacttccagaacacacagggtcttatctttgttgtggatagcaatgatcgcgaccgtgttgtggaagctagagatgagctgcacaggatgctgaatgaggatgagttgcgtgatgctgtgttgcttgtgtttgccaacaagcaagatcttccaaacgctatgaatgctgctgagattactgataagcttggattacattcccttcgtcagcgtcactggtacatccagagcacttgtgccacaactggcgagggtttgtatgagggcctggattggctgtccagcaacattgctagcaaggcttgatgcttgatacgtggacctttaagacatggagctgactaggagctatggcatgtatctcattcatatgtaggacgaagcactgtttcaatctgtttttgtaaggcatgtggcttcggcgagtccaatatttttgtaatgatacctcacttgaatgttccgtacttttggatattatttgtacctgttcattttgcacaaggatttacagcatgatggatgtttccgc

SEQ ID NO: 12368 - DNA, 1173 bp, Oryza sativa
atggaagatgggctgcgacgacaggagcccgaggcattggcgctcctcttctttctgagttccgacgaaacgacgatgaaccaatggcgggatccgaggaggaggcggatggagcggcatcgggacaaagggggagcagggccgctgctgtcgcagggtgggaggtgcaaggatgccgctagagaggagcagggcgcggggccgctaccgctgaaggggagggaggctcacggccgctgccatcgccggagagattacgtaatgccgctgccgctggaggggagggaggcccacggctaccgccgccgaagggaagttgggcgcgaacatgccaagttaatgccaagttatttggaaggctggcatttgagaacatgccatccgggatgatggcataaagtccaaaattccccctccgctcccacgcgtcccaccccgaaccgcgtcgctggcgctgcctattattttccacggtcaccgcttcacccccattcccacccccgaaattttccatcggaaatcccaccccgcctctccctccctctcccgcagatcagatcagatcagatccgatcaggtgaaaaagaggaggggggaaagatggggttggcgttcgggaagctgttcagccggctgttcgcgaagaaggagatgcggatcctgatggtcggtctcgacgccgccggaaagaccaccatcctctacaagctcaagctcggcgagatcgtcaccaccatccccaccattgggttcaacgttgaaactgttgagtacaagaacattagcttcactgtttgggatgtcgggggtcaggacaagatcagacctctttggaggcattacttccagaacacacagggtcttatctttgttgttgatagcaatgatcgggaccgtgttgtggaagctagagatgagctccacaggatgctgaatgaggatgagttgcgtgatgctgttttgcttgtgtttgccaacaagcaagatcttccaaatgctatgaatgctgctgagatcactgataagcttggactgcactcccttcgccagcgacactggtacatccagagcacttgtgccacaactggtgagggtctgtacgagggcctggattggctgtccagcaacattgctagcaaggcttgaggcttggaactccgaccgtaaaacttc

SEQ ID NO: 12369 - DNA, 778 bp, Sorghum bicolor
ctcctcctccggatttcgcattcagcacgcagcgcaggtggtgaaggaaagggggccgccgcggaggaaggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcaccgtgtgggatgtcgggggtcaggacaagatcagacctctctggaggcattacttccagaacacccagggtcttatctttgttgtggacagcaatgaccgtgaccgtgttgttgaagcaagagatgagctccacaggatgctgaatgaggatgagctacgtgatgctgtgctgcttgtttttgccaacaagcaagatcttcccaatgccatgaatgctgcagagattactgacaagcttggattacactccctgcgccagcgacactggtacatccagagcacatgtgctacaactggtgagggtctctacgagggcctggactggctgtccagcaacattgcgagcaaggcttgagtcctgccttggatatcaactgcgaactgactaggagctccggaatgtatcatggaaacttaggacagaatcgcctttgcaacctgttaggtgtcttctaccggcacaatatattttttgtttggaatatgtaatgatgtcactgcccaacgttt

SEQ ID NO: 12370 - DNA, 938 bp, Saccharum officinarum
cacgaagcgcggcgttaatatctccccttcttcccctcttcacgtctccgccccgcccccgatccccaattcctcctcctccggatttcgcattcagcacacagcacaggtggtgaaggaaggggggccgccgcggagggaaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggcttcaatgttgaaactgttgagtacaagaacattagcttcaccgtctgggatgtcgggggtcaggacaagatcagacctctctggaggcattacttccagaacacccagggtcttatctttgttgtggacagcaatgaccgtgatcgtgttgttgaagcaagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacctgtgctacaactggtgagggtctctatgagggcctggactggctgtccagcaacattgcgagcaaggcttgagtcctgccttggatatcaactgcgaactgactaggagctctggaatgtatcatggaaacttaggacagaatcgcctttgcaacctgttaggtgtcttataccggcacaatatattttttgtttggaatatgtaatgatgtcactgtccatcgtttattctaccctactatactgttggatgttctttggacctgttcattttgcacaaggattggagttccaatatcatgctacattgggatgttttg

SEQ ID NO: 12371 - DNA, 783 bp, Gossypium hirsutum
ccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgaaggcctggactggctgtccagcaacattgcgagcaaggcttgaggcctaccttgaatgtcaaccgcgaactgactaggagctccggatgtatcatggaaactcaggacagaatcgcagttgcaacctgttagatgtcttctaccggcactatatatattttttgtttgatgtgtaatgatgttactgttcaacgtttattaccctactatcga

SEQ ID NO: 12372 - DNA, 1231 bp, Panicum virgatum
ctaccccccttcgtccccactacccccgccagccggcacgaagcgcggcgttaatatctccacccctcccatctcctccgcccctcctcctcctcaggtctgcccccccatctcctcctcccccgatccccaaatcctcctccggatttcgaactcagcgcgtgcaggtggtgaaggggggcagagaggggaaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaaccgttgagtacaagaacattagcttcaccgtctgggatgtcgggggtcaggacaagatcagacccctctggaggcattacttccagaacacacagggtcttatctttgttgtggacagcaacgatcgtgaccgtgttgttgaagccagagatgagctccacaggatgctgaatgaggatgagctacgtgatgctgtgctgcttgtttttgccaacaagcaagatcttcccaacgctatgaatgctgctgagatcactgacaagcttggattacactccctgcgccagcgacactggtacatccagagcacttgtgccacaactggtgagggtctgtatgagggcctggactggctgtccagcaacattgctagcaaggcttgaggccaggctttcgatatcaactgcgaactgactaggagctccggatgtatcatggaaacttaggacagaatcgcctctgcaacctgttaggtgtcttctgccggcacgatatattttttgtttggaatatgtaatgatgtcactatcaaatgtttgttcaaccctactctactgttggatgttctttggacctgttcattttgcacaaggattggagttccaatatcatggtactttgggaagttattatatacaacattcctatacctgattagtacattagccaaggtaactcccatgtccgtcacatgtgaacgtagatctggtggggatccagatctgagaatctggtttaacagtcaaaattatcctgaagtgaagttgtgctcttagaaacatgtatccctgatccagatctacgtttacatgtgacgtgacgattagtactttcttttgaaccctttggtatctgatgaatgttgggcggcgc

SEQ ID NO: 12373 - DNA, 1032 bp, Cynodon dactylon
gccggggacaccagccggcacgaagcgcgttaatatctccaccaccccttctcccgtctcccctcccagcccaaccccaccacctcctccggatctctcattccgagcagcgcagcgcatcgcaggttggtcggtcggtcgaggagggggcaacgatggggctcgcgttcgggaagctcttcagccggctgttcgccaagaaggagatgcgcatcctcatggtcggtctcgacgccgccggtaaaaccaccatcctctacaagctcaagctcggcgagatcgtcaccaccatccccaccatcggcttcaatgttgaaacggttgagtacaagaacattagcttcaccgtctgggatgtcgggggtcaggacaagatcagacctctctggaggcattacttccagaacacacagggtcttatctttgttgtggacagcaacgatcgtgaccgtgttgttgaagccagagatgagctccacaggatgctcaatgaggatgagctgcgtgatgctgtgctgcttgtttttgccaacaagcaagatcttcccaatgctatgaatgctgctgagatcactgataagcttgggttacactccctgcgccagcgacactggtacatccagagcacttgtgctacaactggtgagggtctgtatgagggcctggactggctgtccagcaacattgctagcaaggcttgagtcctgggatatcaactgcgaactgactaggagctccggatgtatcatggaaacttaggacagactcgcctgttcaatctattaggtgtcttctactggcacgatatatattatttttgggatatgtaatgatgccactgttaaaacgtttgctacctggatgttcgttggatctgcttgttttgacaaggagttccggtatcatgttactttgatatgttcattttgcacaaggagttatcatgttctttgtaactgatcattctgcacctagtagtcttggtacacatttccaaatgttatttgaaaatgatgtgaaggtttgatgcag

SEQ ID NO: 12374 - DNA, 1285 bp, Oryza sativa
acccccgaaattttccatcggaaatcccaccccgcctctccctccctctcccgcagatcagatcagatcagatccgatcaggtgaaaaagaggaggggggaaagatggggttggcgttcgggaagctgttcagccggctgttcgcgaagaaggagatgcggatcctgatggtcggtctcgacgccgccggaaagaccaccatcctctacaagctcaagctcggcgagatcgtcaccaccatccccaccattgggttcaacgttgaaactgttgagtacaagaacattagcttcactgtttgggatgtcgggggtcaggacaagatcagacctctttggaggcattacttccagaacacacagggtcttatctttgttgttgatagcaatgatcgggaccgtgttgtggaagctagagatgagctccacaggatgctgaatgaggatgagttgcgtgatgctgttttgcttgtgtttgccaacaagcaagatcttccaaatgctatgaatgctgctgagatcactgataagcttggactgcactcccttcgccagcgacactggtacatccagagcacttgtgccacaactggtgagggtctgtacgagggcctggattggctgtccagcaacattgctagcaaggcttgaggcttggaactccgaccgtaaaacttcgagctgactaggagctatgcatgtatctcattcatacgtaggacgaagcactgtttcaatcttgttaggtgtcttcggcaagcccaatatttttgtaatgatacctcactccaacgttatcttctccgtattatttgtacctaccccaacctgtggtcgttttgcacaaggatttgcagtatgatgttcccgtgggcatgttgtgatgaacctgtccaataccttactacacattctaccagctttttgctacaaaacatatattgctgctcataggatttgatgaatgcctcatgtttagcagttcaattctttcctaatacgtactgcattctctggatcctggaatcgacgaaaacagttgttctgtttctcttttgtggcctttgtctgtgtgcctgagacatggtgctgaggactatgcatgcgtatgcttatacaagcattagtcattttttttttgttatcttagaatgatgagcgtgtgttcccgtgaggatctttgcatgtaaggctcaatttatgtgtagccattaagatatattctgtttggcgattgtctcgtactctcgtataatgaaatttaaccgaatgtaacctctcctaaa

SEQ ID NO: 12375 - DNA, 1174 bp, Oryza sativa
catggaagatgggctgcgacgacaggagcccgaggcattggcgctcctcttctttctgagttccgacgaaacgacgatgaaccaatggcgggatccgaggaggaggcggatggagcggcatcgggacaaagggggagcagggccgctgctgtcgcagggtgggaggtgcaaggatgccgctagagaggagcagggcgcggggccgctaccgctgaaggggagggaggctcacggccgctgccatcgccggagagattacgtaatgccgctgccgctggaggggagggaggcccacggctaccgccgccgaagggaagttgggcgcgaacatgccaagttaatgccaagttatttggaaggctggcatttgagaacatgccatccgggatgatggcataaagtccaaaattccccctccgctcccacgcgtcccaccccgaaccgcgtcgctggcgctgcctattattttccacggtcaccgcttcagccccattcccacccccgaaattttccatcggaaatcccaccccgcctctccctccctctcccgcagatcagatcagatcagatccgatcaggtgaaaaagagaggaggggggaaagatggggttggcgttcgggaagctgttcagccggctgttcgcgaagaaggagatgcggatcctgatggtcggtctcgacgccgccggaaagaccaccatcctctacaagctcaagctcggcgagatcgtcaccaccatccccaccattgggttcaacgttgaaactgttgagtacaagaacattagcttcactgtttgggatgtcgggggtcaggacaagatcagacctctttggaggcattacttccagaacacacagggtcttatctttgttgttgatagcaatgatcgggaccgtgttgtggaagctagagatgagctccacaggatgctgaatgaggatgagttgcgtgatgctgttttgcttgtgtttgccaacaagcaagatcttccaaatgctatgaatgctgctgagatcactgataagcttggactgcactcccttcgccagcgacactggtacatccagagcacttgtgccacaactggtgagggtctgtacgagggcctggattggctgtccagcaacattgctagcaaggcttgaggcttggaactccgaccgtaaaact

SEQ ID NO: 12376 - DNA, 835 bp, Setaria italica
cccacgatccccaaatcctcctccggatttcgcattcagcgcggcgcaggtggtgaaggggggtagagaaggggaagatggggctcgcgttcgggaagctcttcagccggctcttcgccaagaaggagatgcggatcctcatggtggggctcgacgccgccggtaaaaccaccatcctctacaagctcaagctcggcgagatcgtcaccaccatccccaccatcggtttcaatgttgaaactgttgagtacaagaacattagcttcaccgtctgggatgtcgggggtcaggacaagatcagacctctctggaggcattacttccagaacacacagggtcttatcttcgttgtggacagcaatgaccgtgaccgtgttgttgaagccagagatgagctccacaggatgctgaacgaggatgagctacgtgatgctgtgctgcttgtttttgccaacaagcaagatctgcccaacgctatgaatgctgctgagatcactgacaagcttggattacactccctgcgccagcgacactggtacatccagagcacttgtgccacaactggcgagggtctgtacgagggtctggactggctgtccagcaacattgctagcaaggcttgaggggcctggctttggatatcaactgcgaactgactaggagctccggatgtatcatggaaacttaggacagaatcgcttctgcaacctgttaggtgtcttctgccggcacgatatattttttgtttggaatatgtaatgatgtcactgttgaatgtttgttctaccctacttctactgttggatgttctttggacctgttcattttgcacaag

SEQ ID NO: 12377 - DNA, 1024 bp, Pennisetum glaucum
ccgatccccaattcctcctccggatttcgcactcgacgcggcgcaggtggtgaagggagaaggggaagaagatggggctcgcgttcgggaagctcttcagccggctcttcgccaagaaggagatgcggatcctcatggtggggctcgacgccgccggtaaaaccaccattctctacaagctcaaactcggcgagatcgtcaccaccatccccaccatcggtttcaatgttgaaactgttgagtacaagaacattagcttcaccgtctgggatgtcgggggtcaggacaagatcagacctctctggaggcattacttccagaacacacagggtcttatcttcgttgtggacagcaatgaccgtgaccgtgttgttgaagccagagatgagctgcacaggatgctgaacgaggatgagctacgtgatgctgtgctgcttgttttcgccaacaagcaagatctgcccaacgctatgaatgctgctgagattactgacaagcttggattacactccctgcgtcagcgacactggtacatccagagcacttgtgccacaactggtgagggtctgtacgagggtctggactggctgtccagcaacattgctagcaaggcttgaggggcagggctttggatatcaactgcgaactgactaggagctccggatgtatgatggaaacttaggacagaatcgcttctgcaatctgttgcgtgtcttctgttggcacgatatatttttttgtttggaatatgtaatgatgtcactgttaaatgtttgttctaccctacttctactgttgaatgttctttggacctgttcattttgcacaaggattggagttccaaaatcatgctacttttggaaagctgttgtatacattcgtagtacccgcgtatgtagggatggattcggatcggatatgcacggatacgaatttggatgtcactatttaccaacattttattttgaattcggaggcgaatactatcgaatatgaatacaagtagatatgtcgaattcgcatt

SEQ ID NO: 12378 - DNA, 1304 bp, Oryza sativa
aaaattttttagtccgtatagagaaattcgcacgttttcagaagcttcctgcctctccgctctccatgtgcgtgccaccaaatttccctggagaccgatctcagccgtccatcccaagatcggacgccctccatcccatgcccaccatccttatattattctccgctcctctccaccaccccttctcttcccttccctcccccccaaatccatccgcttccaccccccagcccccgaattccatcgcagatcagatcaggtgaaaaagagaggaggggggaagatggggttggcgttcgggaagctgttcagccggctgttcgcgaagaaggagatgcggatcctgatggtggggctcgacgccgccggaaagaccaccatcctctacaagctcaagctcggcgagatcgtcaccaccatccccaccattgggttcaatgttgaaactgttgagtacaagaacattagcttcactgtctgggatgtggggggtcaagacaagatcagacctctttggaggcattacttccagaacacacagggtcttatctttgttgtggatagcaatgatcgcgaccgtgttgtggaagctagagatgagctccacaggatgctgaatgaggatgagttgcgtgatgctgtgttgcttgtgtttgccaacaagcaagatcttccaaacgctatgaatgctgctgagattactgataagctcggattacattcccttcgtcagcgtcactggtacatccagagcacttgtgccacaactggcgagggtctgtatgagggcctggattggctgtccagcaacattgctagcaaggcttgatgcttgatacgtggacctttaagacatggagctgactaggagctatggcatgtatctcattcatatgtaggacgaagcactgtttcaatctgtttttgtaaggcatgtggcttcggcgagtccaatatttttgtaatgatacctcacttgaatgttccgtacttttggatattatttgtacctgttcattttgcacaaggatttacagcatgatggatgtttccgcgacatgttacttggaacttgtcaattatcctccgtttcacaatgtaagactttctagcattatctatattcatatagataatagcattacccatattcatatagataatgtctagattcaataacatctatatgaatatgggtaatgctagaaagtcttataatctgaaacggatgaaacggagggagtagtatttagcttgagggaaaaattattgaagttggtattttggaatcccaagtggtatca

SEQ ID NO: 12379 - DNA, 821 bp, Echinochloa colona
ggaagaagatggggctcgcgttcgggaagctcttcagccggctcttcgccaagaaggagatgcggatcctcatggtcggtctcgacgccgccggtaaaaccaccatcctctacaagctcaagctcggcgagatcgtcaccaccatccccaccatcggtttcaatgttgaaactgttgagtacaagaacattagcttcaccgtctgggatgtcgggggtcaggacaagatcagacctctctggaggcattacttccagaacacacagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaatgctatgaatgctgctgagatcactgacaagcttggactgcactctctgcgccagcgacactggtacatccagagcacctgtgccacaactggtgagggtctgtacgagggtctggactggctgtcaagcaacatcgctagcaaggcttgaggtctggctttggatatcaactgcgaactgactaggagctccggatgtatcatggaaacttaggacagaatcgcctttgcaatgtgttaggtgtcttccggcacaatatattttttgtttcgaatatgtaatgatgtcaccgttaaatgtttgttctaccctactctactgttggttgttctttgaacctgttcattttgcacaaggattggagttccaatatcatgctactctggaaagttattatacaccaacattcgtagtacc

SEQ ID NO: 12380 - DNA, 1558 bp, Brachypodium distachyon
ccatcgacgcgtgcctctcgaattttgacctcaccgtcgtcgatcgcatcgaacataaataaactcccgtcccgaatcacgacgcacgttcccgtcttcttcgccttcttcttctcctccctcccctctctctctccccctccccgcattggatcgcatcgaacaaccaagcgccagccagcttcttctcgtcaggtgaccggaggagaggtaggacgagatggggcttgctttcgggaagctcttcagccggctcttcgccaagaaggagatgcggatcctcatggtcggtctcgacgccgccggaaagaccaccatcctctacaagctcaagctcggcgagatcgtcaccaccatcccaaccatcgggttcaatgttgagactgttgagtacaagaacattagcttcactgtttgggatgtcgggggtcaggacaagatcagaccactctggaggcattatttccaaaacacccagggtcttatcttcgttgtggacagcaatgatagggaccgtgttgttgaagccagagatgagctccacaggatgctgaatgaggatgagcttcgtgatgctgtgttgcttgtctttgccaacaagcaagatcttccaaatgctatgaatgctgctgagattactgacaagcttggactacattcccttcgtcagcgacactggtatatccagagcacctgtgctacaactggtgagggtctgtatgagggcctggactggctgtccagcaacattgctagcaagtcttgaggcttggagtttcgactggagctgactagaagctgtggatgtatcaattcatacttaggacgaattatttgttaccatctgttgcgtgcgctctgcaagctcaatatttttgtaatgatgtcccagttaaacgtttcctaaagaatgttcttttgtacctgttaattttgcagaaggatttaaatattacatttctttgacgagttaccacgaacctgttccatgcctgctagctcaaggccctaaagattgtctatgttgatacgacggtatagccattgattgtgttttatatgccggggtgattgggtagcaaaggctgcgttgaacttagattatttttaagtggtggcgtatcatgtgaaaactgtctttgaaaacacatcggaaccactgtaaaaaggtgaaaacaaattgtatatgttggtagagtcgatgtgtaaaatggaaaacacaaatgcaacatgaatagtgattcttcactattagacactttgtgtatttctccttttaacccttgcaaatgcagcgtatatactttaagttttacaaatttatattccctccgtctcatagtaagtgactcaaatttgtctaatatgtacgtgtctatatagtacaatacgtctagaacatgtaatatttcggcatttaatatgagacagagcatagtagtgcatatggtatttttctttttaggaatattttttacttgtaaacatgtttttatggagtttggagggtaagaatgttttttccctaatatatttacccttttaatatattgacagt

SEQ ID NO: 12381 - DNA, 837 bp, Festuca arundinacea
gccgaaccccaggcgaagctcctcgccggaatcaggtgaccagagggcgagatggggctcgcgttcgggaagctcttcagccggcttttcgccaagaaggagatgcggatcctcatggtcggtctcgatgccgccggaaagaccaccatcctctacaagcttaagctcggcgagatcgtcaccaccatcccaacaattgggttcaatgttgagactgtggagtacaagaacattagtttcaccgtctgggatgtcgggggtcaggacaagatcagacctctctggaggcattacttccagaacacccaggggcttatctttgtcgtggacagcaatgacagggatcgtgttgttgaagctagggatgagctccataggatgcttaatgaggatgagttgcgtgatgctgtgttgcttgtctttgccaacaaacaagatcttccaaatgctatgaatgctgctgagatcactgataagcttggtttacattctctacggcagcgacactggtacatacagagcacttgcgccacatctggggagggtctgtacgagggtctggactggctgtccagcaacattgccagcaaggcttgaggctatgagttattgaggctgtccagtcgacttggagctatggatgttatgaccctagggttgttgttatctactatttcagtctcttagacattgcatacactaaaatattttttaagcttgttataaccaaggatttcaatgttccctgtagtttcaaatgtttgcacattttccacttttactccaggcctttccagtaccatgtctctgctattcttgaagtctgatgaacttgtc

SEQ ID NO: 12382 - DNA, 932 bp, Lolium multiflorum
ctctctctcctcgcgccgaaccccaggcgaagctcctcgccggaatcaggtgaccagagggcgagatggggctcgcgttcgggaagctcttcagccggcttttcgccaagaaggagatgcggatcctcatggtcggtctcgatgcagccggaaagaccaccatcctctacaagcttaagctcggcgagatcgtgaccaccatcccaacgattgggttcaatgttgagactgtggagtacaagaacattagtttcaccgtctgggatgtcgggggtcaggacaagatcagacctctctggaggcattacttccagaacacccaggggcttatctttgtcgtggacagcaatgacagggatcgtgttgttgaagctagggatgagctccataggatgcttaatgaggatgagttgcgtgatgctgtgttgcttgtctttgccaacaaacaagatcttccaaatgctatgaatgctgctgagatcactgataagcttggtttacattctctacggcagcgacactggtacatacagagcacttgcgccacatctggggagggtctgtacgagggtctggactggctgtccagcaacattgccagcaaggcttgaggctatgagttatcgaggctctccagtcgacttggagctatggatgttatgaccctagggttgttgttatctgctatttcagtctcttagacattgaatacactaaaatattttttgagcttgttataaccaaggatttcaatgttccctgtagtttcaaatgtttgcacattttccatttttactccaggcctttccagtaccatgtctctgctattcttgaagtctgatgaacttgtcccttttgtttactcgccatattagtctgaaaattgcccatgtatagtgtgttgcttttgtgaaatgttcaggtgacagaga

SEQ ID NO: 12383 - DNA, 989 bp, Avena sativa
aggctgctgcctgctgctgctccgttgtacataaactctgtccctgaatcccgacgcgcattcccaccttcccctcctcgtgtcgaaccgcaggcgaagctcctagccagactcaggtgactggaggagaagtagggcgagatggggcttgctttcgggaagctcttcagccgcctcttcgccaagaaggagatgcggatcctcatggtcggtctcgatgccgccggaaagaccacaatcctctacaagcttaagcttggcgagatcgtcaccaccatcccaaccattgggttcaatgttgagactgtggagtacaagaatattagtttcactgtctgggatgtcgggggtcaggacaagatcagacctctctggaggcattatttccagaacacacaggggcttatctttgttgtggatagcaatgacagggatcgtgttgttgaagctagagatgagctccataggatgctcaatgaggatgagttgcgtgatgctgtgttgcttgtctttgctaacaagcaagatcttccaaatgctatgaatgctgctgagattactgataagcttgggttacattctctacggcagcgacactggtacatacagagcacttgcgccacatctggcgagggtttgtatgagggtctggactggctgtccagcaacattgccagcaaggcttgatgcttggaattatcgaggccctcaaatcaacttggagctgtggatttactggtgatccttgggtccttgttcgctgctatttcagtctcttagacatacgctcaaatattttttgagctcgttataacccaggatttgaatgttccctgtagttttcaaatgttgcacatttcccccttttacttctaggcctttccagtaccatgtctgctctgctattcttgaagtctaaggaacttgtcttgatgtttacacgccaacttagtctgaaaattgcttatgtatagcgtgttgctttcgtg

SEQ ID NO: 12384 - DNA, 977 bp, Pseudoroegneria spicata
ggaggagccccactaccctaccccattcctcaccagccgctaggcacgactattatctccccaccacccgcgtccttctccgactaacaaatcccccaaatctcctccctcccggcatcgcatttcttcaacactagcaggtgatcggaagaggagtagggcgagatggggctcgcgttcgggaagctcttcagccggctcttcgccaagaaggagatgcggatcctcatggtcggtcttgatgccgccggaaagaccaccatcctctacaagctgaagctcggcgagatcgttaccactatcccaaccatcgggttcaatgttgaaactgtcgagtacaagaacattagcttcactgtttgggatgttgggggtcaggacaagatcagacctctctggaggcattacttccagaacacacagggtcttatctttgttgtggacagcaatgatagggaccgtgttgttgaagccagagatgagctccacaggatgctgaatgaggatgagttgcgcgatgctgtgttgcttgtctttgccaacaagcaagatcttccaaatgctatgaatgctgctgaaattactgataagcttggattacattcccttcgccaacgtcactggtacatccagagcacatgtgctacatccggtgagggtctgtatgagggcctggactggctatctagtaacattgccagcaaggcttgaggcttggaattttgactgcggagctggctaggagctgtggatgtatcacttcgtacttgagacgaattatttgttccaatctgttgcctttcgcaagctcagtatttttgtaatgatgtcccagttaaatgcttccttatggatgctctttctacttgttgatattttgcacaatgatttcaaatatcatacgtttttgactagttatcatgtccaattagttatataaacggggccaaaatattatttatttgatatgatgagca

SEQ ID NO: 12385 - DNA, 970 bp, Secale cereale
cccggcatcgcatttcttgaccactagcaggtgatcggaagaggagtagggcgagatggggctcgcgttcgggaagctcttcagccggctcttcgccaagaaggagatgcgtatcctcatggtcggtcttgatgccgccggaaagaccaccatcctctacaagctgaagcttggagagatcgttaccactatcccaaccatcgggttcaatgttgaaactgtcgagtacaagaacattagcttcactgtttgggatgttgggggtcaggacaagatcagacctctctggaggcattacttccagaacacacagggtcttatctttgttgtggacagcaatgatagggaccgtgttgttgaagccagagatgagctccacaggatgctgaatgaggatgagttgcgcgatgctgtgttgcttgtctttgccaacaagcaagatcttccaaatgctatgaatgctgctgaaattactgataagcttggattacattcccttcgccaacgtcactggtacatccagagcacatgtgctacatccggtgagggtctgtatgagggcctggactggctatctagtaacattgccagcaaggcttgaggcttggaattttgattgtggagctggctagagctgtggatgtatcacttcatacttaagacgaattatatgttcgaatctgttatgtgcctttggcaagctcagtacttttctaatgatgtcccagttaaatgcttccttatggatgctctttctacttgttgatattttgcacaatgatttcaaatatcatatgtttttgactagttatcatgtccaattagttatacaaatgaggccaaaatattatttatttgatatgacgagcagcaatttattgtattgatgttaggcttctttcttgaaaagtacgggcgacttgtatcgaatattgtctttggaggctgagctccatggagcttggttttg

SEQ ID NO: 12386 - DNA, 1182 bp, Secale cereale
cccattcctcaccagccgctagggacgctataatctccccagcacccgcgtccttcgccgactaacaaattccccaaatctcctccctcccggcatcgcatttcttgaccactagcagaggaatcgatcatcggttttctgccgatatcaccgatgcaaagattggatctgacgttcgaattgcgtggtcctcggaggcgctagatctgcgaccgttctgtcacgtcgcggatctcgaatttatttgggtgatcggaagaggagtagggcgagatggggctcgcgttcgggaagctcttcagccggctcttcgccaagaaggagatgcgtatcctcatggtcggtcttgatgccgccggaaagaccaccatcctctacaagctgaagcttggagagatcgttaccactatcccaaccatcgggttcaatgttgaaactgtcgagtacaagaacattagcttcactgtttgggatgttgggggtcaggacaagatcagacctctctggaggcattacttccagaacacacagggtcttatctttgttgtggacagcaatgatagggaccgtgttgttgaagccagagatgagctccacaggatgctgaatgaggatgagttgcgcgatgctgtgttgcttgtctttgccaacaagcaagatcttccaaatgctatgaatgctgctgaaattactgataagcttggattacattcccttcgccaacgtcactggtacatccagagcacatgtgctacatccggtgagggtctgtatgagggcctggactggctatctagtaacattgccagcaaggcttgaggcttggaattttgattgtggagctggctagagctgtggatgtatcacttcatacttaagacgaattatatgttcgaatctgttatgtgcctttggcaagctcagtacttttctaatgatgtcccagttaaatgcttccttatggatgctctttctacttgttgatattttgcacaatgatttcaaatatcatatgtttttgactagttatcatgtccaattagttatacaaatgaggccaaaatattatttatttgatatgacgagcagcaatttattgtattgatgttaggcttctttcttgaaaagtacgggcgacttgtatcgaatattgtctttggaggctgagctccatggagcttg

SEQ ID NO: 12387 - DNA, 1108 bp, Avena sativa
ctgcctgctgctgctccgttgtacataaactctgtccctgaatcccgacgcgcattcccaccttcccctcctcgtgtcgaaccgcaggcgaagctcctagccagactcaggtgactggaggagaagtagggcgagatggggcttgctttcgggaagctcttcagccgcctcttcgccaagaaggagatgcggatcctcatggtcggtcttgatgccgccggaaagaccacaatcctctacaagcttaagcttggcgagatcgttaccaccatcccaaccattgggttcaatgttgagactgtggagtacaagaatattagtttcaccgtctgggatgttgggggtcaggacaagatcagacctctctggaggcattatttccagaacacacaggggcttatctttgttgtggatagcaatgacagggatcgtgttgttgaagctagagatgagctccataggatgctcaatgaggatgagttgcgtgatgctgtgttgcttgtctttgctaacaagcaagatcttccaaatgctatgaatgctgctgagattactgataagcttgggttacattctctacggcagcgacactggtacatacagagcacttgtgccacatctggtgagggtttgtatgagggtttggactggctatccagcaacattgccagcaaggcttgatgcttggaattatcgaggccctcaaatcaacttggagctgtggatgtacttgtgatcctcagggtccttgttcgctgctatttcagtctcttagacattgcatacgctaagatattttttgagctcgttataacccaggatttgaatgttccctgtagttcccaaatgttgcacatttcccccttttacttctaggcctttccagtaccatgtctgctctgctattcttgaagtctaaggaacttgtcttgatgtttacacgccaacttagtctgaaaattgcttatgtatagcgtgttgctttcgtgaaatggtcgagtgacgagatattatgagtgcaggttgtactagaatacggagtactactctccaaaggtcacacccgcgtatgttcgtgtcatgagcagacgtagaggggcagaattgg

SEQ ID NO: 12388 - DNA, 846 bp, Avena sativa
tggttcctattacgggccgggggtagaccaaatcccccaaatctactcccgaggtcgcatttcctccagcgtttgcaggtgaccggaggagaagtagggcgagatggggcttgcgttcgggaagctcttcagccggctcttcgccaagaaggagatgcgcatcctcatggtcggtcttgatgccgccggaaagaccacaatcctctacaagcttaagctcggcgagatcgtcaccaccatcccaaccatcgggttcaatgttgaaactgttgagtacaagaacattagcttcactgtttgggatgtcgggggtcaggacaagatcagacccctctggaggcattacttccagaacacacagggtcttatctttgttgtggacagcaatgatagggaccgtgttgttgaagctagagatgagctccacaggatgctaaatgaggatgagttgcgtgatgctgtgttgcttgtctttgccaacaagcaagatcttccaaatgctatgaatgcggctgaaattactgataagcttggattacattcccttcgccagcggcactggtacatccagagcacctgtgctacatctggtgagggtctgtacgagggcctagactggctttccagcaacattgctagcaaggcttgattgaaatttggactgggagctgtctaggagctgtggatgtatcaatttatatgtaggacgaattatttcttctcatctgttacgtgccttcggcgagcccaatatttttgtaatgatgtcttggttaaatgtttccgtatgaatgttctttgtacttgctccttttgcacaacgatttccaatatcatattttgttg

SEQ ID NO: 12389 - DNA, 1055 bp, Avena sativa
ctgcctgctgctgctccgttgtacataaactctgtccctgaatcccgacgcgcattcccaccttcccctcctcctcgcgtcgaaccgcaggcgaagcttagccaggtgactgggggggaagtagggcgagatggggcttgcgttcgggaagctcttcagccgcctcttcgccaaaaaggagatgcggatcctcatggtcggtctcgatgccgccggaaagaccacaatcctctacaagcttaagcttggcgagatcgtcaccaccatcccaaccattgggttcaatgttgagactgtggagtacaagaatattagtttcaccgtctgggatgttgggggtcaggacaagatcagacctctctggaggcattatttccagaacacacaggggcttatctttgttgtcgatagcaatgacagggatcgtgtcgttgaagctagagatgagctccataggatgctcaatgaggatgagttgcgtgatgctgtgttgcttgtctttgctaacaagcaagatcttccaaatgctatgaatgctgctgagattactgataagcttgggttacattctctacggcagcgacactggtacatacagagcacttgtgccacatctggtgagggtttgtatgagggtttggactggctatccagcaacattgccagcaaggcttgatgctaggaattatcgaggccctcaaatcaacttggagctgtggatgtacttgtgatcctcagggtccttgttcgctgctatttcagtctcttagacattgcatacgctaagatattttttgagctcgttataacccaggatttgaatgttccctgtagttcccaaatgttgcacatttcccacttttacttctaggcctttccagtaccatgtctgctctgctattcttgtagtctgatgaacttgtcttgatgttttctcgccaacttggtccgaaaattgctcatgtatagcgtgttgctttcgcgaaatggttgagtgaccgagatatgatacgtgcaggttgtactagaatacggagtactactctccaaaggtc

SEQ ID NO: 12390 - DNA, 843 bp, Fraxinus spp
atctgagtctgaggtgaagcagagatggggctggcatttgggaagctgttcagcagactctttgcgaagaaagagatgcggattctgatggtaggtcttgatgctgctggtaaaactaccatattatacaaactaaagcttggagaaattgtcactacaatccctaccattggatttaatgttgagacagtggagtacaagaatattagcttcactgtctgggatgttggtggccaagataagatccgtcccttgtggaggcactacttccaaaatacacagggtcttatttttgtggttgatagcaatgacagggatcgagttgttgaagcaagagatgaactgcacagaatgttgaacgaggatgaattgagggatgctgtcttgcttgtatttgctaataagcaagatctgcctaatgcaatgaatgctgcagaaattactgacaaacttggcctccactctcttcgtcaacgtcactggtacatccagagcacgtgtgcaacctctggggagggcctttatgaagggttggattggctttcgagcaacatcgccagcaaggcatgaagcagtaaaggatttattattgctggttagatttttgcttggatcatggacacaggacacttttatggaattggcaatatcaaagagagaccttttgattttcactttcagtatgttatagtaagaactttataattttacaattgcagctatttgtcttccttattttcagctacattattaggtatatgccttttgttaatgttcttgccaacttcagaagttgagatactctcttaaatgtttgttttaataaaaaataatctgttttcc

SEQ ID NO: 12391 - DNA, 821 bp, Leymus cinereus x Leymus triticoides
aatctcccccctcccggcatcgcatttcttcaacactagcaggtgatcgaagaggagggtagggcgagatggggctcgcgttcgggaagctcttcagccggctcttcgccaagaaggagatgcggatcctcatggtcggtcttgatgccgccggaaagaccaccatcctctacaagctgaagctcggcgagatcgttaccactatcccaaccatcgggttcaatgttgaaactgtcgagtacaagaacattagcttcactgtttgggacgttgggggtcaggacaagatcagacctctctggaggcattacttccagaacacacagggtcttatctttgttgtggacagcaatgatagggaccgtgttgttgaagccagagatgagctccacaggatgctgaatgaggatgagttgcgcgatgctgtgttgcttgtctttgccaacaagcaagatcttccaaatgctatgaacgctgctgaaattactgataagcttggattacattcccttcgccaacgccactggtacatccagagcacatgtgctacatccggtgagggtctctatgagggcctggactggctatctaataacattgccagcaaggcttgaggcttggaattttgactgcggagctggctaggagctgtggatgtatcacttcatacttaagacgaattatttgttccaatctgttatgtgcctttcgcaagctcagtatttttgtaatgatgtcccagttaaatgtttccttatggatgctctttctacttgttgatattttgcacaatgatttcaaatatcatacgtttttgacta

SEQ ID NO: 12392 - DNA, 873 bp, Oryza sativa
cccaacccatcgcttcccccctccacccgtctcctccgtctccggcgccggcgccggcgagctcgccccccgcgattcgtgccctccgatcagaggcgaggcgggagaagagatggggctcacgttcaccaagctgttcagccggctcttcgccaagaaggagatgcggatcctgatggtgggtcttgacgcggccggaaagaccacaatcctctacaagctcaagctcggcgagatcgtcaccaccatccccaccatcggattcaatgttgaaaccgtggagtacaagaacatcagcttcaccgtctgggatgtggggggtcaggacaagatcaggcctctgtggaggcattatttccagaacacccagggtctcatctttgttgtggacagcaatgatagggaccgtgttgtcgaagccagggatgagctccacaggatgctgaacgaggatgagctacgtgatgctgtgctgcttgtctttgctaacaagcaagatctgccaaacgctatgaatgctgctgagatcactgataagcttggactgcactcccttcgccagcgacactggtatatccagagcacttgtgctacaacaggtgagggattgtacgagggcctggactggctgtccagcaacattgccagcaaggcctaaattttaacaagatttgcataagctaggggagctttggatggatcgatgggtatttagggctgtggttgctatcccaatatgtaaggtgtaattccggagctcaatagttattgagctttggttatgatttcacagttaaatggtttactgtactttgagccttaacatgtttctgaattaaacagctattacattgagttccgtcgaattattct

SEQ ID NO: 12393 - DNA, 789 bp, Eragrostis curvula
caaatttcccgggcagcgcaacgcaggttctcggtcgaggaggggggcaagatggggctcgcgttcgggacccttttcggccggctgttcgccaagaaggagatgcggatcctcatggtcggtctcgatgccgccggtaaaaccaccatcctctacaagctaaagctcggcgagatcgtcaccaccatccccaccatcggcttcaatgttgaaactgttgagtacaagaacattagcttcactgtctgggatgtcgggggtcaggacaagatcagacctctctggaggcattacttccagaacacgcagggtcttatctttgttgtggacagcaatgatcgtgaccgtgttgttgaagctagagatgagctccacagaatgctgaacgaggatgagctgcgtgatgctgtgctgcttgtttttgccaacaagcaagatcttcccaatgctatgaacgctgctgagatcactgacaagcttgggttacattccctgcgccagcgacactggtacatccagagcacttgtgctacaactggtgagggtctgtacgagggcctggactggctgtccagcaacattgctagcaaggcttgagtcctgggatatcaattgcgaactgactaggagctccggatgtatgatggaaacttaggacagactcgccttttcaatctattaggtgtcttctactggcacgatatatattatttttggaatatgtaatgatgtccctgttaaaatgtttgccctactcttgaatgttcgttggatctgcttgttttgtac

SEQ ID NO: 12394 - DNA, 887 bp, Festuca arundinacea
cccttccttctccggctcctacgccggcgaacccaccgcggatccagtgattcctccgatcaggagaggcgaggcgggaggaagagagagcacctgcgcgggaggagacgagatggggctcacgttcaccaagctgttcagccgcctgttcgccaagaaggagatgcggatcctgatggtgggtctcgacgccgccggaaagaccacaatcctctacaagctcaagctcggcgagatcgtcaccaccatccccaccatcggattcaatgttgaaactgtggagtacaagaacatcagcttcactgtctgggatgtcgggggtcaggacaagatcagacctctgtggaggcattacttccagaacacgcaaggtcttatcttcgtcgtggacagcaacgatagggaccgtgttgttgaagccagggatgagctccacaggatgctgaatgaggatgagttacgtgatgctgtgttgcttgtgtttgctaacaagcaagatcttccaaatgctatgaatgctgctgagattactgataagcttgggctgcactcccttcgccagcgacactggtacatccagagcacttgtgctacaacaggtgagggattgtacgaaggcctggactggctgtccagcaacattgctagcaaggcctaaattttcgtcaagattttggatggatgagctaggagatttggatggatcattcaatctagggatgggttggcaagggatgctatccccgtatgtaatgtgtatttcatgagatcaacagttattgagctctggctgtggtttcactgttatattgtttattgtattttgagccctaagatgtttctgaagtaaacagctaaagagagtcatgttcaatttatcagtcttc

SEQ ID NO: 12395 - DNA, 1026 bp, Festuca arundinacea
gggggccctctctccctcgttcttctcgcgccccacctgtttgtttccgtccccttccttctccggctccgtcgccggcgatcccaccgcggatcgagtgattcctccgatcaggagaggctaggcgtggggaagagagtacctgcgcgggaggagacgagatggggctcacgttcaccaagctgttcagccgcctgttcgccaagaaggagatgcggatcctgatggtgggtctcgacgccgccggaaagaccacaatcctctacaagctcaagctcggcgagatcgtcaccaccatccccaccatcgggttcaatgttgaaacagtggagtacaagaacatcagcttcactgtgtgggatgtcgggggtcaggacaagatcaggccattgtggaggcattacttccagaacacgcagggtctcattttcgttgtggacagcaacgatagggaccgtgttgttgaagccagggatgagctccacaggatgctgaatgaggatgagttacgtgatgctgtgttgcttgtgtttgctaacaagcaagatcttccaaatgctatgaatgctgctgagatcaccgataagcttggactgcactcccttcgccagcgacactggtacatccagagcacttgtgctaccacaggtgagggattgtatgaaggcctggactggctgtccagcaacattgctagcaaggcctaaattttcggcaagattttggatggatgagctaggagctttggatggatcattcaccgggtacctagggattgggttggaaagggatgttatccccgtatgtaatgtgtatttcctgagatcaacagctattgacctccggctgtggtttcactgttataatattgttttattgtattttgagccctaagatgtttcttctggagtaaacagctaaagagagtcatgttcaatttatcggtcttcgtaataatcgttcatgccttgaatttgttccgaaaaaaaagaaaaaaaaacaaaagtactctgcgttgataccact

SEQ ID NO: 12396 - DNA, 1260 bp, Oryza sativa
agtagggtgagacgcgttcatttgacgcgacccgcacaaaggttggctctccctcgtttcccttccctcgcataaataaaagctcgcaccaccgccacaatccctcctcctccccaacccatcgcttcccccctccacccgtctcctccgtctccggcgccggcgccggcgagctcgccccccgcgattcgtgccctccgatcagaggcgaggcgggagaagagatggggctcacgttcaccaagctgttcagccggctattcgccaagaaggagatgcggatcctgatggtgggtcttgacgcggccggaaagaccacaatcctctacaagctcaagctcggcgagatcgtcaccaccatccccaccatcggattcaatgttgaaaccgtggagtacaagaacatcagcttcaccgtctgggatgtggggggtcaggacaagatcaggcctctgtggaggcattatttccagaacacccagggtctcatctttgttgtggacagcaatgatagggaccgtgttgtcgaagccagggatgagctccacaggatgctgaacgaggatgagctacgtgatgctgtgctgcttgtctttgctaacaagcaagatctgccaaacgctatgaatgctgctgagatcactgataagcttggactgcactcccttcgccagcgacactggtatatccagagcacttgtgctacaacaggtgagggattgtacgagggcctggactggctgtccagcaacattgccagcaaggcctaaattttaacaagatttgcataagctaggggagctttggatggatcgatgggtatttagggctgtggttgctatcccaatatgtaaggtgtaattccggagctcaatagttattgagctttggttatgatttcacagttaaatggtttactgtactttgagccttaacatgtttctgaattaaacagctattacattgagttccgtcgaattattctgctttgggtggtcctccgtctctctcatctgccgtatcagactatgtatatgtgtactgcaaagtacgcggtacggctaattgtttctgtactcttcgttacggctagatggttgtctcgaggtattactctcgtagtaagggaagtaagggaaaagataataataggcaataaaacttgtttgtatgcttatataaaggagagaaaaattcggaccatcgttttgtgaaacggcatatttgtaaataaaaaataatttataaataaaacttata

SEQ ID NO: 12397 - DNA, 876 bp, Festuca arundinacea
gtgaccagagggcgagatggggcttgcgttcgggaagctcttcagccggcttttcgccaagaaggagatgcggatcctcatggtcggtctcgatgccgccggaaagaccaccatcctctacaagcttaagctcggcgagatcgtcaccaccatcccaaccattgggttcaatgttgagactgtggagtacaagaatattagtttcaccgtctgggatgtcgggggtcaggacaagatcagacctctctggaggcattatttccagaacacccaggggcttatctttgtcgtggacagcaatgacagggatcgtgtcgttgaagctagggatgagctccataggatgcttaatgaggatgagttgcgtgatgctgtgttgcttgtctttgccaacaaacaagatcttccaaatgctatgaatgctgctgagatcactgataagcttgggttacattctctacggcagcgacactggtacatacagagcacttgcgccacatctggtgagggtctgtatgagggtctggactggctgtccagcaacattgccagcaagtcttgaggcttggaattatcgaggctcttcaatcgacttgggagctgtggatgctatctgtgatccctagggtcgttgttatatgttatttcagtctcgtagacattgcatacgctcaattatttttcgagcttgttataaccaacggtttcaatgctccctgcagtttcaaatgtttgcacatttcccacttttacgctaggcctttcaagtaccatgtctgctctgctattcttgaagtaccgtgtacctttcaaatgcttgatgtttactcgccaaaaaaaagaaaaaaaacaaaagtactctgcgttgataccact

SEQ ID NO: 12398 - DNA, 1069 bp, Triticum aestivum
agacgtgacctttcaatttgggaaaataatgtcgcctgataatcgggggatgaagaagcagccccactaccccatcccattcctcagcagccgcttaggcacgactattatctccccaccatccgcgtccttctccgactaacaattcccccaaatttcttcgcaggtgttcggaagaggggtagggcgagatggggctcgcgttcgggaagctcttcagccggctcttcgccaagaaggagatgcggatcctcatggtcggtcttgatgccgccggaaagaccaccatcctctacaagctgaagctcggcgagatcgttaccactatcccaaccatagggttcaatgttgaaactgtcgagtacaagaacattagcttcactgtttgggatgttgggggtcaggacaagatcagacctctctggaggcattacttccagaacacgcagggtcttatctttgttgtggacagcaatgatagggaccgtgttgttgaagccagagatgagctccacaggatgctgaatgaggatgagttgcgcgattctgtgttgcttgtctttgccaacaagcaagatcttccaaatgctatgaatgctgctgaaattactgataagcttggattacattcccttcgtcaacgtcactggtacatccagagcacatgtgctacatccggtgagggtctgtatgagggcctggactggctatctagtaacattgccagcaaggcttgaggcttggaattttgactgcggagctggctagtagctgtggatctgttatgtgcctttcgcaagctcagtgtttttgtaatgatgtcccagttaaatgcttccttatggatgctctttctacttgttgatactttgcacaatgatttcaaatatcatacgtttttgactagttatcatgtccacttagttatataaatgaggccaaaatattatttctttgatatgatgagcagcaattaaattttttttgaactgatgagcagcaatttattgtattgacgttaggcttggtttcttggaaaatatgggtgacttgtatccctttgtttttt

SEQ ID NO: 12399 - DNA, 970 bp, Festuca arundinacea
cgacgcgcattcccacctcctcctcctctctctctcctcgcgccgaaccccaggcgaagctcctcgccggaatcaggtgaccagagggcgagatggggctcgcgttcgggaagctcttcagccggcttttcgccaagaaggagatgcggatcctcatggtcggtctcgatgccgccggaaagaccaccatcctctacaagcttaagctcggcgagatcgtcaccaccatcccaaccattgggttcaatgttgagaccgtggagtacaagaacattagtttcactgtctgggatgtcgggggtcaggacaagatcagacctctctggaggcattacttccagaacacccaggggcttatctttgtcgtggacagcaatgacagggatcgtgtcgttgaagctagggatgagctccataggatgcttaatgaggatgagttgcgtgatgctgtgttgcttgtctttgccaacaagcaagatcttccaaatgctatgaatgctgctgagatcaccgataagcttggtttacattctctacggcagcgacactggtacatacagagcacttgcgccacatctggtgagggtctgtatgagggtctggactggctctccagcaacattgccagcaagtcttgaggcttggaattatcgaggctctcgaatcgacttggagctatggatgttatctgtgatccctagggtcgttgttatatgctatttcagtttcttagacattgcatacgctcaattattttttgagcttgttataacaaagagtttcaatgctccctgtagtttcaaatgtttcacatttcctacttttactctaggcctttccagtacaatgtttgctctgctattcttgaagtctgatgaacttgtcttaatgtttactcgccaacttagtctgaaaattgcccatgaaaaaaaaaagaaaaaaaacaaaagtactctgcgttgataccact

SEQ ID NO: 12400 - DNA, 942 bp, Olea europaea
gatactcggggttctatttccgccaggccttcaaataggaatagtgagagattcaaattccccgaaacattctctctacatacatttcgattcttctacgaagctttcgagaagttggcagcgatctgagtctgaggtgaagcagagatggggctggcatttggaaagctgtttagcaggctctttgccaagaaagagatgcggattctgatggtaggtcttgatgctgctggtaaaactaccatattatacaaactcaagcttggagaaattgtcactacaatccctaccattggatttaatgttgagacagtggagtacaagaatattagcttcactgtctgggatgttggtggccaagacaagatccgtcccttgtggaggcactacttccaaaatacacagggtcttatttttgttgttgatagcaacgacagggatcgagttgttgaagcaagagatgaactgcacagaatgttgaatgaggatgaattgagggatgctgtcttgcttgtatttgctaataagcaagatctgcctaatgcaatgaatgctgcagaaattactgacaaacttggcctccactctcttcgtcaacgtcattggtacatccagagcacgtgtgcaacctctggggagggcctttacgaagggttggaatggctttcgagcaacatcgctagcaaggcatgaagcagtaaaggatttattattgctggttagatttttgcttggaacagggacacagtactcttttatggaattggctatatcaaagagaccttatgattttcactttcagtttgttgtagtaaaattttcttaattttacaattgcagctatttgtcttccttattttcagcaacatatttagctatatgccttgtggttaatgttctttcctaattctgatgttgagatactttcttaatcgttttaat

SEQ ID NO: 12401 - DNA, 733 bp, Olea europaea
cttcaaatagcgaagaatagtctgagattaacgttcctcgaatcctctctttctccactccactcttctgcggagctttcgagaagtgagcactgagcagtgatctgtgtctgaagtgaagcagtgatggggctggcattcgggaagctcttcagcaggctctttgccaagaaagagatgcgaattctgatggtaggtctcgatgctgctggtaaaactaccatattatacaaactcaagcttggagaaattgtcactacaatcccaaccattggatttaatgttgagacagtggagtacaagaatattagcttcactgtgtgggatgttggtggccaagataagatccgtccattgtggaggcactacttccaaaatactcagggtctaatttttgtggttgatagcaacgacagggatcgagttgtcgaagcaagagatgaactgcatagaatgttgaacgaggatgaattgagggatgctgtcttgcttgtatttgctaataagcaagatctgccgaatgcaatgaatgctgcagaaattacagacaaacttggcctccactctcttcgtcaacgtcattggtacatccagagcacatgtgcaacctcgggggagggcctttatgaagggttggattggctttcaagcaacatcgctggcaaggcatgaagctgttaaggatttattattgctggttaatttttgcttggatcacttttatggaattggc

SEQ ID NO: 12402 - DNA, 837 bp, Allium cepa
aggtaaatcaaattcgtgattctttttatcagatccaagaggaaaacatgggtttggcctttggaaagttgtttagtagattgttcgcgaagaaagagatgaggattttaatggttggtctcgatgctgctggtaaaactacgattttgtataagttgaagcttggcgagatcgtcactacaattcccactattgggttcaatgtggagactgttgagtacaagaacattagcttcaccgtgtgggatgtcggaggtcaggataagattagacctctatggaggcattacttccaaaacacacaaggtctcatatttgttgttgacagcaatgacagagaccgtgttgttgaggctagagacgagctccacaggatgctcaatgaggatgagttgcgtgatgctgtcctacttgtatttgcaaacaaacaggatttgccgaatgcaatgaatgctgctgaaatcacagataagcttggcctgcactcccttcgtcagcgacactggtacattcagagcacatgtgctacatcgggggaggggttgtatgagggacttgactggctctccagcaacatcgctagcaagagctaaaacatccttgtatcaagcatgatcttgcggagccagtaaattaatattaacatgctatgttatttgtttctataaaggtagcagcagcccctttggtatattgcaattggacggttaaattatttatcaagaatattgtatcacataatccttttgtgttgttgacaattaaaacatcatctggtatttgattgtttctttatatatttgctttgtaacttaatgtttgttatgtactttgttt

SEQ ID NO: 12403 - DNA, 1288 bp, Musa acuminata
gcggggtaagcctgtgtacggagtcgtaggcgatgaggggatgagaggggaccggtgatcgaaatgggtttatttaaagaaaaataattacgctgctgtgtgggaaaactacaagtgcgatagtggattgattctccatcactcgtagtcacgtgataggacggtcgtctcccggcgaaccggggtggtcgcacgtgcgaaagccggcctttcgaccgataaatagaaaaccgacctttcctcaccccctctgcctcttcccatctcagagctcgagagctcgaaagcgcgaagccgcccgcccccacccgatcggccccccctctctgcctcccgcggagatctccagcttaggagcaatggggctcacgttcacgaagctgttcagtcgcctcttcgcgaagaaggagatgaggatcttgatggtgggtcttgacgctgctggtaagacgaccatcctctacaagctcaagctcggagaaattgtcaccaccattcccactatcgggttcaatgttgagactgtggagtacaaaaatattagcttcactgtttgggatgtcggaggtcaggacaagatcagacctctatggaggcattacttccagaacacacagggccttatttttgttgttgacagcaatgacagagatcgtgttgttgaggcgagggatgagctccacaggatgctgaatgaggatgaactacgggatgctgttttgcttgtttttgcaaacaaacaagatcttccgaatgcaatgaatgctgctgagatcacggacaaacttggtctgcattccctgcggcaacgacactggtacatccagagtacctgcgctacttctggtgagggtttgtatgaggggcttgattggctctccagcaacattgccagcaaggcttaaattgccaggaggtgcttgttgatatggtctctctcccgatgctggtcttgagtgctcaagggacattgagagccgacagaactattagaggaatttatgtggattattttacctcagcttttttgcatttacgtcttaagattttgcttgttcagaatgatttgagatgttggctaccttgtgttttctgttcatttctggttattttcgtaacagatgacatttgcttgttgagatcatcaccggcggataacatctttatggttgcttctcagcctgcttttctgtatttctcgggttttgatgccaattttgtgcgccatctcgttaagccaattcgttcttgacaactttagtgagtatgaatttgtgctaggaacaag

SEQ ID NO: 12404 - DNA, 893 bp, Cirsium arvense
tttcacagactccatttctctctctttctcttctctatctctctcttcgaatcgatcaattgatccatctccaacaagcttttctcagggatcctcaccagcaagaggatggggttaactttcaccaaactattcagccggctctttgccaagaaagagatgcgtatattgatggtgggtctcgatgcggctggtaagacaaccattttgtacaagctcaagctcggcgagattgtgaccaccatcccaaccataggttttaacgtggagactgttgagtacaaaaacataagcttcacagtgtgggatgttggaggtcaagacaagattcgtccactatggaggcattattttcagaacacacagggacttatctttgtggttgatagcaatgacagggacagagttgttgaggcaagagatgaattgcacaggatgttgaatgaggatgagttaagagatgcagttcttcttgtctttgctaacaaacaagatctcccaaatgcaatgaatgctgctgaaatcactgataagctcggcctccactccctccgacagcgccactggtacatccagagcacctgtgcaacctctggagaaggactttatgagggattggattggctttccagcaacatagcaagcaaggcatgagaagatgattgattttgttgtgagggtgggatgcaagttttgcttttaggttggccagtttatcgtcgtcgttgtttttgtgcttctgtgcactactactgcccgtggttttggaaacatgttcttttaaaaaaggtctttggcttttgatatagaagttatggatgtgtctaattgaatatattgtttgtttggattgcaagtattattattatgtgttaggttttgatttcacatat

SEQ ID NO: 12405 - DNA, 1203 bp, Coffea canephora
gggagaaggggcagacagatcgacctccttcgaaactagcggccctctatctctctctgcttcaaggaaatctttttcccactcgattccttctgccagactttatccaagaggtttccacattcggcagtgttgagtgatccgagcagagatggggcttaccttcactaagctgttcagcaggctgtttgccaagaaagagatgaggattctgatggtaggtcttgatgctgctggtaagactacaatactgtacaagctcaagcttggagaaattgtcactactattcctaccattggctttaatgttgaaactgtggagtataagaatattagcttcaccgtgtgggatgttggtggccaggacaagatccgtccattatggaggcactacttccaaaacacacagggtcttatatttgtggtggatagcaatgacagggaccgagttgttgaagctagggatgagctgcataggatgttaaatgaggatgaactgcgagatgctgtgttgctagtgtttgctaacaagcaggatctgcccaatgcaatgaatgctgcagaaattactgacaagcttggcctccattctctccgtcagcgccattggtacatccagagcacttgtgctacctctggggagggcctttatgaagggctggattggctttccagcaacattgctagcaaggcataaggcaagaaatcaatttgttcgcttgctgcttggataattgtgggattcaaggactgatactatcttgctttatgtgagactgaaacatggtagtgaccatactgttttgcccatttttcattctgtatcgtaactatgatgtagcagaagttgcttttaaagctcttctttggcttgatttttagctgcttgctttaaatgtagatgctttgttatctcgtttgaaacttataactactgtcattcaacttgcaaagtggtacgtgcctcatccaacttggaattgacgaaaaatatgacacatccaaatgttccaattggcggtgggggagccccgtaacttcattttcccaatagaggaccatgcacaacttggaggggacctatatcagaaagattttgatgctgctgctgagatcagtggatcacaattctattacataaagaatgaagctgttctgttaaaaatgggccttggtaactgggcagtctcagaagtaatgaaa

SEQ ID NO: 12406 - DNA, 939 bp, Pseudoroegneria spicata
ctctcgccccctcctgtttccgcccaccttctccggctccggcgccggcgaacccaccgcggatcgagcgattcctccgataaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccactatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacgcagggtctcatctttgttgtggacagcaacgatagggaccgtgttgttgaagcaagggatgagctccacaggatgctgaacgaggatgagttacgtgatgctgtgctgcttgtgtttgctaacaagcaagatcttccaaatgctatgaatgctgctgagatcactgataagcttggcctgcactcccttcgccagcgacactggtacatccagagcacttgtgctacaacaggggagggactgtatgaaggcctggactggctgtccagcaacattgccagcaagtcctaaatattcgtcaagattttgaaagagctaggagcgctttggatggacgattcaatcaccgggtacctagggattgtgttgggatgggatggtgctatgctattcccgtatgtaatgtgtattttcctgagatcaacagttactgagccagctccggctgtggtttcactgtcatactattgttttattgtattttgagccctaagatgtttctgaagtaaacagctaaagagagtcctgttcaatttcgtaataagtgttcaagca

SEQ ID NO: 12407 - DNA, 1106 bp, Saccharum officinarum
cccacgcgtccgggacgcgctccaccgccagaagcatcatcaccccagagcctctccttaccggtctccgcccgttgccttctccgtccccggctgcgtcgccggcgaacccaccaccgcgaatcggatccgccgacaaggcgagaggggagagatggggctcacgttcaccaagctgttcagccggctgttcgccaagaaggagatgcggatcctcatggtggggctcgacgccgccggaaagaccaccatcctctacaagctcaagctcggcgagatcgtcaccaccatccccaccatcggattcaatgttgaaactgtggagtacaagaacatcagcttcactgtctgggatgtcgggggtcaggacaagatcaggccgctgtggaggcattacttccagaacacacagggtctcatcttcgttgtggacagcaatgatagggaccgtgttgttgaagcaagggatgagcttcaccgaatgctgaatgaggatgagttgcgtgacgctgtgttgcttgtgtttgctaacaagcaagatcttccaaatgctatgaatgccgctgagattactgataagcttggactgcattcacttcgccagcgtcattggtacattcaaagcacttgtgctacaactggtgagggattgtacgaaggcctggactggctgtccagcaacattgcaagcaagtcctaaattttcaagcgaggtttggatcatctaggagcttttggatgatgatggtgctggatatttagggttgggttgatatttccgtatgtaagatgtatgccctgagctcaacagttattgagctctgcttaagatttcacagttaaattgttttatgtaatttgggccttgagatgtttctgaaccaaacagctaaaaagagttcagttgagttatggttgtcattacattccgagattctttcatggtccatatgttcataggatcacatcagaatgatggcgttttcgccaatggcatggattctgcacatctgctggtgtattgaaatgcatggcataaattgttttatgtaatttgaccttgagatgtttctgaaccaagcagctaaaaagtgttcagttgagtt

SEQ ID NO: 12408 - DNA, 823 bp, Sorghum bicolor
gcctctccttcccggtctccgcccgttgccttctccgtccccggctgcgtcgccggcgaacccaccaccgcgaatcggatcctccgacaaggcgagaggggagagatggggctcacgttcaccaagctgttcagccggctgttcgccaagaaggagatgcggatcctcatggtggggctcgacgccgccggaaagaccaccatcctctacaagctcaagctcggcgagatcgtcaccaccatccccaccatcggattcaatgttgaaactgtggagtacaagaacatcagcttcactgtctgggatgtcgggggtcaggacaagatcaggccgctgtggaggcattacttccagaatacacagggtctcatcttcgttgtggacagcaatgatagggaccgtgttgttgaagcaagggatgagcttcaccggatgctgaatgaggatgagttgcgtgacgctgtgttgcttgtgttcgctaacaagcaagatcttccaaatgctatgaatgcagctgagattactgataagcttggactgcattcacttcgccagcgtcattggtacattcaaagcacttgtgctacaactggtgagggattgtacgaaggcctggattggctgtccagcaacattgcaagcaagtcctaaattttcaagcgaggtttggatcatctaggagcttttggatgatgatggtgctggatatttagggttgggttgatatttccgtatgtaagatgtatgccctgagctcaacagttattgagctctgcttaagttttcacagttaaattgttttatgtaatttgggccttgagat

SEQ ID NO: 12409 - DNA, 895 bp, Brachypodium distachyon
gcccctgttcccgtcccgttctccggctccggcgccgccgaaccccaccgcggatcgagcgattcctccgatcaggagaggctaagcggggaggaagagaccacgcgggaggagaggagagatggggctcacgttcaccaagctgttcagccgcctgtttgccaagaaggagatgcggatcctgatggtgggtctcgacgccgccggaaagaccaccatcctctacaagctcaagctcggcgagatcgtcaccaccatccccaccatcggattcaatgttgaaacagtggagtacaagaacatcagcttcactgtctgggatgtcgggggtcaggacaagatcaggcctctctggaggcattacttccagaacacgcagggtctcatctttgttgtggacagcaacgatagggaccgtgttgttgaagccagggatgagcttcacaggatgctgaatgaggatgagttacgtgatgctgtgttgctggtttttgctaacaagcaagatcttccgaacgctatgaatgctgctgagattactgataagcttggactgcactccctccgccagcgacactggtacatccagagcacttgtgctacaactggtgagggattgtatgaaggcttggactggctgtccagcaacattgctagcaagtcctaagttctcgacaagattttgggtgaactaggagcttttggatggatcattcactgggtacctagggagggcttgggatgggttgctgctattaccgtatcatgtgtaatttcctgagctcgaccgtttttgagctctggctatgatttcacagttatattgttctactgtatgttgggctctgagatgtttctgaagtataaacagctaaagagagttctgttcaatttt

SEQ ID NO: 12410 - DNA, 1158 bp, Setaria italica
ccagccgttgcctcctccgtccccgcccgcgtcgccggcgatctcaccgcgaatcggatccgccgacaaggtgagccagccccctcccacccacccgctcctccccttgtaggatcgctctctctgcgtccgagatctaggcgaatgttcccttctcttcttgcgtttgcgctcgcttgggtgtatgtagatccgcgtgcggatctcggctcgggtcgttggtttcccgcgctgcgggtggaaggttccgcggttgctcgatcccgaggtggatctgggtgatgcgcgtgtagatctagcggcctgagcctgagggaaggacgggcgacgaatgaatcagcggtttgattttgagtttcgtgtttcaggcgagaggggagagatggggctcacgttcacgaagctgttcagccggctgttcgccaagaaggagatgcggatcctcatggtggggctcgacgccgccggaaagaccaccatcctctacaagctcaaactcggcgagatcgtcactaccatccccaccatcggattcaatgttgaaactgtggagtacaagaacatcagcttcaccgtctgggatgtcgggggtcaggacaagatcaggccgctgtggaggcattacttccagaacacacagggtctcatcttcgttgtggacagcaacgatagggatcgtgttgttgaagccagggatgagctccaccgaatgctgaatgaggatgaattacgtgatgctgtgttgcttgtgtttgctaacaagcaagatcttccgaatgctatgaacgctgctgagattactgataagcttggactgcactcacttcgccagcgtcactggtacattcaaagcacttgtgctacaactggtgagggattgtatgaaggcctggactggctgtccagcaacattgccagcaagtcctaaattttcgagaggtttggaccatctaggagcctttggatgatgatattgctggatatttagggttgggttgctattcccgtatgtaaggtgtatgccctgagctcaatagttattgagctttggttaagatttcacagttaaattgttttgtgtaatttgggcccttgagatgtttccgaaccaaacagctaaagagagttccgttgagttaattggttgggggaatgcgt

SEQ ID NO: 12411 - DNA, 903 bp, Leymus cinereus x Leymus triticoides
ggcgccggtgaacccaccgcggatcgagcgattcctccgatcaggagaggcgagccgggaggaagagcacctacgcgggaggagaggagatggggctcacgttcaccaagctgttcagccgcctgttcgccaagaaggagatgcggatcctaatggtgggtctcgacgccgccggaaagaccaccatcctctacaagctcaagctcggcgagatcgtcaccaccatccccaccatcggtttcaatgttgaaactgtggagtacaagaacatcagcttcactgtctgggatgtcgggggtcaggacaagatcaggccactgtggaggcattacttccagaacacgcagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgagggcctggactggctgtccagcaacattgccagcaagtcctaaattttcgtcaagattttgaaagagctaggagcgctttggatggaagattcaatcaccgggtacctagggattgtgttgggatgggatggtgctatgctattcccgtatgtaatgtgtattttcctgagatcaacagttactgagccagctccggctgtggtttcactatcatactattgttttattgtattttgagccctaagatgtttctgaagtaaacaactaaagagagtcctgttcaatttcgtaataagtgttcaagcatcta

SEQ ID NO: 12412 - DNA, 940 bp, Avena sativa
ggccactctctccctcgtttctctctcgcgcgcccctgtttgttcccgtccccttccttctccggctcctgcgccggcgaacccaccgcggatcgagcggttcctccgatcaggagaggccaggcggtaggaagagagtacctgcccgggaggagaggagatggggctcacgttcaccaagctgttcagccgcctgttcgccaagaaggagatgcggatcctgatggtgggtctcgacgccgccggaaagaccacaatcctctacaagctcaagctcggcgagatcgtcaccaccatccccaccatcggattcaatgttgaaactgtggagtacaagaacatcagcttcacagtctgggatgtcgggggtcaggacaagatcaggccattgtggaggcattacttccagaacacgcagggtctcatctttgttgtggacagcaacgatagggaccgtgttgttgaagccagggatgagctccacaggatgctgaatgaggatgagttacgtgatgctgtgttgcttgtgtttgccaacaagcaagatcttccaaatgctatgaatgctgctgagattaccgataagcttggactgcactcccttcgccagcgacactggtacatccagagcacttgtgctacaacaggtgaaggattgtatgaaggcctggactggctgtccagcaacattgctagcaagtcctaaattttcgtcaagattttggagctaggagctttggatggatcattcaccggatacctagggattgggttgggatgggatgctattccccgtatgtaatgtgtatttcctgagatcaacagttacttgagctccggctgtggtttcactgttatattgttttgttgtattttgtgccctaagatgttcctgaagtaaacagctaaagagagtcctgttcaatttattggtcttcgt

SEQ ID NO: 12413 - DNA, 839 bp, Avena sativa
tctctccctcgtttctctctcgcgcgcccctgtttgttcccgtccccttccttctccggctccggcgccggcgaacccaccgcggatcgagtgattcctccgatcaggagaggccaggcgggaggaagagagtacctgcccgggaggagaggagatggggctcacgttcaccaagctgttcagccgcctgttcgccaagaaggagatgcggatcctgatggtgggtctcgacgccgccggaaagaccacaatcctctacaagctcaagctcggcgagatcgtcaccaccatccccaccatcggattcaatgttgaaactgtggagtacaagaacatcagcttcacagtctgggatgtcggaggtcaggacaagatcaggccattgtggaggcattacttccagaacacgcagggtctcatctttgttgtggacagcaacgatagggaccgtgttgttgaagccagggatgagctccacaggatgctgaatgaggatgagttacgtgatgctgtgttgcttgtgtttgctaacaagcaagatcttccaaatgctatgaatgctgctgagattaccgataagcttggactgcactctcttcgccagcgacactggtacattcagagcacttgtgctacaacaggtgaaggattgtatgaaggcctggactggctgtccagcaacattgctagcaagtcctaaattttcgtcaagattttggagctaggagctttggatggatcattcaccggatacctagggattgggttgggatgggatgctattccccgtatgtaatgtgtatttcctgagatcaacagttacttgagcttcggctgtg

SEQ ID NO: 12414 - DNA, 990 bp, Secale cereale
cttaaatacgacgccgcaggccccaacgcctggccactctctcccccttctctctcgcgacctcctgtttccgcccaccttctccggctccggcgccggcgaacccaccgcggatcgagcgattcctccgatcaggagaggccagccgggaggaacagcacctacgcgggaggagaggagatggggctcacgttcaccaagctgttcagccgcctgttcgccaagaaggagatgcggatcctgatggtgggtctcgacgccgccggaaagaccacgatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacgcagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgccacaacaggggagggactgtacgaaggcctggactggctgtccagcaacattgccagcaagtcctaaattttcgtcaagattttgaatgggagctaggagggctttggatggacgattcaatcacctagggattgtgttgggatgggatggtgctatgctattcccgtatgtactgtgtattttcctgagatcaacagctactgagccagctccggctgtggtttcactgttatactattgttttattgtattttgagccctaagatgtttctgaagtaaacagctaaagagagtcctgttcaatttcgttcgtaataagtgttcaagcat

SEQ ID NO: 12415 - DNA, 1055 bp, Secale cereale
actctctcccccttctctctcgcgacctcctgtttccgcccaccttctccggctccggcgccggcgaacccaccgcggatcgagcgattcctccgatcaggagaggccatccgggaggaacagcacctacgcgggaggagaggagatggggctcacgttcaccaagctgttcagccgcctgttcgccaagaaggagatgcggatcctgatggtgggtctcgacgccgccggaaagaccacgatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacgcagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgccacaacaggggagggactgtatgaaggcctggactggctgtccagcaacattgccagcaagtcctaaattttcgtcaagattttgaaggagagctaggagggctttggatggacgattcaatcacctagggattgtgttgggatgggatggtgctatgctattcccgtatgtactgtgtattttcctgagatcaacagctactgagccagctccggctgtggtttcactgttatactattgttttattgtattttgagccctaagatgtttctgaagtaaacagctaaagagagtcctgttcaatttcgttcgtaataagtgttcaagtatctatctatctattcctgcatatatatattcagcagtgctccaaaaaaaaaaaaaaactagagactagtccgaacggacgacacacgggaggtaaggcgac

SEQ ID NO: 12416 - DNA, 1020 bp, Secale cereale
cgttcaaccgacgcgacccgtacaacacaagcgctggctctccaccctcgcgtcgcttaaatacgacgccgcaggccccaacgcctggccactctctcccccttctctctcgcgacctcctgtttccgcccaccttctccggctccggcgccggcgaacccaccgcggatcgagcgattcctccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccacgatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacgcagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgccacaacaggggagggactgtatgaaggcctggactggctgtccagcaacattgccagcaagtcctaaattttcgtcaagattttgaaggagagctaggagggctttggatggacgattcaatcacctagggattgtgttgggatgggatggtgctatgctattcccgtatgtactgtgtattttcctgagatcaacagctactgagccagctccggctgtggtttcactgttatactattgttttattgtattttgagccctaagatgtttctgaagtaaacagctaaagagagtcctgttcaatt

SEQ ID NO: 12417 - DNA, 991 bp, Secale cereale
actctctcccccttctctctcgcgacctcctgtttccgcccaccttctccggctccggcgccggcgaacccaccgcggatcgagcgattcctccgatcaggagaggccagccgggaggaacagcacctacgcgggaggagaggagatggggctcacgttcaccaagctgttcagccgcctgttcgccaaaaaggagatgcggatcctgatggtgggtctcgacgccgccggaaagaccacgatcctctacaagctcaagctcggcgagatcgtcaccacgatccccaccatcgggttcaatgttgaaactgtggagtacaagaacatcagcttcactgtctgggatgtcgggggtcaggacaagatcaggccactgtggaggcattacttccagaacacgcagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgccacaacaggggagggactgtatgaaggcctggactggctgtccagcaacattgccagcaagtcctaaattttcgtcaagattttgaaggagagctaggagggctttggatggacgattcaatcacctagggattgtgttgggatgggatggtgctatgctattcccgtatgtactgtgtattttcctgagatcaacagctactgagccagctccggctgtggtttcactgttatactattgttttattgtattttgagccctaagatgtttctgaagtaaacagctaaagagagtcctgttcaatttcgttcgtaataagtgttcaagtatctatctatctattcctgcatatatatattcagcagt

SEQ ID NO: 12418 - DNA, 1480 bp, Panicum virgatum
atccggctgaatccgccagccgaacaaggcactggaagagaataaattttctagggtttcaggatgggcttcgggcttttatagtgaggagagatactcgtgggctgttatagacattgggctgggctaaaaatttaaattgggccgaatttttttggccggtttaattttattttgggtcttaccgaattggacgaatttcggtgaaattcggcccattcggtccgaatcccaaaaccctggtaacgcatagattttgctaaattctctttgtaatccgcattctaaaagtgttttttctccgttagctgccgtcgaatacacacatgcggtggaggtgagacgcgttcggttgacgcgaccaagggttggctcgctcctctgggcccgtataaaataggcgaagacgcgcacctccgccccaagcaacaacacccggtgcgcctctccttccccgtctccggccgttgcctcccccgtctccggctgcgccgccggcggtctcaccgcgaatcggagccgacaaggcgagagggaagagatggggctcacgttcaccaagctgttcagccggctgttcgccaagaaggagatgcggatcctcatggtggggctcgacgccgccggaaagaccaccatcctctacaagctcaagctcggcgagatcgtgaccaccatccccaccatcggattcaatgttgaaactgtggagtacaagaacatcagcttcactgtctgggatgtcgggggtcaggacaagatcaggccactgtggaggcattacttccagaacacacagggtcttatcttcgttgtggacagcaacgatagggaccgtgttgttgaagccagggatgagctccaccggatgctgaacgaggatgagttacgtgatgctgttttgcttgtgtttgctaacaagcaagatcttccaaatgctatgaacgctgctgagattactgataagcttggactgcactcacttcgccagcgtcactggtacattcaaagcacctgtgctacaactggggagggattgtatgaaggcctggactggctgtccagcaacattgccagcaagtcctaagttgtcgagaggtttggatcatctaggagcttttggatgatgatatttctgggtatctagggttgggttgcgattcccgtatgtaaggtgtatgccctgagctcaatagttattgagctttggttaagatttaacagttaaattgtttttgtgtaatttgggccttgagatgtttcgaaacaaacagctaaagagttccgtggagctaattggttggggaatgcgtgccagtacgttatgagattttttcatgctccatatgttaaaacaccattagttttttgagatttttccatactccatatatgttaaaacaccagaatgagttcgtcctatcctatgtgttctggaaaaaaaaagtgcggccgaagcaaaaaaaaaacagctttgcca

SEQ ID NO: 12419 - DNA, 1133 bp, Triticum aestivum
gcgttcaaccgacgcgacccgtacaacacaagcgctggctctccaccctcgcgtcgcttaaatacgacgccgcaggcccaacgcctggccactctctcccccttctctctcgcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccagcaagtcctaaattttcgtcaagattttgaaggagctaggagcgctttggatggacgattgaatcaccgggtacctagggattgtgttgggatgggatggtgctatgctattcccgtatgtactgtgtattttcctgagatcaacagttactgagccagctccggctgtggtttcactgtcatactattgttttattgtattttgagccctaagatgtttctgaagtaaacagctaaagagagtcctgttcaatttcgtaataagtgttccaagcatctgtctgtctatctatgcctgtatatattcagcactgctcaacttttatttgcgcatttgttggtagcaccccggaagaagataag

SEQ ID NO: 12420 - DNA, 1032 bp, Triticum aestivum
catcgctgtctggaacagcgatgactcgagaaccggaatgcagtaaacaccagaagcatcaaaactatgatgcactctctcccccttctctctcgtgacctcctgtttccgcccaccttctccggctccggcgccggcgaacccaccgcggatcgagcgattcctccgatcaggagaggccagccgggaggaagagcacctacgcgggaggagaggagatggggctcacgttcaccaagctgttcagccgcctgttcgcgaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccagcaagccctaaattttcgtcaagattttgaaggagctaggagcgctttggatggacgattgaatcaccgggtacctagggattgtgttgggatgggatggtgctatgctattcccgtatgtactgtgtattttcctgagatcaacagttactgagccagctccggctgtggtttcactgtcatactattgttttattgtattcgagccctaagatgtttgtgaagtaaacagctaaagagagtcctgttcaatttcgtaataagtgttcaagcataact

SEQ ID NO: 12421 - DNA, 1092 bp, Triticum aestivum
tcatcgctgtctggaacagcgatgactcgagaaccggaatgcagtaaacaccagaagcatcaaaactatgatgcactctctcccccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccagcaagccctaaattttcgtcaagattttgaaggagctaggagcgctttggatggacgattgaatcaccgggtacctagggattgtgttgggatgggatggtgctatgctattcccgtatgtactgtgtattttcctgagatcaacagttactgagccagctccggctgtggtttcactgtcatactattgttttattgtattcgagccctaagatgtttgtgaagtaaacagctaaagagagtcctgttcaatttcgtaataagtgttcaagcatctatctacctatctattcctgtatatatttcagcactgctccacttttattgcgcatttgtta

SEQ ID NO: 12422 - DNA, 885 bp, Echinochloa colona
ccggcgatctcaccgcgaatcggatccgccgacaaggcgagaaggaagagatggggctcacgttcaccaagctgttcagccggctgttcgccaagaaggagatgcggatcctcatggtggggctcgacgccgccggaaagaccaccatcctctacaagctcaagctcggcgagatcgtgaccaccatccccaccatcggattcaatgttgaaactgtggagtacaagaacatcagcttcactgtctgggatgtcgggggtcaggacaagatcaggccactgtggaggcactacttccagaacacgcagggtctcatcttcgttgtggacagcaacgatagggaccgtgttgttgaagccagggatgagctccaccgaatgctgaatgaggacgagttacgtgatgctgtgttgcttgtgtttgctaacaagcaagatcttccaaatgctatgaatgctgctgagattactgacaagcttggactgcactcacttcgccagcgccactggtacattcaaagcacttgtgctacaactggtgagggattgtatgaaggcctggactggctatccagcaacattgccagcaagtcctaaattttcaagaggtttggatcatctaggagcttttggatgatgatattgctggatatttagggttgggttactattcccgtatgtaaggtgtatgccctgagctcaatagttattgagctttggttaagatttcacagttaaattgttttgtgtaatttgggccttgagatgtttccgaaccaaacagctaaagagagttccgttgagttaattggtgggggaaatcgtgccagtaagcagtatcaacattgccattgagattctttcgtgctccatatgttaaaacgcc

SEQ ID NO: 12423 - DNA, 960 bp, Avena sativa
ctctcgcgcgcccctgtttgttcccgtccccttccttctccggctccggcgccggcgaacccaccgcggatcgagtgattcctccgatcaggagaggccaggcgggaggaagagagtacctgcctgggaggagaggagatggggctcacgttcaccaagctgttcagccgcctgttcgccaagaaggagatgcggatcctgatggtgggtctcgacgccgccggaaagaccacgatcctctacaagctcaagctcggcgagatcgtcaccaccatccccaccatcggattcaatgttgaaactgtggagtacaagaacatcagcttcacagtctgggatgtcgggggtcaggacaagatcaggccattgtggaggcattacttccagaacacgcagggtctcatctttgttgtggacagcaacgatagggaccgtgttgttgaagccagggatgagctccacaggatgctgaatgaggatgagttacgtgatgctgtgttgcttgtgtttgctaacaagcaagatcttccaaatgctatgaatgctgctgagattaccgataagcttggactgcactctcttcgccagcgacactggtacattcagagcacttgtgctacaacaggtgaaggattgtatgaaggtctggactggctgtccagcaacattgctagcaagtcctaaattttcgtcaagattttggagctaggagctttggatggatcattcaccggatacctagggattgggttgggatgggatgctattcccccgtatgtaatgtgtatttcctgagatcaacagttacttgagcttcggctgtggtttcactgttatattgttttgttgtattttgagccctaagatgcttctgaagtaaacagctaaagagagtcctgttcaatttattggtcttcgtaataatccttcaagttgttcatatttgtattcagtgttttg

SEQ ID NO: 12424 - DNA, 1068 bp, Avena sativa
tatgtccgcctgactctctccctcgtttctctctcgcgcgcccctgtttgttcccgtccccttccttctccggctccggcgccggcgaacccaccgcggatcgagtgattcctccgatcaggagaggccaggcgggaggaagagagtacctgcccgggaggagaggagatggggctcacgttcaccaagctgttcagccgcctgttcgccaagaaggagatgcggatcctgatggtgggtctcgacgccgccggaaagaccacaatcctctacaagctcaagctcggcgagatcgtcaccaccatccccaccatcggattcaatgttgaaactgtggagtacaagaacatcagcttcacagtctgggatgtcggaggtcaggacaagatcaggccattgtggaggcattacttccagaacacgcagggtctcatctttgttgtggacagcaacgatagggaccgtgttgttgaagccagggatgagctccacaggatgctgaatgaggatgagttacgtgatgctgtgttgcttgtgtttgctaacaagcaagatcttccaaatgctatgaatgctgctgagattactgataagcttgggttacattctctacggcagcgacactggtacatacagagcacttgtgccacatctggtgagggtttgtatgagggtttggactggctatccagcaacattgccagcaaggcttgatgcttggaattatcgaggccctcaaatcaacttggagctgtggatgtacttgtgatcctcagggtccttgttcgctgctatttcagtctcttagacattgcatacgctaagatattttttgagctcgttataacccaggatttgaatgttccctgtagttttcaaatgttgcacatttcccccttttacttctaggcctttccagtaccatgtctgctctgctattcttgaagtctaaggaacttgtcttgatgtttacacgccaacttagtctgaaaattgcttatgtatagcgtgttgctttcgtgaaatggtcgagtgacgagatattatgagtgcaggttgtactagaat

SEQ ID NO: 12425 - DNA, 1065 bp, Amaranthus tuberculatus
ccgcccatacattattcaaactttaaatcgggctgctttctcttcttctgcccgccgtccgttgttgtagccctaatttttctatctttgatttgcagatttgacagaaaatggggctttcgttcggaaagttgttcagtaggttatttgcgaagaaagaaatgagaattttgatggttggtctagacgccgctggtaagaccaccattttgtataagcttaagctcggagagattgttaccaccattcctactattggattcaatgttgagactgtggaatacaaaaacattagctttactgtttgggatgttgggggtcaagacaagattcgacctttgtggagacattactttcaaaacacccaaggactcatctttgtggtcgatagcaatgaccgtgaccgtgttgttgaagcaagagatgagctgcacaggatgttgaatgaggatgagttgagggatgctgttctgctggtatttgccaacaagcaggatcttccaaatgcaatgaatgctgctgagattactgacaaacttggtctccactccctccgccagcgtcattggtatatccagagcacatgtgccacttctggtgaaggtctgtacgagggattggactggctttccaacaacattgcgagcaaggcatagattacaggaatgtcccagcagaggttaggatgaagtaaatgttggattttgcagcacctgctcaagtgggagaacaatgtggagcgtttagttttttttttctttgcatgttgaagatcacggtgatttttgtgtcaatgtgattatgtggttatgaagatttttgttatgattacagaaattctatatcaatactattgtagattcagaataactaaaatgtatctcaggaaagcttttgtttcatgtttatatatactgtgacagcgatattctttggaaccagctatggtagttccgttccattcttcaattctaagttctatctactactatatattttcatataatttctgcatatcagtataatttgtacaattctataatattatttttgtcttgaaggggg

SEQ ID NO: 12426 - DNA, 1125 bp, Amorphophallus konjac
gggggattttgccatttttcttcttctttccggttcccgtctgcttttggaagaggagggagaggagaagagaggaccagcaccgaggccggagcccctcctccccatttcgatatcgccgccgcggcctgcgcaggtcccccccatccgcatcggtgaaagatggggctgacgttcactaaactcttcagccggctcttcgccaagaaggagatgaggatcctgatggttgggcttgatgccgccggtaagacgaccatactttacaagctcaagctcggagagatcgtcaccaccatccccaccatcggttttaacgtagagactgtggagtacaagaacattagtttcactgtctgggatgttggtggtcaggacaagatcagaccactctggagacactacttccagaacacacaaggccttatttttgttgtggacagcaatgatagggatcgtgttgttgaggcaagggatgagcttcacaggatgctgaatgaggatgagctgcgagatgctgtgttacttgtctttgcaaacaagcaagatcttccaaatgcaatgaatgctgctgaaatcactgataagcttggtctgcattccctacgtcagcggcactggtatatccagagcacctgtgcaacttctggcgaagggctgtatgaggggctggattggctctccagcaacatcgccagcaaggcttgaaattctcatggtgtcagctgagcagttaaacattggaggatacaacatggttcgtgcgcaaaaataggagaatcttggagcgtttctgggttgctactggatttcattactttctttggttatttttcattttgttgtctcagatattgaagaaaagaaaaactctgcggttattgttagtatcttacttgctccgcataatagttatctctatgtaagtgcttacagagtgatttgttgttaaaagtttttgtggattagtttgtagttatcttaattctccagatcatttatgcaatttcttttgccaagaacatacacaactttacactggagataacatgctaaggctcttctgattccatcattgaactttgtaaaattagagatgataaatatctgataggaaggaatgct

SEQ ID NO: 12427 - DNA, 625 bp, Cirsium arvense
ctctctctcagggatcctcatcagaaaaaggatggggcttacattcaccaaactcttcagccggctctttgccaagaaagagatgcgcatattgatggtgggtctcgatgcagctggtaagacaaccattttgtacaagctcaagctcggcgagatcgtgacaacaattcctaccattggttttaatgtggagactgttgagtacaaaaacataagcttcacagtgtgggatgtgggaggtcaggacaagattcgtccactatggaggcactacttccagaacacccagggtcttatctttgtggttgatagcaatgacagggacagagttgttgaggcaagagatgagttgcataggatgttgaatgaggatgagctaagagacgctgttctccttgtatttgccaacaaacaagatctgcctaatgcaatgaatgctgctgaaatcactgataagcttggcctccactccctccgacagcgccactggtacatccagagcacctgtgccacctctggggaaggactttatgagggattggactggctctccagcaacattgcaagcaaggcttaaggtgatgattggattgtattttgagggtggatactggaggcaggtttt

SEQ ID NO: 12428 - DNA, 1487 bp, Sorghum bicolor
gaaaaaaagagttcacgaagcgtcggttgcacgttggagcttcaaacgaggagcgcacgcccacctctcctggacccgttccacctgcaccgcagcctacccgcacgccaccatcccccacgggctcacgtagactgggcccagcctccgccccaccaaccccgcctccccccacctctttttgaagcccagaggcgccccccggcccgggcatcgaccactcgtctctttttcttcgccccgcctgaagccgaggaggagagggagaggggagcagcgagatcgcgcgcgcctccgagatctccacgaaggtgtggcaatatggggctcagcttcacgaagctctttagccggctctttgccaagaaagagatgaggatccttatggtcggtctcgatgcagctggtaagaccaccatcctctacaagctcaagctcggagagatcgtgaccaccatccctacaatcgggtttaatgtggagactgttgaatacaagaacattagcttcactgtctgggatgtcgggggtcaggacaagatcaggccattgtggaggcactatttccagaacacccaaggccttatctttgttgttgatagcaatgacagagatcgtgttgttgaggcaagggatgagctccacaggatgctgaacgaggatgagttgagggatgctgtcttgctcgtttttgctaacaagcaagatctgccaaatgcaatgaatgctgctgagatcaccgataagcttggtctccattccttgcgccaacgtcactggtatatccagagcacttgtgctactacaggagaaggtttgtacgagggtcttgactggctctccagcaacattgcaaacaaggcctgattggacgattctgcggtttcatggagcacatggcgaggcattttctgcagaaacggagccatggtcattttgacctgacctgtttgtttcgctgaaatttggctgatgttgctgcttatgctgatttgttgagaagagaaaaatatttgttgtttcattgaaatgttaagtattgtatttctttgctaggcttttcagagagctggtttgttatgttgcgtgattactctctaaaaacctgttccgatatcaagactgtaattggccattggcactagtagatcgtttatactgagtaatgcagtttaaaatattaatgcatcacaattgtgctgtacgatacaactttacattcttctctgtgtgtatcggactttccagttaatctggatggatgttaacgataacgagtcgtattgtgggtatatataattagttccatacatatatatatggttcctggcaatagcttattcttgacaaagggtctagttcctcttgctaaattttacctagcgaaactttagtcaatttagctaaacttctaaatacactgatatctaaaatagttttactgggctaaaatttagcaagggatccaaacacacacagtttcacag

SEQ ID NO: 12429 - DNA, 1012 bp, Amorphophallus konjac
attactccttttataaatagtttccattccttccattttgttttagctcgcttctgtttcggaggaagagcccaaggagggcgatagggagggagccccacgccgaagcctcctccccatctcgtttccacatcctctgttcgttgctgtactcccttccgcccacctcttctggtgagcgaagatggggctaacgttcacgaagctcttcagccggctcttcgccaagaaggagatgaggattcttatggttgggcttgacgcagctggtaagacgaccatcctctacaagctcaagcttggggagatcgtcaccaccatacccaccatcggttttaatgtggagactgtggaatataagaatattagtttcactgtttgggatgttggtggtcaggacaagatcaggccactttggaggcactacttccaaaatacacagggcctcatttttgttgttgacagcaatgatagagatcgtgttgttgaggcaagggatgaactgcacaggatgctaaatgaggatgagttacgagatgctgtgttgcttgtatttgcaaacaagcaagatcttccaaatgcaatgaatgctgctgaaatcactgataagcttggacttcactccctacgccaacgacattggtatatccagagcacctgtgctacttctggtgaggggctgtatgaggggttggattggctctccagtaacattgccagcaaggcttgatgttctcatggtgtcaacatagaagcatatcagaggtttccaacatggttaatatctgagaaactgactcataaaaccttttctggtttgctactgaatttctcttccgtcatttggatttcttcccttttgttgttgcttgcaccaatgttggaaaattctgtcactttcaaaagaaatgttggaaatttctgtagtaatggtaatattttggttgtcatagactaattaattaatttacttacttactaactaagtacggtgggtaggacgaacggacaa

SEQ ID NO: 12430 - DNA, 822 bp, Allium cepa
aattcaaatctaagatctgaaaggaaacaatggggttggcatttgggaaattgttcagtaaattgttcgcgaagaaagaaatgagaattttgatggttggtctcgatgcagctggtaaaactacaattttgtacaagttgaagcttggcgaaatcgttactacgatacctactattgggttcaatgttgagaccgttgagtacaagaacattagcttcactgtgtgggacgtaggaggtcaagacaagattagacctctttggaggcactacttccagaacactcaaggcctcatctttgttgttgacagtaacgacagagaccgtgttgttgaggccagagatgagcttcataggatgctcaatgaggatgagttgcgagatgctgtcttgcttgtatttgcaaacaaacaggatctgcctaatgcaatgaatgctgctgaaatcactgataagcttggccttcactcccttcgccagcgacactggtacattcagagtacatgcgctacatccggggagggattgtatgaaggacttgactggctgtccagcaacattgctagcaagagttaaacttcctgcggtgccatcatcttgaagagctaggaaattaatattgaaagtcatggtcatttgcttgtaaaaaggcgatatatgccttttgaatgttgcaaaatggttcggcagtcaaaatctattgcttttgtggattttttttatcagtttgttattaacacagtatttgtttgtaatgtagctgtactgaactgtatcttgcttgaattggcttatttctatattttactatattttgacttta

SEQ ID NO: 12431 - DNA, 794 bp, Allium cepa
agatcgaattcaaatctaagatctgaaaggaaacaatggggttggcatttgggaaattgttcagtaaattgttcgcgaagaaagaaatgagaattttgatggttggtctcgatgcagctggtaaaaccacaattttgtacaagttgaagcttggcgagatcgttactacgattcccactattggattcaatgttgagaccgtcgagtacaagaacattagcttcactgtgtgggatgttggaggtcaagacaagattagacctctttggaggcactacttccagaacactcaaggcctcatttttgttgttgacagtaatgacagagaccgtgttgttgaggccagagatgagcttcataggatgctcaatgaggatgagttgcgagatgctgtcttgcttgtgtttgcaaacaaacaggatcttccgaatgcaatgaatgctgctgaaatcactgataagcttggccttcactcccttcgccagcgacactggtacattcagagtacgtgtgctacatctggggagggattgtatgaaggacttgactggctctccagcaacattgctagcaagagttaaacttcctgtggtgccatcatgttgaagagctaggaaattaatattgaaagtcatggtcatttgcttgtaaaaaaggtgatatatgccttctgaatgttgcaaaatggttcggcagtcaaaatctattgcttttgtgggtttttttaatcagtttgttgttaacacagtatttgtttgtaacgtagttgtactgaactgtatcttgcttgaatt

SEQ ID NO: 12432 - DNA, 996 bp, Platanus occidentalis
agatctctcgccttgctcatttcattttcaagcccgagtttcggtagactttcttctccgatcgccgctagccttattttgtccgatctcctccagtcactggtaggctttcttctacgatcttgtctggtcgccgatctgcatttggtgatctgactgatttgtaacaatggggctcacattcgggaaactctttagccgcctctttgcgaagaaggagatgaggatccttatggtcggccttgatgcggctggtaaaacgacgatcctctacaagctcaagctcggagagatcgttaccaccattcccaccattggtttcaatgtagagacagtggagtacaaaaacatcagctttactgtctgggatgttgggggtcaggataagatcagaccactatggaggcactatttccaaaatacacagggtcttatctttgttgttgacagcaatgatagagaccgtgtagttgaggcaagggatgagctccaccgaatgctgaatgaggatgaattacgagatgctgtcttgcttgtttttgccaataagcaagatctgcccaacgcgatgaacgctgctgaaattactgataagcttggtctacattctctgcgtcagcgacattggtacattcagagcacctgtgctacatctggtgagggactgtatgaagggttggattggctttctagcaacattgccaacaaggcatgacctctatcattcactatgctggcggagaattagagaattatgctgcaggcgtttctctctcatacaaatggattgaacactcatgatgtgtgtgtgtgttttttttttttttttttaccttcactgattataccctttgaagaatagaattgtttgattttctctctccttagcccttacgtttatttcagctttaattttttttaacctctcaactgacttgctcctgctttgtagaacttctaaatttttagaatgtctgcaaatatagtttctacatg

SEQ ID NO: 12433 - DNA, 867 bp, Arabidopsis thaliana
aaaaacaaaaaaatcatcgtgaaacgttcgaaggccattttctttggacgaccatcggcgttaaggagagagcttagatctcgtgccgtcgtgcgacgttgttttccggcttgatcaaaatggggttgtcattcggaaagttgttcagcaggctctttgcgaagaaagagatgcgtattctgatggttggtctcgatgctgctggtaagacgactatcctctacaagctcaaacttggagagatcgtcaccactattccaaccattgggttcaacgttgagactgttgaatacaagaacatcagcttcaccgtgtgggatgttgggggtcaagacaagatccgtccattgtggagacattacttccagaacacacagggacttatctttgttgtggacagcaatgatcgtgaccgtgttgttgaagccagggacgagcttcacaggatgctgaatgaggatgaattgagggatgcagttctgcttgtatttgctaacaagcaagatcttcccaacgcgatgaacgctgctgagataactgacaagcttgggcttcattctcttcgtcaacgacactggtacattcagagcacatgtgccacctctggagaaggactctatgagggacttgactggctctccaacaacatcgcaagcaaggcatagatggaatgttagccagattcctcttctgcttgtttggtttacaaatcaaagacagaggtctgtttctctagtactaaaagatttattattatattcttcttcgtcacttatctcaaacgcagatcattttacactttgtacttccccttcaataacttgttacttctctcgtttgcttcctgaatttgagtatatcattttt

SEQ ID NO: 12434 - DNA, 907 bp, Gossypium raimondii
tttttgagcaaattattttttatatgccacgaattaaataaaacagcagagaaataaacggggggactctctcaagaaaaccacaacagatttcagatcctccttccaagctctgcagaaagaaagtggaaagcaacgatggggctgacatttacaaagctctttagccggctttttgccaagaaagagatgcgtattttaatggtgggtcttgatgcagctggtaaaaccaccattttgtacaagctcaagctcggcgaaatcgtcaccacaatccccaccattggattcaatgttgagactgtggaatacaagaacatcagcttcactgtttgggatgttggtggtcaggacaagattcgtcctttatggaggcactatttccagaatactcagggtctcattttcgtggtggatagcaacgacagggaccgtgttgttgaggcaagagatgagttgcacaggatgttgaatgaggatgaactgagagatgctgttttgcttgtatttgccaacaagcaagatcttcccaatgcaatgaatgctgccgaaataactgataagcttggtcttcattctctccgtcagcgccactggtatatccagagtacgtgtgcaacttctggggaaggcctctatgagggccttgattggctttccagcaacattgctagtaaggcatgagaaaggatcagtgtattggttgttagttagacttgttgaaactctggcaactcttgaagaggatatagcttcctgtttatccagcaacgtttgtaatgacagaatatctagctttgtttaatctttttacttggaattttcattttctttaatgtatttgtgttaaatattcggacttgttatggtttatatcggaaaaaaaaatagtaacattgcatgtcaa

SEQ ID NO: 12435 - DNA, 808 bp, Antirrhinum majus
attctcttcagacaaaaaaatggggttatctttcggcaagcttttcagtcggctatttgccaagaaggagatgaggattcttatggtaggtctagatgctgctggtaagaccactatattgtacaaactgaagctgggagaaatagtgacaacaattcccaccattggattcaatgtggagactgtggaatacaagaacataagcttcactgtctgggatgttgggggtcaagacaagatccgaccattgtggaggcattactttcagaatactcaagggctgatctttgtggttgacagtaatgatagagatcgtgttgttgaggctagggacgagctgcataggatgttaaatgaggatgaactgagggatgcagtgcttcttgtttttgcaaacaaacaagatcttccaaatgccatgaacgctgctgaaataactgacaaacttgggcttcattcgctccgccaacgtcattggtatatccagagcacatgtgctacctctggggaaggtctatatgaggggctggactggctctccaacaacattgctaacaaggcttaagaagagatgtcagatggattttgctgtctcaatccttgttgaaatggcgatcatggtttacgttttgcgcctttggttcaaagaatctctgtacttcgattgctttttcttccatagatgttaacttgctattatgtagattcagactcttcacttttgtaactcgatttgacttattgttgaagccttgaaggatatttctgtctccttaacatgcatgtgcgtatagaaatcttatgcatt

SEQ ID NO: 12436 - DNA, 881 bp, Brassica juncea
gggcgtcgcggatctctatctctctctctccctctctcgattccgaaactattccgcagagtgaagaaggatggggttgtctttcgggaagcttttcagcaggctttttgccaagaaggagatgaggattctgatggttggtcttgatgctgctggtaagaccaccatcttgtacaagctcaagctcggagagattgtcaccaccattcccactattgggttcaatgttgaaactgttgagtacaagaacatcagcttcacagtgtgggatgtcgggggtcaagacaagattcgtccattgtggaggcactacttccagaacactcaaggactcatctttgtggtggatagcaatgacagagaccgtgttgttgaggctagagatgaattgcacagaatgctcaatgaggatgagctgcgtgatgctgttctgctcgtgtttgctaacaaacaggatcttccaaatgccatgaacgcagctgagatcactgataagcttggtctccactctctccgtcagcgtcactggtacatccagagcacatgtgctacttcaggcgaggggctttacgaaggtcttgactggttgtccaacaacatcgccggcaaggcgtagagggaaggtttgtggttgagttgattttgctgggcaaatctggatgcaggggcaaacattatctgattttttcttctttattgttctgttcttttttttttgttcgggtatgtggatttgattttgtgatcgttgttctgatttgtgcaaggagggactcgtctcttgcacgtagaacatagaaactaccttttatatagtttgtaatcgaagatttactctacttctttctgcttctacgttttatttttgatttcaattcaat

SEQ ID NO: 12437 - DNA, 755 bp, Brassica oleracea
gtcgcggatctctatctctctctctccctctctctctctcgattccgaaactattccgcagagtgaagaaggatggggttgtctttcgggaagcttttcagcaggctttttgccaagaaggagatgaggattctgatggttggtcttgatgctgctggtaagaccaccatcttgtacaagctcaagctcggagagattgtcaccaccattcccactattgggttcaatgttgaaactgtggagtacaagaacatcagcttcacagtgtgggatgtcgggggtcaagacaagattcgtccgttgtggaggcactacttccagaacactcaaggtctcatctttgtggtggacagcaatgacagagaccgtgttgttgaggctagagatgaattgcacagaatgctcaatgaggatgagctgcgtgatgctgttctgctcgtgtttgctaacaagcaggatcttccaaatgccatgaacgcagctgagatcaccgataagcttggtctccactctctccgtcagcgtcactggtacatccagagcacatgtgccacttcaggagaggggctttacgaaggtcttgactggttgtccaacaacatcgccggcaaggcgtagagggaaagattgtggttgagctgattttgctgggcaaatctggatgcaggggcaaacattatctgattttttctttattgttctgtttcttttttggtttcgggtatttggatttgattttgtgatcgttgttctga

SEQ ID NO: 12438 - DNA, 1127 bp, Brassica rapa
ggtaatttaacgacttaataacttgaattgacgttttagtccttcgcctctatatagatcttctccgttcaacataacggaggcgtcgcggatctctctctatctctctctcgatcgatcgattccgaaaaactattccgcagagtgaagaaggatggggttgtcattcgggaagcttttcagcaggctatttgccaagaaggagatgaggattctgatggttggtcttgatgctgctggtaagaccaccatcttgtacaagctcaagctcggagagattgtcaccaccattcccactattgggttcaatgttgaaactgtggagtacaagaacatcagcttcacagtctgggatgtcgggggtcaagacaagattcgtccgttgtggaggcactacttccagaacactcagggtctcatctttgtggtggacagcaatgacagagaccgtgttgttgaggctagagatgaattgcacaggatgctcaatgaggatgagctgcgtgatgctgttctgctcgtgtttgctaacaaacaggatcttccaaatgccatgaacgcagctgagatcaccgataagcttggtctccactctctccgtcagcgtcactggtacatccagagcacatgtgccacttcaggcgaggggctttacgaaggtcttgactggttgtccaacaacatcgccggcaaggcgtagagggaaagattgtggttgagctgattttgctgggcaaatctggatgcaggggcaaacattatctgattttttctttattgttctgttcttttttgtttttttttggtttcgggtatgtggatttgattttgtgatcgttgttctgattgtgcaaggaggagtctcttgcacgtagaacatagaaactacctttttatatagtttgtaatcgaagatttactctacttctttctgcttcacgtttcatttttgatattcaatttataagttggaaccgcggctacgtttataatagagatcatgtggtcgtgcatatgttactgagacccgtcttcaatgccacctcatgtcgtttttctctatcttataatgtacctgcaaacaataagcgcaataccaagagttaacaaaaaacattgtttctcct

SEQ ID NO: 12439 - DNA, 1529 bp, Musa acuminata
atgcaaattatttcatttaatttaatttcaaccccgaaaatgctggtttggtgtaacgtgttctgtgacgtattaagaaagaatgccatgacccgacttacaatacgacggaaggattgtgttgacgagactgcttctcctttccctatttattacgaccctctcgccttttcttcttttctcacgcggaagagaaggcgaagaggcgacctgtctcgctcctttcaatctttcggccccctccgcctaccgccccgtcaagatctacagggaacgatggggctcacgtttgggaagctttttagccgcttgtttgcgaagaaggagatgaggattctgatggtcgggcttgatgctgccggtaagaccaccatcctttacaagctcaagctcggagagatcgtcaccaccattcccaccatcggattcaatgtggagactgtcgagtacaaaaacattagcttcaccgtatgggatgttggtggtcaggataagatcagaccactatggaggcattacttccagaacacgcaaggccttatttttgttgtcgacagcaatgaccgagatcgtattgttgaggcaagggatgaactccacaggatgctgaatgaggatgagttaagggatgctgtcttgcttgtgtttgcgaacaaacaagaccttccgaatgcaatgaatgctgctgaaatcactgataagcttggtctgcattccttgcgccagcgacactggtatatccagagcacttgtgctacatctggtgagggcttgtacgagggacttgattggctctccagtaacatagccagcaagtgaccaaagttgctcaacggccctcaacagcagacaaaatttggcatttcagtgttggatgctttggtgaatcgttaccaagacaacaaaatttgaaggttccactggttaccaaaactttaaagatatcggctgcctcagaccttttatacttttatctatctactcctttttctggatatatctaggatgatgatactcttgtcatatatttctcacaccactgggtgcccattatgtcatctgatatttcttacttaaaactggatgtgcatgaaagtgacattttgagtaatttgaccagctcttttgatacttgtcaagtctgctaaattgccccttccagatcacccgacaaaaaggggctgtcaactgttaagggcaacaattccatgatgccccactcggtgaacgaccagaattgtcttttgagtaaatgtggctctagctgctggactcgtctcttgacatgttatcaataaaaatgcttgtttagtcgatttagtttacaagatactcaacctttatgcctcctcacttgtctccggcatgggcactatagtgaaagcaaggcatttgggcgaagctgttttgggttgctcttatcatgcatttggacaaagcccatatgttaagaaattgcacgtatcacagatcaacaaatgccatggttctgattcaaagtctatctcgcctgtccgccttcaccccgg

SEQ ID NO: 12440 - DNA, 875 bp, Beta vulgaris
tcagctttctgagatcttgccctctctttcctcctttctctctcatcatcatcgtgaaagatggggctgtcatttaccaaactattcagtcggctttttgccaagaaggaaatgcgtatccttatggtcggtctcgatgcggctggtaaaactacaattttgtataaactcaagctgggagagattgtcaccaccattcctaccatcggatttaatgttgaaactgttgaatacaagaacatcagcttcaccgtgtgggatgtcgggggtcaagacaagattcgtccattgtggagacattacttccaaaacacccaaggactcatctttgtggttgacagtaacgatcgtgaccgtgttgttgaggctagggacgagctgcataggatgttaaatgaggatgaattacgagatgcagtgttgttggtgtttgccaacaagcaagatcttccaaacgcaatgaatgctgctgaaataacggacaagcttggccttcattctctacgtcaacgacactggtacatacagagcacatgtgccacctctggagaagggctttacgagggacttgactggctttcaaacaacatcgctagcaaggcctaaaagaaaaacgcttaacgtagctgttatcagaaaagaagccgggagtataggcagaggattgtcattactgctagtgttgtgctaccctctttatttttgcaattatatgttctcatttttggttgctaccttgacaaggatatttttctggtgttcatgttgacttgttataataccatactttttagttgatgagctattatccctgtcggcttgttcatgttgacttgtttcagttcttctctgtatttcagaaaaacacacaggcg

SEQ ID NO: 12441 - DNA, 934 bp, Daucus carota
atacatacgcacattacacacaccccttcgctctgttttcctctccttcgaaatctaccatttttaggagtgctaaagatggggctgtcctttaccaaactcttcagtcggctctttgccaagaaagagatgcgcatactgatggtgggtctcgatgcagctggtaagacaaccattttatacaagctcaagctgggagagattgttacaaccattccaactattggatttaatgtggagactgtggaatataagaacatcagcttcactgtctgggatgttggaggccaggacaagatccgtcctttgtggagacattactttcaaaatactcagggcctcatcttcgtggttgatagcaatgatcgagatcgtgtagttgaagccagagatgagctgcacagaatgcttaatgaagatgaattaagggatgctgtcctacttgtatttgccaacaagcaagatcttccaaatgcaatgaatgctgcggagattactgataaacttggacttcattctcttcggcagcgacactggtacattcagagcacatgcgccacatcaggtgaaggattatacgagggtctggactggctctcgaataatattgcaagcaaggcttaggttgatcaggttgggatcttctctgcatcaagacggggttcttcatactcctatattttaatctgtaatgacagtttgatagagtttattgtattttatttgtcccgagtggtgtaccttgtgcttcagatcttgttccgctctccttcaagttgactcattatgcctaggcgaaatatgtaatgtttgggtaaattacttaaagtgagctttaggtaagaaatgggtcagcaaacattgagtgcctaggaggtacttttacattttatacttgctactttaagctaatatcaagtattttataagcaac

SEQ ID NO: 12442 - DNA, 997 bp, Centaurea maculosa
tccaaatctgaaagcccttaaatactaccctcccttctctgcatctccttcttcttatctcacgaattccgtcggtgatcggcggctccccattttcaaaccacctccgtcactctccggccgatcatatcaagatggggttgtcttttggcaagctttttagccgcttgtttgctaagaaagagatgcgcattttgatggttggtctcgatgcagctggtaaaacaacaattttgtacaagctcaagttgggagagattgtaaccacaattcccactattggctttaacgtggagactgttgagtacaagaacatcagctttactgtttgggatgttggtggtcaggacaagatccgacctttgtggaggcactacttccagaacacacaagggcttatctttgtggtcgatagcaatgaccgtgaccgtgtggtggaggctagagacgagctgcacaggatgcttaatgaggatgaactaagagatgcagtgttgcttgtgtttgccaacaaacaagatcttccaaatgctatgaatgccgctgagatcactgataagcttggcctgcattctctcagacaacgacactggtacatccagagcacatgtgccacctctggagaaggtctatatgagggactcgattggctttccaacaatatcgctaacaaggcataaacagggctgggctggtgaacttcctgttagttagtgtggtttgggttgaggtttctttttacttaatgttacgaatgaaatgacattttaatccctccgaccgacctctgttcttgaatgaatctgtttgacggttggtcgttcattgtaatctaaattctgcagggttgatcttattgtatccttgaaactcacttgtgcaactttttccaacactatgaaacaaatgagaaaagctataaagactatatgttataaagagagtgtttgtttgaaaccatatctttgagaaataagggtatgaggattgctttttg

SEQ ID NO: 12443 - DNA, 910 bp, Cleome spinosa
cgaagggtcatcggcgattcggcggcaggcgaactagatctcgagcgctgtggtttttcttcgcaggctcggaaaatggggctgtctttcgggaagttgttcagcaggctctttgccaagaaagagatgcgtatccttatggtgggtcttgatgctgctggtaagacgaccattttgtacaagctcaaacttggagagattgttaccactattcccaccattgggttcaatgtggagacagtggaatacaagaacatcagctttacagtctgggatgttgggggtcaggacaagatccgtccattgtggagacattactttcaaaacacccaggggcttatctttgttgttgacagcaacgacagagaccgtgttgttgaagccagagacgagcttcacagaatgctgaatgaggatgagttgagggatgctgttctgcttgtctttgctaacaagcaagacctgcccaatgcgatgaacgctgccgagatcactgacaagctcggacttcactctctccgtcaacggcactggtacatccagagcacatgtgccacatccggtgaagggctctacgagggtctggactggctctcaaacaacatcgcaaacaaggcatagatggcatgtgtctgagatacgggcctcaacaagaaagtagtcaattcctcgggttccttgttatggggagccttatattgcaagttaaaaacaacgctttactgtcacattcctcaattccaaactcttatagtctctctctttgaacttcttccaataatcgatgtatcatccttagagttatctggtcaatgtttgttctttcgcgttctctctcgttttgcacggacaagacctctcttgtttcattgttcataagttaactgatcgtccttcttactatgtttac

SEQ ID NO: 12444 - DNA, 896 bp, Cucurbita pepo
ccatattacgcgttgctctgaagctcgatttttcttgctctctccatccctttcaatacacctctggcctctttgtgtagctctcggaggaacttcaacgttacgaacagatatggggctgactttcggaaagctcttcagtcggctgtttgctaagaaggagatgagaattctgatggttggccttgatgctgctggtaagacgaccattctctataaactcaagcttggagagatcgtcacaactattcctaccatcggatttaacgtggagactgtggaatataagaacatcagcttcactgtttgggatgtcggtggtcaagacaaaattcgtccattgtggaggcactacttccagaatacgcaaggtcttatatttgtggtggacagtaacgacagagaccgtgttgttgaggcaagggatgaattgcatagaatgctgaatgaggatgagcttcgagatgcagtattacttgtgtttgctaacaaacaagatctccccaatgcaatgaatgccgctgagattactgataagcttggtcttcactctcttcggcagcgccattggtatatccagagcacctgtgcaacctccggggaagggctctatgagggtttagattggctctcaaacaacattgctaacaaggcataaagctgtgaaagagttgtcttgtagactggcaatcctggatgcaggggtgaatgttatctactttttcttgttttttggggaatagtcttccatgccttttctttagggataatcttccgtggtatcggtctatcatattgtaatggatatttgtgtcttcacctagccttctgtgtgtttaatgagattatgttattcaaactaaactcgtcatcttctaatgtgaaattcttacaat

SEQ ID NO: 12445 - DNA, 921 bp, Curcuma longa
ccacgacctcttgcgttctcatctccttcagcctgcccgtctcctccctgctacacgactcctgtgatccccagccgagggaacgatggggcttactttcgcaaagctatttagccgcctgtttgcgaagaaggagatgaggatcctgatggtcgggctcgatgctgctggtaagacgaccatcctctacaagctcaagcttggagagattgtcaccaccattcctacaatcggattcaatgtggagactgtcgagtacaagaacatcagcttcactgtatgggatgttggtggtcaggacaagatcagacctttgtggaggcattacttccagaacacacagggacttatttttgttgttgatagcaatgatcgagatcgagtcgttgaagcaagggatgaacttcacaggatgcttaatgaggatgagttaagggatgctgtcttgcttgtgtttgctaacaaacaagaccttccaaatgcaatgaatgctgctgaaataactgataagcttggtcttcattccctccgtcagcgtcactggtacatacaaagcacttgtgcaacatccggtgaaggtttgtatgaagggctcgattggctctccagcaacatcgccagcaagtaaaggccctgttttttaacagcaccaatgtatgtgttcgatgcttttgcgccatcctggaagcaagaaaactgtcagtgtctttcaaaaccccaatacttgtctgcagaacaaatacatgtttggtcgttactttttatatgtttatgtgattctctccagcaccttatttccttttgactgagatggcaaacagcttcgcttgttgacatgttacgttttctaatattttatttgtctgggttgcataaaaaaaaactaactgaagaaatactgaacataaaaaagtaaaaagg

SEQ ID NO: 12446 - DNA, 1099 bp, Solanum melongena
agaccttctattctttcatcacgaccgaaaaatagaagacagctccagggaggacgagatctctgcttcatcatttctctcctctttctcagtaaaattcaaagatggggctgtcttttgggaagcttttcagtcggctttttgcaaagaaagagatgcgcatactgatggtgggtcttgatgctgctggtaaaacaaccattttgtacaaactcaaactgggagagatagtcaccaccatccccaccattggtttcaatgtggagaccgtggaatataagaacattagctttacagtttgggatgtcgggggtcaggataagattcgtcctttgtggagacactacttccaaaacacccagggactcatctttgttgttgatagcaatgacagagatcgtgtagttgaagctagggatgagcttcacaggatgttgaatgaggatgaattgagggatgctgttctgctcgtgtttgccaacaagcaagatcttccaaatgctatgaatgcagcagagataactgacaagcttggcctccattctctccgccagcgtcactggtacatccagagcacttgtgcgacttctggtgaaggtctgtatgaagggctagattggctgtcaaacaacatagcaaataaggcgtagaggctaaacatctttggactctggattatggagtagtgaaattgtgagagaataggctttgtcaattacttgtaaaccgttcatttggtatctttcttttgacaacattttctttgtcaaggattccttgttgtgccttctgcagcgttaaaataaattttaaatttaatatctttgtggttgttgatttgtctctggatccgttgaatccatctcgttgggtatatgttctagttgttaccctgttggttgcgaaggatagtgggccaactccatgtattcattagctacatctctcattcatatcccaatttaatttttcttgggcttttatgttcaatgtatacaaaatcaggaatgatgatgcttcgacaacagaatgagaagctaatttcgttgcaccccttcttttgtgacctatataacaaaaacaatggtgctaaaagtgc

SEQ ID NO: 12447 - DNA, 2228 bp, Zingiber officinale
gcaccagtgagctcggagactgttgtagtagttcttgcttttggagatttgcatttgcaagatgatccaaagctcaagagaaagagctgtgatcatcaatgaaggcaaggctcagccgactttttcgcgggcagggtggacggcgatgctcaagaacccgaggatcgtgcgtgtctcccgatcatttgggggcaaggaccggcacagcaaggtgaggactatccgcgggctgagggaccggcgcgtgcggctgtcggtgccgacagccatccagttgtatgacctccaagacaggctagggcttagccagccgagcaaagtggtggactggctcatcaacgctgctcagcatgagatcgacaagctgcccccacttgagatgctgcaaggagaatatgaccacggccatgatcatctcttcccactgatgcctcaaatagcaaaccctaacaccacttcaggtgcaaactatcaggacattgatgattcaaggacctgcaaagggaaggaagtggaagtgaggggagggaatttgggtgtagcatgggagaacaatgagttgacaaacaatccctactatcagttagaccctgcaaatggaggctacatacctataactattcttgcatcatacatggctgctgcatcaaatggtgttcaggaagcaaagcagtatggccacttattgggcacaacaacagcattatcatgccaaggcaatgcctctccaaatgaggctttcagaactcttcatcatgatcagtaatttgtatttgtagcagtctttgattttcatacatgattttgaaagagatagggatatatatatatataaaaaagcgaagagaccacgacctctcgcgttctcatctccttcagccttcccgtctcctccgtgatacacgactcctgtgatctccagacgagggaagatggggctttctttcgcaaagctatttagccgcctgtttgcgaagaaggagatgaggatcctgatggtcgggctcgatgctgctggtaagacgaccatcctctacaagctaaagcttggagagattgttaccaccattcctacaatcggattcaatgtggagactgtcgagtacaagaacatcagcttcactgtatgggatgtcggtggtcaggacaagatcagacctttgtggaggcattacttccagaacacacagggacttatttttgttgtcgatagcaatgatcgagatcgagtcgttgaagcaagggatgaacttcacaggatgcttaatgaggatgagttaagggatgctgtcttgcttgtgtttgctaacaaacaagaccttccaaatgccatgaatgctgctgaaataactgataagctcggtcttcattccctccgtcaacgtcactggtacatacaaagcacttgtgcaacatccggtgaaggtttgtatgaagggctcgattggctctccagcaacatcgctagcaagtaagaaaagctgcttggaggccctgttttttaacagcaccaatgtatgtgttcgatgcttttgcgccatcctggaagcaagaaaactgtcagtgtctttcaaaaccccaatacttgtctgcagaacaaatacatgtttggtcgttactttttatatgtttatgtgatcctctccagcaccttatttccttttgactgagatggcaaacagcttcgcttgttgacacgttacgttttctaatattttattgtcacctcgtgccgaattcggcacgaggcctcgtgccaaattcggcacgaggcttttgtccaagctcaaatattcaccaggttgaaggatggaaagattttgatgaacgccggcgttcaaagcatcagaaacaactcgatttccgcgtggggtcttcaaaggtgtttgatgagggtgccgacgatgatcaaatccacagatagatttcctttgtttccattaataatacgataatatcgtaaatgcatgacgtttttgtatgttcacgttggctcagttcaatttggagcagtggatcaatgatgggtatttgacttcattcaacctcgtgccgaattcggcacgaggatcaaattctaattaacaactgaatatttcaattcttacccaaaaaaacaaacaccaaacatcacaacgaagggggaaaaaacagaaaaaagaaacagacggaggatgtcctataatcggatggtgcgtttgtcttcttttatggtaccgaaagggacg

SEQ ID NO: 12448 - DNA, 1313 bp, Zingiber officinale
attaaaaactccttgagcctcacgactgaacgcttcttgtatcccttttcgtggtcgagatctccatcacggcaccaaatgccagtcaatttccttcgagacattgaaagcgcagatcttgtctctatggtacatcatccagcaaccagcgtgcgaatctctctcggttggtgccattatggtgctgcaggtcggtcatctcatcaacttcgccaccacgccccctcgcctttcttcaccatagccataatggcagttgcaaactgcacgctttcccgccagatgagcgcccctgattaagtttctcaatccatttgataaaataataataatacacaaataatgatggtcacagaaaaatgggatcgttcttggggctccttcctcggtagggaagttgatatttcagcgaaatgattagcctcgtgccgaattcggcacgaggaggaagcgaatacctctctcgtcctcaactcttttaatcgacccgtcttctccggtctacgcttatccttgattcctagctgagggaaagatggggctcactttcgcaaagctatttagccgcctgtttgcgaagaaggagatgaggatcctgatggtggggcttgatgctgctggtaagacgaccatcctgtacaagctcaagcttggagagatcgtcaccaccattccaacaattggattcaatgtggagactgttgaatacaagaacattagtttcactgtatgggatgtcggtggtcaggacaagatcagacctctgtggaggcattactttcagaacacccaggggcttatttttgttgttgatagcaatgaccgtgatcgtgttgtggaggcaagggatgaactccacaggatgctaaatgaggatgagttaagggatgctgtcctacttgtgttcgccaacaaacaagaccttccaaatgcaatgaatgctgctgaaataaccgataagcttggccttcattctctccgtcagcgccattggtatatacaaagcacatgtgctacatctggcgagggcttgtacgaaggacttgattggctctctagcaacattgccagcaagtaatcgtagcttctgtgaaagctgcgcgttcaaggcttttgtgatgtggcaagcaagaagactattaaattattaatgatccacttggattatctttattctagcgttggaaaatatgaaacttaactgtatcacacttatgtgcgtggttgttgaaccttttatgtgatcctctttagcttacatatcagtttcattaatgaatgtggacatgcacgcggcaattagccttcttttg

SEQ ID NO: 12449 - DNA, 909 bp, Zingiber officinale
gaagcgaagacctcggctctcaggttcttatctccttccatctacccgcttcctccgtcctacacgcctcccgtgatccccagctgaaggagctatggggctcactttcgcaaagctctttagccgcctgtttgctaagaaggagatgagaattctgatggttgggcttgatgctgctggtaaaacgacgatcctttacaagctcaagctcggcgagattgtcaccaccattccaactatcggattcaatgtggagactgttgagtacaaaaacatcagtttcactgtatgggatgttggtggtcaggacaagatcagacctctctggaggcattacttccagaacacacaaggacttatttttgttgttgatagcaatgaccgagatcgtgttgttgaggcaagagatgaactccacagaatgcttaatgaggatgagttaagggatgctgtcttgcttgtgtttgctaacaaacaagaccttccaaatgcaatgaatgctgctgaaataactgataagcttggcctccattctctccgtcagcgtcactggtacatacaaagtacgtgtgctacatccggtgaggggttgtatgaagggcttgattggctctccagcaacatcgccagcaagtaatcaaagctgccttgaggttcatgtcttaacagcacgattgttaacgttcattgctcacgttcgatgcttttgagaccttgtggaaacagcaaaactatcagtgtgccactgtttttcctgccttttgaaaagtcttaatacttgtctgtagaacaaatacgtgtctggttgtcacttaatatggtttatgtgattctcaccaacaccttattccatttctaaaagagaccgtcaactaatagcctttgctcgtggccatttttctctctttt

SEQ ID NO: 12450 - DNA, 920 bp, Zingiber officinale
gcccccggggaaggcgaagcagaggcgtcccctccgccagctcgatctctctgcttcggctccgtcgctgagttctgcaggcactatgggtctcaccttcacaaagttgttcagtcgcctctttgcaaagaaagagatgcggatcctgatggtcggtctcgacgccgctggtaagacaaccatcctctacaagctcaagcttggagaaatagtcactaccattcccactatcgggttcaatgtggaaactgttgagtacaagaatattagcttcactgtttgggatgttggtggtcaagacaagatcagacctctttggaggcattactttcagaatactcagggccttatttttgtcgttgatagtaatgacagagatcgagttgttgaagcaagggatgagctccacagaatgcttaatgaggatgaattacgggatgctgtgttgcttgtttttgccaacaaacaagaccttccaaatgcaatgaatgcagctgaaatcacggacaagctcggtcttaattccctgcgccaacgacactggtacatccagagcacctgtgccacttctggcgagggcttgtacgaggggctcgattggctctccagcaacatcgctagcaaggcttgacgttacccagaatgcctacgagcatgttcgacgatctttctttagctcgggtaatttctagcttatcttctgccgactatttttccaatgcttttactgtttcgcattttaagtttttgttgctcagaaatatagtcttgttggctaatggctacttatccaattgcatttgtggttgctagttatttttctaaatgaatgcttattaatttgtaccattaacaaagaatgtctagggtccctgctgttcctaaaggtgatacattgtacgttcatccgagcattgata

SEQ ID NO: 12451 - DNA, 867 bp, Zingiber officinale
aaaaagcgaagagaccacgacctcttgcgttctcatctccttcagcctgcccgtctcctccctgctacaccactcctgtgatccccagccgagggaacgatggggcttactttcgcaaagctatttagccgcctgtttgcgaagaaggagatgaggatcctgatggttgggctcgatgctgctggtaagacgaccatcctctacaagctcaagcttggagagattgtcaccaccattcctacaatcggattcaatgtcgagactgtcgagtacaagaacatcagcttcaccgtatgggatgtaggtggtcaggacaagatcagacctttgtggaggcattacttccagaacacacagggacttatttttgttgttgatagcaatgatcgagatcgagtcgttgaagcaagggatgaacttcacaggatgcttaatgaggatgagttaagggatgctgtcttgcttgtgtttgctaacaaacaagaccttccaaatgcaatgaatgctgctgaaataactgataagcttggtcttcattccctccgtcagcgtcactggtacatacaaagcacttgtgcaacatccggtgaaggtttgtatgaagggctcgattggctctccagcaacatcgccagcaagtaagaaaagctgtttggggcctaatgtaagtgttccatgcttttgcgccatcctggaagcaagaaaactctcagtgtctttcaaatacttgtctgcagagcaaatacatgtttggtcgttactttttatatgtttatgtgattctctccagcaccttatttccttctgactgagatggcaaacagcttagcttgttgacatgttacgttttctaatattttatttgtc

SEQ ID NO: 12452 - DNA, 893 bp, Zingiber officinale
gcacccgtgacgagaggaaccgaagagccgaaggcctctcgcgttctcatctcctccaatccacccgtctcctccgtccagcgcctcccgtgatcgccagttgagggaacgatggggctcactttcgcgaagctatttagccgcctgtttgcgaagaaggagatgaggatcctgatggtcgggcttgatgctgctggtaagacgaccatcctctacaagctcaagcttggagagatcgtcaccaccattccaacaatcggattcaatgtggagactgttgagtacaagaacattagtttcactgtatgggatgttggtggtcaggacaagatcagacctctgtggaggcattacttccaaaacacacagggacttatttttgttgttgatagcaatgaccgagatcgtgttgttgaggcaagagatgaacttcacaggatgcttaatgaggatgaattaagggatgctgttctgcttgtgtttgctaacaaacaagaccttccaaatgcaatgaatgctgctgaaataactgataagcttggtcttcattctctccgtcagcggcactggtacatacaaagtacttgtgctacatcaggtgaaggtctgtatgaagggcttgattggctctccagcaacatcgccagcaagtaatcaaagctgctcagaggctctcttatcttagcaataccagtgttcgcgttccatgctttttgccatcacagaagcaagaaaattatcaatgtggtaactctttttttttctgcctttgaaacccctaatactttgtatccagaacaaatacgtgtttggttactttcatgtgatcctctccaagatctcatttccttttgttgatgagacgcctgatagctttgctcgtcaaaaaaaag

SEQ ID NO: 12453 - DNA, 825 bp, Zingiber officinale
gcaccagtcgaagacctcggctctctcatctccttccacatacccgcttcctccgtcctacacgcctcccgtgatccccagctgagggaactatggggctcactttcgcaaagctatttagccgcttgtttgcgaagaaggagatgagaattctgatggtcgggcttgatgctgctggtaaaacgacgatcctttacaaactcaagctcggagagattgtcaccactattccaacaatcggattcaatgtggagactgttgagtacaaaaacatcagtttcactgtatgggatgttggtggtcaggacaagatcagacctctctggaggcattacttccagaacacacaaggacttatttttgttgttgatagcaatgaccgagatcgtgttgttgaggcaagagatgaactccacagaatgcttaatgaggatgagttaagggacgctgtcttgcttgtgtttgctaacaaacaagaccttccaaatgcaatgaatgctgctgaaataactgataagcttggccttcattctctccgtcagcgtcactggtacatacaaagtacttgtgctacatccggtgaagggttgtatgaagggcttgattggctctccagcaacatcgccagcaagtaatcaaagctgcttagaggctcttgtcttagctgcaccgattgctcacgttcattactcacgttcaatgctcacgttcaatgcttttgagacactgcggacgcaagaaaactatcagtgtgccactgtttttcctgcctttcgaaaaatcttaatacttgtctgtagaacaaatacatgttggttgtccctt

SEQ ID NO: 12454 - DNA, 953 bp, Zingiber officinale
ctcgtgccgaattcggcacgagggaagaaccgaagagccgaaggcctctcacgttctcatctcctccaatccacccgtcttctccgtccaacgcctcctgtgatcgccagttgagggaacgatggggctcactttcgcgaagctatttagccgcctgtttgcgaagaaggagatgaggatcctgatggtcgggcttgatgctgctggaaagacgaccatcctttacaagcttaagcttggagagatcgtcaccaccattccaacaatcggattcaatgtggaaactgttgagtacaagaacattagtttcactgtatgggatgttggtggtcaggacaagatcagacctctgtggaggcattacttccaaaacacacagggacttatttttgttgttgatagcaatgaccgagatcgtgtcgttgaagcaagagatgaacttcacaggatgcttaatgaggacgagttaagggatgctgttttgcttgtgttcgctaacaaacaagaccttccaaatgcaatgaatgctgccgaaataactgataagcttggtcttcattctctccgtcagcggcactggtacatacaaagcacttgtgctacatcaggtgaaggtctgtatgaagggcttgattggctctccagcaacattgccagcaagtaatcaaagctgctcagaggctctcttatcttaacagcaccagtgttcgcgttccatgctttttgccatcacagaagcaagaaaattatcaatgctacactttttttttctgcctttgaaaaccctaatacttttgtctccagaacaaatacgtgtttggttacttaaaatgtgatcctctccaagatcttatttccttttgctgattgagacgccaacagcctttgctcgttcacatatttccttttcagatattttatgtcgtctgaaatattgtttgtctgggttgcag

SEQ ID NO: 12455 - DNA, 1554 bp, Zingiber officinale
ttgaaccagcaaatgagatcatctccaaaggcattaacataatcatcacaataacatctttatgaaacctcaagataggattgctgactgttaaagggcagaatttaatgtatgactaatataagtagttgtagttaaaggtttgttgttgtttctttaatttcttccaaggtgatggactgttctcttccagcaaattcattatcaggagtgagaaacagcatacaatggcattccttcctctctcgcataggtacacatgggcaattccaaaatccttgtgctacttcagctgctttatcatcataatgcctacaaggacataatggtgcacccaatgtatctttgtgatttgcaagacccttgattacaacagaggtgactcccttatccacgcagaagaatgtttccgatctaacggcatattgctctgagaactttctcataatctcaactgacttttcgctaggttcttcttgagcccgaacttttaggcgacgggagcggcagtaccgcaacgaggagagtttcctgctgggaagcagcgttacgccgtggagtggagcattgcgggagctgacgggcatcccctctagcagatcaaacatctgcgatgaccaaaatcgacaggtttcgccttccacggagggtttcgaccttcaagagctccggaaatcgaaggccactctcgtcctcatctcctcccatctgcccttttcctcggggctacgtacccgcatccccaggtgagaagcaatggggctcactttcgcaaagctgtttagtcgtctgtttgcgaagaaggagatgagaatcctgatggtcgggcttgacgctgctggtaagacgaccatcctgtacaagctcaagcttggagagattgtaaccaccattccaacaatcggattcaatgtggagactgtcgaatacaagaacatcagtttcactgtatgggatgttggtggtcaggacaagattagacctctgtggaggcactatttccagaacacacaaggacttatttttgtggttgatagcaatgaccgggatcgtgttgttgaggcaagagatgaactacacaggatgcttaatgaggatgaactaagggatgctgtcttgctcgtgtttgcaaacaaacaagaccttccaaatgcaatgaatgctgccgaaatcactgataagcttggccttcattctctccgtcagcgacattggtatatacaaagcacttgtgctacatccggtgaggggctgtatgaagggcttgattggctctccagcaacattgctagcaagtaatcaaagcctgtttcgaaggttgttgcctaacatcagcgatgctctactttgatgcttttgtgacagcagaagcaagaagactatttattgttccacttggaacattttgttccccttctgcattcaaaaaccttgtctgtaaaacaaatatgtgcttggttgttacctttttctatgtttcatcgatggacgcagcaaacagctttgtttctctgcatattttgtcctcatattattgtatttgatattttgctt

SEQ ID NO: 12456 - DNA, 686 bp, Actinidia deliciosa
ctctctctctctctcgccctgctctccgatccttccgtgaagagagtgccaagggacaagcccataggcgaagagaaacagaatggggttgaccttcacaaagctgttcagcaggctttttgccaagaaggagatgcgaattcttatggtaggtcttgatgctgccggtaagactaccatcctttacaaactcaagcttggagaaattgtcactacaatccccaccattggatttaacgtggagacagtggagtacaagaacattagcttcacagtttgggacgtcgggggtcaggacaagatccgtccattgtggaggcattacttccagaatacacaggggcttatatttgttgtggatagcaatgatagggatcgagttgttgaggcgagagatgaattgcataggatgttgaatgaggatgagttgagagatgctgtcttgcttgtctttgctaacaaacaagatcttcccaacgcaatgaatgcagcggaaataaccgacaagctcggtcttcattcactccgacaacgccactggtacattcagagcacatgtgcaacctctggagaagggctttacgaagggctagattggctttctaacaacattgctagcaaggcataaggctgtcgagggttttggttgctgctggaattttggtgatgcacgggcggatactatc

SEQ ID NO: 12457 - DNA, 676 bp, Medicago truncatula
gtttcgctcttctcttcaaaatatctcagatcgaagaaaaaaagagcgatttgtgtaggtgaaaatggggttaacgttcacgaagctgttcagtaggttgtttgcgaagaaggagatgagaattttgatggtaggtctcgatgcggctggtaagactactattttgtataaattgaagcttggagaaatcgttactaccatccctaccattggatttaatgttgaaaccgtggagtacaagaacatcagcttcaccgtgtgggatgtcgggggtcaggacaagatccgcccattgtggaggcactacttccagaacacccagggtcttatttttgtggttgatagcaatgatagagaccgggtggttgaggcaagggatgagttgcacaggatgttgaatgaggatgaacttagagatgctgttttgcttgtttttgccaacaaacaagatcttccaaatgcaatgaatgctgcagaaataactgacaaacttggacttcattctctccgccaacgccactggtatattcagagcacttgtgcaacttctggagagggtctttacgagggtttagactggctttctaacaacattgcaagcaaggcataatgagacatttgaacaattttgggtgtgatctgatcatttcctgagtctggtggttcttgaagaagg

SEQ ID NO: 12458 - DNA, 693 bp, Allium cepa
aagaaaaagaaaatcaaatcaatatcatctcgaagatggggttgacattcacgaagctgtttagtcgattattcgcgaagaaagagatgagaattctgatggttggtctcgatgcggctggtaaaaccaccatcttgtataagctcaagcttggtgaaatcgtcactaccattcctacaattggatttaatgtggagactgtggagtacaagaacattagttttactgtttgggatgttgggggtcaagataagatcagacctttgtggaggcactacttccagaatactcagggccttatctttgttgttgacagcaatgatagagatcgtgttgttgaggcaagggatgagctccataggatgctaaacgaggatgagctgcgggatgccgtactgcttgttttcgcaaacaaacaggatcttccaaatgcaatgaatgcagccgaaatcactgacaagcttggcttgcattctctccgtcaaaggcactggtatatacagagcacttgtgctacatctggagaaggattgtatgaaggtctagattggctctctagtaacattgccagcaaggggtgagaacttggaagctatcgctgagaatgtaacccgggatgaagaggacatactgttttgaaattttttatattaaagtggtcagtacatgtttgatcgatatttatttcttgcg

SEQ ID NO: 12459 - DNA, 746 bp, Capsicum annuum
agacagctccagggaggacgagaacgagaacgagatctctgcttcttcatttctctcctctttctctgcaagattcaaagatggggctgtcttttggcaagcttttcagtcggctttttgccaagaaggagatgcgcatactgatggtgggtcttgatgctgctggtaaaacaaccattttgtacaaactcaaacttggagagatagtcaccaccattcctaccattggtttcaatgtggagaccgtggaatataagaacattagctttacagtttgggatgttgggggtcaagataagattcgtcctttgtggagacactacttccaaaatacccaggggctcatctttgttgttgatagcaatgacagagatcgtgttgttgaagctagggatgagcttcacaggatgttgaatgaggatgaattgagggatgctgttctgctagtgtttgctaacaagcaagatcttccaaatgctatgaatgcagcagagataactgacaagcttggtctccattctctccgccagcgtcactggtacattcagagcacttgtgcaacttctggtgaaggtctgtatgaagggcttgattggctgtcaaacaacatagcaaataaggcatagaggcttaatcatctttggactctggattatggagtagtgaacccagagagaataggctttgtcaattacttgtaaacggtttatttgttatctttcttttgtccaatgttttgtttctca

SEQ ID NO: 12460 - DNA, 1350 bp, Petunia hybrida
cagcactgttacattgcgtcagggggagaagaagcactacaataacaaggttgatgtgtatagttttggcattgtcttgtgggagttactgacaaatcgcatgccctttgagggaatgtcaaatttacaagctgcttatgctgctgcttttaagcaagagagacctggtcttcctgaagatatttctcccgacttagcatttatcatacaatcatgctgggtggaggaccctaacatgcgaccaagcttcagccagataatccggatgcttactacacatctcttcacgctccctctgcctgcaccatccataccagcaccagaatccatggagcagacagttaccagcaatggtacgcgggggaccgaaactcgaagacagctccctgtgagagaacgagatctctgtttcatcaattctctcttctttctcagcagattcaaagatggggctgtctttcggcaagctcttcagtcgtctttttgcaaagaaagagatgcgcatactgatggtgggtctcgatgctgctggtaaaactaccatattgtacaagctcaaactgggagagatcgtcaccactatccctaccatcggtttcaatgtggagactgtggaatataagaacattagctttacagtctgggatgtcggaggtcaagataagattcgtcctttgtggagacactacttccaaaatacccagggactcatctttgtggttgatagcaacgacagagatcgtgtagttgaagctagggatgagcttcacaggatgttgaatgaggatgaattgagggatgctgttttgttagtgtttgctaacaaacaagatcttccaaatgctatgaatgcagcagagataactgacaagcttggcctccactctctccgccagcgtcactggtacatccagagcacttgtgcaacttccggggaaggtctctatgaagggctggattggctttcaaacaacatagcaaataaggcatagaggctaagcatcttggtctctggataatggagtagtgagaccgtgacagaataggcattggcaattacatttgttatcatttcccaagtttttctttctcaaggattccttactgtactttttgcagcgtcaaaacaatttttacatttaacgcttagtgattcttaatttgcattcgggttcctagctctactttgtgggtgtaggctcttgttcttcccttcttgatggggaaggatgttgggttgatccgaagtattcattagcccatgcctgattatccgaatcttttatgttcaatatgtactaatcatgttattgctttgtaaaacgcaatgattaagagccaatgtcgttg

SEQ ID NO: 12461 - DNA, 847 bp, Raphanus sativus
ctcttttactcgttggaagaccccatttgcttggttctttggacgacccatcccatcgccgacgcgactgtgaaaggcttttgaagtgaaagatggggctgtcctttgggaagttgttcagtagactgtttgcgaagaaagagatgcgaatcctcatggttggtctcgatgctgctggtaagactaccatcttgtacaagctcaagcttggcgagatcgtcaccaccattcctaccattggtttcaatgtggagactgtggagtacaagaacatcagcttcaccgtctgggatgtcgggggtcaggacaagattcgtccactgtggaggcactacttccagaacacgcaagggctgatcttcgtggtcgacagcaatgaccgtgaccgtgttgtcgaagctagagacgagcttcacagaatgctcaacgaagatgaattgagagatgcagtgcttctcgtctttgctaacaagcaagatcttccaaacgccatgaacgccgctgagattactgacaaacttggccttcactctctccgtcaacgacactggtacatacagagcacatgtgctacctcaggagaagggctctatgagggtcttgattggctctccaacaacatcgctaacaaggcttagagcagtttgtgggagagtgtcttgtcttcttggactctgttttgttctttcgtctgtctcaacactttttatcatttcatttcgtactttgttcttcgctcttttttactcttctatcctaaattcagaatattatgaaatggggcctacatttcgacggattttccaatctcttcctacatttatttgaattttatgagtttatacta

SEQ ID NO: 12462 - DNA, 1537 bp, Glycine max
tgtaaattatgtttattcttttaaaatgaagcaagtaattgtactttattgcaattgatgatgctttattttatacatgacacaagtcttgacaattgattctgaaataaatcacaaaagatttgatcaacttagttttaatgaatttcatgaataatttaaatggagttaagaaaaattgattacagaaggagaattggaggacacacaatgcgtcgccgtatcgaagacatttgttgttaaataacggtggaagtgaaactgcgatctctctctctctttcactctttctccgagaacaaaaaaaaaaacgtgattcgctcttctcttcgaataaaccacaaaaccaacaaacgagaagaggagtgagagaagatggggttgtcgttcacgaagctgttcagcaggttgtttgcgaagaaggaaatgaggattctgatggtaggtctcgatgctgctggtaagacaaccatcttgtacaagctcaagcttggagaaatcgtcaccaccatccccaccatcggatttaatgttgagactgtggagtacaagaacatcagcttcactgtgtgggatgttggtggtcaggacaagatccgtcctctgtggaggcattatttccagaacactcagggtctcatttttgtggttgatagcaatgatagggatcgagtggttgaggcaagggatgagttgcacaggatgttgaatgaggatgaacttagagatgctgttttgcttgtttttgccaacaagcaagatcttcctaatgcaatgaatgctgcagaaataactgacaagcttggacttcattcactccgtcaacgccactggtatatccaaagcacttgtgcaacttctggagagggtctctatgagggtttggactggctttctaacaacattgccagcaaggcatgagacatttgaaaatttttggtcttgtctggtgatttcctgctgagtatggcggttcttggagaaagatgcttatcctttcttgtcaatgttgtaatagcagaatgcttgctagaagtattctcttcttttgtgtaacttgggtttgtatgattgcttaaattagctaatacttttagctataattggaactcttggaccctcttgtgcgtgccttgtttgtgttcattttgttagtttgatttttggttgaatatttccgtgcgttttgttcttggagtgcttgttggtgatgatagttgaatgaggattagaaaattgcgccagtttttgctcttgggccaagagtcacctgttcaaatattgtctttgcgaaattccagttcagatagacttggtacctgtttgttttaaagttgagcagacctaattttgatagaattggttaattatttattgtgattcagatgtgtgtctaaattaattatagtaataaagtttatattgaaacatgtattatggtgtacaattagaggattttttttgttaaatatcaattagaggatgagaaaaagttgacattttagaaattaagatgggcaaaattagaaaaatattg

SEQ ID NO: 12463 - DNA, 1345 bp, Glycine max
aataagaaaaaaacactagtttcagattttcaaatattattattacggaaataaaaatatatttagtcttctttttattttttttactgtagagaggactaattattgaagaaatgactaaacgaaaacgacgacgttttagagaacgcacaatgcgacgccgtatcgaagacatttttgtcattaaataacggtgcgaagtgtaactgcgatctctctctcactctttctccgagaacaaaaaaaaaaaaaaaaaaaatccgcgattcgctcttctcttggaaaagtgaaaaccagaagtacgaacgaaagagaagagcgatttagaagtgagagaagatggggttgtcgttcacgaagctgttcagcaggttgtttgcgaagaaggaaatgaggattctgatggtaggtctcgatgctgctggtaagacaaccatcttgtacaagctcaagcttggagaaatcgtcaccactatccccaccatcggatttaatgttgagactgtggagtacaagaacatcagcttcactgtgtgggatgttggtggtcaggacaagatccgtccactgtggaggcattatttccagaacactcagggtctcatttttgtggttgatagcaatgatagagatcgagtggttgaggcaagggatgagctgcacagaatgttgaatgaggatgaacttagagatgctgttttgcttgtttttgccaacaagcaagatcttcctaatgcaatgaatgctgcagaaataactgacaagcttggacttcattcactccgtcaacgccactggtatatccagagcacttgtgcaacttctggagagggtctctatgagggtttggactggctttctaacaacattgccagcaaagcatgagacatttgaaaaattttggtcttgtctggtgatttcatgcgagtctggcggttcttggagaaagatgcttatcttttctagcgaatgttgtaatagcagaatgcttgctagaagtattctcttttgtgtaacttgggtttgtatgattgcttaaattagctaatacttttagctataattggaactcttgcaccctcttgtgcgtgcgtgctgtgttgcttacatcttgtttgtttgatttttgattgaatatatttccatgcgttttgttcttgaaaagttcactaatttttcagtttaaaagatcggttttgtccggttttccaaacattgataattaattgtgtaaacaaactgttgggacttaattcttacattacacaggatttttatttttttatgtttcactttaattttactcctcatttatagtggctcaaatttctttatgaaagttatg

SEQ ID NO: 12464 - DNA, 1013 bp, Spinacia oleracea
cctcccaattagggtttctcctttctctctcctcgccgtgaaagatggggctgtcgtttaccaaattgttcagtcggttgtttgccaagaaggaaatgcgtatccttatggtaggtctcgatgcggctggtaaaactaccattctttataaactcaagcttggagagattgtcaccaccattcctaccatcggatttaatgttgagactgtggaatacaagaacatcagcttcactgtgtgggatgttggaggtcaagacaagattcgtccattgtggagacattacttccaaaacacccaaggacttatctttgtggttgacagtaatgatcgtgaccgtgttgttgaggctagggacgagctgcataggatgttaaatgaggatgaattgcgggatgcagtattgttggtgtttgctaacaagcaagatcttccaaatgcaatgaatgctgctgagatcaccgataagcttggcctccattctctacgtcaacgtcactggtacatacagagcacatgtgccacctctggtgaagggctttacgagggactggactggctttcaaacaacatcgctagcaaggcttagaagaaacaaaacgagtaacgttagctgttctcaggaaagaagttggagtataggctgaggactgttattactgctagtgttatcttctttatttttccaattatatgttctcatttttggttgctacctggacaaggatgctttcttgtgttcatgttgacttgttataataccatacttttagttggtgagtttctcgttggggtttcggcctctttctttgttggttgcagcattcctgttgctttgtgatctggtatagtatgactatattgattgggcctacaacaaacatatattaatcctataaggtcacacattgtaacactagttgaacaaaagtaaacaagcccattagtgggccttgtaccggtctgccctaaagggaaagggatggagaattagttctgctagttaacctag

SEQ ID NO: 12465 - DNA, 970 bp, Eutrema halophilum
gggagagagagggagtcattttctcttcgaaactcgcggcttgctttacaacagatccttcgttggagcttcttcgaaagggctagctaaaggaaaatgggacttaacttcacgaagttgttcagccggctttttgccaagaaagaaatgcggattctgatggtaggtcttgatgctgctggtaagaccactatcttgtacaagctgaagcttggcgaaattgtcaccaccatcccaaccatcggattcaatgtggagactgttgagtacaagaacatcagcttcactgtttgggatgtagggggtcaggacaagattcgtcccctgtggaggcactacttccagaacactcaaggtcttatattcgtggttgatagcaacgacagagaccgagttgtggaggcaagggatgagttacatcgcatgttgaatgaggatgaactgagggatgctgtccttcttgtgtttgcaaacaaacaagatcttcccaacgcaatgaatgctgcagaaataaccgacaagcttggccttcactctcttcgccaacgccattggtacattcaaagcacatgtgccacatctggggaaggtctctatgaaggccttgattggctctccaacaacatcgctagcaaggcatgatgaagctgctggaacactttttgcacttgaaagagaccattagtgattgtggagaagagagaatgaagaagaaaccagtattgtgtctgatgttttcaactgtccgttgatgtttatgtccttatgtgcgtgtagtccataaaactcacctctactcttttacccgtttaatggatttatgatagtttttacttttgccttctcgttattatgtcaaagtttgattccgtttatgctgactgatcacttggatccacgaccctccgttggttttagccttacgcttcgaattgtgtgtttcagtccagattttggttttgttggtttc

SEQ ID NO: 12466 - DNA, 877 bp, Gossypium hirsutum
cttcccggtctcctccgcccgttgccttcgtcccctccatctccggctgcgtcgccggcgagcccgacaccgcgaatcggatccgccgacaaggtgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacgcagggtctcatctttgttgtggacagcaatgatagggaccgtgttgttgaagcaagggatgagctccaccgaatgctgaatgaggatgagttacgtgatgctgtgttgcttgtttttgctaacaagcaagatcttccaaatgctatgaatgccgctgagatcactgataagcttggactgcattcacttcgccaacgtcattggtacattcaaagcacttgtgctacaacgggtgagggattgtatgaaggcctggactggctgtccagcaacattgcaaccaagtcctaaattgtcaagcgaggtttggatcatctaggagcttttggatgatgatgatgatgatggtgctggatatttagggttgggttggtatttccgtatgtaagatgtatgcccctgagctcggcagtttttgagctctgcttaagattctcacagttaaattgttttatgtaatttgggccttgagatgtttctgaaccaaacagctaaaagagttcagttgagttaaa

SEQ ID NO: 12467 - DNA, 918 bp, Zea mays
atcatcgtcaccccggagcctctccttcccggtctcctccgcccgttgccttcgtcccctccatctccggctgcgtcgccggcgagcccgacaccgcgaatcggatccgccgacaaggtgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacccagggtctcatctttgttgtggacagcaatgatagggaccgtgttgttgaagcaagggatgagctccaccgaatgctgaatgaggatgagttacgtgatgctgtgttgcttgtttttgctaacaagcaagatcttccaaatgctatgaatgccgctgagatcactgataagcttggactgcattcacttcgccagcgtcattggtacattcaaagcacttgtgctacaacgggtgagggattgtatgaaggcctggactggctgtccagcaacattgcaaccaagtcctaaattgtcaagcgaggtttggatcatctaggagcttttggatgatgatgatgatgatggtgctggatatttagggttgggttggtatttccgtatgtaagatgtatgcccctgagctcggcagtttttgagctctgcttaagattctcacagttaaattgttttatgtaatttgggccttgagatgtttctgaaccaaacagctaaaagagttcagttgagttaactggttgccattattaca

SEQ ID NO: 12468 - DNA, 887 bp, Pennisetum glaucum
cctccacatcctcctcccccgatccccaattcctcctccggatttcgcactcgacgcggcgcaggtggtgaagggagaaggggaagaagatggggctcacgttcacgaagctgttcagccggctcttcgccaagaaggagatgcggatcctcatggtggggctcgacgccgccggaaagaccaccatcctctacaagctcaagctcggcgagatcgtcaccaccatccccaccatcggattcaatgttgaaactgtggagtacaagaacatcagcttcactgtctgggatgtcgggggtcaggacaagatcaggccgctgtggaggcattacttccagaacacacagggtctcatctttgttgtggacagcaacgatagggaccgtgttgttgaagccagggatgagctccaccggatgctgaatgaggatgaattacgtgatgctgtgttgcttgtgtttgctaacaagcaagatcttccgaatgctatgaacgctgctgagattactgataagcttggactgcactcacttcgccagcgtcactggtacattcaaagcacttgtgctacatctggtgagggattgtacgaaggcctggactggctgtccagcaacattgccagcaagtcttaaattttcaagaggtttggatcatctaggagcttttggatgatgatattgctggatatttagggttgggttgatattcccgtatgtaaggtgtatgccctgagctcaatagttattgagcttggttaagatttcacagttaaaattgttttgtgtaatttgggcccttgagatgtttccgaaccaaactgctaaatagtgctccgttgagttaattggttggggaaatcgtgccggtatgcatcatggcaatgc

SEQ ID NO: 12469 - DNA, 863 bp, Pennisetum glaucum
ccgtgtcccacagcccgcgtcgccgccggcgatctcaccgcgaatcggatccgccgacaaggtcgagagggggagagatggggctcacgttcacgaagctgttcagccggctcttcgccaagaaggagatgcggatcctcatggtggggctcgacgccgccggaaagaccaccatcctctacaagctcaagctcggcgagatcgtcaccaccatccccaccatcggattcaatgttgaaactgtggagtacaagaacatcagcttcactgtctgggatgtcgggggtcaggacaagatcaggccgctgtggaggcattacttccagaacacacagggtctcatctttgttgtggacagcaacgatagggaccgtgttgttgaagccagggatgagctccaccggatgctgaatgaggatgaattacgtgatgctgtgttgcttgtgtttgctaacaagcaagatcttccgaatgctatgaacgctgctgagattactgataagcttggactgcactcacttcgccagcgtcactggtacattcaaagcacttgtgctacatctggtgagggattgtacgaaggcctggactggctgtccagcaacattgccagcaagtcttaaattttcaagaggtttggatcatctaggagcttttggatgatgatattgctggatatttagggttgggttgatattcccgtatgtaaggtgtatgccctgagctcaataactattgagcttggttaagatttcacagtgaaaattgttttgtgtaatttgggcccttgagatgtttccgaaccaaactgctaaatagtgctccgttgagttaattggttggggaaatcgtgccggtatgca

SEQ ID NO: 12470 - DNA, 1124 bp, Hordeum vulgare
gcgttcaaccgacgcgacccgtacaacacaaagcgctggctctcctccctcgcgtcgcttaaatacgacgccgcaggccccaacgcctggccactctctccccccttctctctcgcgaccccctgtttccgccccccttctccggctccggcgccggcgaacccaccgcggatcgagcggttcctccgatcaggagagacaaaccgagaggaagagcacctacgcgggaggagaggagatggggctcacgtttaccaagctgttcagccgcctgttcgccaagaaggagatgcggatcctgatggtgggtctcgacgcagccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacgcagggtctcatctttgttgttgacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccaacaagtcctaaattttcgtcaagattttgaaagagctaggagcgctttggatggatgattcaatcaccgggtacctagggattgtgttgggatgggatggtgctatgctattcccgtatgtactgtgtattttcctgagatcaacagttaccgagctccggctgtggtttcactgtcatactattgttttattgtattttgagccctaagatgtttctgaagtaaacagctaaagagagtcctgttcaatttcgtaataagtgttcaagcatctatctgtctatctatctatgcatgtatatattcagcaccgctccacttttatttgcgcatttgtttatagcactcggc

SEQ ID NO: 12471 - DNA, 864 bp, Cynodon dactylon
gctagaagcgacatctccaccccgagcctctcgctccccgtctcccctgacccgtcgttgtcttctccgtcgccggcgagctccagcaaggcggagggaagagatggggctcacgttcaccaagctgttcagccgcctgtttgccaagagggagatgcggatcctcatggtcggtctcgacgccgccggaaagaccacaatcctctacaagctcaagctcggcgagatcgtcaccaccatccccaccatcggattcaatgttgaaactgtggagtacaagaacatcagcttcactgtctgggatgttgggggtcaggacaagatcaggcctctgtggaggcattacttccagaacacacaaggtctcatctttgttgtggacagcaatgatagggatcgtgttgttgaagccagggatgagctccaccgaatgctgaatgaggatgagttacgtgatgccgtgttgcttgtgtttgctaacaagcaagatctgccaaatgcaatgaatgctgctgaaattactgataagcttggactgcattcacttcgccagcgtcactggtacattcaaagcacctgtgctacaactggggagggattgtacgaaggtctggactggctgtccagcaacattgccagcaagtcctaaattttcgagaggtttggatcagctaggagcttttggatgatgatacttggggatatctagggatgggttgctattccaatatgtaaaatgtgtatttcctgagctcaatagttattgagctttggtgaaggtttcagttattgttttctgtaatttgattgttgagatgtttctgaaccaaagagctaaagggagtcatgttgaattaatcacct

SEQ ID NO: 12472 - DNA, 1065 bp, Triticum aestivum
cactctctcccccttctctctcgtgacctcctgtttccgcccaccttctccggctccggcgccggcgaacccaccgcggatcgagcgattcctccgatcaggagaggccagccgggaggaagagcacctacgcgggaggagaggagatggggctcacgttcaccaagctgttcagccgcctgttcgcgaagaaggagatgcggatcctgatggtgggtctcgacgccgcgggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccaacaagtcctaaattttcgtcaagattttgaaggagctaggagcgctttggatggacgattgaatcaccgggtacctagggattgtgttgggatgggatggtgctatgctattcccgtatgtactgtgtattttcctgagatcaacagctactgagccagctccggctgtggtttcactgtcatactattgttttattgtattttgagccctaagatgtttcttctgaagtaaacagctaaagagagtcctgttcaatttcgtaataagtgttccaagcatctgtctgtctatctatgcctgtatatattcagcactgctcaacttttatttgcgcatttgttggtagcacttggggaagaagataagagtacgatatgctttcc

SEQ ID NO: 12473 - DNA, 1014 bp, Triticum aestivum
tggctctccaccctcgcgtcgcttaaatactacgccgcagccccacgcaaagccactctctccctccccccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccaacaagtcctaaattttcgtcaagattttgaaggagctaggagcgctttggatggacgattgaatcaccgggtacctagggattgtgttgggatgggatggtgctatgctattcccgtatgtactgtgtattttcctgagatcaacagctactgagccagctccggctgtggtttcactgtcatactattgttttattgtattttgagccctaagatgtttcttctgaagtaaacagctaaagagagtcctgttactaatttacgtaataagttcg

SEQ ID NO: 12474 - DNA, 1007 bp, Malus domestica
tcctctcatttgatccttcctcgttcctccaggtctctctctctctctctctctctctctctctctctctctctagaatttcttcgtcctaaattcgaattcttcgttaccagatttgaatcgtagatctacagttgcacgatcgatctttgatctccatctgaattcgattgaaaaatggggcttacgttcacgaagctcttcagccggctctttgccaagaaagagatgcgaattctgatggtgggtctcgatgcggccggtaagaccaccatcttgtacaagctcaagctcggagaaatcgtcaccaccatccccaccattggatttaatgtggagacagtagaatacaagaacatcagcttcaccgtctgggatgtcgggggtcaagacaaaatccgaccattgtggaggcactacttccagaacacacaaggtcttatctttgtggttgatagcaatgacagggatcgagttgttgaggcaagggatgaattacacaggatgttgaatgaggatgaactaagggatgctgttctgcttgtatttgccaacaaacaagatcttcctaatgcaatgaatgccgccgagataactgataagcttggtcttcattctctccgtcaacgtcactggtacatccagagtacttgtgcaacctctggagagggcttgtacgaggggttggactggctttccaacaacattgctagcaaggcatgagagaattgaggccaaggagtttggttgcttgccttggagattctggggaaggatagttttctttatttcgatgaatgttgtaatagcagaatgttttggagaaactctctctgaattcgtgtgtgtgtttgctactctagctatactgtttagctgtaaacgaagtttctatgtcgttacctttgttttgacacatgagccaaggttatattttatcgtgtttgcttcattaatctgtttgatttttacgatgaattggattcgataacttgttagattcaagg

SEQ ID NO: 12475 - DNA, 853 bp, Brassica juncea
atcttttcgcatcaagctcgaaaggatcagtagctgaaggagaaaatggggctttcatttggaaagcttttcagcaagctatttgcgaagaaggagatgcgtatccttatggttggtcttgatgctgctggtaagaccaccattctttacaagctcaagcttggtgagatcgttaccaccatccccaccattggttttaatgtggaaacagttgaatacaaaaacatcagcttcactgtgtgggatgtcgggggtcaagacaagatccgtcccttgtggaggcactacttccagaacactcaaggtctgatcttcgtggtcgatagcaatgacagagatcgtgttgttgaagcaagagatgaacttcacaggatgttaaacgaggatgagcttcgtgatgcagtacttcttgtgtttgctaacaagcaggatcttccaaatgcaatgaatgctgctgagataaccgataagcttggactccactctctccggcagcgtcattggtacatccagagcacgtgcgccaccaccggtgagggactgtacgaaggtctggactggctctccaacaacattgctaacaaagcttgagctttgtgagacgaaagctttggcttctgggagaagcattatctctgcttcttgttcaaaacctttttctctctttttttttttgagttttggtgattatggagtcgtatatgttgccagttaaaaatgatttattttgtgtctttaacgatagatataacagaacgttggtgatgaatttatttatcttttattacttttgggacaatgttcacatgtccgtgacaaattctcatttttctatgaacatgaagtaataata

SEQ ID NO: 12476 - DNA, 984 bp, Brassica rapa
atttagaggatacattttcacttaacctactcgcattgattgaaaacttctctctctctctctctctctctctctcgttcagatcttttcgcatcaagctcggaaggattagtagctgaagggggaaatggggctttcatttggaaagcttttcagcaagctatttgcgaagaaggagatgcgtatccttatggttggtcttgatgctgctggtaagaccaccattctttacaagctcaagcttggtgagatcgttaccaccatccccaccattgggtttaatgtggaaacagttgaatacaaaaacatcagcttcactgtgtgggatgtcgggggtcaagacaagatccgtcccttgtggaggcactacttccagaacactcaaggtctgatcttcgtggtcgatagcaatgacagagatcgtgttgttgaagcaagagatgaacttcacaggatgttaaacgaggatgagcttcgtgatgcagtacttcttgtgtttgctaacaagcaggatcttccaaatgcaatgaatgctgctgagataactgataagcttggactccactctctccggcagcgtcattggtacatccagagcacgtgcgccaccaccggtgagggactgtacgaaggtctggactggctctccaacaacattgctaacaaagcttgagctttgtgagacgaaagctttggcttctgggagaagcattatctctgcttcttgttcaaaacctttttctctcttttttttgttttgagttttggtgattatggagtcgtatatgttgccagttaaaaatgatttattttgtgtctttaacgatagatataacagaacgttggtgatgaatttatttatcttttattacttttgggacaatgttcacatgtccgtgtcaaattctcatttttttatgaacatgaagtaataataaacaccgtagagagttgaaagaagttgttgatggtatcgttatgtat

SEQ ID NO: 12477 - DNA, 777 bp, Brassica napus
aagtagctgaaggagaaaatggggctttcatttggaaagcttttcagcaagctatttgcgaagaaggagatgcgtatccttatggttggtcttgatgctgctggtaagaccaccattctttacaagctcaagcttggtgagatcgttaccaccatccccaccattgggtttaatgtggaaacagttgaatacaaaaacatcagcttcactgtgtgggatgtcgggggtcaagacaagatccgtcccttgtggaggcactacttccagaacactcaaggtctgatcttcgtggtcgatagcaatgacagagatcgtgttgttgaagcaagagatgaacttcacaggatgttaaacgaggatgagcttcgtgatgcagtacttcttgtgtttgctaacaagcaggatctcccaaatgcaatgaatgctgcggagataaccgataagcttggactacactctctccggcagcgtcattggtacatccagagcacgtgcgccaccaccggtgagggactgtacgaaggtctggactggctctccaacaacattgctaacaaagcttgagctttgtgagacgaaagctttggcttctgggagaagcattatctctgcttcttgttcaaaacctttttctctctctttttgttttgaattttggtggttatggagtcgtataagttgccagttaaaaatgatttattttgggattgtgatattaagattcttgtctttaacgatagatataacagaacgttggtgatgaatttatttatcttt

SEQ ID NO: 12478 - DNA, 768 bp, Echinochloa colona
tccccttccccgtctccggccgttgcctcccccgctcccggctgcgtcgccggcgatctcaccgcgaatcggatccgccgacaaggcgagaaggaagagatggggctcacgttcaccaagctgttcagccggctgttcgccaagaaggagatgcggatcctcatggtggggctcgacgccgccggaaagaccaccatcctctacaagctcaagctcggcgagatcgtgaccaccatccccaccatcggattcaatgttgaaactgtggagtacaagaacatcagcttcactgtctgggatgtcgggggtcaggacaagatcaggccactgtggaggcactacttccagaacacgcagggtctcatcttcgttgtggacagcaacgatagggaccgtgttgttgaagccagggatgagctccaccgaatgttgaatgaggacgagttacgtgatgctgtgttgcttgtgtttgctaacaagcaagatcttccaaatgctatgaatgctgctgagattactgacaatcttggactgcactcacttcgccagcgccactggtacattcaaagcacttgtgctacgactggtgagggattgtatgaaggcctggactggctatccagcaacattgccagcaagtcctaaattttcaagaggtttggatcatctaggagcttttggatgatgatattgctggatatttagggttgggttactattcccgtatgtaaggtgtattgagctttggttaagatttcacagttaaat

SEQ ID NO: 12479 - DNA, 1087 bp, Eucalyptus grandis
acgacagcgtaagccttcgaggtcaaacgcgtcacagcatttcgtgctctcctcccactttcgattcgagaggtcacgattgcacgacggactagaaaaacagagcagaggaaggagagagagagacagagagagagggaaaggagcgagagagcgagcctcgtcgtcgttcggaaaccgcgtcttctttctcctttctccgggagagatcgtcgctcctcgtcgaccaaggtacggcgaggtgaccatggggcttacgttcacgaagctgttcagccggctcttcgccaagaaggagatgcggattctgatggtaggtctcgatgcggccggtaagaccacgatcctctacaagctcaagctcggggagatcgtcaccacgatcccgaccatcggattcaatgttgagacggttgaatacaagaacataagtttcaccgtgtgggatgttggtggccaggacaagatccgtccattgtggaggcactacttccaaaacacgcagggcttgattttcgttgttgacagcaatgatagagatcgagtagtggaggcaagagatgaactgcataggatgttgaatgaggatgagctgcgcgatgctgttcttcttgtttttgccaacaagcaagatcttcctaatgcaatgaatgctgcagaaataactgataaacttggtcttcattctctccgtcaacgccattggtacatccagagcacatgtgcaacctccggtgaaggtctctatgagggtctggattggctttccaacaacattgctagcaaggcttgaggcatttgtggattttggttggcagacttgctgaagtaatttgatcctgggacagagttgattttcttttgctgaatgttttaatcatataatcatatgctagaatccttttatgttatgcaagtttgtgtagttcttttctgaagctaattacacctagatgtaaactcaaggtcacatcatgtctgaacattcaggatgagtaaatttcttgtgctgttgggaaggtccatgaataaagtatgtagatttgggttctgcttctacgtattatatagaaagatttcatggcca

SEQ ID NO: 12480 - DNA, 760 bp, Adiantum capillus-veneris
gattctcctctgagagaggtgaagcaaaggagggcgagatgggtctctctttcaccaagctgtttagccggttatttgcgaagaaggagatgcgcattttgatggtgggtctcgatgcggctggaaaaaccaccattctctacaagctcaagctcggcgagatcgtcaccaccatccccacaatcggatttaatgtggaaactgttgagtacaagaacatcagctttacagtttgggatgtcggaggccaagacaagattcgacctttgtggaggcactactttcaaaacacccaaggcttgatctttgtggtggatagcaatgacagagatcgtgtggtggaagccagggatgagcttcatagaatgcttaatgaggatgagctgagggatgctgttcttctcgtctttgcaaacaagcaagatcttccgaatgctatgaatgctgctgagattactgacaagctgggcttgcattctctccgccagcgccattggtacattcagagcacatgtgcaacttctggagaaggactttatgaaggcttggactggctttcgggcaacattgctagcaaggcttaagctggaaaaggctgctgctgctgctgtgcaaactcaaggttggtttggacgtggttgtgggctctcatgaaaatagattgagccaatgggtgttgctgtgataagaggcttttcattggccccaaattttgtactaaactatttttttcaatggttgggttatttggcagtttttt

SEQ ID NO: 12481 - DNA, 902 bp, Lotus japonicus
ggcctctttcatctttctctgagaataaacaaaaaatcaattcgagattcgctcttctctccaaaacctttgaaatcgagaagagcgattggtgggagtgaagatggggttgacgttcacgaagctgttcagcaggttgtttgcgaagaaggaaatgaggattttgatggtgggtctcgatgctgctggtaagactaccatcttgtacaagctcaagctcggtgaaatcgtcaccactatccccaccattgggtttaatgttgagactgtggagtacaagaacatcagcttcactgtgtgggatgttgggggtcaggacaagatccgtccactgtggaggcactacttccagaacactcagggacttatttttgtggttgatagcaatgatagagaccgtgttgttgaggcaagggatgagttgcacaggatgttgaatgaggatgaacttagagatgccgtcttgcttgtttttgccaacaaacaagatcttcccaatgcaatgaatgctgctgaaataactgacaagcttggacttcattcactccgccaacgccactggtatatccagagcacttgtgcaacatctggagagggtctctacgagggtttggactggctttccaacaacattgccagcaaggcatgagacatttgaaatttttggtgtggtctggccttttcatgcgggtctggcggttcttggagaaggatgcttttcctttctagtgaatgttgtaatagcagaatgtttgttagaaatattcacttttttagtgtaacttgggtttgtatgattacttaaatcagctaatacttttagctatagttgggtttgcatgacacttatttttcatgtttattttgtttgtttcattgtctcgttgaatatttccatcggt

SEQ ID NO: 12482 - DNA, 1171 bp, Populus trichocarpa
ctttgacactaacgtcattaacggcgttaactcacgtccatggctagattctatacgcacatagataaatatccccttctctttctcatttctttcatctcccatctctgcacagcttcttagcagatcctgccctctctcttcgtcttcgttctgtgagaacaaggaaagatggggctctcattcaccaaactttttagccgtctgtttgccaagaaagaaatgcgaattctcatggtgggtcttgacgctgctggtaagaccaccatcttgtacaagctcaagctcggagagattgtcaccaccattccaacaattgggtttaacgtggagactgtggaatacaagaacataagcttcactgtctgggatgtaggtggtcaggacaagatccgaccattgtggaggcattatttccaaaacactcaagggctcatctttgtggttgatagcaatgatcgtgaccgtgtggttgaagctagggatgagctgcaccggatgttgaatgaggatgaattgagggatgctgtgctacttgtgtttgcaaacaagcaagatcttccaaatgctatgaatgctgctgaaattacagataagcttggtcttcattcactccgtcaacgccactggtatatccagagcacctgtgccacttctggtgaaggcctctatgagggactggactggctctccaacaacattgctagcaaggcttaagagatggatcgatttctgcagctttttggatagcactctacttcaaattgggaatcgtgctaggttgtttggtgttcagatttttaatcctgtaattgtcaagagaatgtatgtttggttgtgtaagatattgttactgtaatagaaattgacaaattatccctataggttttaaaataattcatgattcacagtttttaacataatgtatcttgattctagttttatgctagtggagtttttgaagaactgtgcttctttcaatgaccagccattgtttcattgcattctctcaagtaatgtagttctacgggccggtcaaatttttgagtgtacagaaggaagctgagacgacggtgctattttaaaaaagcaagaaaagttttatatcaggtagtttaataattttatttaaactatagacaataatagtagacaaattgaaaaacaaact

SEQ ID NO: 12483 - DNA, 1144 bp, Populus trichocarpa
cgaaaatcaaccaaaaaatgtggggtctacaaattgaatatcaatttttaccctaacctcgttaaatcactacgccgttaactcatcgcttccatcaagcaaagatccataaatagagcccgtatcttttccatatccttcatttctttctgggcagcttctcttctctgtagaccctgccctctccctccctcactttctctgcttgatttaggaaagatggggctttcattcactaagctttttagccgtctttttgccaagaaagaaatgagaattctcatggtgggtcttgatgctgctggtaagactaccatcttgtacaagctcaagcttggagagattgtcaccactattcctacaattgggtttaatgtggagactgtagaatacaagaacataagcttcactgtctgggatgttggtggccaggacaagatccgaccattgtggaggcattatttccaaaacactcaagggctcatctttgtggttgatagcaatgatcgtgaccgtgtggttgaagctagggatgagctgcaccggatgttgaatgaggatgaattgagggatgctgtgctacttgtgtttgcaaacaagcaagatcttccaaatgctatgaatgctgctgaaattacagataagcttggtcttcattcactccgtcaacgccactggtatatccagagcacctgtgccacttctggtgaaggtctctatgagggactggactggctctccaacaacattgctagcaaggcttaagagatggatcgatttctgcagcttttcgggcagcattctgcttcaatttgggagactatttaggttgtttggtgttcaaggattccttatcctgtgaggttgttaagagaagaatgtatttgtttggttttgtaagatattgttactgtaatagaaagtggcaaattatccctaatagatactaaaataattcatgattcacagtttttaacatgatgtatcttgattcaagtcaggttctgtaattcatgctattggggcttttgtagagtatggttctttcattgaccagccattgcttgattccggcggctgccattttaaattacaataatgctgtaaaactttgaccgaatgcatgtacatctcccgtgttgac

SEQ ID NO: 12484 - DNA, 1148 bp, Amorphophallus konjac
cgcgtacattgaacgcggaatccgcttcttccacatcgccggcacacctcccatcccggcccacaccccctcaccacgataaatggagggacggcagaaacggagaagacgaccgcgtgggctcgctgttattagtggtcgtttcagttccctccgtccccgccgtgtccgttcccggaggagcgagaggggagagagaaggagcagccggcgctggtgccggagcccacccccgtccccgcccctctcgcgtcctcgtcgcctccgccgccgtgctcgcgtctccaccttcccctctggtgagcgaagatggggctaacattcgcgaaactcttcagccggctattcgccaagaaggagatgaggatcctgatggtcgggcttgatgccgccggtaagacgactatcctctacaagctcaagctcggagagattgtcaccaccatccctaccatcggatttaatgtagagaccgtggagtacaagaacattagcttcactgtatgggatgttggcggtcaggataagatccgacctctttggaggcactactttcaaaacacccagggccttattttcgttgtggacagcaatgatagggatcgtgttgttgaggcaagagatgaactccacaggatgctaaatgaggatgagttacgagatgctgtgttgcttgtatttgcaaacaagcaagatcttccaaatgcaatgaatgctgctgaaatcaccgataagcttggtctgcactccttacgtcaacgacactggtatatccagagcacttgtgccacttctggtgagggtttatatgagggacttgattggttatccagcaacatcgtcagcaaggcttgaaccttttatggcgtcaagagtaggagaagtgcttgaagactctggacaggattgctgctgctgcatttcttactgccatttggatttcttcgaatccgttgcctgttgatttgctaaagacttgtctttgtagtgattgagatgcctggtctacattataggttatgtttatggagttaatttgcggaaatttgcattccatggctcatttctcattcagtactggtgggtttttttgttgttcactccgccaattggttccttccttccttcttgaaaccatccattttttt

SEQ ID NO: 12485 - DNA, 848 bp, Amorphophallus konjac
acctgccgaatcaactagccccgaaaactggatcggcgctcaagcgcgcgacccacacccggccgccggggcctccgccgccgtgctcgcgtctccaccttcccctctggtgagcgaagatggggctaacattcgcgaaactcttcagccggctattcgccaagaaggagatgaggatcctgatggtcgggcttgatgccgccggtaagacgactatcctctacaagctcaagctcggagagattgtcaccaccatccctaccatcggatttaatgtagagaccgtggagtacaagaacattagcttcactgtatgggatgttggcggtcaggataagatccgacctctttggaggcactactttcaaaacacccagggccttattttcgttgtggacagcaatgatagggatcgtgttgttgaggcaagagatgaactccacaggatgctaaatgaggatgagttacgagatgctgtgttgcttgtatttgcaaacaagcaagatcttccaaatgcaatgaatgctgctgaaatcaccgataagcttggtctgcactccttacgtcaacgacactggtatatccagagcacttgtgccacttctggtgagggtttatatgagggacttgattggttatccagcaacatcgtcagcaaggcttgaaccttttatggcgtcaagagtaggagaagtgcttgaagactctggacaggattgctgctgctgcatttcttactgccatttggatttcttcgaatccgttgcctgttgatttgctaaagacttgtctttgtagtgattgagatgcctggtctacattataggttatgtttatggagttaattt

SEQ ID NO: 12486 - DNA, 850 bp, Arabidopsis thaliana
cgtctttgtgctgctgattggaagcttctctctctctcggtttagatccctttcaattctccaaaggatcaacagttaaaaggaaaatggggctttcatttgcaaagctttttagccggctttttgccaagaaggagatgcgaatccttatggttggtcttgatgctgctggtaagaccaccattttgtacaagctcaagcttggtgagattgtcaccaccattcccaccatcgggtttaatgtggagacggttgagtacaagaacatcagcttcacggtttgggatgtcgggggtcaggacaagatccgtcccttgtggagacactacttccaaaacactcaaggtctgatatttgttgttgatagcaatgacagagaccgtgttgttgaagccagagatgaacttcacaggatgttgaatgaagatgagcttcgggatgcagtattgcttgtgtttgccaacaagcaggatcttccaaacgctatgaatgctgctgagattactgataagcttggccttcactcactccggcaacgccactggtacatccaaagcacatgcgcaactagcggtgaagggctctatgaaggtctggattggctttccaacaacattgctagcaaagcttgaggttatctcgaccagatagttttggtgaggggattgaagctttctctccggagtcgacttgatttcttgtggtttaagacctgctcgatttgtttcatgttttactgtcaccgtttctcctttttgcttactcttctcgaatgtttgaattcttctaggctttaaaagacttcttttttttttttaattggagttaaaaaatcacatcacttattttc

SEQ ID NO: 12487 - DNA, 980 bp, Vaccinium corymbosum
gcatctccccgaaaaaccttctctgtctctgcgcccttccttccatccgatccttctgcgagatctctgttgatctcacatcagtgacagtgaccagtgatagctgaagcaaagcagagatggggttgaccttcacgaagctattcagcaggctttttgccaagaaagagatgcgaattctcatggtaggtcttgatgctgctggtaagactaccatcttgtacaaactcaagcttggagaaattgtcacaacaattcctaccatcggattcaatgtggagacagtggagtacaagaacattagcttcacagtttgggatgttggtggtcaagacaagatccgccccttgtggaggcactacttccagaatacacagggacttatatttgtggtggatagcaatgatagggatcgagttgttgaggcaagagatgagctgcataggatgttgaatgaggatgagttgagagatgctgtcttgcttgtgtttgctaacaaacaagatcttcctaatgcaatgaatgcagcagaaataactgacaagctcggtcttcattcactccgacaacgccactggtacattcagagcacatgtgcaacctctggagaggggctttatgaagggctggattggctttccaacaacatcgccagcaaggcttgaggctgtcgaggatttcgtttgatgctggaattttttgcttatgctgcgttagatatgtatgctatctttggtttttatgagatcttttggctattcctagtgttaatctatcttgaatacctgagtgacgacgttactgtaatatgattggcatgatatactttcagaacctacttcgcctgtaatatcactgctacttttcgcttgcgatgacactcttgtctttgctattcccatttctttcggaaatgagcagcagcgatttggatgggttgttttggttatttttgccgcaaattttatctgcatgattcc

SEQ ID NO: 12488 - DNA, 800 bp, Cleome spinosa
gcggcaggcgatctagatctcgagctctcttgttcttcttcggatcggaaaatggggctgtcttttgggaagttgttcagcaggctctttgccaagaaagagatgcgtatccttatggtgggtcttgatgctgctggtaagacgaccattttgtacaagctcaaactcggtgagattgtgaccactatcccaaccattgggttcaatgtggagacagtggaatacaagaacatcagctttaccgtctgggatgtcgggggtcaggacaagatccgtccattgtggagacactacttccagaacacccaggggcttatctttgttgttgacagcaacgaccgagaccgtgttgttgaagccagggacgagcttcacagaatgctgaacgaggatgagttgagggatgccgtgctgctcgtgtttgctaacaagcaggatcttcccaatgcaatgaacgctgccgagatcactgacaagctcggtctccactctctccgccaacgacactggtacattcagagcacatgtgccacctcgggcgaaggtctgtacgagggccttgactggctatccaacaacattgcgaacaaggcatagaccagaggcatgtgtccgagccatggacctcgacaacatataaagtagtcagaatcctctgttgtctctgcttgttttggtaatctttgctagtgaaactactatttgttgtcattcttcactctctctccttcgttattcaatttcaaactatgttttgtctctttgtacttcccttaataattgaaaaatctgatttttct

SEQ ID NO: 12489 - DNA, 912 bp, Cucumis sativus
acctccggtattccttcaatccaaatctctttcacttttcaaatcttctttcaattatcccttatcgcttctcttcttacacaaagtgaaatagccggctaagtgaaaggagaaatgggattgactttcaccaagctcttcagtaggctttttgccaagaaggagatgcgaattttgatggttggtcttgatgctgctggaaagaccacgatcttgtacaagctcaagctcggagaaattgtcacaactattcctacaattggatttaatgtggagactgtggaatataagaacatcagcttcactgtatgggatgttggtggtcaggacaaaattcgaccactgtggaggcattacttccaaaacacacagggtcttatatttgttgtggatagcaatgacagagatcgtgttgttgaagcaagagatgaattgcacagaatgttgaatgaggatgaactgagagatgctgtgttgctcgtatttgccaacaagcaagaccttccaaatgcgatgaatgctgctgaaataaccgacaagcttggtcttcattcactccgtcaacgtcactggtacattcagagcacctgtgcaacttctggagagggtttatatgagggtttagactggctttccaataatattgctagcaaggcatgaggcagttgaggttttcggctgtcagactctggaccgtgggtgaagtttggtgatgatagggggtatagtttgtttttctaaagatgtgtcgttagcagcagaacagtttgccagacttctatatgtactctctgtttgtatacttgcggcttgatctaaaattatctaaccttgttatagtttctttggagaagttaatcttgtcataatttccatcactttgctttagagatctccattgtctctctactt

SEQ ID NO: 12490 - DNA, 825 bp, Cyclamen graecum
ctctctagatctctctgaaaacaccctccggcagggatccattgaaaaagatggggttgacattcacaaagcttttcagtcggctttttgccaagaaagagatgcgtattcttatggttggtctcgatgctgccggtaagaccacaattttgtacaagctcaagcttggagagatagtaaccacaattcccaccattggcttcaatgtcgagactgttgagtacaaaaacatcagcttcacagtgtgggatgtcgggggtcaggacaagattcgcccattgtggaggcactatttccagaacacacaaggtctcatatttgtggtggatagcaatgatagggatcgtgttgttgaggctagagatgagctgcatcgcatgctgaatgaggatgagctgcgtgatgcggtgctgctcgtgtttgctaacaaacaagatcttcccaatgctatgaatgctgctgaaataactgacaagctcggtctccactcactcagacaacgtcattggtacatccagagcacctgtgctacatcaggcgaggggctctacgagggtctggattggctctccaataacattgctagcaaggcatgaaacagtttggaaaactcacggggatgatcctgaatgttatcggcttttatgtcggccatttcttcccctttattttttccgttgtctctctgtcagatggtgtggtgttatgatttgcgacttcttttaatgtatttttcatttcatctagggtcttaaaatggcttgtttaatagaatggtgaaatatgttaattttttactagcaatatctttaaatttgaatgtga

SEQ ID NO: 12491 - DNA, 625 bp, Cyclamen graecum
tgctagatcccttcccagacaccttttagcagggaacaattgacaacaacagagatggggctgacattcacaaagcttttcagtcggctctttgccaagaaagagatgcgcatccttatggttggtctcgatgctgctggtaagaccacaattttgtacaagctcaagcttggagagattgtgaccacaattcccaccattggctttaatgtcgagactgttgagtacaaaaacatcagcttcactgtgtgggatgttgggggtcaggacaagattcgtccattgtggaggcactatttccagaacacacagggtctcatctttgtggtggatagcaacgacagggaccgtgttgttgaggcaagagatgagctccatcgcatgttgaatgaggatgagctgcgtgatgcagtgcttcttgtctttgctaacaaacaagatcttcccaatgctatgaatgctgctgaaataactgataaactcggtctccactctctccgacagcgtcactggtacatccagagcacctgtgctacatctggcgaggggctctacgagggtctggattggctctccaataacattgctagcaaggcatgaaacagtttggaaaactcacggggat

SEQ ID NO: 12492 - DNA, 1097 bp, Eucalyptus grandis
gagaggtcattattaagcaacccaagcgaagacggggtctcgttcaaacgctgcggctccttttcgcacagagaaagacccaaatagtgatttttctcatctgggttgagctagagcgtttgggaccatggggctcacgttcacgaagctctttagccggctcttcgccaagaaggagatgaggattctgatggtgggtctcgatgccgctggtaagaccaccatcttgtacaagctcaagctcggagaaatcgtcaccacgatccccactattggatttaatgtagagacagtcgaatacaagaacatcagcttcacagtttgggatgtcgggggtcaggacaagattcgtccattgtggaggcactacttccagaacacacaaggtttaattttcgttgtggatagcaatgatagggatcgagttgttgaggcgagagatgagttgcatagaatgctgaatgaggatgagctgagagatgccgttttgcttgtgtttgcgaacaaacaagatcttcctaatgcaatgaatgcagctgaaataactgacaagcttggtcttcactctctccgtcaacgccattggtacatccagagcacctgtgcaacatctggagaaggactttacgagggtctggattggctttccaacaatattgccagcaaggcttgaaatctctgaggactttgacaggcttcacgacggggcaccagaattatgtttggtcttgaaaggatttagtctttgtttttgctgttgatatactgttgtaaaagctcaaatggtttgctagagctttatctgtgtaatgtgacatgggattgcataactgctgtttttggctaaatacttttaagcagtacaaatggctctttaagacctttctaaacttccgatcaaggtttgtatggagattaaaccgagctgtattatgataaactgatagattccaagcagattctcttgactcaaaatgtaatgttaacagtgattttacccttctagatgctagagggtatgccaccgggtcattcggtatgatggagcaagtaacattgttataaactcaatggaggagaggagacgttttgggatt

SEQ ID NO: 12493 - DNA, 938 bp, Arachis hypogaea
gtggtatcaacgcagagtacgggggctctttctcgttgtgtgtttttccgtatctcgaatcgctcttctctgcaacgccaaaagctccttcgaaaacctcgactacgagaagagtgattgaagctttgaagggatggggttgacgttcacgaagctgttcagcaggctcttcgcgaagaaggagatgaggattctgatggttggtcttgatgccgctggtaagactacaatcctctacaagctcaagctcggagagatcgtcaccactatccccaccattggatttaatgttgagaccgtggagtacaagaacatcagcttcactgtgtgggatgttggtggtcaggacaagatccgtccattgtggaggcactacttccagaacactcagggtcttatttttgtggttgatagcaatgacagagatcgagtagttgaagcaagggatgagttgcaccggatgttgaatgaggatgaactgagggatgctgttttacttgtttttgccaacaaacaagatcttcctaatgcaatgaatgctgctgaaattactgacaagcttggacttcattcactccgccaacgccactggtacatccagagcacttgtgcaacctctggagagggtctctatgagggtttggactggctttccaacaacatcgcaagcaaggcatgagacttgaaaaatttttggtgtggtctggtaattccacgcttgtgtggcggttcttggagaaggatggtgtttacctttcaagtgaatggatgtaatagcagaatgttttgttagaaatattatccacttcactctgtaacttgggtttgtaccttgtatgattgcttaaattagctaatacttttagctataattggaactcttgcaatctcatttggctaccaaaaaaaacaaaagtactctgcgttgataccactgc

SEQ ID NO: 12494 - DNA, 1168 bp, Populus trichocarpa
aaattcccagcgcacatagatagcccatccgtctctctttcccatttctttcatccccctctctgcacagcttctctgcagatcctgccctctctcttcctctgcgtctctctaagaacttggaaagatggggctctcattcaccaagctttttagccgtctgtttgccaagaaagaaatgagaattctcatggtgggtcttgatgctgctggtaagaccaccatcttgtacaagctcaagctcggagagattgtcaccactattccaacaattgggtttaatgtggagaccgtggaatacaagaacataagcttcactgtctgggatgttggtggccaggacaagattcgacctttgtggagacattatttccaaaacactcaagggctcatctttgtggttgatagcaatgatcgtgaccgtgttgttgaagctagggatgagctgcacaggatgttgaacgaggatgaattgagggatgctgtgctacttgtttttgcaaacaagcaagatcttccaaatgctatgaatgctgctgaaatcacagataagcttggtcttcattctcttcgtcaacgccactggtatatccagagcacttgtgccacttctggtgaaggtctttacgaaggactagactggctttccaacaacattgctagcaaggcttaagaaatgggttgatcatgcaactttttggatcgcacttaccttgggaatcttgcgaggttcggtgtttgcacttactttgggaatcttgctaggtttggtgttgcggatttcatatcctgtaatcggcaagagaatgtatctttggttgtgtaagatattattactgtaatagaaattgactaattatccctatagttttgaaataattcatgattcacagctttaacaagatgtatcttgatacaagtttattgctagtggagctctgcgagattaatgtttctttcattgaccagccattgcttgatggcaattttttttgtagttaatatattgcaatgcaggacattcgctatttttctgcgaatgtacgctatatttcggcgaatgttgtacatttgatttctattatcagtttgcacgaacgatgaacagtcctgatcagacttttctgcagacatcataaatttataatgctttggttctggttttttc

SEQ ID NO: 12495 - DNA, 921 bp, Prunus mume
aattttgattttactgtatggtctgattgtatgtggcagacaatttgataaaaatggggcttaccttcacgaagctcttcagcaggctctttgccaagaaagaaatgcgaattctcatggtgggtctcgatgccgctggtaagactaccatattgtataagctcaagctcggagaaattgtgaccaccatccctaccattggatttaatgtggagacagtagaatataagaacatcagcttcactgtgtgggatgtagggggtcaagacaaaatccgtccattgtggaggcactacttccagaacacacaaggtcttatttttgtggttgatagcaatgatagggatcgagttgttgaggcaagggatgaattgcataggatgttgaatgaggatgaactgagggatgctgttctgcttgtatttgccaacaaacaagatcttcctaatgcaatgaatgccgcagaaataactgataagcttggtcttcattctctccgccaacgtcactggtacatccagagcacttgtgcaacctctggagagggtctgtacgaggggttagactggctttccaacaacattgctagcaaggcatgagagtcaaggtcaaggagtttcgttgcttgacttggagattctggggaggagagttttcctttatttcgatgaatgttgtaatagcagaatgttttggcgagacgttgtcagaaatcatgtgtgtatttgctactctagctataatgtttagctgtaaacgaagttgctatgttgttacaatcattttgacgcatgagccaagtttatatttatcgtgtttgcttcaattgtctgctcttcatgtttcgaccaaaacatcaaattttgaagttaaaaaagaagaaaaacttaattagagatcatgcgcggctgtattttcgca

SEQ ID NO: 12496 - DNA, 991 bp, Pteridium aquilinum
acttgcgggttaagagaacctcttgtgagcagatattagagagagagagaaaggaagaaggggtcagggctctctacggaggtcagagagcgagagaaagagagagagagagagagagactagtatcgatctgagcgagcgagtgagagcagatcagatccttgcagaggagagggagtatctgggcggatctgatccccaccagagagagagagagagagagagcatcagatccttgcaagactgtgtgtgagagagggaggggcgccatgggtctgtctttcacgaagctgtttagccggctgtttgcgaagaaggagatgcgcattttgatggtgggtctcgacgcagccggaaagaccaccattctttacaagctcaagcttggcgagatcgtcaccaccatccccaccatcggtttcaacgtggagactgttgagtacaagaacatcagtttcactgtttgggatgtgggaggccaagacaagatccgacctctgtggaggcactactttcagaatacacaaggcctgatatttgttgttgatagtaacgacagagatcgtgttgtggaagccagagatgagcttcatagaatgcttaatgaggacgagctgcgggatgccgttcttctcgtatttgcaaacaagcaggatcttccaaatgcaatgaatgcagctgaaatcactgacaagctggggttgcactctctgcgccagcgccactggtacatccagagcacatgtgccacctctggagaaggcctttacgaagggctggactggctttcaggcaacattgctagcaaggcttaaatcggagttaagctggtccttgagcatgagatgtgtttttgacatggtgatgctgggttcttgcacaagtacggtttggctgctgtttttgagccaatgggctttttggttataaaaggctttctttctattgcctaagtctctgtacttattgattattttttaatatgttgatt

SEQ ID NO: 12497 - DNA, 967 bp, Raphanus sativus
ggattgaaaacttctctctctcggacagatattttcgcatcaagctagaaaaggatcagcaggtgaagtgaaaaatggggctatcatttgcgaagcttttcagcagactatttgcgaagaaggagatgcgtatccttatggttggtcttgatgctgctggtaagaccaccattctttacaagctcaagcttggtgagatcgttaccaccatccccaccattgggtttaatgtggaaacagttgaatacaaaaacatcagcttcactgtctgggatgtcgggggtcaagacaagatccgtcccttgtggaggcactacttccagaacactcaaggtctgatcttcgtggttgatagcaatgacagagatcgtgttgttgaagcaagagatgaacttcacaggatgttaaacgaggatgagcttcgtgatgcagtccttcttgtgtttgctaacaagcaggatcttccaaatgcgatgaatgctgctgagataaccgataagcttggactccactctctcaggcagcgtcattggtacatccagagcacgtgcgccaccaccggtgagggactgtacgaaggtctggactggctctccaacaacattgctaacaaagcttgagctttttgagaagaaagctttggcctctgggagaagcattatttctgctttcttgttcaaaacctctttctttttttgttgagttttagtcatttgatattgttctacgttttacaggcttgagctttttgagacgaaagctttggcctctgggagaagcattatctctgctttcttgttcaaaacctctttctttttttgttgagttttagtgattatggagtcgtatatgttgccagttaaaaatgatttattttgggattgtgatattaagattcttgtttttaacaacagatattataaaatgttggtgatgaatttatttatcttttacttattttgggaca

SEQ ID NO: 12498 - DNA, 979 bp, Oryza sativa
gaggagatgagagaggccacgcgcgcgcacgagatcgatctccagcaaggtcttgcacaactgcggcaagatgggcctcactttcacgaagcttttcagccgcctcttctccaagaaggagatgaggatcctcatggtcggtctcgacgcagctggtaaaaccacaattctctacaagctcaagcttggagagattgtcaccaccattccaacaatagggtttaatgtggagactgttgaatacaagaacattagcttcactgtctgggatgtcgggggtcaagacaagatcagacctttgtggaggcactatttccagaacactcaaggtctcatctttgttgttgatagcaacgacagagatcgtgtggttgaggcaagggatgaactccacaggatgcttaatgaggatgagttgagggatgcggtgttgctggtttttgctaacaagcaagatcttcctaatgcaatgaatgctgctgagatcacagataagcttggtctccattccctgcgccaacgccactggtatatccagagtacatgcgccacaacaggagagggtttatatgagggccttgactggctctcgagcaacattgcaaacaaggcctgattggatgaccagaataccacattacatagcagttgcattttctggagaacggaggagatggtcattttgatactgagatttggattattatttcactggagtgttcgttgaatatattgtatttcttcgttaggcttttcagatctggtttgttatgttacctagctactctctacaaccccttccggtattattaagagactaattgtcagcttgaactatatcatatattcatatacgatatacccgagtaatgcagttcttttcctcaattaatcgttgctaatgcccactaaattccctatgtgttgagtactggtacacataacaatcatcacgaattcatgacaactgggatttcca

SEQ ID NO: 12499 - DNA, 808 bp, Rosa hybrid cultivar
tccttccacggtttccttcctccagcaaaagttgaaaaaaaaaatggggctgacgttcacgaagctcttcagccggcttttcgccaagaaagagatgcgaattctgatggtcggtctcgacgccgccggtaagaccaccatcttgtacaagctcaagctcggagaaatcgtcaccaccatccctaccatcggatttaatgtggagactgtggaatacaagaacatcagcttcactgtgtgggatgtagggggtcaggacaagatccgtccattgtggaggcactacttccagaacactcaaggtcttatttttgtggttgatagcaatgacagggatcgagttgttgaggcaagggatgagttgcacaggatgttgaatgaggatgaactgagggatgctgttttgcttgtatttgccaacaaacaagatcttcctaatgcaatgaatgctgcagaaataactgataagcttggtcttcattctctccgccaacgtcactggtacattcagagcacatgtgcaacctctggtgagggactgtacgagggattggactggctttccaacaacattgctagcaaggcttaagataatgaaggccaaggagttcagtttgccttggagattctggggaaggatagttttctttgtttccagtgaatgttgtaataggagaacgttttggtgagactttgtcttctgattttgtgttgtgtatttgctactttagctatacttcagctataaacagagtttgctaattactatgttacagtcttccttaagcaaaaaaaaaaaaaaaactaa

SEQ ID NO: 12500 - DNA, 1337 bp, Glycine max
aattggaggacacacaatgcgtcgccgtatcgaagacatttgttgttaaataacggtggaagtgaaactgcgatctctctctctctttcactctttctccgagaacaaaaaaaaaaacgtgattcgctcttctcttcgaataaaccacaaaaccaacaaacgagaagaggagtgagagaagatggggttgtcgttcacgaagctgttcagcaggttgtttgcgaagaaggaaatgaggattctgatggtaggtctcgatgctgctggtaagacaaccatcttgtacaagctcaagcttggagaaatcgtcaccaccatccccaccatcggatttaatgttgagactgtggagtacaagaacatcagcttcactgtgtgggatgttggtggtcaggacaagatccgtcctctgtggaggcattatttccagaacactcagggtctcatttttgtggttgatagcaatgatagggatcgagtggttgaggcaagggatgagttgcacaggatgttgaatgaggatgaacttagagatgctgttttgcttgtttttgccaacaagcaagatcttcctaatgcaatgaatgctgcagaaataactgacaagcttggacttcattcactccgtcaacgccactggtatatccaaagcacttgtgcaacttctggagagggtctctatgagggtttggactggctttctaacaacattgccagcaaggcatgagacatttgaaaatttttggtcttgtctggtgatttcctgctgagtatggcggttcttggagaaagatgcttatcctttcttgtcaatgttgtaatagcagaatgcttgctagaagtattctcttcttttgtgtaacttgggtttgtatgattgcttaaattagctaatacttttagctataattggaactcttggaccctcttgtgcgtgccttgtttgtgttcattttgttagtttgatttttggttgaatgaggattagaaaattgcgccagtttttgctcttgggccaagagtcacctgttcaaatattgtctttgcgaaattccagttcagatagacttggtacctgtttgttttaaagttgagcagacctaattttgatagaattggttaattatttattgtgattcagatgtgtgtctaaattaattatagtaataaagtttatattgaaacatgtattatggtgtacaattagaggattttttttgttaaatatcaattagaggatgagaaaaagttgacattttagaaattaagatgggcaaaattagaaaaatattgtgtagttcctaacttataagtcataacttatcatcaaaactgaa

SEQ ID NO: 12501 - DNA, 908 bp, Tabernaemontana elegans
gaaagacgcagcccttctctctgcggcaggaaactcttcccactcgattcttctctgaagctttcgagagtgttgagtggtacatagcaaaggcaaagcagagatggggctgacattcaccaagctgttcagcaggctctttgccaagaaagagatgcgaattctgatggtaggtcttgatgctgctggtaagactaccatcttgtacaagctgaagcttggagaaatcgttaccactattcccaccatcggtttcaatgttgagactgtggaatataagaatattagcttcactgtatgggatgttggtggccaggacaagatccgtcctttgtggaggcactactttcaaaacactcagggccttatctttgtggtggatagcaatgacagggatcgagttgttgaagcaagagatgagctgcataggatgctgaatgaggatgaactgcgagatgctgtcttgcttgtatttgctaacaagcaagatctgcccaatgcaatgaatgctgcagaaattactgacaaacttggtctccactctctccgtcagcgccattggtatattcagagcacctgcgcaacttcgggggagggcctctatgaagggctggattggctttccagcaatattgctaacaaggcataaggcaggaaagaacttcatcgcggttgggaattttgtggggttcatagttggatactgttttgctttatatgtgattggtgattcctagatatgataatttcgtattttgtctttttttaatctggaagcgtgatgtagcataaattacttttgaaggtctttgttggcgtgatgtttttcttgtttaattgactttttcatcaactataagccctggataccgcgtaatggaatgaaattggacgcttgttggcaattt

SEQ ID NO: 12502 - DNA, 856 bp, Eutrema halophilum
acaaaaatcgcgtcttctgctaattttgaagcttcagatcccttgcgatttttcgaaaggatcaacatttacaaggaaaatggggctttcatttgctaagcttttcagccggcttttcgccaagaaggagatgcgaatcctaatggttggtcttgatgctgctggtaagacaaccattttgtacaagctcaagcttggtgagattgtaaccaccattcccaccattgggtttaatgtggagacggttgagtacaaaaacatcagcttcactgtctgggatgtcgggggtcaggacaagatccgtcccttgtggaggcactacttccaaaacactcaaggtctgattttcgtggttgatagcaatgacagagaccgagttgttgaggcgagagatgaacttcacaggatgctgaatgaagatgagcttcgggatgcagtattgcttgtgttcgccaacaaacaagatcttccaaacgcaatgaatgctgctgagataactgataagcttggccttcactctctccgacaacgccactggtacatccaaagcacatgcgcaaccactggtgaagggttgtatgaaggtctggattggctctccaacaacattgctaacaaagcttgaggttatctcgaccagatatttttgtgagagaattggaagcttcttcttcggagtgaactttgtttcttgtgttttaagacctattattggagtcacatttgtttaatttcttcaaggggtgaaaatgatttgatttctcctacttggttacttttctcgaatgtttggattctttcaggcttaaaaaatgtttttatttctaaatgagtagaaatttcatatcatttattt

SEQ ID NO: 12503 - DNA, 1068 bp, Citrullus lanatus
tgtgtgtcagcttgaaatagccggctaaggcaaagcagaaatggggttgaccttcaccaaactcttcagtaggcttttcgcgaagaaagagatgcgcattttgatggttggtctagatgctgctggaaagaccaccatcttgtacaagctcaagctcggagaaatagtcacaactattcctacaattggatttaatgtggagactgtggaatataagaacatcagcttcaccgtatgggatgttggtggccaggacaaaattcgtccactgtggaggcattacttccaaaacacacagggtcttatatttgttgtggatagcaatgacagagatcgtgttgttgaagcaagagatgaattgcacagaatgttgaatgaggatgaactgagagatgctgtgttgctcgtatttgccaacaagcaagaccttcctaatgcaatgaatgctgctgaaataaccgacaagcttggtcttcattcactccgtcaacgccactggtacatccagagcacctgtgcaacatctggagagggtctatacgagggtttagactggctttccaacaatattgctagcaaggcatgaggcagttgaggttttcggctgtcagactctggactgtgggtgaagtttggcgctgataggggtatagttcgtttttctcaagaagtgtcgttagcagcagaacagtttgccagacttctatatgtactctctgtttgtatacttgcgacttgatctaaaattatctaaccttgttatagtttctttgggaagttaaccttgtcatagtttccttgtgatcatactattttgctttttaagatctccattgtctctctgcttgggtatggagttcagtgggagaacttcgtctgtgccgaaaaaatgtcatgcaaggttggctggcggatgctggccaccgatccagatcagacccctcttcctaaagttggtgaagttttaacatcaagtaaaataggtttttctttatggggttgctttcactttttgcttgaaagaatataagcggaaatttctaggaccccttaaaatctgaatttgtc

SEQ ID NO: 12504 - DNA, 969 bp, Zostera marina
caatataaatacctataacccggcaacaacccgaacatcatctcccctaccgctacaagtctacaacaatctcctcgagtaattcgatctcgatcgtcgtcttctattctcttcggtcgccgatcgttcgcatcggtatttgaggagagaagatatggggttgtcgttctcgaggttgttcagccgattgttcgcgaagaaggagatgcggatcctgatggtcggtctcgatgcggctggtaaaacgacaattctgtacaagctcaaactgggagagatcgtcacaactattcccaccattggttttaatgttgagactgtggagtacaaaaatatcagcttcacagtttgggatgttgggggtcaggacaagattagacctttatggaggcactacttccagaacacccagggacttatctttgttgtggatagcaatgacagggaccgtgttgtggaagcaagggatgagctccacaggatgctaaatgaggatgagttgcgggatgctgtgttgcttgtgtttgcaaacaaacaggatctcccaaatgcgatgaatgctgctgaaatcactgataaacttggtctgcattccctgcgacagaggcactggtacatccagagcacttgtgccacatctggcgaagggctttatgagggtctagactggctttcaagcaacattgctagcaaggcttaaataagcggactgttcaaggtgccagcatttactctatttagagttatatctatgtctactagctattattgtaaaccagatttctcaatatattgaattttttaatcacctaaagtttcatactgtggaaaatatcttgtattaaatactgttattatcattctcttaaatcctaatgttaatgatccaattcccattttattgcataatttaccagtgttctacagcagactacaattaatattagattctgaataatatttcattgg

SEQ ID NO: 12505 - DNA, 1058 bp, Zostera marina
tattctcctcctaagctcaaagagatatcctcggtagtcggtactatataaataaccacaacccggcaaccacccctaacttccctcccctctccccactgcttgaacaacctcctccattaattcgatctcgatagtcgtcttttattctctccgtacattgatcgtttgcatcggtatctgaggagagaaaatatggggttgtcgttctcgaggttgttcagccggttgtttgcgaagaaggagatgcggatcctgatggtcggtctcgatgcggctggtaaaacgacaattttgtacaagctcaagttgggagagatcgtcacaactattcccaccattggttttaatgtggagaccgtggagtacaaaaacatcagtttcacagtttgggatgttggaggtcaagacaagattagacctctatggagacactacttccagaacacccagggtcttatctttgttgtcgacagcaatgacagagatcgtgttgttgaagcaagagatgagctccacaggatgctgaatgaggatgagttgcgggatgctgtgttgcttgtgtttgcaaacaaacaagatcttccaaatgcgatgaatgctgctgaaatcaccgataaactcggtttgcattctttgcgacagaggcactggtatatccaaagcacatgtgccacatctggggaggggctgtacgagggactagattggctttccagcaacatagccagcaaggcttgaatgcgtcgatggtatgatgtttggggggcttgtcttgtgaagtgttgtaaggggtcgtattatctaaatagctttagctattataaagaagctttctgaaatatattgaatttttatcacttgtgaatgataacatattgttgttttgttgctatcagattacctttaaaaaccttttttctagtttgtgaaatcatcttgtaaactatttttacctatgcttttcaattgcaatattgataatccaatccttatttcatcattaaatcttgaacagctttcagtcagcatttacttgtatcaaacaacatatctaa

SEQ ID NO: 12506 - DNA, 627 bp, Fraxinus spp
aagatggggctgtctttcaccaagcttttcagtcggctgttcgccaagaaagagatgcgcatactgatggtgggtcttgatgctgctggtaaaacgaccattctctataagctcaaacttggagagattgtcacaacaattcctaccattggatttaatgtggagactgtggaatacaagaacattagctttacagtttgggatgtcgggggccaggataagatccgtccactgtggagacattatttccaaaatactcagggactaatctttgtggttgatagcaatgaccgagatcgtgttgttgaagcaagggatgagctgcacaggatgttaaatgaggatgaattgagagatgcagtgctgctagtatttgcaaacaagcaagatctcccgaatgcaatgaatgctgctgaaataactgacaagcttggccttcattctctccgccaacgacactggtacattcagagcacatgtgccacttccggtgaaggtctgtatgaggggttggactggctctcaaacaacattgcaagcaaggcttagagtgctgtatctgaggtccacttttgtatcagtgctggaagaaacttcatgtctttgttgctttgaacttatgctttt

SEQ ID NO: 12507 - DNA, 1012 bp, Primula obconica
tatttctctcactagatccctctgacaaatacactctggcgagggatcaactagaaaatacaagatacaaaaatgggtttgacattcacaaagcttttcagtcggctatttgccaagaaagagatgcgtattcttatggttggtctcgatgctgctggtaagaccacaattctgtacaagctcaagcttggagagattgtgaccacaattcctaccatcggcttcaatgtcgagactgtcgagtacaaaaacatcagcttcacagtgtgggatgttgggggtcaggacaagattcgcccattgtggaggcactatttccagaacacacaaggtctcatcttcgtggtggatagcaacgacagggaccgtgttgtggaggcaagggatgaactgcatcgcatgttgaacgaggatgagctgcgtgatgcagtgctgcttgtgtttgctaacaaacaagatcttcccaatgctatgaatgctgctgaaattaccgacaagcttggtctccactctctccgacagcgtcactggtacatccagagcacctgtgccacatctggcgaggggctctacgagggtctggattggctctccaacaacattgctagcaaggcttaaagcaattgaaattttcactagaggagtgatcctggatacaaggtggctttttatttggcggtattttttccctttatttcttcgccttacttggtgtgtggttacgaattgcaacaaatttactttttatctatttctggtttcatgtagggttttgaaaaggctttttttaatagaattatgttggggatgtgtgatatgtgtactagcaatgttgttcagttttgaatataatgcttgttataagggtttaatacgttgaggattccatactgagatttgtctgcattttctgatcaaatttgtacaaccaatttgttaaatttagtcggaaagaatgcttgttgcaaggagactaaccaaaacttggtgcttccattgtgcctaaagcagg

SEQ ID NO: 12508 - DNA, 982 bp, Aristolochia fimbriata
gacctgctttctctctgtataaaattcccaaacatgacctttcattttccccgtttcccgaagcttcctttctctcgatctgcattccgaagatcctctgctgcgagaatggggctcacgttcacgaagctcttcagtcgtctcttcgccaagaaggagatgagaatcctcatggtcggactcgacgcggctggtaaaaccaccatactctacaagctcaagcttggagagatcgtcaccaccattcctacaatcggtttcaatgtcgaaactgttgaatacaagaacatcagcttcaccgtctgggatgtcggtggtcaggacaagatcagaccactatggaggcattatttccagaatacacagggtcttatttttgttgttgacagcaatgacagagatcgtgtggttgaagcaagggatgagctccatagaatgttgaatgaggatgaactgcgagatgctgtattgctagtgtttgctaacaagcaggatcttcccaatgcaatgaatgcagctgaaatcactgacaagcttggtttgcattcattgcgccagcgacactggtatatccagagcacatgtgcaacatcaggtgagggattgtacgaggggctggattggctctccagcaacattgccaacaaggcatgaaaattttcgtggtgctgagcggattagggaagcaatatttggagggatttgccttttgcagatctgtgtggaacttgctcgtggccgacttaaccttcgattgttatagtactgttattcatagatctttctgtatttttggttctttgttttggtttggtttaattactttttcatagtttagcaatcgtggttattgcatttcgaactactgaatttcattgttataatattttggtatgttattctgcgggttttgtaatcagcagtgggcctaattcagagtcagtcatataatgtgaaataactggtagtttgtccagtttgt

SEQ ID NO: 12509 - DNA, 853 bp, Persea americana
tttcatcttcttcgaaagccagaaagaaccatggggcttactttcacgaagcttttcagccggctttttgccaagaaggagatgcgtattctgatggttggtcttgatgctgctggtaagaccaccatcttgtacaagctcaagctgggagagattgtaaccactattccaaccattggttttaatgtggagactgtggagtacaagaatatcagtttcactgtctgggatgttggtggtcaggacaagatccgaccattgtggaggcactacttccaaaatacgcagggtcttatattcgtggtagatagcaatgatagagatcgtgttgttgaagcaagggacgagttgcatagaatgttgaatgaggatgagctgcgagatgctgtcttgcttgtgtttgcaaacaaacaagatcttccaaatgctatgaatgcagcagagataactgataagcttggccttcattctctccgtcaacgccattggtacatccagagtacgtgtgcaaccagtggagagggcctgtatgaagggttggattggctttccaacaacattgctagcaaggcctaagacattggtgttgcagtttcttggggtttttatctggatgcaggggtaaatattatctgggtcttctgaggtaagagattgtggtggcagtgatatgttagtgggtgttttatcttttgtgattgtgatctgtcatagaagatcagatttcatacttcattactggttttcatttgggtttctattttgtttggctaatccttttagctgtatcagaaactaatatatgacattatatatcttcatagtaaccacacctgccccttgcttgtggagg

SEQ ID NO: 12510 - DNA, 1167 bp, Brassica juncea
cgcatctctatctctctttcgatcgatcaggtaatctccgaagctattccgcagagtgaagaaggatgggtttgtcattcgggaagcttttcagcaggctatttgccaagaaggagatgaggattctgatggttggtcttgatgctgctggtaagaccaccatcttgtacaaactcaagctcggagagattgtcaccaccattcccaccattgggttcaatgtggaaactgtggagtacaagaacatcagtttcacagtgtgggatgtcgggggtcaagacaagattcgtccattgtggaggcactacttccagaacacccaaggactcatctttgtggtggacagcaatgacagagaccgtgttgttgaggctagagatgaattgcacagaatgctcaatgaggatgagctgcgtgatgctgttctgctcgtgtttgctaacaaacaggatcttccaaatgccatgaacgcagctgagatcaccgataagcttggtctccactctctccgtcagcgtcactggtacatccagagcacatgtgccacttcaggtgaggggctttacgagggtcttgactggttgtccaacaacatcgccggcaaggcgtagaggaaaagtttgtggttgagttgaatttgctgagcaaatctggatgcaggggcaaacagtatctgatttttttttccccgattttcttattgttctgttcttttttttccgtttcgggtatgtggatttgatttgtgatcgttgttctgatttgtgcaaggagtcgtctcttgcacgtagaacatagaagctaccttttttatatagtatgtaatcgaagatctactctacatctttctgcttcaccttttacttttgaattttaattcataagttggaatcgtggctacgttgatattagagatcgtggggtcgtgcatgtatgtcactgagacccaaccggatgttatggtgaggatgtttaagtaaagagattattgtataccggagtcattgtacttttggagaatcagtaatgaatatactcaatcgtagatataaatgtatcaaaaatgtaattacgcatgacttaagtcagatttctgcaaaagtgttatatttccagtttcaaagatgaaacaataaccatcaataaaaacaagcatacacataaaaa

SEQ ID NO: 12511 - DNA, 870 bp, Brassica juncea
ctatctctctttcgatcgatcaggtaatctccgaagctattccgcagagtgaagaaggatgggtttgtcattcgggaagcttttcagcaggctatttgccaagaaggagatgaggattctcatggttggtcttgatgctgctggtaagaccaccattttgtacaagctcaagctcggtgagattgtcaccaccatccccactattgggttcaacgttgagactgtggagtacaagaacatcagcttcacagtctgggatgtcgggggtcaagacaagattcgtccattgtggaggcactacttccagaacactcaaggtctcatctttgtggtggacagcaatgacagagaccgtgttgttgaggctagagatgaattgcacagaatgcttaatgaggatgagctgcgtgatgctgttctgcttgtgtttgctaacaagcaggatcttccaaatgccatgaacgcagctgaaatcactgataagcttggtctccactctctccgtcagcgtcactggtacatccagagcacatgtgccacttcaggcgagggactttacgaaggtcttgactggttgtccaacaacatcgccggcaaggcgtagagggaaagtttgtggttgaattgattttgctgggcaaatctggatgcaggggcaaaacattatctgagtttttctattccggttatcttatattgtttttgtttttttttcgggtatgtggattgattttctgatcgttgttttaacttgtgtaaggcgggatgggcctcttgtacgtagaacacagaaactacctttattacatatatagcttgttattcataagttggaactgcggctacatttgatactaatagtaatagaca

SEQ ID NO: 12512 - DNA, 1053 bp, Musa acuminata
atcgatcgcctcctccccgcataaatggcatatcttatttcctcttttattctcttccgcagtctcattcctctctctttctctctctctcttccaggaacgaggaagaagggagagaaacgtggtggaagaaggagaagaagcggagaccgtagcctcgcgtcttagtggatatctggatcgggaagaatggggctcacgttcgcgaagctcttcagccgcctctttgcgaagaaggaaatgcggatcctgatggttgggcttgacgcggcgggtaagacaaccatcctgtacaagctgaagctcggggagatcgtcaccaccatacccaccatcggattcaatgtggagactgtagagtataaaaatattagcttcactgtctgggatgttggtggccaggacaagatcagacctttatggaggcattacttccagaacacacagggtcttatttttgttgttgacagcaatgacagagatcgcgtagttgaggcaagggatgaacttcacaggatgcttaatgaggatgagttgcgcgatgctgtcttgctcgtgtttgcaaacaaacaagatctgccaaatgctatgaatgctgctgaaatcactgataagcttggtctgcattccctgcgtcaacggcattggtacatacagagcacttgtgccacatccggtgagggtttatacgaggggcttgattggttgtccaacaacatagctagcaaggcttaaaaaatgtggaagatgcaacaagaagtctcagatgcaaggagcaactgcgttccccttttcggtatcctgacgatgcttttggtacattatgacccaagacactttttaagctttagcgtgtatggatgatcttatgtttggttctttgttgccacctgacgttttatgtatacacatggttttctagttctttcactggaaaatctgcttcattatcttgatcacacgcctgtatgacttcttagatttccattaaaaccatgctactttcgtgcttcgaaatctcacatacaacatgaacatggtctagccgtagat

SEQ ID NO: 12513 - DNA, 914 bp, Musa acuminata
cataaatagcatttatttcccgttttaaacgcttacattccccctctcttctacccatcacgaggaaaaagaagagcaaagaggaggaagaagaagagccgcgcgtagatcgggaagaatggggctcacctttgcgaagctcttcagccgcctctttgcgaagaaggagatgcggatcctgatggttgggcttgatgccgccggtaagacgaccatcctgtacaagctcaagctgggggaaatcgtcaccaccattcccactatcgggtttaatgtggagactgtggaatacaaaaatataagcttcactgtctgggatgttggtggccaagacaagattagacctttatggaggcattacttccagaacacacagggtcttattttcgttgtcgacagcaatgacagagaccgtgtagttgaggcaagagatgaacttcacaggatgctcaacgaggatgagttgcgtgatgctgtcttgctcgtgtttgcaaacaaacaagacctgccaaatgctatgaatgctgctgaaattacggacaagcttggtctgcattccttgcgtcaacggcactggtacatacagagcacctgcgccacaaccggtgaaggtttatacgaggggcttgattggctgtccaacaacatagccaacaaggcctaagctatgacgatgaagttccaggagctctcggatctaaaaaaccgtctcgttggatgccttaggtatgacgatgataagaaaacctttagcttaacttatgtgaattaattttacctcagattttgcactttaatgtgtttgctacttatgcgtcatatatacgactttttcatacattctttcagaaacaattctattttgttgatcattgtgatggcctttcattgttgaaatttctgtctgctaagag

SEQ ID NO: 12514 - DNA, 892 bp, Brassica napus
gccgcgatcgtagcttggctcctctagagtcgacccacgcgtccgctctctatctctctctctcgattccgaaaaactattccgcagagtgaagaaggatggggttgtcattcgggaagcttttcagcaggctatttgccaagaaggagatgaggattctgatggttggtcttgatgctgctggtaagaccaccatcttgtacaagctcaagctcggagagattgtcaccaccattcccactattgggttcaatgttgaaactgttgagtacaagaacatcagcttcacagtctgggatgtcgggggtcaagacaagattcgtcccttgtggaggcactacttccagaacactcaaggtctcatctttgtggtggacagcaatgacagagaccgtgttgttgaggctagagatgaattgcacaggatgctcaatgaggatgagctgcgtgatgctgttctgctcgtgtttgctaacaaacaggatcttccaaatgccatgaacgcagctgagatcaccgataagcttggtctccactctctccgtcagcgtcactggtacatccagagcacatgtgccacttcaggcgaggggctttacgaaggtcttgactggttgtccaacaacatcgccggcaaggcgtagagggaaagcttgtggttgagctgattttgctgggcaaatctggatgcaggggcaaacattatctgattttttctttattgttctgttctttttttttcctttttggtttcgggtatgtggatttgattttgtgatcgttgttctgattgtgcaaggaggagtctcttgcacgtagaacatagaaactacctttttatatagtttgtaatcgaagatttactctacttctttctgcttcacgtttcatt

SEQ ID NO: 12515 - DNA, 901 bp, Gossypium hirsutum
gatattttctatcaagttgatgttttttgtcttgaatttattcgggtttcgaaatttattagtgtttttctgggtttttaatgtttgatttgctaactctttatgtgaaaattcgatgttgcgagctagaaaaggggaaaaaaagagagagatggggttgtcttttacaaagctcttcagccggcttttcgccaagaaggagatgcgtattttaatggtgggtcttgatgcagctggtaaaaccactattttatacaagctcaagctcggtgaaatcgtcaccactatcccaaccatcggattcaatgtcgagacagtggaatacaagaacatcagcttcactgtttgggatgtcggtggccaagacaagatccgtcctttgtggaggcactatttccaaaacactcaaggtctcattttcgtggtggatagcaatgacagggaccgtgttgttgaagcaagggatgaactgcacaggatgttgaatgaggatgaattgagagatgccgttttgctcgtatttgccaacaaacaagatcttcccaatgcaatgaatgctgctgaaataactgataagcttggtcttcattctctccgccagcgccactggtatatccagagtacatgtgcaacttctggagaaggcctttacgagggactcgattggctttccaacaacattgctagcaaggcatgagggaggatgggtgtttgattgttagctcaactctggccaggatagcttcctctgctataccgaaactttttcgtaacgacggaatgtttattagatatgatattgcgatatgcgctttgtttaacctcaactatacccgtgactttcggaaatgggagttcttagggagtgaaaatatttcgacttaattaagttgatattttt

SEQ ID NO: 12516 - DNA, 933 bp, Cucumis sativus
agaaggccattataagaaaggaaaaaggcttgaggtaagatgttgcgattccctttcccttcagatctgtctcctgaaggccccaaattcaagagtcctgtgattgttgctcatagagggaagaagaaatggggttgacgttcacgaagctctttagcaggctcttcgctaaaaaagagatgcgtattttgatggtgggtctcgatgctgccggtaagacgacgatcctgtacaagttaaagctcggagaaattgttaccaccattccgactatcggatttaatgtggagactgtagagtacaagaacatcagctttactgtttgggatgttggtggtcaggacaagatccgtccactttggaggcactatttccagaatacacagggccttatttttgttgtggatagcaacgatagggacagagttgttgaggcaagagatgagttgcacaggatgttgaatgaggatgagcttagagatgccgttttgcttgtatttgctaacaagcaagatcttcctaatgccatgaatgctgcagaaataactgacaagcttggtcttcattctcttcgccaacgccactggtacattcagagcacatgcgcgacatctggagagggtttatacgaaggtctagactggctttccaacaacattgctagcaaggcctaaagcgataaatgattttggtggttcaagaatttgttcagagtttccttcattctgggaccaatagttttcatttaatttcagtgatagttgggaaacatttggctagaccttaaaatgtactccaagttgttaattgcttctttaagcttaaacttcttagctcctagaagtccattattgtactgttttccattcaataccaagtccaatttttatctgatcaatttaattaatatgaaatgcccctattttggcgtgc

SEQ ID NO: 12517 - DNA, 697 bp, Cucurbita pepo
ccatttggctctcctctcgttcagagttttccactgcgcgccattctccagctccactcctcagacaaatagaaatagccggctaaaacaaagtagaaatggggttgaccttcaccaaacttttcagcaggcttttcgccaagaaagagatgcgcattttgatggttggtcttgatgctgccggaaagaccacgatcttgtacaagctcaagctcggagaaatagtcacaaccattcctacaattgggtttaatgtggagactgtggaatataagaacatcagcttcactgtatgggatgttggtggtcaggacaaaattcgtccactgtggaggcattacttccaaaacacacagggtcttatatttgtggtggatagcaatgacagggatcgtgttgttgaagcaagagatgaattgcatagaatgttaaatgaggatgaactgagagatgctgtgttgctcgtgtttgccaacaagcaagaccttcctaatgcgatgaatgctgctgaaataaccgacaagcttggtcttcattcacttcgtcaacgccactggtacatccagagcacctgtgcaacatctggagagggtctatacgagggtttagactggctttccaacaatattgctagcaaggcatgaagcagctgaggtttttgactgtcagactggactgtgggtaagtttggcgatga

SEQ ID NO: 12518 - DNA, 878 bp, Eschscholzia californica
cagaaggcaaggcaggcagctccttctctacccttttcttcttcttcttccccatttcgtataacgaagatggggctgtctttcaccaagcttttcagtcggctctttgccaagaaagaaatgcgtattcttatggtcggtctcgatgcagctggtaagacaaccattctttacaagctcaagctcggagagatcgtcactaccattcctaccattggatttaatgttgagaccgtggagtacaagaacatcagtttcactgtctgggatgttggtggtcaggacaagatccgacctttgtggagacactacttccaaaacacacaaggtcttatctttgtggttgacagcaatgaccgtgatcgtgttgttgaggctagagatgagttgcacaggatgttgaatgaggatgagctgagagatgccgtgcttcttgtgttcgctaacaagcaagatcttccaaatgcaatgaatgctgctgagatcactgataagcttggccttcactctctccgtcaacgtcactggtatattcagagcacatgtgctacttcaggagaaggactgtacgaaggacttgactggctctctaacaacattgctagcaaggcttagaggggttggaacttttttttgagctgctgttgctatgaatgttggattagagatgttatataaactactattgttattgtcttggtgggattgttcgtgaatcgatttaacttttgtcccttttatttcttctcttgatgcaagaaaggaatgggttgttattggtcaatcctttctttttaaacaagcaaatgttgtgaatggtttctctctttagtttctataacacagtacaaaaagacagatgaaggcatttattattt

SEQ ID NO: 12519 - DNA, 863 bp, Zingiber officinale
gcacgaggagaaagcgaagacctctctcgtcctcgtctcctccattctgcccttttcctccggactacgtgcccggattcccaggtgagacgcaatggggctcactttcgcaaagctgtttagccgcctgtttgcgaagaaggagatgagaatcctgatggtcgggcttgatgctgctggtaagacgaccatcctgtacaagctcaagcttggagagattgtaaccaccattccaacaatcggattcaatgtggagactgtcgagtacaagaacatcagtttcactgtatgggatgttggtggtcaggacaagattagacctctgtggaggcactacttccagaacacacaaggacttatttttgttgttgatagcaatgaccgggatcgtgttgttgaggcaagagatgaactacacaggatgcttaatgaggatgaattaagggatgctgtcttgctcgtgtttgcaaacaaacaagaccttccaaatgcaatgaatgctgccgaaatcactgataaacttggccttcattctctccgtcagcgacactggtacatacaaagcacttgtgcaacatccggtgaggggctgtatgaagggcttgattggctctccagcaacattgcgagcaagtgatcaaagcctcgacatcagcgatgctctactttgatgcttttgtaacagcagaagcaagaagactatttatcgttcggcttggaacattttttcccccctttcccttctgcgtttaaaaaccttgtctgtaaaacaaatatgttcctgatattgtatttgttattttgctcatctagtgtgctgcctcttgaggtacttgccgtgtcctggacacgattaaaaaaaa

SEQ ID NO: 12520 - DNA, 848 bp, Gossypium raimondii
gaataaaataagctgagacataaacggagagactctgaggagaaataatatcagatcctccttctaagctctccacaaagaaaagggggaaaaaaagagagagatggggttgtcttttacaaagctcttcagccggcttttcgccaagaaggagatgcgtattttaatggtgggtcttgatgcagctggtaaaaccactattttatacaagctcaagctcggtgaaatcgtcaccactatcccaaccatcggattcaatgtcgagacagtggaatacaagaacatcagcttcactgtttgggatgtcggtggccaagacaagatccgtcctttgtggaggcactatttccaaaacactcaaggtctcattttcgtggtggatagcaatgacagggaccgtgttgttgaagcaagggatgaactgcacaggatgttgaatgaggatgaattgagagatgccgttttgctcgtatttgccaacaaacaagatcttcccaatgcaatgaatgctgctgaaataactgataagcttggtcttcattctctccgccagcgccactggtatatccagagtacatgtgcaacttctggagaaggcctttacgagggactcgattggctttccaacaacattgctagcaaggcatgagggaggatgggtgtttgattgttagctcaactctggccaagatagcttcctctgccataccgaaactttttcgtaacgacggaatgtttattagatatgatattgcgatatgcgctttgtttaacctcaactatacccgtgactttcggaaatgggagtgaaaatatttcgactgaatcaagttgatatgttttatttt

SEQ ID NO: 12521 - DNA, 888 bp, Momordica charantia
agaccgcggtaaactttgtttgcccctcccggcccctcccccgattcagagctttccacagcgcgacctttctgcgccattctccaactccgactaatagagatagccggctaaggcaaagcggaaatggggttgactttcaccaaactcttcagcaggcttttcgccaagaaagagatgcgcattttgatggttggtcttgatgctgccggaaagaccacgatcttgtacaagctcaagctcggagaaatcgtcacaactattcctacaattggatttaacgtggagactgtggagtataagaacatcagcttcaccgtatgggatgttggcggtcaggacaaaattcgtccactttggaggcattacttccagaatactcagggtcttatatttgttgtggatagcaatgacagggatcgtgttgttgaggcaagagatgagttgcatagaatgttgaatgaggatgaactgagagatgctgtactgctcgtatttgccaacaagcaagatcttcctaatgcgatgaatgctgctgaaataactgacaagcttggtcttcattcactccgtcaacgccactggtacatccagagcacttgcgcaacatctggagagggtctatacgagggtttagactggctttccaacaatattgctagcaaggcatgaggcagttgaggtttttgactgtcagacgggactgtggtaaaggtttggccgatggtggtaggggggtatagttcgcttttcttgagaaaaatgtcattagtagcagaacagtttgccagacttctatatgtactctctgtttgtatacttgcgactttgtctgaaattatctaaccttgttctagtttctttgggaagttaacaagctgaggttgt

SEQ ID NO: 12522 - DNA, 1002 bp, Citrus sinensis
cgcaaaccattttgaattcgacaaagctctttctcttgacttgaccatcaacggcaaaatctaaatccatcacaagttaattaacaacagagatgggattgacgttcacgaagttgtttagtcggttatttgcgaagaaggagatgcgaattctaatggtgggtctcgacgccgccggtaagaccactattttgtacaagcttaagctcggtgagatcgtcaccaccatccctacaatcggttttaatgtggagacggttgaatacaagaacattagcttcacggtttgggatgtcggaggtcaggacaagatccgtccattgtggaggcactattttcagaacactcagggcctcatttttgtggtggatagcaatgacagggatagagtagttgaggcaagggatgagttgcaccgaatgttgaatgaggatgaattgagggatgctgttctgcttgtatttgctaacaaacaagatcttccgaatgcaatgaatgctgcagaaataactgacaagctcggtcttcattctcttcgccagcgacactggtatatccagagcacatgtgcaacctctggagagggtctttatgaagggttggattggctttccaacaacatcgctagcaaggcttgaatgaagcagtgaagattctggctcctcttttagatttcgttatggcttatacctattctaggtattctgaagaagatagtttcccttttgttcagtcacttctataacagcataatgtttgttgaaaatctactgctatgtgaagtatggattttgtataatcctacataactattaagatgatgatgcgtctgttcggaaatggttgtttcgatatcatggcttcacataagtgtcgttttgataggcatataattttgtaagttcttgttaattttactgccatttgaattcgatacttcgaaatttctgacccctcttcggctcgccataagaggtctcgaacttcagaatgaatcactca

SEQ ID NO: 12523 - DNA, 1089 bp, Cajanus cajan
gcgccgtcgtgtgactgacatttgtcattaaataacggtgtaaagcgtatcttcgatctctctctctctctttctctttctccaaaaacaaaaatcgcgattcgctcttctcttcgaaaatctcgatatagcacgagaagaagagcgatttggagtgagagaagatggggttgtcgttcacgaagctgttcagcaggttgttcgcgaagaaggaaatgaggattctgatggtaggtctcgatgctgctggtaagacaaccatcttgtacaagctcaagcttggagaaattgtcaccactatccccaccattggatttaatgttgagactgtggagtacaagaacatcagcttcactgtgtgggatgttggtggtcaggacaagatccgtccattgtggaggcattatttccagaacactcagggtctcatttttgtggttgatagcaatgatagagatcgagtggttgaggctagggatgagttgcacaggatgttgaatgaggatgaacttagagatgctgttttgcttgtttttgccaacaagcaagatcttcctaatgcaatgaatgctgcagaaataactgacaagcttggacttcattctctccgacaacgccactggtatatccagagcacatgtgcgacttctggagagggtctctatgagggtttggattggctttctaacaacattgccagcaaggcatgagacatttgaaaatttttggtcttgtctggtggttcttggagaaagatgctacttatcctttctagttaatgttgtaatagcagaattcttattagaagtattttcttctcgtgtaacttgggtttgtacgattgcttaagttggctaatacttttagctataattggaacgcttgcaatcttcttctgcgtgctcattttgttagttgattatcggttgaatatttctgcgccttttgttcttggggtattgctggtgatatcgttgaatcatgattggaaaattgcacaccagattttgctcttgggccaagagtcacctattcaagtattatctttgcaaaactcagcttacatgttaagcatgtgattaggcccga

SEQ ID NO: 12524 - DNA, 1412 bp, Glycine max
ttctttttattttttttactgtagagaggactaattattgaagaaatgactaaacgaaaacgacgacgttttagagaacgcacaatgcgacgccgtatcgaagacatttttgtcattaaataacggtgcgaagtgtaactgcgatctctctctcactctttctccgagaacaaaaaaaaaaaaaaaaaaaatccgcgattcgctcttctcttggaaaagtgaaaaccagaagtacgaacgaaagagaagagcgatttagaagtgagagaagatggggttgtcgttcacgaagctgttcagcaggttgtttgcgaagaaggaaatgaggattctgatggtaggtctcgatgctgctggtaagacaaccatcttgtacaagctcaagcttggagaaatcgtcaccactatccccaccatcggatttaatgttgagactgtggagtacaagaacatcagcttcactgtgtgggatgttggtggtcaggacaagatccgtccactgtggaggcattatttccagaacactcagggtctcatttttgtggttgatagcaatgatagagatcgagtggttgaggcaagggatgagctgcacagaatgttgaatgaggatgaacttagagatgctgttttgcttgtttttgccaacaagcaagatcttcctaatgcaatgaatgctgcagaaataactgacaagcttggacttcattcactccgtcaacgccactggtatatccagagcacttgtgcaacttctggagagggtctctatgagggtttggactggctttctaacaacattgccagcaaagcatgagacatttgaaaaattttggtcttgtctggtgatttcatgcgagtctggcggttcttggagaaagatgcttatcttttctagcgaatgttgtaatagcagaatgcttgctagaagtattctcttttgtgtaacttgggtttgtatgattgcttaaattagctaatacttttagctataattggaactcttgcaccctcttgtgcgtgcgtgctgtgttgcttacatcttgtttgtttgatttttgattgaatatatttccatgcgttttgttcttgaaaagttcactaatttttcagtttaaaagatcggttttgtccggttttccaaacattgataattaattgtgtaaacaaactgttgggacttaattcttacattacacaggatttttatttttttatgtttcactttaattttactcctcatttatagtggctcaaatttctttatgaaagttatgtaatatttttttggttaaatatgtttttaagtccataaaaatagggttaatgttcggttttggtttaaaatgttgaagtgactaaccgactgatgtgtcatcccttggcatgtgttctagtacaatgggtagggg

SEQ ID NO: 12525 - DNA, 1017 bp, Trigonella foenum-graecum
ttctttctctcacaaatcgcgtttcgctcttctcttcaaaaaatatctctctagatcgaagaagaaaaagagcgatttttgtaggtgaagatggggttaacgttcacgaagctgttcagtaggttatttgcgaagaaggaaatgaggattttgatggtaggtctcgatgctgctggtaagactacaattttgtataaattgaagcttggagaaattgtcactaccatcccaaccattggatttaatgttgaaaccgtggagtacaagaacatcagcttcaccgtgtgggatgtcgggggtcaggacaagatccgtccattgtggaggcactacttccagaacacccagggtcttatttttgtcgttgatagcaatgatagagaccgagtggttgaggcaagggatgagttgcacaggatgttgaatgaggatgaacttagagatgccgttttgcttgtttttgccaacaaacaagatcttcccaatgcaatgaatgctgcagaaataactgacaaacttggacttcattcactccgccaacgccactggtatattcagagcacttgtgcaacttctggagagggtctttacgagggtttggactggctttcaaacaacattgcaagcaaggcttaatgagacatttgaaaattttgggtgtgatctgatcatttcctgagtctggtggttcttgaagaaggatgcttttcctttcaagtgaatatttgtaatagaggaatgattgttagaaatattctcctctaaagtgttacttgggtttgtatgattgcttaaatgagctaatacttttagctaaaatttgaactcttgcaatctgttttggtgtgccttcatgattattttactagtttgattatcagttgaatatttccatgggttctgttctaggagttttaccagtaatatttttgtctagagattgttgcagcagaatacaaaaaatgtaacagcatagtttgttttagtatatagatgtaaaaggataaaattaagtaa

SEQ ID NO: 12526 - DNA, 915 bp, Trigonella foenum-graecum
aaccaacgacgaggagaagaagagaagagaaagatctcgtctccattttcaccacaaaatatctttctcaaatctcaaagaatagttgaaaatgggtctctcattcacgaagctattcagccggttgtttgcgaagaaggagatgcgtatacttatggtgggtctcgatgctgctggtaagaccaccattctctataagctcaagcttggagaaattgtcaccaccattcctaccattgggtttaatgtggaaactgtggaatataagaacatcagctttactgtctgggatgttggtggccaggacaagattcgtcctttatggagacattacttccaaaatacacaagggcttatttttgtggttgatagcaatgaccgagaccgtgttgttgaagctagggacgagctgcacaggatgttaaatgaggatgagttgagagatgctgtgcttctagtttttgcaaacaagcaagatcttccaaatgctatgaatgctgctgaaataaccgataagctaggtcttcattcacttcgtcagcgtcactggtatatccagagcacatgtgccacctctggtgaaggactttatgaaggactagactggctctcaaacaacattgcaagcaaggcttagttattgttagtcatgggcttcatgaagttcagttgagtttagagattatgatttcagatgtttgaatatggttaccctgtctagtatgtattgtttcatttgtattcgaaaaagaacaaacttacctagtttaatacatttgcaatttttttcctttataaacttaaagcattgtttcacccattgatctggattgtcaattaaatcattgaaagcttttacatttatacataacataatagctatggctataaaacaaacaatcatatattcagctt

SEQ ID NO: 12527 - DNA, 789 bp, Brassica juncea
cgcgggggtcgcggatctctctctatctctctctcgatcgatcgattccgaaaaactattccgcagagtgaagaaggatggggttgtcattcgggaagcttttcagcaggctatttgccaagaaggagatgaggattctgatggttggtcttgatgctgctggtaagaccaccatcttgtacaagctcaagctcggagagattgtcaccaccattcccactattgggttcaatgttgaaactgtggagtacaagaacatcagcttcacagtctgggatgtcgggggtcaagacaagattcgtccgttgtggaggcactacttccagaacactcagggtctcatctttgtggtggacagcaatgacagagaccgtgttgttgaggctagagatgaattgcacaggatgctcaatgaggatgagctgcgtgatgctgttctgctcgtgtttgctaacaaacaggatcttccaaatgccatgaacgcagctgaaatcacggataagcttggccttcactccctgcgtcagcgtcactggtacattcagagcacatgcgccacttcaggtgaaggactgtacgaaggtctggactggctgtccaacaacatcgctggcaaggcgtgatgagggtgagttgcatttgcatcgagatggttctaccttctgtgatgcaagaaacgattataaatattatctgaacctttttgatattgggtatgtgaatgttttgattgtgcaagtagatgtcttgtctctaaaacttactagaagaacccatttaaataagttt

SEQ ID NO: 12528 - DNA, 885 bp, Amaranthus tuberculatus
cgtggacgcttcagcttcctgagatcttcgcttttcctcaccacgaaaaatggggctttcgtttacgaagttgttcagtcggttgtttgcgaagaaggaaatgcgtattcttatggtaggtctcgatgcagctggtaaaactactattctttataaactcaagctcggagagattgtcaccactattcctaccattggatttaacgtcgagaccgttgagtacaagaacattagcttcaccgtgtgggatgtcggaggtcaagacaagatccgtccattgtggagacattacttccaaaacactcaaggactcatttttgtggttgacagtaacgatcgtgaccgtgtcgttgaggccagggacgaattacataggatgttaaacgaggatgagttacgggatgcagtcttgttggtgtttgctaacaagcaagatcttccaaatgcaatgaatgctgctgagatcactgacaagcttggtctccattctctacgtcagcgtcactggtacatacagagcacatgtgccacctccggagaaggactttatgagggtttggactggctctcgaacaatattgctagcaaggcttaaatgaaagaaatggagtaacgttagctgttctcagatgagatgctgaaataggctgaggagtctgtcagtactgctggtgttgccctttttatttttgtcattctatgttctcatttttggtttctaaaaggacaaaaggatatatctttctgttgtttatgttgacatgttataataccctactttttagcttatgagatcttctgaattgtgattcaacttattatttttagatattttgaacatgtctttcaaataaaaagggaaaacgacaccagcagtcgtgggag

SEQ ID NO: 12529 - DNA, 1072 bp, Amsonia hubrichtii
gcagcccttctctctctgtggcaggaaattcttcccactcgattcttctgtgtagctttctctcgagagtgctgagagttgcatagcagaggcaaagcagagatggggctgacattcaccaagctgttcagcaggctctttgccaagaaagagatgcgaattttgatggtaggtcttgacgctgctggtaagactaccatcttatacaagctgaagcttggagaaatcgttaccactattcccactattggttttaatgttgagactgtagaatataagaatattagcttcactgtctgggatgttggtggccaggacaagattcgtcctctgtggaggcactacttccaaaacactcagggccttatctttgtggtggatagcaatgacagggatcgagttgttgaagcaagagatgagctccataggatgttgaatgaggacgaactacgcgatgctgtcttgcttgtatttgctaacaagcaggatctgcccaatgcaatgaatgctgcagaaattactgacaaacttggtctccattctcttcgtcagcgccactggtatatccagagtacctgtgcaacctctggggagggcctgtatgaagggttggattggctttccagcaatattgctaacaaggcatgaggcaggcaggcaggcaaggaatttcgttgctggtgggaattggggttcatagttattagatactcattttgcttcatatgtgattggcgattccttgatatgatagtttcttaattttcttttgaatctggaagcgtgatgttgcagaagttgctcttgaagcaagctcttttgttggtttgatattttctcttttagttaatcatatcgactataagccttatatattccatgatggaaagaatcggactgttttggcatttcactgaaagaatcatttgaacatcctccctcatttatattgtattctcctctcacctttcaactgcggtgataatggggaattattatactccctttctgctgtgtatgctggagcttagaaagggataaggaagggaaaaaaagttaatatattggtatc

SEQ ID NO: 12530 - DNA, 926 bp, Amsonia hubrichtii
gcccttctctctctgtggcaggaaattcttcccactcgattcttctgtgtagctttctctcgagagtgctgagagttgcatagcagaggcaaagcagagatggggctgacattcaccaagctgttcagcaggctctttgccaagaaagagatgcgaattttgatggtaggtcttgacgctgctggtaagactaccatcttatacaagctgaagcttggagaaatcgttaccactattcccactattggttttaatgttgagactgtagaatataagaatattagcttcactgtctgggatgttggtggccaggacaagattcgtcctctgtggaggcactacttccaaaacactcagggccttatctttgtggtggatagcaatgacagggatcgagttgttgaagcaagagatgagctccataggatgttgaatgaggacgaactacgcgatgctgtcttgcttgtatttgctaacaagcaggatctgcccaatgcaatgaatgctgcagaaattactgacaaacttggtctccattctcttcgtcagcgccactggtatatccagagtacctgtgcaacctctggggagggcctgtatgaagggttggattggctttccagcaatattgctaacaaggcatgaggcaggcaggcaggcaaggaatttcgttgctggtgggaattggggttcatagttattagatactcattttgcttcatatgtgattggcgattccttgatatgatagtttcttaattttcttttgaatctggaagcgtgatgttgcagaagttgctcttgaagcaagctcttttgttggtttgatattttctcttttagttaatcatatcgactataagccttatatattccatgatggaaagaatcggactgttttggcatttcactgaaagaatcatttg

SEQ ID NO: 12531 - DNA, 834 bp, Antirrhinum majus
caaacaggtagatcttggagtgagcaacatcactccttccttcgattcaaatctcctctcccttttcttcttctcaatttgcatagatggggctttcattcggcaagctttttagccggctttttgccaagaaggagatgcgtatactgatggttggtctcgatgcggctggtaaaacgactattctctacaagctcaaactcggagagatcgtcaccacaattcctactattggattcaatgtggagactgtggagtacaagaacattagtttcactgtctgggatgttgggggtcaagacaagattcgtccattgtggagacattacttccagaacactcagggcctgatctttgtggttgacagcaatgacagagatcgtgttgttgaggctagggatgagctacacaggatgttgaatgaggatgaactgagggatgctgttcttctagtgtttgccaacaagcaagatcttccaaatgcaatgaatgctgctgaaataactgacaagctgggccttcactctctgcgccaacgccattggtacatccagagcacttgtgctacttctggtgagggtctgtacgaggggctggactggctgtcaaacaacatcgcaaataaggcgtaggtcctgcagtccaagtttgatcaatctgccttgtgtttttgttgcttcgagctgtgctgaatcatcttgtacttcactgacagtagtcttttaactgattgccatcttttcttattagctcctaataaattgtacaatttgcctattcaagtgatgcctgccctttcccctgatatgtgatgccaggacaatgcgtctttaa

SEQ ID NO: 12532 - DNA, 754 bp, Arabidopsis lyrata
gagggagagacattttctcttcgaaactcgcggcttgctctacaacagagatccttctttggagcttcttcgaaagataaaggaaaatggggcttaatttcacaaagttgttcagccggctttttgccaagaaagaaatgaggattctgatggtaggtcttgatgctgctggtaagaccactattctctacaagctgaagcttggcgaaatcgtcactaccattccgaccatcggattcaacgtggagactgttgaatacaagaacatcagcttcactgtttgggatgtggggggtcaggacaagattcgtcccctgtggaggcactacttccagaacacacaaggtcttatctttgtggttgatagcaacgacagggaccgagttgtggaggcgagagatgaattacatcgcatgttaaatgaggatgaactgagggatgctgtccttcttgtgtttgcaaacaaacaagatcttcccaacgcaatgaatgctgcagaaataactgacaagcttggacttcactctcttcgccaacgccattggtacatccaaagcacctgtgccacatctggagaaggtctttatgaaggccttgattggctctccaacaacatcgctagcaaggcatgatgaagctgctggaacactttttgcacttggaagagaccattagtgattgtggagaagaaagaagtattatatctgactttacaacggtttatagcatccgttgatgtttgtgtcattgcgtg

SEQ ID NO: 12533 - DNA, 917 bp, Brassica juncea
attataagtagagattatttttctctgtcccttgagaaaaatcaaatcgtgaaacgttcgtaggccatttgcttggacgaaagagagcttagatctcgctcggcgttgtttcttccgttttggattttaaaaaatggggctatcatttggaaagctgttcagcaggttgtttgcgaagaaagagatgcgtattctcatggttggtctcgatgctgctggtaagactaccatcctctacaagctcaagcttggtgagatcgttaccaccattcccaccattggtttcaatgttgaaactgtggaatacaagaacattagcttcacagtgtgggatgtcgggggtcaggacaagatccgtccattgtggagacactacttccagaacacacagggacttatctttgtcgtggacagcaacgatcgtgaccgtgttgttgaagccagggacgagcttcacaggatgctcaacgaggatgaattgagggatgcagttctgcttgtttttgctaacaagcaagatctccccaacgctatgaacgctgctgagattactgacaagcttggccttcactctctccgccaacgccactggtacattcagagcacatgtgccacctctggagaaggactctacgagggtcttgactggctctccaacaacattgctaacaaggcatagaaaaggaggtagcaagattcctccctgcttgtttggtttataaatcaaagaaggggttctgtgtcgccaccgaaaccaagattttattttcatatgttcttcttcttctcccatctcaaacttcaaatgatatttacattttgtactttcctttattaactcaagctcttctactttcggatattaatttcgttattcaaatttggacttcgaaagcaaaaaactgtagtgaggtcca

SEQ ID NO: 12534 - DNA, 698 bp, Brassica juncea
attataagtagagattatttttctctgtcccttgagaaaaatcaaatcgtgaaacgttcgtaggccatttgcttggacgaaagagagcttagatctcgctcggcgttgtttcttccgttttggattttaaaaacatggggctatcatttggaaagctgttcagcaggctgtttgcgaagaaagagatgcgtattctcatggttggtctcgatgctgctggtaagaccaccatcctctacaagctcaagcttggtgaaatcgtgacaaccattcctaccattggtttcaatgttgagactgtggaatacaagaacatcagctttactgtgtgggatgttgggggtcaggacaagatccgaccattgtggaggcactacttccagaacacgcagggacttatctttgttgttgacagcaacgatcgtgaccgtgttgttgaagccagggacgagcttcacaggatgctcaacgaggatgaattgagggatgcggttctgcttgtctttgctaacaagcaagatcttcccaacgcaatgaacgctgctgagatcactgacaagcttggccttcactctctccgccaacgacactggtacattcagagcacatgtgccacctctggagaaggactctacgagggacttgactggctctccaacaacatcgcaaacaaggcttaggagagcaatttgtgggag

SEQ ID NO: 12535 - DNA, 1152 bp, Musa acuminata
catggcctgtaacaaacagtacctgccatccacgtgacgtcggttgggtttcttccctctttatttattccgttttccgcctgaccccccctccgcggaagaggaagtagcggggaccctcgatctctacgcggccagccttccttccgcaatctccagctgacggaacgatggggctctcctttgggaagctctttagccgcttgtttgcgaagaaggaaatgaggatcctgatggtcggacttgatgccgctggtaagacgaccatcctttacaagctcaagcttggagagattgtcaccaccattccgaccatcggattcaatgttgagactgtggagtacaaaaacattagctttactgtttgggatgttggtggtcaggataagatcagacctctgtggaggcattacttccaaaacacacagggccttatttttgttgttgacagcaatgaccgggatcgtattgttgaggcaagggatgaactccataggatgctaaatgaggatgagttaagggatgcggttttgcttgtgtttgctaacaaacaagaccttccaaatgcaatgaatgctgctgaaatcactgataagcttggtctgcattccctgcgtcaacgacactggtacatacaaagcacttgtgccacatctggtgagggtttgtacgaggggcttgattggctctccagcaacattgccagcaagtaaccgacagcagcagtattgcccgttcacggcatagttggatgctttcatgacatcagggaccaagagcactcaaatttccacgtaggtggattatatttttatgccccgccccccatccgccccgcccattttctatttcgtatttcaaaaagcttcaagaaaaagtttgcagtacacagacgtgctgctactaccttgtagcgtttgtatgtcatatctatttcttttccgatgcattaatggccttttgttgaatggtttttggtggatgattttactttgctcgttaccattactattctctttttttttgcttttcttgacattggatctatctccttcatctttgcacccgacaaggatgcggttgctgagaactaacaatgcaacgccaagccttgtcgatagagacgagagcagttaatggaaaagctcatgg

SEQ ID NO: 12536 - DNA, 995 bp, Vaccinium corymbosum
ccgggacggagagatcgtcccaaagtccgagtctctctcttctctttcctcgatcctcctgcgaagcattcgagaggtgttaaccaacaacagtatcataagcaggtagctggagtgaaacagagatggggctgaccttcacgaagttgttcagcaggctttttgccaagaaagagatgcggattcttatggtaggtctcgatgctgctggtaagactaccatattgtacaaactcaagcttggagaaatcgtcactacaatccctaccatcggatttaacgtggaaacagtggagtacaagaacattagtttcacagtgtgggatgttggtggtcaggacaagatccgtccattgtggaggcactatttccagaatacacaggggctaatattcgttgtggatagcaatgacagggatcgagttgtggaggcgagggatgagttgcataggatgctgaatgaggatgagttgagagatgctgttttgctagtgtttgctaacaaacaagatcttcccaatgcaatgaatgctgcagaaataactgacaagctcggacttcattcactccgacaacgccactggtacatccagagcacatgtgcgacctctggagaggggctttatgaagggctggattggctctctaacaacattgccagcaaggcttaaggctctcgaggattctggctgctctcaggattttttgccgatgctaaggttaagggaaagatcaagagacctgagttctatttccgcaactacctcataaaacttgtccgaaatttttagggtttttatgtcacatactttctcttaaatacttcagtgaggttgttatagcaagattgtcgactcaatatgctttcttgaattgttgtttggttgtattgctactactttcggtcagatgtttagctgtaatggttttgttatgtgttaattgactttcggtttttgtcttctctttctggaatgagcaccccattctttcgt

SEQ ID NO: 12537 - DNA, 1833 bp, Cicer arietinum
aagaacaaccaaccacacacttatagattgataattgatcacaatcacaacttcaaaaaaaaaaactcaaaacgacgtcgttttgtggccaaacccaatacgatgcgtttaacaagcatcccctttcacaattaaataacgttacaaacgtaaacaacgttcttactctccgcttaaacaaaaaatcgcgtttcgctctcttctcttcgaaaaacctcacagatcgagaagaagaagaagagagattggtgttgttgaagatggggttaacattcacgaagctgttcagtaggttatttgcgaagaaggaaatgagaattttgatggttggtctcgatgctgctggtaagacaaccatcttgtataaactcaagcttggagaaatcgtcacaaccatccccaccattgggttcaatgttgaaaccgtggagtacaagaacatcagcttcactgtgtgggatgtcgggggtcaggacaagatccgcccattgtggaggcactacttccagaacacccagggtctcattttcgtggttgatagcaatgatagagaccgagtggttgaggcaagggacgagttgcacaggatgttgaatgaggatgaacttcgagatgctgttttgcttgtttttgccaacaaacaagatcttcccaatgcaatgaatgctgcagaaataactgacaagcttggacttcattcactccgccaacgccactggtatattcagagcacttgtgcaacttctggagagggtctttacgaaggtttggattggctttctaacaacattgctagcaaggcataatgagacatctggaaaattttgggtgtgatctgataatttcctgtgagtctggcggttcttgaagaaggatgcttttcctttcaagtgaatattgcaatagaggaatggttgtttgttagaaatattatcctctttagtgttacttgggtttgtatgattgcttaaatgagctaatactcttagctataattgaaactcttgcaatctacactactttggcgtgccttcatgtttagtttgattatcagttgaatatctactggttctgttgttggagttataccagtaataattttgtctagcaattggtgaagtgggatacgagatatcgcataattgtttctgatatagagatgtaaaagattaaaaaaaagtgtcatctagaatcagcaagttcatcataacataaataggtatctaacagaaacagcaataagaggaagaagaatagtgtctagtaatggaacagagatgagattagtcaacaacttctctctcttcggataacttccccattacattcttctcatttcttcttctttcacacccactatcccttgctgttcatttgcgaagttataccatggctgatttcttatacattattccctgagttataccagctttcttactgccaccatggctgatttagatatgaagttttttctcctttaaatgatagggaaaatgttgttactatagatgacattatttgatttttagtggagcaatcacaattagcgtcgagatgaacttcaggaggggtttttgaatgacaatgactcaacaagacaatcctttgtgactcttcatgaacatggatttagaatcaacttgaatctatataaacaaattgattaaaaccaaacaaattttaaaagtaaaaacatcttcggtttaagaaactagttcgatgttctttttggatcaacaaatgtataatagtcgttatattggtggtgttttcgcctttgtccgagtttaaactctagttcttttactcctaaacacttttaatccagaattt

SEQ ID NO: 12538 - DNA, 817 bp, Cleome gynandra
cccgtcttcgcgttcatttgaagcttctctctctctctctcttggagatcccttcgcaccgatttcgaaaggatcaccagctgaaggaaaatggggctttcatttgcgaagctctttagccgcctttttgcgaagaaggagatgcgcatcctaatggtgggtcttgacgctgctggtaagacgaccattttgtacaagctcaagcttggtgagatcgtaaccaccattcccaccattgggttcaacgtggagacagttgaatacaaaaacatcagcttcactgtctgggatgtcgggggtcaggacaagatccgtcccttgtggaggcactacttccaaaacacccaaggcttgatatttgtggtggatagcaatgacagagaccgtgttgttgaagcaagggatgaacttcacaggatgttgaatgaggatgagctacgtgatgcggttctgcttgtatttgcaaacaagcaggatctgccaaacgctatgaacgcggccgagataactgataagctgggcctacactctctgcggcaacgtcactggtacattcagagcacatgtgccacaactggtgagggactgtacgagggcctcgactggctttccaacaacatcgctaacaaagcctgagtgggtttattatgatggatgcatccacccgtagattttgaggctgtgttgaagtattatcttcttcttctttttcttcttttctttgttgttattatggagaatatctatatatacacacacataaatttcacttttgtgggagttttctgatatcatcttttttggttttgggtagttg

SEQ ID NO: 12539 - DNA, 729 bp, Cleome spinosa
gtctatagagcaagacagacatggggctgagcttcactaagctgtttagccggctttttgccaagaaggaaatgcgtattctgatggttggtttggatgctgctggtaagactaccattttgtacaagctgaagctcggtgaaattgtcaccacgatccctaccatcggattcaatgtcgagacagttgagtataaaaacatcagcttcactgtatgggatgttggaggtcaggacaagatccgtccattgtggaggcactacttccagaacacccagggtcttatatttgtggtggacagtaatgacagggatcgtgttgtcgaggcaagagatgaattgcaccgtatgttgaatgaggatgaactgagagacgctgttctgctagtgtttgcaaacaagcaggatcttcccaacgcgatgaacgccgcggaaataaccgacaagctcgggctccattctcttcggcagcgccattggtacatacagagcacttgtgccacgtccggggaaggcctttacgagggcctcgactggctttccaacaacatcgctagcaaggcgtaagagcaaaaggtacgagcctcctggagaaaacatcgtatgatgaatgatatgattcttctcctcattcttttatttcaacccttttttttgtgtgcgcgcgcgcgcgtcttctttgtttggagttgtcgtcgtcagacccctggatgttcggtgatctctcaac

SEQ ID NO: 12540 - DNA, 1016 bp, Trifolium pratense
atacaaatcgcgattcgctcttctcttcgcaaaaaatctagatcgagaagaagagttattggatcagcgatttgtgttggtgaagatggggttaacgttcacgaagctgttcagtaggttattcgcgaagaaggaaatgagaattttgatggttggtcttgatgctgctggtaagactactattttgtataaactcaagcttggagaaatcgttactactatcccaaccattggatttaatgttgaaaccgtggagtacaagaacatcagcttcaccgtgtgggatgttgggggtcaggacaagatccgtccattgtggaggcactacttccagaacacccagggtcttatttttgtggttgatagcaatgatagagaccgagtggttgaggcaagggatgagttgcacaggatgttgaatgaggatgaacttagagatgctgttttgcttgtttttgccaacaaacaagatcttcccaatgcaatgaatgctgcagaaataactgacaaacttggacttcattcactccgccaacgccactggtatattcagagcacttgtgcaacttctggagagggtctttacgagggtttggactggctttctaacaacattgctagcaaggcataaagaaacatttgaaaatttttgggtgtgatctgatcatttcctgtgagtctggtggttcttgaagaaggatgcttttcctttcaagtgaatattgtaatagaggaatgattgttagaaatattctcatcttcagtgttacttgagtctgtatgattgcttaaatgagctaatacttttagctataattggaactcctacaatctgttttggtgtgccttcatgttagtttgattatcggttgaatatttccgtggattattatgttcttggaatattaccagtaataatttttgtctagtgatcagtgaaacagaatacaaagaatgtaacatcatagttgtttttgttatatagatgtaaaaggataaaataaaatagtatcttc

SEQ ID NO: 12541 - DNA, 892 bp, Olea europaea
gcaccttgcaaagatcttcgaccggggaatctctatcgccattccttctgtgattaactgctgatctctctcttcccactttcaaattattgcatttcagaatcctagttgcaaagatggggctgtctttcaccaagcttttcagtcggctgttcgccaagaaagagatgcgcatactgatggtaggtcttgatgctgctggtaaaacgaccattctctataagctcaaactcggagagattgtcacaacaattcctaccattggatttaacgtggagacggtggaatacaagaacattagctttacggtttgggatgtcgggggccaggataagatccgtccattgtggagacattatttccaaaatactcagggactaatctttgtggttgatagcaatgaccgagatcgtgttgttgaagcaagggatgagctgcataggatgttaaatgaggatgaattgagagatgcagtgctgctagtatttgcaaacaagcaagatctcccgaatgcaatgaatgctgctgaaataactgacaagcttggccttcattctctccgccagcgacattggtacattcagagcacatgtgccacttctggtgaaggtctttatgaggggttggattggctctcaaacaacattgcaagcaaggcttagagtactattgtctgagtgctggaagaaaccttaatttctttgtcgcgttgaacttttgcttttctgtcaaaatttggttcttcttttgctaaggttgaaatctgattcttgtacttgagaataattcatagatttttgtcggttctttagcatcttccctgctatatattctcaactgagtcttttccatattctgctattagcgtactacagggaatcgattctttttc

SEQ ID NO: 12542 - DNA, 645 bp, Allium cepa
tccagtttccttcccaaatctcgaaagaaaaatcagaaatattatctcgaagatggggttgacattcacgaagctgtttagtcgattattcgcgaagaaagagatgagaattctgatggttggtctcgatgcggctggtaaaaccaccatcttgtataagctcaagcttggtgaaatcgtcactaccattcctacaattggatttaatgtggagactgtggagtacaagaacattagttttactgtttgggatgttgggggtcaagataagatcagacctttgtggaggcattacttccagaatactcagggcctcatctttgttgttgacagtaatgatagagatcgtgttgttgaggcaagggatgagctccacaggatgctaaacgaggatgagttgcgagatgctgtactacttgtttttgcaaacaaacaggatcttccgaatgcaatgaatgcagctgaaatcactgataagcttggcttgcattccctccgtcaaaggcactggtacatacagagcacttgtgcaacatccggtgaaggattgtacgagggtctagattggctgtctagcaacattgccagcaagggttaaaagcatggaagggatcgctgataatatagtctgcagatgaagacgac

SEQ ID NO: 12543 - DNA, 632 bp, Allium cepa
atccattccagtttccttcccaaatctcgaaagaaaaatcagaaatattatctcaaagatggggttgacattcacgaagctgtttagtcgattgttcgcaaagaaagagatgagaattttgatggttggactcgatgcggctggtaaaaccaccatcttgtataagctcaagcttggtgaaatcgtcactaccattcctacaattggatttaatgtggagacagtggaatacaagaacatcagttttactgtttgggatgttggaggtcaagataagatcagacctttgtggaggcattacttccagaatacacagggcctcatctttgttgttgacagtaatgatagagatcgtgttgtcgaggcaagggatgagctccatagaatgctaaacgaggatgagttgcgggatgctgtactgcttgttttcgcaaacaaacaggatcttccaaatgcaatgaatgcagccgaaatcactgacaagcttggcttgcattctctccgtcaaaggcactggtacatacagagcacttgtgcaacatccggtgaaggattgtacgagggtctagattggctgtctagcaacattgccagcaagggttaaaagcatggaagggatcgctgataatata

SEQ ID NO: 12544 - DNA, 944 bp, Allium cepa
tagttacgggggataaaacaaggcaaaccactgaaattgtaacatccattccagtttccttcccaaatctcgaaagaaaaatcagaaatattatctcaaagatggggttgacattcacgaagctgtttagtcgattgttcgcaaagaaagagatgagaattttgatggttggactcgatgcggctggtaaaaccaccatcttgtataagctcaagcttggtgaaatcgtcactaccattcctacaattggatttaatgtggagacagtggaatacaagaacatcagttttactgtttgggatgttggaggtcaagataagatcagacctttgtggaggcattacttccagaatacacagggcctcatctttgttgttgacagtaatgatagagatcgtgttgtcgaggcaagggatgagctccatagaatgctaaacgaggatgagttgcgagatgctgtactgcttgttttcgcaaacaaacaggatcttccaaatgcaatgaatgcagctgaaattactgacaagcttggcttgcattctctccgtcaaaggcactggtacatacagagcacttgtgcaacatctggagaaggattgtacgagggtctagattggctctctagtaacattgccagcaagggttgaaaacttggaaaggatcgctgagaatataacccggggatgaatatgacttataatattttgaactttttatattaaagtggttattacatgtttgatcaacatttgtgtttcttgtgcttaatttagggttgattttaaattcattttctgcagttttattatagtatttgatatattgttactggtaaactgttgctgttgattgattttgttcattttggtttggttgaatggttgtatatcgagcatggtttcattacaaagtttggtgattctatattccagaaaaacacacac

SEQ ID NO: 12545 - DNA, 820 bp, Allium cepa
atccattccagtttccttcccaaatctcgaaagaaaaatcagaaatattatctcaaagatggggctgacattcacgaagctgttcagtcgattgttcgcaaagaaagagatgagaattttgatggttggactcgatgcggctggtaaaaccaccatcttgtataagctcaagcttggtgaaatcgtcactaccattcctacaattgggtttaacgtggagacagtggaatacaagaacatcagttttactgtttgggatgttggaggtcaagataagatcagacctttgtggaggcattacttccagaatacacagggcctcatctttgttgttgacagtaatgatagagatcgtgttgtcgaggcaagggatgagctccatagaatgctaaacgaggatgagttgcgagatgctgtactgcttgttttcgcaaacaaacaggatcttccaaatgcaatgaatgcagctgaaattactgacaagcttggcttgcattctctccgtcaaaggcactggtacatacagagcacttgtgcaacatctggagaaggattgtacgagggtctagattggctctctagtaacattgccagcaagggttgaaaacttggaaaggatcgctgagaatataacccggggatgaatatgacttataatattttgaactttttatattaaagtggttgttacatgtttgatcaacatttgtgtttcttgtgcttatctagggttgattataaattcattttctgcagttttattatagtatttgatatattgttactggtaaactgttgctgttgattgattttgttcatt

SEQ ID NO: 12546 - DNA, 701 bp, Lippia dulcis
tctccgtctacgcgcactgccatttttctgcctttttcggagatctaaagcaaaaaagagaaatggggctgacattcacgaagctttttagccggctttttgccaagaaggaaatgcgcattctgatggttggtcttgatgctgctggtaagaccaccattttgtacaagctcaagcttggagagattgtcactacaattcctaccattggtttcaatgttgaaactgtggagtacaaaaacattagcttcactgtctgggatgttggaggccaagacaagatccgcccattgtggaggcactacttccaaaacacccagggtctcatatttgtggtggatagcaatgatagggaccgtgttgtggaggcaagggatgaattgcataggatgttgaatgaggacgagttgagagacgctgtattacttgtatttgcaaataagcaagatcttccaaatgcaatgaatgctgccgaaataaccgacaagcttggtctgcactcactcaggcagcgccattggtacatccagagcacctgtgccacctcaggggaggggctatatgagggactggattggctctcaaacaatattgctagcaaggcataaatgtcaaaggagttctgatgttttggagatgctgggtgcatgcgggtttttatctacttttatactggactgtgtggttatgttttttccctt

SEQ ID NO: 12547 - DNA, 781 bp, Papaver somniferum
gagtaaatatgggtctgtcatttgggaagctcttcagtcgtctcttcgccaagaaagagatgagaatattaatggttggtctcgatgctgctggtaaaaccaccatactttacaagcttaagctgggcgagattgttacaaccatccccaccattggcttcaatgtagagacagtggagtacaagaacatcagcttcactgtttgggatgttggaggccaagataagatcagacctctatggaggcactatttccagaacactcaaggtctcatattcgttgttgacagcaacgacagggaccgtgtagttgaggcaagggatgaactccacaggatgctaaatgaggatgagttgagagatgctgtgctacttgttttcgcaaacaaacaggatctgccaaatgcaatgaatgctgctgaaattactgataaacttggtctacattccttacgtcagagacactggtacatccagagcacttgcgctacatctggtgagggattgtacgaagggctggattggctatccaacaacattgcaaacaaggcctaatcttcaaattttcattctggaggtgaagaacttattttgcaggcatttgagtcatacagcttggaggggctactcgttggattttctattctattttctgtatactttgtttggttgttacggcagaaggaatttatagtccctttccttcattctgttatttgttttacttttatttagctttggcatattgtttcgaactttttcacctgtctggagatactttt

SEQ ID NO: 12548 - DNA, 1216 bp, Chenopodium quinoa
gatcgtggacgcttcagctttctcagatcctcctctcttcttccttctcctttctctctcctcttcgtgaaaaatggggctatcatttacgaaattgtttagccggttatttgccaagaaggaaatgcgaatccttatggtgggtctcgatgcggctggtaaaactacaattctttacaagcttaagctcggagagattgtcaccaccattcccaccatcggatttaatgtggagactgtggaatacaagaacatcagcttcaccgtgtgggatgtcggaggtcaagacaagattcgtccattgtggagacattacttccaaaacacccaagggctcatctttgtggttgacagtaatgatcgtgaccgtgttgttgaggctagggacgagctgcataggatgttaaacgaggatgaattgcgagatgcagttttattggtgtttgctaacaagcaagatcttccaaatgcaatgaatgctgctgagattactgataagcttggcctccattctctacgtcaacgtcactggtacattcagagcacatgtgccacctctggagaaggactttacgagggtttggactggctctcaaacaacatcgctagcaaggcttagaagaaacaaaacgagtaacgttagctgttctcagaaaagaggctggagtataggctgaggactgtcattactgctagtgttatcttctttatttttcccattatatgttctcatttttggttgctacctggacaaggatgttttttctggtgttcatgtttacttgttataataccatactttatagttggtgagcttctctctgggtttctgtcattttctattgaagttgtagacttgcagcatacatgttgcatagtgaccacatagtatagcaaaatggtgatcctagacagctttaggcattggcccatcatttgagttaaaatctaagagactggatttgaggttatagtgggttgtggaggattctgaacttttgcagttatgcgtgtttgaaagtattggctgccaacaatggtgtttggagtgcatgttgccataacataacttctgctgtccatcttacatgaactttttcttggaagctagtggtaactacatacaacagtctcaaatcgaattgaccaaattagagtttcctttaaataaaagatacatttatatgtctaaaatttcgcatatcttgtctatacc

SEQ ID NO: 12549 - DNA, 887 bp, Sarracenia psittacina
tctctctctggcttagccattctcgatctgtctgcaaagcttgcgaaaggtgtctgtgcctagtgataagtcgatagcgagagtgacaaagagatggggctcacattcacaaagttgttcagcaggctgtttgccaagaaagagatgcggattctcatggtaggtcttgatgctgctggtaagactaccatcttgtacaagctcaagcttggagaaattgtgacgacaatccctaccattggatttaacgtggagacggttgagtataagaacattagtttcacagtctgggatgttggtggtcaggacaagatccgccctctgtggaggcactacttccagaatacacaggggctaatatttgtggtggatagcaatgacagggatcgagtagttgaggcgagggatgagctgcataggatgttgaatgaggatgagttgagagatgctgttctgctcgtgtttgctaacaaacaggatcttccaaatgcaatgaacgctgccgaaataactgacaagctcggtcttcattcactccgacaacgccactggtacattcagagcacatgtgcaacctctggagaagggctttatgaaggactggattggctctctaacaacattgctagcaaggcataagactggaggattctggctgatgctgggatttttgccgatgcatggttagaaatctagggtttttatatgatatccacatttcctagagaatacttgagtgatgttgttatagcaaggtgaatagcttaaatataagtttcttaaactattgttgggttgtatccccgtcatctttggttggtacttctagctgtaatggtgtccttgtgtgttgtcctttttgccttcccttttataaatgatcaaac

SEQ ID NO: 12550 - DNA, 898 bp, Silene vulgaris
gtacttctctctcctctcaatcgtttgtgaaagatggggttatcattcaccaagttgttcagtcggcttttcgccaagaaggaaatgcgtattcttatggtgggtctcgacgcagctggtaaaactacaattctttataagctcaagctcggagagattgttaccaccatccccacaattggatttaatgtggagactgtggaatacaagaacatcagcttcaccgtgtgggatgtcgggggtcaagacaagatccgtccattgtggaggcattacttccaaaatacccaagggcttatctttgtcgttgacagcaacgatcgtgatcgtgttgttgaggctagggatgagctgcacaggatgttgaatgaggatgaattgcgagatgcagtgctgttggtatttgctaacaagcaagatcttccaaatgcaatgaatgctgctgaaattaccgacaagcttggcctccattcactacgtcaacgccactggtacattcaaagcacatgtgccacatctggagaggggttgtatgagggactggactggctctcaaacaacattgctagcaaggcctaaaagaaacaagtcgagttacgttagctgctctcataacagaaggtggagtataggcagaggactgtcatctactagtgttttcctctttattatcgccgctatatatgtactcacttttggtttgaactcagacctggatcttattttggttttcattgaatcatgtttacttttaattccaaatacccttcttactacttgacatattatctccccaaggttctgccctgattctgtcgatcttctcatattggggctcccggaagattattgtttccctctctcatgtattgatcaacgttggggatctactaattat

SEQ ID NO: 12551 - DNA, 1211 bp, Fragaria vesca
agcagaattcgaatataaagactttgaaacgacgtcgttggttaaccgcggtaaattaactaactgaccagggtcgaggagagagaaagagagaaactgaaaaagaaaggctgtaataaaaatcgcaggtgttgctgtgttggctcctcctctcatttttccaggtcctccacacaaaaacaaagcttcgtttcctccagtgagaaaagatgggactgacgttcacgaagctcttcagccggcttttcgccaagaaggagatgcgaattctgatggtcggtctcgacgccgccggtaagactacgatcttgtacaagctcaagctcggtgaaatcgtcaccaccatccctaccatcggatttaatgtggagactgtggaatacaagaacattagcttcactgtgtgggatgtcgggggtcaggacaagatccgtccattgtggaggcactacttccagaacactcaagggcttatttttgtggttgatagcaatgacagggatcgagttgttgaggcaagggatgagttgcacaggatgttgaatgaggatgaactgagggatgctgttttgctcgtatttgccaacaaacaagatcttcccaatgcaatgaatgctgcagaaataactgataagcttggtcttcattctctccgccaacgtcactggtacattcagagcacatgtgctacctctggagagggactgtacgagggactggattggctttccaacaacattgctagcaaggcataaggtaatgaaggtcagggagttcggtttgccttggagatttcttgggaggatagttttctttgtttccagtgaatgttgtaataggagaacgttttggtgagactttttctgattttgtgttgtgtatctgctctactttagctatactatttagctgtaaacaaagtttgctattactatgttacagtctttcttaaacatcagccgatttaatgtcctctgttcagtttatatgtctgtggttcaaaaaatagtggtctacaactgaagagtggggattttaaaattagagacccaagtgtgcgcagcatattaatccccgatatggtgtttgattcactctcaacagttcttgtatctatctgtattgtaacttgcttgaaggttctaaggctcttagattgaaactcataaagtaacaggaactgatatccaaaccatcaaatatatgcaact

SEQ ID NO: 12552 - DNA, 1152 bp, Eutrema halophilum
atgaaaaagaaatgcggtgagcgtggatcgaacacgcgaccttcagatcttcagtctgacgctctcccaactgagctatccccgcgatttgatgatctaatccgaagtaaaaagtatattcgtaatataacttcaggacgcgataattttttgtttttggcataagtagagaattgttgcgttgcacgattctcctcttacgttcgaagaccattgcttgttctttggacgaccatcggcgacagtgaaagtctaggtcttcctcggcgtcgttttttctttcccggcttggaaaatggggctgtccttcggcaaattgttcagcaggctctttgcaaagaaagagatgcgtatcctcatggttggtcttgatgctgctggtaagacaaccatcctgtacaagctcaagcttggagagatcgtcaccacgattccaaccattggtttcaatgtggagactgtggaatacaagaacatcagcttcaccgtgtgggatgtcgggggtcaggacaagattcgtccattgtggagacactacttccagaacacacaagggctaatctttgtggtggacagcaatgaccgtgaccgtgttgtggaagctagggacgagctccatagaatgctaaacgaagatgagttgagagatgctgtgcttctcgtctttgctaacaagcaagatcttccaaacgcaatgaacgccgctgagataactgacaagcttggacttcactctctccgtcaacgacactggtacatacagagcacatgtgctacatccggagaagggctttatgagggacttgactggctctccaacaacatcgcaaacaaggcttagaagagcaacgtgtggtcttgttttatcgaggagaagtgtctcgtcttcttcgtctctctttccgtctttcgcctcaaactttatcatttcatactttgtcttctttgctctaataattcatcagtttttttttctttttcttttatcctaaaactcagacgcttataatatggggccagctttttggcggagattccaatttcgttaggtttctacatttatcaaacacaatttatgaacttccctacttataatttcattagaaggctagtgaattattacgactaataaaaaaccgacattatagcaaa

SEQ ID NO: 12553 - DNA, 997 bp, Eutrema parvulum
ttggtaaatattctattattagattagagctcctgcgggagggagagagagggagtcattttctcttcgaaactcgcggcttgctttacaacagatccttcgttggagcttcttcgaaagggctagctaaaggaaaatgggacttaacttcacgaagttgttcagccggctttttgccaagaaagaaatgcggattctgatggtaggtcttgatgctgctggtaagaccactatcttgtacaagctgaagcttggcgaaattgtcaccaccatcccaaccatcggattcaatgtggagactgttgagtacaagaacatcagcttcactgtttgggatgtagggggtcaggacaagattcgtcccctgtggaggcactacttccagaacactcaaggtcttatattcgtggttgatagcaacgacagagaccgagttgtggaggcaagggatgagttacatcgcatgttgaatgaggatgaactgagggatgctgtccttcttgtgtttgcaaacaaacaagatcttcccaacgcaatgaatgctgcagaaataaccgacaagcttggccttcactctcttcgccaacgccattggtacattcaaagcacatgtgccacatctggggaaggtctctatgaaggccttgattggctctccaacaacatcgctagcaaggcatgatgaagctgctggaacacttttttgcacttgaaagagaccattagtgattgtggagaagagagaatgaagaagaaaccagtattgtgtctgatgttttcaactgtccgttgatgtttatgtccttatgtgcgtgtagtccataaaactcacctctactcttttacccgtttaatggatttatgatagtttttactttttttattagaatataaattgccggtttggtataagttttgatttgggctttaagccgaagtcaaagttcaattctgtttatgctgactgatcactcggatccacgaccctccgttgttt

SEQ ID NO: 12554 - DNA, 906 bp, Eutrema parvulum
ctcttacgttcgaagaccattgcttgttctttggacgaccatcggcgacagtgaaagtctaggtcttcctcggcgtcgttttttctttcccggcttggaaaatggggctgtccttcggcaaattgttcagcaggctctttgcaaagaaagagatgcgtatcctcatggttggtcttgatgctgctggtaagacaaccatcctgtacaagctcaagcttggagagatcgtcaccacgattccaaccattggtttcaatgtggagactgtggaatacaagaacatcagcttcaccgtgtgggatgtcgggggtcaggacaagattcgtccattgtggagacactacttccagaacacacaagggctaatctttgtggtggacagcaatgaccgtgaccgtgttgtggaagctagggacgagctccatagaatgctaaacgaagatgagttgagagatgctgtgcttctcgtctttgctaacaagcaagatcttccaaacgcaatgaacgccgctgagataactgacaagcttggacttcactctctccgtcaacgacactggtacatacagagcacatgtgctacatccggagaagggctttatgagggacttgactggctctccaacaacatcgcaaacaaggcttagaagagcaacgtgtggtcttgttttatcgaggagaagtgtctcgtcttcttcgtctctctttccgtctttcgcctcaaactttatcatttcatactttgtcttctttgctctaataattcatcagtttttttttctttttcttttatcctaaaactcagacgcttataatatggggccagctttttggcggagattccaatttcgttaggtttctacatttatcaaattttatatatagaaacctaattccgtgagatgg

SEQ ID NO: 12555 - DNA, 869 bp, Platanus occidentalis
gcttcgtaacaatggggctcacttttgccaagctcttcagtcgtctctttgcgaagaaggagatgaggatcctcatggtcggccttgatgcggctggtaaaacgaccatcctttacaagctcaagctcggggagatcgttaccaccattcccaccattggtttcaacgtagagacagtagagtacaaaaacattagtttcaccgtttgggatgtggggggccaggataagattagaccattatggaggcactatttccaaaatacacagggtcttatctttgttgttgacagcaatgatagagaccgtgtggttgaggcaagggatgagctccaccggatgctaaatgaggatgaattacgagatgctgttttgcttgtttttgctaataagcaagatctgcctaatgcaatgaatgctgctgaaattactgataagcttggtctccattccctgcgccagcgacattggtacattcagagcacctgtgctacatcaggcgagggattgtatgaagggctggattggctctccagcaacattgctaacaaggcatgacctcttgtcattcaccatgctagcaaagaattggagaattatgttgcaggtggttgtctttcttacaattgtgttgaacactcctttgattatgagttttgtaccttctttgactttaccttttcaagaatggatttgttttcttcccgttcattctgtttcagctttaaaatttgtttacctctcagcatacttcatcccgctttgtagaactcaaaaattgctactataactgcaaatgaagtttcttcatgatgctcctatgtacaacttacagtgcttgatgtctaacaatgtcattcactggttttt

SEQ ID NO: 12556 - DNA, 1044 bp, Arabidopsis lyrata
ttgttaacaaagctaatatatttaattatatacttaaattataaaagcgagaattgtgatttttttttggccataagtagagaattgttgtgttccactattcctcctctcacgttcgaagaccatttcttgttctttggacgaccatcggcgacagtgttaagtctaggtcttcttcttcggcgtagtttttttcccggcttgataatatggggctgtccttcggaaagttgttcagcaggctctttgcaaagaaagagatgcgtatcctcatggtgggtctcgatgctgctggtaagactacgatcctgtacaagctcaagcttggagagattgtgactacgatcccaaccattggtttcaatgtggagactgtggaatacaagaacattagctttactgtgtgggatgtcgggggtcaagacaagattcgtccattgtggaggcactacttccagaacactcagggacttatctttgtggtggacagcaatgatcgtgaccgtgttgtggaagccagggatgagcttcacagaatgttgaacgaagatgagttgagagatgctgtgctcctggtctttgctaacaagcaagatcttccaaatgcgatgaacgccgctgagataactgacaagcttggacttcactctctccgtcaacgacactggtacatacagagcacatgtgctacctccggagaagggctttatgagggacttgactggctctctaacaacatcgcaaacaaggcttaggagagcattgtgtggtttggttttaatcgaggagagtcttgtcttcttcgtctctctcttttgttctttcttctcaaactctttatcatttcatactctttgttctttgctctaataaattcacgagtttttttttccttttttcttttatcctataattcagagtttcagacgcttataaaatggggcccaatttaggcggatattccaatttctttttagccttgtgcattttctaaattaatttatcgacacacccaattggccaatcccgtgagatggatttgaa

SEQ ID NO: 12557 - DNA, 1104 bp, Arabidopsis lyrata
aaaaaattgcggtgagcgtggatcgaacacgcgaccttcagatcttcagtctgacgctctcccaactgagctatccccgcgatttgttaacaaagctaatatatttaattatatacttaaattataaaagcgagaattgtgatttttttttggccataagtagagaattgttgtgttccactattcctcctctcacgttcgaagaccatttcttgttctttggacgaccatcggcgacagtgttaagtctaggtcttcttcttcggcgtagtttttttcccggcttgataatatggggctgtccttcggaaagttgttcagcaggctctttgcaaagaaagagatgcgtatcctcatggtgggtctcgatgctgctggtaagactacgatcctgtacaagctcaagcttggagagattgtgactacgatcccaaccattggtttcaatgtggagactgtggaatacaagaacattagctttactgtgtgggatgtcgggggtcaagacaagattcgtccattgtggaggcactacttccagaacactcagggacttatctttgtggtggacagcaatgatcgtgaccgtgttgtggaagccagggatgagcttcacagaatgttgaacgaagatgagttgagagatgctgtgctcctggtctttgctaacaagcaagatcttccaaatgcgatgaacgccgctgagataactgacaagcttggacttcactcactccgtcaacgacactggtacatacagagcacatgtgctacctccggagaagggctttatgagggacttgactggctctctaacaacatcgcaaacaaggcttaggagagcattgtgtggtttggttttaatcgaggagagtcttgtcttcttcgtctctctcttttgttctttcttctcaaactctttatcatttcatactctttgttctttgctctaataaattcacgagtttttttttccttttttcttttatcctataattcagagtttcagacgcttataaaatggggcccaatttaggcggatattccaatttctttttagccttgtgcattttctaaattaatttatcgacacacccaattggc

SEQ ID NO: 12558 - DNA, 672 bp, Brassica juncea
gatggggctatcattcgggaagctgttcagcagactgtttgcaaagaaagagatgcgtatcctcatggttggtctcgatgctgctggtaagactaccatcctgtacaagctcaagcttggtgagatcgtcactaccattccaaccattggtttcaatgtggagactgtggaatacaagaacatcagcttcaccgtctgggatgtcgggggtcaggacaagattcgtccattgtggaggcactacttccaaaacacgcaagggctgatcttcgtggtggacagcaatgaccgtgaccgtgttgtggaagctagagacgagcttcacagaatgctcaacgaagatgagttgagagatgcagtgcttctggtctttgctaacaagcaagatcttccaaacgccatgaacgccgctgagataactgacaaacttgggcttcactctctccgtcaacgacactggtacatacagagcacatgtgccacttcaggagaagggctgtatgagggacttgactggctctccaacaacatcgcaaacaaggcttagaagagcagttggtgggtttggttttgtcttcttcgactctgttttgttctttcgtatcagacttttatcatttcatacttttgttcttcgctccctaataattcttttaaagttgtttttcttcc

SEQ ID NO: 12559 - DNA, 1523 bp, Musa acuminata
ccgcccccttcctcacgtagcaaaacacgatttggcagtcaaccggacaagttggcttgtcgatttattctgtttccaacctcgctctcctccacgcggaagaggaagcagaggagaagcggagatttctgtcgccctcgatcgctcggcctccgccgccaaccgcccttccacgatctgcagctgagggaacgatggggctcaccttcgcgaagctctttagccgcctgtttgcgaagaaggagatgaggatactgatggtcggtcttgatgcggctggtaagacgaccatcctttacaagctcaagctcggagagattgtcaccactattccaaccatcggcttcaatgttgagactgtcgagtacaaaaacatcagcttcactgtctgggatgttggtggtcaggacaagattagaccactgtggaggcattacttccagaacacacagggtcttatttttgtggttgacagcaatgaccgagatcgtgttgttgaggcaagggatgaactccacagaatgctgaatgaggacgaactaagggatgctgtcttgcttgtgtttgctaacaaacaagaccttccaaatgcaatgaatgctgctgaaatcacggataaacttggtctgcattccctgcgccagcgacactggtatatacaaagcacttgtgccacatctggtgaggggttgtacgaggggcttgattggctctccagcaacatcgccagcaagtgaccatggttgctccgaggaacttaacagcgggtagtaatctacatttacggtttgttatatgttttcgtggcatggttaccaaggccttttgcatttagaagaataccttcaagtaatagattgcagtaaaacagggacgtcctgactaccttatacaggttttcatgtcttctgtattctttttttctgacattgttggctttgttgatgagagaatcctacttctgctcgtagacattattatctgataattctttccgacatccaagctgctccccttgaatgccatgaaatatggccacctactggtagtagaaacttttaacatggatgagagttctcaatattgatatggaacactttacgttcatggctcctgagacatcggagatatgtgacctcctgtgcatgttcacaatgcagtcctgagcctggctcaacctcattaggtctttctaagcataggaaactaaacaagaggtccaaataagatgaggatattttatgttcctcagtaaatcaaagtcccacctatgtaaatgtttacaatcttatttatgttcataaccactcaggatcctatctaatggtttaatatcaataaaagacatttttgagatttagaagattttttgaaactccatcaacgaaaaatacaaagaaaatgtacaaaatttagagaccacaaaaacgaaatgaagaaactaaattataatattccatttggatcatatcaaggaggtttgattgctttgatctctctttcattctcattcacattcccac

SEQ ID NO: 12560 - DNA, 862 bp, Brassica napus
gtagcttggatcctctagagcgcccgctcgcgatctagaactaggtcacacggtcctcctcttgctcgtacgaagaccatcatttgcctttggacgacccatcggcgacagtgaaagtctatatcttcttccggatttgaaaaagatgggtctgtctttcgggaagctgttcagcagactctttgcaaagaaagagatgcgtatcctcatggttggtctcgacgctgctggtaagaccaccatcttgtacaagctcaagcttggcgagatcgtcaccaccattccaaccattggtttcaatgtcgagactgtggaatacaagaacatcagcttcaccgtctgggatgtcgggggtcaggacaagattcgtccattgtggaggcattacttccagaacacccaagggctgatcttcgtggtggacagcaacgaccgtgaccgtgttgtggaagctagagacgagcttcacagaatgctcaacgaagatgagttgagagatgctgtgcttcttgtctttgctaacaagcaagatcttccaaacgccatgaacgccgctgagattactgacaaacttggccttcactctctccgtcaacgacactggtacatacagagtacatgtgctacctcaggagaagggctctacgagggacttgactggctctccaacaacatcgcaaacaaggcttaggagagcagtttgtcggtttggtctcgtcttcgtcggctctgttttgttctttcgtctcagacttttatcatttcatactttgttcttcgctcccaaataattcttttgaactgtttttcttatatactaaaattccgaatattatgaaatgaacccacgtttcggcggatt

SEQ ID NO: 12561 - DNA, 666 bp, Castanea mollissima
agggatccgtagccaggaccagaaatggggctgacattcacgaagctgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagcttcactgtctgggatgtcgggggtcaggacaagatccgtcccttgtggaggcactactttcagaacacacagggtcttatatttgtggtggacagcaatgacagagaccgagttgttgaggcgagggatgaattgcataggatgttgaatgaggacgaactgcgagatgcagtgttgcttgtatttgctaacaaacaagatcttcccaacgcaatgaacgctgcggagattactgataagcttggcctccactctctccggcaacgtcactggtacatccagagcacctgtgcaacctcaggagaggggctttacgagggtttggattggctctctagcaacattgcaaacaaggcataaagctcctggggagtcgttttgtgcactggcaattctggatgcaggggtgaatattatctagttctttttaaagacagttggattgtggttatgtcc

SEQ ID NO: 12562 - DNA, 829 bp, Cleome gynandra
cagatgatttcggtgttcgtcaaatatcgtaaaacgttacacgaccatctggaggaaggtcatcggcggcaggcgaactagatctcgattgctgtgaatttttttcctacaggctcgcagaatggggttgtctttcgggaagctgttcagcaggctctttgccaagaaagaaatgcgtatccttatggttggtcttgatgctgctggtaagaccacgattttgtacaagctcaaacttggagagattgtgaccactattccaaccattggattcaatgtggagacagtagaatacaagaacatcagcttcaccgtctgggatgtcgggggtcaggacaagatccgtcctttgtggagacactacttccagaacacccaggggcttatctttgttgttgacagcaacgatcgtgaccgtgttgttgaagctagagacgagcttcacagaatgttgaacgaggatgagttaagggatgctgtgttgctcgtctttgctaataagcaggacctgcccaatgccatgaatgcagctgaaattactgacaagcttggtcttcactctcttcgccaacgacactggtacattcagagcacatgtgccacatccggtgaagggctttacgagggtcttgactggctctccaacaatattgcaaacaaggcatagggatggaatctcagcaagaaagtagtcaagattcttctggagtctactttgctagtcaaccaatgatttatttgtcacattcttctgtcttttatttcaaactcttattatgttttgtctctttgtacttccgtaataatccatgttttatttgtcacatcc

SEQ ID NO: 12563 - DNA, 919 bp, Quercus alba
atttcacgcattcctgtaaagctcattttttttctctctctctaagcgttttttttcactagatccctctgcgaagctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcgggggtcaggacaagatccgtcccttgtggaggcactactttcagaacacacagggtcttatatttgtggtggacagcaatgacagagaccgagttgttgaggcgagggatgaattgcataggatgttgaatgaggacgaactgcgagatgcagtgttgcttgtatttgctaacaaacaagatcttcccaacgcaatgaatgctgcggagattactgataagcttggcctccactctctccggcaacgtcactggtacatccagagcacctgtgcaacctcaggagaggggctttatgagggtttggattggctctctagcaacattgcaaacaaggcataaagctcctggggagttgttttgtgcactggcaattctggatgcaggggtgaatattatctagttctttttaaagacagttggattgtggttatggcttttttattgcgggaatttctctttttattaggaactttgtggctatattgtaatagaaaaatgtcgtgggatatatatacttgagcttttggtcttggttgtatgcaattctcttagctgtaatcagaaccaatttgtttcaacatttaattggttt

SEQ ID NO: 12564 - DNA, 948 bp, Quercus alba
atggggactccccatttcacgcattcctgtaaagctcatttttttttctctctctctaagtcgtttttttcactagatccctctgcgaagctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcgggggtcaggacaagatccgtcccttgtggaggcactactttcagaacacacagggtcttatatttgtggtggacagcaatgacagagaccgagttgttgaggcgagggatgaactgcataggatgttgaatgaggacgaactgcgagatgcagtgttgcttgtatttgctaacaaacaagatcttcccaatgcaatgaatgctgcggagattactgataagcttggcctccactctctccggcaacgtcactggtacatccagagcacctgtgcaacctcaggagaggggctttacgagggtttggattggctctctagcaacattgcaaacaaggcataaagctcctggggagttgttttgtgcactggcaattctggatgcaggggtgaatattatctagttcttttaaagacagttggattgtggttatggctttttattgcgggaatttctcttttattaggaactttgtggctatattgtaatagaaaaatgtcgtgggatatatatacttgagcttctggtcttggttgtatgcaattctcttagctgtaaatcagaaccaatttgtttcaacattttaatggttttatacctatcatgttga

SEQ ID NO: 12565 - DNA, 962 bp, Quercus alba
atgggaccactcctcatttctacgcattcctgtaaagctctattttttctctctctctaagcgttttttttttttcactagatccctctgcgaagctctctctctctctctctctctacgaagggatccatagccaggaccagaaatggggctgacattcacgaagttgttcagccggctttttgccaagaaagaaatgcgaattctgatggttggtctcgatgctgctggtaagaccaccattctctacaagctcaagcttggcgagatcgtcacaaccattcccaccattggtttcaatgtggagactgtggaatacaagaacatcagctttactgtctgggatgtcgggggtcaggacaagatccgtcccttgtggaggcactactttcagaacacacagggtcttatatttgtggtggacagcaatgacagagaccgagttgttgaggcgagggatgaattgcataggatgttgaatgaggacgaactgcgagatgcagtgttgcttgtatttgctaacaaacaagatcttcccaatgcaatgaatgctgcggagattactgataagcttggcctccactctctccggcaacgtcactggtacatccagagcacctgtgcaacctcaggagaggggctttacgagggtttggattggctctctagcaacattgcaaacaaggcataaagctcctggggagttgttttgtgcactggcaattctggatgcaggggtgaatattatctagttctttttaaagacagttggattgtggttatggctttttttattgcgggaatttctctttttattaggaactttgtggctatattgtaatagaaaaatgtcgtgggatatatatacttgagcttttggtcttggttgtatgcaattctcttagctgtaatcagaaccaatttgtttcaacattttaattggttttatacctatcatgttg

SEQ ID NO: 12566 - DNA, 993 bp, Allium cepa
gatttgcgaaacttttttcatacattaatagatccgacgcaaccattcagatccacaacctaatacctaattgtatatttcttcgttttggatctcagatctgtcccaatttatactcagatctgcttattttcttgtgttttattgaaaccaaagatggggttgacattcacgaagctgttcagtcgattgttcgcgaagaaagagatgagaattttgatggttggtctcgacgcggctggtaaaaccacgatcttgtataagctcaagcttggtgaaatcgtcactaccattcctacaattggatttaatgtggagactgtggaatacaagaacattagttttactgtttgggatgttgggggtcaagataagatcagacctttgtggaggcactacttccagaatacacagggcctcatctttgttgttgatagtaatgatagagatcgtgttgtcgaggcaagggatgagctccataggatgctaaacgaggatgagttgcgggatgctgtactgcttgttttcgcaaacaaacaggatcttccaaatgcaatgaatgcagctgaaatcactgacaagcttggcttgcattctctccgtcaaaggcactggtatatacagagcacttgtgctacatctggagaaggattgtatgaaggtctagattggctctctagtaacattgccagcaagggttgaaaacttggaagggatagccgagtatgtaacccggggatgaagaggacttgtaatattttaaactttttatattaaagtggttattacatgtttgatcaatatttgtgttgtttcttgtacttattcagggttgattataaattcatttcatgcagttttattatattatagtatttgatatattgttactgataaactgttgctgttgattaattttgttcattttggtttggttgtatgcttgtagaatgagcatgatttcatgataaaagtttggtatttctatagttc

SEQ ID NO: 12567 - DNA, 847 bp, Allium cepa
acctaatacctaattgtatatttcttcgttttggatctcagatctgtcccaatttatactcagatctgcttattttcttgtgttttattgaaaccaaagatggggttgacattcacgaagctgttcagtcgattgttcgcgaagaaagagatgagaattttgatggttggtctcgacgcggctggtaaaaccacgatcttgtataagctcaagcttggtgaaatcgtcactaccattcctacaattggatttaatgtggagactgtggaatacaagaacattagttttactgtttgggatgttgggggtcaagataagatcagacctttgtggaggcactacttccagaatacacagggcctcatctttgttgttgatagtaatgatagagatcgtgttgtcgaggcaagggatgagctccataggatgctaaacgaggatgagttgcgggatgccgtactgcttgttttcgcaaacaaacaggatcttccaaatgcaatgaatgcagctgaaatcactgacaagcttggcttgcattctctccgtcaaaggcactggtatatacagagcacttgtgctacatctggagaaggattgtatgaaggtctagattggctctctagtaacattgccagcaagggttgaaaacttggaagggattgctgagaatgtaacccggggatgaagaggacttgtaatatttgaaacttattatattaaagtggttattacatgtttgatcaatatttgtgttgtttcttgtacttattcagggttgattataaattcatttcatgcagttttattatattatagtatttgatatattgttactgataaactgttg

SEQ ID NO: 12568 - DNA, 853 bp, Allium cepa
atcaaatccagatctaaaaccacattacctagttctgtgttcttcgttttggatctcagatctgttccaatttatacttagatctgcttattttctcgtgtgttattgagaccacagatggggttgacattcacgaagttgttcagtcgattgttcgcgaagaaagagatgagaattctgatggttggtctcgacgcggctggtaaaaccaccatcttgtataagctcaagcttggtgaaatcgtcactaccattcctacaattggatttaatgtggagactgtggagtacaagaacattagttttactgtttgggatgttgggggtcaagataagatcagacctttgtggaggcattacttccagaatacacagggcctcatctttgttgttgatagtaatgatagagatcgtgttgtcgaggcaagggatgagctccataggatgctaaacgaggatgagttgcgggatgccgtactgcttgttttcgcaaacaaacaggatcttccaaatgcaatgaatgcagctgaaatcactgacaagcttggcttgcattctctccgtcaaaggcactggtatatacagagcacttgtgctacatctggagaaggattgtatgaaggtctagattggctctctagtaacattgccagcaagggttgaaaacttggaagggattgctgagaatgtaacccggggatgaagaggacttgtaatatttgaaacttattatattaaagtggttattacatgtttgatcaatatttgtgttgtttcttgtacttattcagggttgattataaattcatttcatgcagtttattatattatagtatttgatatattgttactg

SEQ ID NO: 12569 - DNA, 811 bp, Allium cepa
aaagaaaaatcagaaatattatctcaaagatggggttgacattcacgaagctgtttagtcgattgttcgcaaagaaagagatgagaattttgatggttggactcgatgcggctggtaaaaccaccatcttgtataagctcaagcttggtgaaatcgtcactaccattcctacaattggatttaatgtggagacagtggaatacaagaacatcagttttactgtttgggatgttggaggtcaagataagatcagacctttgtggaggcactacttccagaatacacagggcctcatctttgttgttgatagtaatgatagagatcgtgttgtcgaggcaagggatgagctccataggatgctaaacgaggatgagttgcgggatgctgtactgcttgttttcgcaaacaaacaggatcttccaaatgcaatgaatgcagctgaaattactgacaagcttggcttgcattctctccgtcaaaggcactggtacatacagagcacttgtgcaacatctggagaaggattgtacgagggtctagattggctctctagtaacattgccagcaagggttgaaaacttggaagggatagccgagtatgtaacccggggatgaagaggacttgtaatattttaaactttttatattaaagtggttattacatgtttgatcaatatttgtgttgtttcttgtacttattcagggttgattataaattcatttcatgcagttttattatattatagtatttgatatattgttactgataaactgttgctgttgattaattttgttcattttggtttggttg

SEQ ID NO: 12570 - DNA, 936 bp, Platanus occidentalis
gatctcttcatttatttccaaaattttctcatttccttcccatttcctctgtctcctcggccccgagatcacaggctttcttctccgatctccccggttgccgatctgcatttggagatctgactgctttgaacaatggggctcacattcgcgaagctcttcagtcgcctctttgcgaagaaggagatgaggatcctcatggttggcctcgatgcggctggtaaaacgacgatcctctacaagctcaagctcggagagatcgttaccaccattcccaccattggtttcaacgtagagacagtggagtacaaaaacataagcttcactgtttgggatgtggggggccaagataaaatcagaccactgtggaggcactatttccaaaacacacagggtcttatctttgttgttgacagcaatgatagagaccgtgtagttgaggcaagggatgagctccaccggatgctaaatgaggatgaattacgagatgctgtcttgcttgtttttgctaataagcaagatcttcccaatgcaatgaatgctgctgaaattactgataagcttggtctgcattctctgcgacagcgacactggtacattcagagcacctgtgctacatcgggtgagggattgtatgaagggctggattggctctccagtaacattgccaacaaggcatgaccactaccattcactgtgctggcggaaaattagagaattatgttgcaggcgttttactctcacaactggattgaacactcgtatgattgcggaccattgccttctttcattgttagcttttcaagtatagattgtcttatcttttttccttaatctgtttcagcttcattttttcccctctcaacagacttgttcttgctttgcttccaaatatttaccatgcaaatatggtttctacaggattttctcatatgt

SEQ ID NO: 12571 - DNA, 699 bp, Scabiosa columbaria
aaacgcgctcgtctttctcctctctctcatttctgttcctgcgaagttttccagagtttaacagtatttgtatcctgctcaagcgagatccagatggggctcacattcacgaagctgttcagtagactctttgcgaagaaagagatgcgaattctgatggtaggtcttgatgctgctggtaagacgaccattctctataagctcaagcttggagaaatcgtgacaacaatccctactattggatttaatgttgagactgtggaatacaagaacatcagcttcacagtgtgggatgttgggggccaagacaagatccgtcccttgtggaggcactacttccaaaacacacaaggtctgatttttgtggtggatagtaatgacagggaccgagttgttgaagcaagagatgagttgcacaggatgttgaacgaggatgaacttagagatgctgttttacttgtttttgctaacaaacaagatctccccaatgcgatgaatgctgcagaaataactgacaaacttggtctccattctcttcgccaacgccactggtacatccagagcacatgcgcgacctcaggagagggtctttatgaagggctcgattggctttccaacaacattgctagcaaggcataagtcaatttggttatggagtctgttggtgcagaatttcttttgctgttttgtgtgaagaga

SEQ ID NO: 12572 - DNA, 920 bp, Eutrema halophilum
aagaagagatttttctgtatctcacaaattcatcatcgtgaagcgtccgaaggctattatttggacgaccatcagagaaagagcttagatctcgtccggcgttgtttcttcggcttggaaaaatggggctttcgttcggaaagttattcagcaggctttttgcgaagaaagagatgcgtattctgatggttggtctcgatgctgctggtaagacgacaatcctgtacaagctcaaacttggagagatcgttaccactattcccaccattgggttcaacgtcgaaactgtggaatacaagaacattagcttcaccgtgtgggatgtcgggggtcaggacaagatccgtccattgtggaggcactacttccagaacacacaaggacttatttttgttgtggacagcaacgatcgtgaccgtgttgttgaagctagggacgagcttcacaggatgctgaatgaggatgaattgagggatgcagttctgcttgtttttgctaacaagcaagatcttcccaacgcaatgaacgctgctgagataactgacaagcttgggcttcactctctccgccaacgacactggtacattcagagcacatgtgccacctctggtgaaggactctacgagggacttgactggctctccaacaacatcgcaaacaaggcatagaaaggaggtagcagggttcctccttgcttgtttggttttataaaccaaggaagtgaagtggtctgtttcgctagtactaaaaaaaacgaaacccagatttattatcatcatattcttcttcttcgtctctcatctcaaactcaaatcattttacattttgtaatttcctttgattactcgtaagctttttttcttcttcctggagtgagtatatctcttttatttcttcttttaatcagtttcttcctcgca

SEQ ID NO: 12573 - DNA, 1008 bp, Eutrema parvulum
tcgatgaattgggaattaagatcttagattcgatcttcagacacgactgagataaacgattcctcaattgcgttttggttgaatttatcaaatttgtttttgtgaaacaggtttggaaaaaatggggctttcgttcggaaagttattcagcaggctttttgcgaagaaagagatgcgtattctgatggttggtctcgatgctgctggtaagacgacaatcctgtacaagctcaaacttggagagatcgttaccactattcccaccattgggttcaacgtcgaaactgtggaatacaagaacattagcttcaccgtgtgggatgtcgggggtcaggacaagatccgtccattgtggaggcactacttccagaacacacaaggacttatttttgttgtggacagcaacgatcgtgaccgtgttgttgaagctagggacgagcttcacaggatgctgaatgaggatgaattgagggatgcagttctgcttgtttttgctaacaagcaagatcttcccaacgcgatgaacgctgctgagataactgacaagcttgggcttcactctctccgccaacgacactggtacattcagagcacatgtgccacctctggtgaaggactctacgagggacttgactggctctccaacaacatcgcaaacaaggcatagaaaggaggtagcagggttcctccttgcttgtttggttttataaaccaaggaagtgaagtggtctgtttcgctagtactaaaaaaaacgaaacccagatttattatcatcatattcttcttcttcgtctctcatctcaaactcaaatcattttacattttgtaatttcctttgattactcgtaagcttttttatttgctttttcttcccgaagttagtatatcccttatattttttcttctcaatgactcgaaaattttgaacacgttaatcttttgaaattgacgccaaatagatctttccttctgattttaatttcgttattcaaatttcaacttcggaa

SEQ ID NO: 12574 - DNA, 1261 bp, Musa acuminata
tctcggatcctgtgacagatcgagagacagagaaaacagggcagggttttgaggatcggaaagataggaggccgtaaaaaggccgttttaaagaatctcttcagttgttatctttattatagcgcagtcgtgaaaaatcatcataacggcggtgccgttatttcgaacagttacgaacctgacctataccgaacaccttatgacagtcacgtgacatcggttgcgttctttctatttattcccttgcatctccattttcccttcccctctccgtgcggtttcgaaggaagggaagaagcggaggcctctctcgccccatccctctcgatctctccacctctttcgcgatctccagctgaaggaaagatggggttgtcgttcgcaaagctctttagccgcctgtttgcgaagaaggagatgaggatcctgatggtcgggcttgatgccgctggtaagaccacaattctttacaagctcaagcttggagagatcgtcaccaccattccaaccattggattcaatgtggagaccgttgagtacaaaaacattagcttcactgtatgggatgttggtggtcaggacaagatcagacctctgtggaggcattacttccagaacacacagggccttattttcgttgttgacagcaatgaccgtgatcgtgttgttgaggcaagagatgaactccacaggatgctaaatgaggatgagttacgggatgctgtcttgcttgtgtttgctaacaaacaagaccttccaaatgcaatgaatgctgctgaaatcactgataagcttggtctgcattccctgcgtcagcgacactggtacatacagagcacttgtgccacatctggtgagggcttatacgaggggctcgactggctttctagcaacattgccagcaagtaaccaaggttgcttggaggggcgcatgacagcatcagtattatggaatttcccacattgttgcacgcttttgggacacatcggaaccaacgcaacttataatgtttcacttgaatgggtcatctttttcccttgtcttatgctttttcaaaacctaagtaatactttggcagtaaaataaccgtgttggctaccttacacctgttctatgtttatgaattctttttgctggtatgctactcgctttgttgaataggtttggggatgatgctggccctattattttatctgatattttattttgacataggagttgcttatcttggtagggacgatgcataatgggctttttttt

SEQ ID NO: 12575 - DNA, 1225 bp, Cucumis melo
ttgttttacccttttgcccctcttcctctcattcacgacctttgtttcttcatcattctccacctccgctattcttccaatccaaatctctcttcactttttcatatcttcattcaattcatcccttctcttttcttatcgcttctgttcttagacaaattgaaaatagcctcctaagggaaaggagaaatgggattgaccttcaccaagctcttcagtaggctttttgccaagaaggagatgcggattttgatggttggtcttgatgctgctggaaagaccacgatcttgtacaagctcaagctcggagaaattgtcacaactattcctacaattggatttaatgtggagactgtggaatataagaacatcagcttcaccgtatgggatgttggtggtcaggacaaaattcgtccactgtggaggcattacttccaaaacacacagggtcttatatttgttgtggatagcaatgacagagatcgtgttgttgaagcaagagatgaattgcacagaatgttgaacgaggatgaactgagagatgctgtgttgctcgtatttgccaacaagcaagaccttccaaatgcgatgaatgctgctgaaattaccgacaagcttggtctccattcactccgtcaacgccactggtacattcagagcacctgtgcaacatctggagagggtttatatgagggtttagactggctttccaataatattgctagcaaggcatgaggcagttgaggtttttggctgtcggactctggaccgtgggtgaagtttggtgatgataggggtatagttcgttttttctaaagaagtgttgttagcagcagaacagtttgccagacttctatatgtactctctgtttgtatacttgcggcttgatctaaaattatctaaccttgttatagtttctttggtgaagttaatcttgtcataatttccatcactttgctttagagatctccattgtctctctaccttgggtatggagttcagtgggagaatctcgtctgtgccaatctggctcattaatttcctctgtggtacgaaatgtcgtgcgaggttagctggcggatgctggctcaccaatacagatcagacccctcttcctaaatttggtgaagttctaaaatcaagtgcaataggtttatctttatgaagttgctttctctttttgcttgaaggaatgtaggcggaactttcaagaatccattaaaa

SEQ ID NO: 12576 - DNA, 951 bp, Papaver somniferum
caaaacaaacttttctctctgtgtttcagtcttttttgtttattttgttttggctctcgcttggatccagacagagagagtaactgatctaagataaaacaagcagttaatatgggtctgtcatttggaaagctcttcagtcgtctcttcgccaagaaagagatgagaatattaatggttggtctcgatgctgctggtaaaaccaccatactttacaagcttaagctgggcgagatcgtaacaaccatccccaccattggcttcaatgtagagacagtggagtacaagaacatcagcttcactgtttgggatgttggaggccaagataagatcagacctctatggaggcactatttccagaacacacaaggtctcatcttcgttgtcgacagcaacgacagggaccgtgtagttgaggcaagggatgaactccacaggatgctaaatgaggatgagttgagagatgctgtgctacttgttttcgcaaacaaacaggatctgccaaatgcaatgaatgctgctgaaattactgataaacttggtctacattccttacgtcagagacactggtacatccagagcacttgcgctacatctggtgagggattgtacgaagggctggattggctatccaacaacattgcaaacaaggcataatcttcaattttcattctggagagagagatgaagaacttattttgcaggcatttgagtcatacagcctggagggggtactctttggattttctattttctgtatactttgtttggttgttactgcagaaggaatttatagttcctttccttctcttcattctgttatttgttttatttacctttggcatattgtttcgaactttttcacctgtctggagatacttttactggatatttagaagtggatttcattttttaactgattgatatatctatggtgtggtggtatttcac

SEQ ID NO: 12577 - DNA, 912 bp, Papaver somniferum
ttatttgtttggctctcgcttggatccagacatagagagtaactgatctaagataaaacaagcagttaatatgggtctgtcattcgggaagctcttcagtcgtctcttcgccaagaaagagatgagaatattaatggttggtctcgatgctgctggtaaaaccaccatactttacaagcttaagctgggcgagatcgtaacaaccattcccaccattggcttcaatgtagagacagtggagtacaagaacatcagcttcactgtttgggatgttggaggccaagataagatcagacctctatggaggcactatttccagaacacacaaggtctcatcttcgttgtcgacagcaacgacagggaccgtgtagttgaggcaagggatgaactccacaggatgctaaatgaggatgagttgagagatgccgtgctacttgttttcgcaaacaaacaggatctgccaaatgcaatgaatgctgctgaaattactgataaacttggtctacattccttacgtcagagacactggtacatccagagcacttgcgctacatctggtgagggattgtacgaagggctggattggctatccaacaacattgcaaacaaggcataatcttcaattttcattctggagagagagatgaagaacttattttgcaggcatttgagtcatacagcttggagaggctactctttggattttctattttctgtatactttgtttggttgttactgcagaaggaattcatagtccctttccttctcttcattctgttatttgttttatttagctttggcatattgtttcgaactttttcacctgtctggagatacttttactggctatttagaagtggatttaattttcttaactgattgatatatcaatggtgtggtggtatttcact

SEQ ID NO: 12578 - DNA, 658 bp, Ambrosia trifida
ccccactattattcgacaagccccctttctctctttctcctatcctatcgatccctctccacatcagggatcttctccggcaagaaaatggggttaacgttcaccaaactctttagtcggctgtttgccaagaaagagatgcggatcttgatggtgggtcttgatgcagctggtaagacaaccattttgtacaagctcaagctcggtgagatcgtcaccacaattcctaccattgggtttaacgtggagactgtggagtacaaaaacatcagcttcaccgtctgggatgtcgggggtcaggacaagatccgtccattgtggaggcactacttccagaacacacaaggtcttatctttgtggttgatagcaatgacagggatagagttgttgaggcaagagatgagttacataggatgttgaatgaggacgagcttcgagatgcagtcttgcttgtatttgctaacaaacaagatcttccaaatgcaatgaatgctgccgaaatcactgataagcttggcctccattcccttcgacaacgccactggtacatccagagcacctgtgcaacctcaggagagggactttacgagggtctagattggctttccaataacatcgctaacaaggcataagattaaaacaaaccaaacctaatgt

SEQ ID NO: 12579 - DNA, 640 bp, Ambrosia trifida
cccccatattattcgacaagccccctttctctctttctcctatcctatctatcgatccctctccacatcagggatcttctccggcaagaaaatggggctaacattcaccaaactctttagtcgactgtttgccaagaaagagatgcggatcttgatggtcggtcttgatgcagctggtaagacaaccattttgtacaagctcaagctcggtgagatcgtcaccacaattcctaccattgggtttaatgtggagactgtggagtacaaaaacatcagcttcaccgtctgggatgtcgggggtcaggacaagatccgtccattgtggaggcactacttccagaacacacaaggtcttatctttgtggttgatagcaatgacagggatagagttgttgaggcaagagatgaattacataggatgttgaatgaggacgagcttcgagatgcagtcttgcttgtatttgctaacaaacaagatcttccaaatgcaatgaatgctgccgaaatcactgataagcttggcctccattcccttcgacaacgccactggtacatccagagcacctgtgcaacctcaggagaggggctttacgagggtctagattggctttccaataacatcgctaacaaggcataagat

SEQ ID NO: 12580 - DNA, 755 bp, Antirrhinum majus
ccaaatatcaaagcacagctccgatttttcttctctctaacatttcgccagatctatcgtcctcaggaaaaaggaagaagaaatggggctgacattcacgaagctttttagccggctattcgcgaagaaggagatgcgcattctgatggtcggtctcgatgccgccggtaagacgacgatcctctacaagctcaagctcggcgagatcgtgacgacgattccgacgatcggattcaatgtggagacggttgagtacaagaacatcagcttcaccgtttgggatgtcgggggtcaggacaagatccgtccgttgtggaggcattacttccagaacacgcagggcttgatcttcgtcgtcgatagcaacgacagggaccgtgtcgtggaggccagagatgagttgcatcggatgttgaatgaggatgagctgagggatgctgtgttacttgtatttgcaaacaaacaagatcttcctaatgcaatgaatgctgccgagataactgacaagcttggcctgcactcactcaggcagcgacactggtacatccagagcacctgtgctacatccggggaggggctgtatgagggtcttgattggctctctaacaacattgcgaacaaggcctaagctcgtggggttgttcatgtgaggtgacgttgggtgcagccgggtttttttatctagtcttatactagtctgtgtggctatgatttcttatattttttgaaagggtttcattttgtttaggacctgt

SEQ ID NO: 12581 - DNA, 768 bp, Antirrhinum majus
aagccatcatcagctccatattcttctcttctcttctccctcattttccttcagatctatcgttttaagggtattaaagcaagagagaaatggggctgacattcacgaagcttttcagccggctttttgccaagaaggagatgcgaattctgatggtcggtcttgatgcggctggtaaaaccaccatcctttacaagttgaagcttggagagatcgtcactactattcctaccattggtttcaacgtcgaaactgttgagtacaagaacatcagcttcactgtttgggatgtcgggggtcaggacaagatccgtccattgtggaggcactacttccaaaacacccagggtctcattttcgttgtggatagcaatgacagggaccgtgttgtggaggcaagggatgaattgcataggatgttgaatgaggatgagttgagagatgcagtattacttgtattcgcaaacaaacaagatcttccgaatgcaatgaatgctgctgaaataactgacaagctcggcctgcattcactcaggcagcgccactggtacatccagagcacctgtgctacctctggggagggactttatgaggggctcgattggctctcaaacaacattgctaacaaggcgtaaagctaatgcggtcgcttcttgagttgatggtgtacgcagccgggttttatctagtcttatacaagtcttgtgtggctatgtttcaatatttcaagtgtttttgttgtttaggacctttgaatggcttattcct

SEQ ID NO: 12582 - DNA, 845 bp, Antirrhinum majus
atttcgccagatctatcgttctcagggttcaaaagcaagaaagagaaatggggctgacatttacgaagctttttagccgcctttttgccaagaaggagatgcgcattctgatggttggtcttgatgctgctggtaagaccaccatcctgtacaagctcaagctcggagaaatcgtcactactattcctaccattggtttcaatgtggaaacggttgagtacaagaacatcagcttcactgtttgggatgtcgggggccaggacaagatccgtccattgtggaggcattacttccaaaacacccagggtctcatttttgtggtggatagcaatgacagagaccgtgttgtggaggcgagggatgaattgcacaggatgttgaatgaggatgaactaagagatgcggtattacttgtatttgctaacaaacaagatcttccgaatgcaatgaatgccgctgaaataactgacaagctcggcctgcactccctcaggcagcggcactggtacatccagagcacttgtgctacctcaggagaggggctttatgaagggctcgattggctatcaaacaacattgctaacaaggcgtaaggctgatgaagttgttttacatgagttgacgctggatgcggccaggattgtatttagtcttatatactagttggtttggctatgttctttaaatgcttttgtctttgtttaggacctttgaagtgggtgtatgagagacacacactggcttgttccatgtaatttgcaaacatttgtttagtttttgatttgatgctatttaatccattcctaaatcactcacacttatttttctacacatctgagctacct

SEQ ID NO: 12583 - DNA, 1038 bp, Aquilegia formosa
gggaaatgattgatgttaggcgtagttataacgcggtggtaatattcttttttccaagctgaaattttctataaaaagaaacaaacccggcttcatttcttcgggaatttagtggtggactggaacacagacagctcttcttctcttctcagagatttgccttttttctttttttctttctatctctcgtctaagccttgaagatggggctgtctttcacaaaacttttcagccgcctttttgccaagaaagagatgcgaattcttatggtaggtctcgatgctgctggtaagactaccattttgtataagcttaagcttggagagattgtcactaccattcctaccattgggtttaatgttgagactgtggagtacaagaacattagcttcactgtttgggatgttggtggtcaggataagattcgacctttgtggagacattatttccaaaatacgcaagggcttatctttgttgttgacagtaatgaccgcgaccgtgttgttgaggctagggatgagctccacaggatgttgaatgaggatgaattgagagatgctgtgttgctcgtgtttgcaaacaaacaagatctaccaaatgcaatgaatgcagctgagattactgataagcttggtttgcactctctccgccaacgccactggtacattcagagcacatgtgccacatctggggaagggttgtacgaggggttggattggctctccaacaatattgctaacaaggcttagagcactgggataattttttgtggctggatactgctgtcataaagatctgctgctaatattgttcaactatctttctcctttcccctttgctttttccttacctttgaaatgctgctaaaagaactgctctgccccttttagacactcttgttaatgcttttctattgtagattctaaattgtattccctatattcacaataaattttatttccaactctcatccacttgttttattgcaccatataagcatcagatgatatactcttactaatataagaagctcctttt

SEQ ID NO: 12584 - DNA, 964 bp, Arabidopsis lyrata
attcgacgtatttttaacgctcactggatttataagtagagattttttgtgtctcacaaaacaaaaatcatcgtgaaacgttcgaaggccatttctttggacggaccatcggcgttaaggagagagcttagatctcgtgcggcgtagtttctccggcttgaaaaaatgggtttgtccttcggtaagttgttcagcaagctctttgcgaagaaagagatgcgtattctgatggttggtctcgatgctgctggtaagacgactatcctgtacaagctcaaacttggagagatcgtcaccactattccaaccattgggttcaatgttgagactgttgaatacaagaacatcagcttcaccgtgtgggatgtcgggggtcaagacaagatccgtccattgtggagacattacttccagaacactcagggacttatctttgttgtggacagcaatgatcgtgaccgtgttgttgaagccagggatgagcttcacaggatgctgaatgaggatgaattgagggatgcagttctacttgtatttgctaacaagcaagatcttcccaacgcgatgaacgctgctgagataactgacaagcttgggcttcactctcttcgccaacgacactggtacattcagagcacatgtgccacctcaggagaagggctctatgagggacttgactggctctccaacaacatcgcaaacaaggcatagatgggaggttagccagatttctcttttgcttgtttggtttataaatcaaagaaagaggtctgtttcgctagtactaaaagatttattattatattcttcttcgtcgcttatctcaaacgcagagatcatttcacagtttgtattttcccataaataacttgtttactcctctccttttcttcctgaatttgagtatatcatttttacgtcttcttttcattggagcatctttcgaaacaaaagttgaaccaaa

SEQ ID NO: 12585 - DNA, 877 bp, Arnica chamissonis
ttttctctcattctcgttcacttctcgatcgatccctctcctaaagctttctctcagggatcatctccagcaacagaatggggttaacattcaccaaactctttagccggctctttgccaagaaagagatgcgtattttgatggtgggtcttgatgcagctggtaagacaaccattttgtacaagctcaagcttggtgagatcgtgacaacaatccctaccattgggtttaatgtggagactgttgagtacaaaaacatcagcttcaccgtctgggatgttgggggtcaggacaagattcgtccactatggaggcactactttcagaacacacaaggtcttatctttgtggttgatagcaatgacagggatagagttgtcgaggcaagagatgagttacataggatgttgaacgaggacgaacttcgtgatgcagtcttgcttgtatttgctaacaaacaagatcttccaaatgcaatgaatgctgctgaaatcactgataagcttggcctccattccctcagacagcgccactggtacatccagagcacctgtgcaacctcaggagagggactttacgagggtcttgattggctttctaataacatcgctaacaaggcataaggtgatgatgtcgaatgtggatcttggatgtgagatgtgtctttgttcttggtttagcagctttttgtggtagcaaagtatgtctgatataatgtttgttaaacgggtttgggttgtattgcaagtgcttttgaaataggttttccttgaagttgtaatagaggttaattttgactcttttattatatgttttctagattatgcctttaccttcattttgattaatatgtgatcaatcattttaacgatgtctt

SEQ ID NO: 12586 - DNA, 965 bp, Artemisia annua
ccccttctttctctctcgatcgatcccttccattaacgccttttctcttcagggatcttttccgccaaaagaatggggctaacgttcaccaagctctttagccggctctttgccaagaaagagatgcgtattctgatggtgggtctcgatgcggctggtaagactaccattttgtacaagctcaagcttggtgagatcgtcacaacaatccctaccattgggtttaatgtggagactgtcgagtacaaaaacatcagcttcactgtctgggatgtcgggggtcaagacaagattcgtccactatggaggcactacttccagaacacgcaaggtcttatctttgtggttgacagcaatgacagggatagagttgttgaggcaagagatgagctacataggatgttgaacgaggacgagcttcgtgatgcagtcttgcttgtatttgctaacaaacaagatcttccaaatgcaatgaatgctgctgaaattaccgataagcttggtctccattccctccgacagcgccactggtacatccagagcacctgtgcaacctcaggagagggactttacgagggtctggattggctttctaacaacattgctaacaaggcataaggtgatactgaactgtttcatgaatgtggattttggatgcgagcttatactgctagtggtgacgttcttatcatctactttccccattctcgttcttgtatgagctgtgtgcggttctgggattttttcgttaaacagctttattgtgcttttctggtagcaatgtgtctgatataatatttggtggtattgcaagtacttttacaagtattgtctaggttttactttataaacctaaagttgtaacagaggttaattttgattgttttcttagatgctatgctttctgcagtttgcttattactctgtacttgataaaatatcggcataaaaaccgtttgaatttt

SEQ ID NO: 12587 - DNA, 886 bp, Persea americana
ggatactcatttcccagcctttgcaggttctctctcgctctctgaaaatggggctaacgttcacgaagctgtttagtcgtctgtttgcaaagaaggagatgaggattttgatggtaggtctcgatgcagctggtaaaaccaccatcctctacaagctcaagctcggagagatcgtcaccaccattcccaccatcggcttcaatgtggaaaccgtggagtataagaacatcagcttcactgtgtgggatgtcgggggtcaggataagatcagaccattgtggaggcactatttccagaacacacagggcctcatttttgttgttgacagcaatgacagagatcgtgtggttgaagcaagggatgaactccacaggatgctaaatgaggatgagttaagagatgctgtgttgctcgtttttgcaaataagcaggaccttccaaatgctatgaatgcggctgaaattactgataaacttgggctccattccctccgccagcgacactggtacattcagagcacatgtgctacttctggagagggattgtacgaaggtctcgattggctctcaaacaacattgcgaacaaggcttgaaatattcttctccatgcttggcatacattactcccattgatcattgagaactgggtgctctggcatatagactttttattgtttcagtactattgttgatctttagtagttctcttctgcttttaagcttgtttgcgttagacaagttttcccttttgtggattttgttattgctccatgacttgaaatccagtgatgagttgctgtggaaattagtttttatatgtgatttccctaaaaaatgtaaagaaattttccagctgtgaaagcaggataggatttgttgggttttg

SEQ ID NO: 12588 - DNA, 764 bp, Brassica oleracea
atcgggaaacgttggaagggtcatcggagctgagatctcgtgcggcgttgtttcttgggtttgggaaaaaaacatggggctgtcattcgggaagctgttcagcaagctgtttgcgaagaaagagatgagaattctgatggtgggactcgatgcagctggtaagacgaccatcctctacaagctcaaacttggtgagatcgtcaccactatccctaccattggtttcaatgttgaaactgtggaatacaagaacattagctttaccgtctgggatgtcgggggtcaggacaagatccgtccattgtggagacactacttccagaacacacagggacttatctttgttgtggacagcaacgatcgtgaccgtgttgttgaagcgagagacgagcttcacaggatgttgaacgaggatgagttgagggatgcagttctgcttgtctttgctaacaagcaagatcttcccaacgcaatgaacgctgctgagattactgacaagcttggccttcactctctccgccaacgacactggtacattcagagcacatgtgccacctctggagaaggactctacgagggacttgactggctctccaacaacatcgcaaacaaggcatagaaaggaggtagcaagatccctcttcacttgttttgtttataaatcaaggaaagaagggttctgtttcgctagtactatcttcatacattcttcttcttcttcgactcagtctcaaactcaaaaccataatcatactttgtacttt

SEQ ID NO: 12589 - DNA, 1064 bp, Musa acuminata
tcaattatattatatatgtgtatatatcggactgttacaaacctcaaaagcgttatacttactgctgtaacaagcatcagctggcagccacgtgacgttaaggcgaagaagcggagcactctcgcgccccgattcggctctcgacgccttcacgatctcgagcgaaagggaacgatggggctcagcttcgcgaagctgttcagccgcctgtttgcgaagaaagagatgaggatcctgatggtagggcttgatgccgccggtaagacgaccatcctctacaagctaaagctcggagagatcgtcaccaccattcccaccattggattcaatgtggaaactgttgagtacaaaaacattagcttcaccgtgtgggatgttggtggtcaggacaagatcagacctctgtggaggcattactttcagaatacgcaaggccttatctttgttgttgacagcaatgatcgagatcgtattgttgaggcaagggatgagctccacaggatgttaaatgaggatgagctacgggatgctgtcttgcttgtgtttgcgaacaaacaagaccttccaaatgcaatgaatgctgctgaaatcactgataagcttggtctgcattccttgcgtcagcgacactggtacatacagagcacttgtgctacatctggtgagggtttgtacgaggggcttgattggctctccagcaacatcgccagcaagtaaacaaagcatggggggtcgctcaaaagcagcagtatgcatcgttcacggcatcagcacattagagggacacgatgacagttaatgttccgcttggatgggtgctatctctttgttattcctgtctcgtgcaattcaaaaaaaatttccatttgctttgttgaattggatttttgtggatgaaactcttgttagaaacacctttctttgacctggaatttgctttcaccattttcaatagagattgtgccgtcttttagttcagagtttgtttcatctgctaaaaaatttggatagaaaacgtcttcaattatgtgtgttatttaatgcaatgaaaatttatttttgag

SEQ ID NO: 12590 - DNA, 1370 bp, Ocimum basilicum
ggtgggggcattccagtataaatagccgctggctgaaaattttgattacttctcccgaaaaggaaaaataaaagcttatattcctatcgcgttcttccaaagcagctccatatttctctgccctctctccaccacttcgccagatctatcgttttccggcaagaaaagagaaatggggctaactttcacgaagctgtttagccggctttttgccaagaaggagatgcgtattttgatggttggtcttgatgctgctggtaagaccaccatcctgtacaagctcaagctcggagaaattgtcaccaccattcccaccatcggtttcaacgtggagactgttgaatacaagaacattagcttcactgtatgggatgtcggaggtcaggacaagattcgtccattgtggaggcactacttccaaaacacacagggtctcatatttgtggtagatagcaatgatagggatcgtgttgtggaggctagggatgagttgcataggatgttgaatgaggatgagctgagagatgctgtattacttgtatttgcaaacaaacaagatcttccgaatgcaatgaatgctgctgagattactgacaagcttggcctgcactcactcaggcagcgacactggtacattcagagcacctgtgctacttccggggaggggctatatgagggtctggattggctctctaacaatattgctaacaaggcttaaatgttgttgggagttgcttggataatgcgtgcagctgtgtttttcatctagccttatactagtctgtgtggaatgttttcttttaaaaatttttggaagttattatgaatttgcttaggatcctttgaaatggctttgtaaaattaagtggctgttgcttcatccgtttgtggtacatgtaatgctatatattcatgaacaattgtattaatattgtctgtatcctaatccgagagcatggtatcataatcttctgataggctatttattatcctaggattgtcatgaatgcggtggagggtgtttataatgtgaaatttgtagcgtgattaaatgttatttatatatacttgatagtcgggacttgttatggaacgaggccaagtgtctggatgtaatacataattctttgcttcctcataaatttaaaagatgtatttttgttgttatctttggtggtaggggacacattaagttgaatgcacttgatttaggcagtgaaggaattttaactaaatggttggggcccgtatgcaggggggtagatagatcgtaacaggactgctctgcgagattgctggagaaatgaactgcagctgctgctttgtctcgcaaaaagcctttcttccttgtttgttttgtttcatttgtt

SEQ ID NO: 12591 - DNA, 860 bp, Fagus grandifolia
agagaggtccctcatttcccgtgcaaatatcgttgcgaaggatagctccttttgtttacacgcagagagagaaaagggagctacatctctcaatctctcttctcttttctcacttctcatcgcccagatatagaatacgtgaaaaatggggctgtctttcaccaagcttttcagtcgtctctttgctaagaaagagatgcgtatactcatggtgggtctcgatgctgcgggtaagactactattctctacaagctcaagctgggagagatagtcaccaccattcctaccattgggtttaatgtggagactgtggaatataagaacatcagcttcactgtctgggatgttggtggccaagacaagatccgacctttgtggagacattacttccaaaacacccaaggacttatatttgtggttgatagcaatgacagggaccgtgtagttgaagctagggatgagctgcacagaatgttaaatgaggatgagttgagggatgcagtgctgctagtgtttgcaaacaagcaagatcttccaaatgccatgaatgctgctgagataactgataagcttggccttcactctctccgtcaacgccactggtatatccagagcacttgtgctacttctggtgaaggactctatgagggacttgactggctctcaaacaatattgcaaacaaggcatagattgctcgattctgagtttcaggttccagcaactgctggaatataaagtgggaattttctatggtattctggattttgcttggctgtttgttctaccatgtttatgttttccctcggagacattgtcatttgttacctgtagtttcagaataattttaatttttttttt

SEQ ID NO: 12592 - DNA, 1164 bp, Cannabis sativa
gactcgaaggacagctccttttcttcttcgtttagagagagagaaaatcaaggacctcagagaacgctctccattgccacaaacctctctcttttttctctcttctcagaatggggctgtctttcaccaagctcttcagccggctttttgccaagaaagagatgcgtatacttatggtgggtctcgatgcggctggtaagactactattttatacaagctcaagctcggggagattgtcaccaccattccaactattggatttaacgtggagaccgtggaatacaagaacattagctttaccgtctgggatgttgggggccaagataagatccgacccttgtggagacattatttccagaacacacagggtctaatctttgttgttgatagcaatgaccgagaccgtgtagttgaagccagggatgagttgcacagaatgttgaatgaggatgagctcagggatgcagtgctgctagtatttgcaaacaaacaagatcttcctaatgctatgaatgcagctgagataactgataagctcggtctccattcacttcgtcaacgtcattggtatatccagagcacatgtgcaacctcaggtgaagggttgtatgagggacttgactggctttcaaacaacattgccaacaaggcgtagatggtgggcggcttcattcgcaattttttgttggctgaagtacaagaaaagattatgatacattttgttgtgtttgttattgttctagatttggtatgttgttaaagtgccttcgttgtacggtgtttatgctttctcttgcaaacgctgactttttgttactaaatagtgttccataataattcatatttcctctttgaaagatttctttggatatattttacccggttggtgttgttatcatataatctagtttgaagaaactcaacccattcacatcgtggcctcctttgtaccagcaatgtttgcatatcagaattcaaagaaatgaggtcaatgtaaatgtaaaactgtggtcgagggtttgagtaaaatatgaaccccccaaatgtgctcagctctgactagttttgaaggttatttggcttgtttgctgtaaagcttcacaacggcaatggtgaaggtaagagcaagaagaaagttattgaaatgccaaaagaaagccaaa

SEQ ID NO: 12593 - DNA, 1088 bp, Daucus carota
aaaaaacaatactagtcatcgtctattttctgcgatctctctcacacactctctgtgtatcttcttctcactcgttccctctcggatacgcaaagatggggctttctttcaccaagctcttcagtcgtttgtttgccaagaaagaaatgcgcatacttatggtgggtctcgatgcagctggtaaaacaacgattctctacaagctcaagctgggagagatagttactacaattccgaccattggatttaatgtggagactgtggagtacaagaacatcagcttcactgtttgggatgtcggcggccaggacaagatccgtcctttgtggagacattactttcagaacacccaggggctcatctttgtggttgatagcaatgatcgagatcgtgtggtagaagcaagggatgaactacacagaatgctgaatgaggatgagttgagagatgccgtgctacttgtatttgcaaataagcaagatcttccaaatgcaatgaatgctgctgagattaccgataaacttggtcttcattccctccgtcagcgccactggtatatccaaagcacttgtgccacctcaggtgagggtttgtacgaggggttagactggctctcaaacaacatagcaaacaaggcataatcacctcacttagggtttgcatgtttgtggaggccagctaagaagttttctcattgctttcgttcttaagggatctgtattgtgtaccatgttaacgctgacatcttttcttactatgttcaaggtctcttttccagatattgtggttctttaactatagtaacaaatgaatttgtggatacaaatgaatttatatgatctaaatcgtatctgctttgttgaacgtatccaagtacaatctgcgaactagaagcagttttttcttctatatatatgtgtagattctaatgaatcctactgtaacttaattgtttccttatgctaccattttgtgggggcttgaggctcaatatcttcagcgcgaaaagttgttttatatttggcacattatctcggaagcaatatctaatcattactaagatcctgtccaaaaattcttgaccgggc

SEQ ID NO: 12594 - DNA, 870 bp, Daucus carota
tctctctcacacactctctgtgtatcttcttctcactcgttccctctcggatacgcaaagatggggctttctttcaccaagctcttcagtcgtttgtttgccaagaaagaaatgcgcatacttatggtgggtctcgatgcagctggtaaaacaacgattctctacaagctcaagctgggagagatagttacaacaattccaaccattggatttaatgtggagactgtggaatacaagaacatcagcttcactgtctgggatgttggaggccaggacaagatccgtcctttgtggagacattactttcagaatactcaggggctcatctttgttgttgatagtaatgatcgagatcgtgtggttgaagcaagggatgaactgcacagaatgctgaatgaggatgagttgagagatgccgtgctacttgtatttgcaaataagcaagatcttccaaatgcaatgaatgctgctgagattaccgataaacttggtcttcattccctccgtcagcgccactggtatatccaaagcacttgtgccacctcgggtgaaggtttgtatgaggggctagactggctctcaaacaacattgctaacaaggcatagtcaccccactcaagtttgcatagtcctgaaattcagcttagaagtatctttactgctttgttcagagatttgtaccatgttaatgttgatctctttttacattctgcctgtggtctcatttccggattttgtgaatttcttactgtagcctcagattatttgatattctcttttgccttaatatgaatttgaaatacaatcagtcttttgctttagattaatctatacacataaattgccagcaacacagttggagcatgggtg

SEQ ID NO: 12595 - DNA, 1037 bp, Daucus carota
gctttaattgtcgtggacgacgacacttgaaatatatctctctcaccatacccgatcgatcgatccagatctctctctctcaagctctctcattcgctccctccaggatttgcaaggatggggctttctttcaccaagctgttcagtcgtctgtttgctaagaaagagatgcgcatactcatggtgggtctcgatgcagctggtaaaacaacaattctctataagctcaagctaggagagattgtaaccacaattcccaccatcggattcaatgtggagacagtggaatacaagaacatcagctttactgtttgggatgttgggggtcaggacaagatccgtcctctctggagacattactttcagaatactcaggggctcatctttgttgttgatagtaatgatcgagatcgtgtggttgaagcaagggatgaactgcacagaatgctgaatgaggatgagttgagagatgccgtgctacttgtttttgcaaacaaacaagatctccccaatgcaatgaatgctgctgagattaccgataaactcgggcttcactccctccgtcagcgccactggtatatccaaagcacttgtgccacctcgggtgaaggtttgtatgaggggctagactggctctcaaacaacattgctaacaaggcatagtcaccccactcaagtttgcatagtcctgaaattcagcttagaagtatctttactgctttgttcagagatttgtaccatgttaatgttgatctctttttacattctgcctgtggtctcatttccggattttgtgaatttcttactgtagcctcagattatttgatattctcttttgccttaatatgaatttgaaatacaatcagtcttttgctttagattaatctatacacataaattgccagcaacacagttgcagtggaaagagatcctatatgttgcttgaaagaattaccaaccagccaatttgctatggcttgactaccaataaaacatgcagacttcaagaaagccatcaaccaaaacatgtcattaag

SEQ ID NO: 12596 - DNA, 953 bp, Manihot esculenta
gtaaatattggacagctcttcattttaattttcctcattttgtgaggaggtagatctcgtatttgctattggctcttctcagacgtgataggatggggctctctttcacgaagttgttcagccgtctctttgctaagaaagagatgcgaattctgatggtgggtcttgatgctgctggtaagaccaccattctctacaagctcaagctcggagagattgtcaccacaatccctaccattggatttaatgttgagaccgtggagtacaagaacattagcttcactgtttgggatgttggtggtcaagacaagattcgacctttgtggagacattacttccaaaacacacaggggcttatctttgtggttgatagcaatgacagagatcgtgtggttgaagctagagatgagctacacaggatgttgaatgaggatgagttgagggatgctgtactgcttgtatttgcaaacaagcaagatcttccaaatgcaatgaatgctgctgaaataactgataagcttggccttcactctctccgtcaacgccactggtacatccagagcacatgtgccacttctggtgaagggctgtacgagggactggactggctctcaaacaacattgcaaataaggcatagatggcataattctgagtttcaattgcattaagtgctggaatacacagttgatagtgctccatcgtgttctgattttttattaaccaccttagcggtcgtatctgtttaaccgtgtttgttatttctctcaaatatcgcattttgttttctgtagcttcagaataattcataaattttcattgtccttggcagcttagttgcattatttgttttgtgggtttttcaaggtaatgaattttgagacattttttcccttgctattggatgcaattatatacttatatatatttacatataaagttagacatattgcat

SEQ ID NO: 12597 - DNA, 867 bp, Ricinus communis
ataataaatacagcgtcgacgacatctctctctcattttcaaaatttcctcatttctgtggtgaagaaggtgtgaaaatatggggctgtctttcaccaagttgtttagccgactctttgctaagaaagagatgcgtatactgatggtgggtcttgatgcagctggtaagaccaccatcctctacaagctcaagcttggagagattgtcaccactattcccaccattggatttaatgtggagactgtggagtacaagaacattagcttcaccgtgtgggatgttggtggccaggacaagatccgacctttgtggagacattactttcaaaacacacaaggactcatctttgtggttgacagcaatgacagagaccgtgtggttgaagctagggatgagctgcacaggatgttgaatgaggatgagttgagagatgctgtgctgcttgtatttgcaaacaagcaagatcttccaaatgcaatgaatgctgcagaaataactgataagctcggccttcattctctccgccagcgccattggtacatccagagcacatgtgccacttctggtgaagggctgtacgagggacttgactggctctcaaacaatattgcaaacaaggcatagatggcataattgtgagttttcacctgcaacggtgctggaatatacagttgatagtgctcagttgtgttctgaattttcttttttttttttttttgtttaattcacctttacgttgtacctgtttaacggttttttgtcatttcttttgcaaacattgaaatttgtttggtgtagcttcagaataactcttaaattttcactgttgacatcttagtaatcattttatggtttttgtttcttta

SEQ ID NO: 12598 - DNA, 700 bp, Ricinus communis
caaaatttcctcatttctgtggtgaggaaggtgcgtagatcccttcatttgctctctctggctgttctctcagcaggtgtgaaaatatggggctgtctttcactaagttgtttagccgactctttgctaagaaagagatgcgtatactgatggtgggtcttgatgcagctggtaagaccaccatcctctacaagctcaagcttggagagattgtcaccactattcccaccattggatttaatgtggagactgtggagtacaagaacattagcttcaccgtgtgggatgttggtggccaggacaagatccgacctttgtggagacattactttcaaaacacacaaggactcatctttgtggttgacagcaatgacagagaccgtgtggttgaagctagggatgagctgcacaggatgttgaatgaggatgagttgagagatgctgtgctgcttgtatttgcaaacaagcaagatcttccaaatgcaatgaatgctgcagaaataactgataagctcggccttcattctctccgccagcgccattggtacatccagagcacatgtgccacttctggtgaagggctgtacgagggacttgactggctctcaaacaatattgcaaacaaggcatagatggcataattgtgagttttcacctgcaacggtgctggaatatacagttgatggtgctcctttgtgtt

SEQ ID NO: 12599 - DNA, 1111 bp, Catharanthus roseus
atccaaagaattcggcacgaggttctgtggcaggaatttcttcccactcgattcttcagcggaagctttcgagagtgttgagtggtgcatagcagaggagaaacagagatggggctgacattcaccaagctgttcagccggctatttgccaagaaagagatgcggattttgatggtaggtcttgacgcagctggtaagaccaccatcttgtacaagctgaagcttggagaaattgttaccactattcccaccataggtttcaatgttgagactgtagaatataagaatattagcttcactgtctgggatgttggtggccaggacaagattcgtcctttgtggaggcactacttccaaaacactcagggccttatctttgtggtggatagcaatgacagggatcgtgttgttgaagcaagggatgagctccataggatgttgaatgaggacgaactgcgagaggctgtcttgcttgtatttgctaacaagcaagatctcccgaacgcgatgaatgctgcagaaatcactgacaagcttggtctccattctctccgtcagcgccattggtatatccagagcacctgtgcaacctccggggaggggctgtatgaagggctggattggctctcaagcaatattgctaacaaggcatgaagcagggaaggaatttcattgctgttgggaattttgtggggttatggtccatactattttgcttttatatggtattgggcaattcctagattatatatgatatagtagtttaatgttttttctctctttaatatggaagcgtgatgtagctgaagttgcttttaagccctatatatgttgttggcttgatacttttattgtttagttgattttcttttcaaccgagtcttagatgctttgtgatggtattgaattgaacgcttttttgatacactgatggctctctgttttggttgggtatgtatatgctctcatccaagtgtgagtgggttggcagaaaaagagccaatctatatctgtagtccccgttggagggccgaggacacgatcaacaatctactccctttaccgacttcttttttttttttaaatttgtcataatggaatgaaccttcaa

SEQ ID NO: 12600 - DNA, 1012 bp, Catharanthus roseus
aaaattctcatttccccagattacgcgttggtctcaggctttcgttttcttcttcgctccgatcctcgaaggccatctcagggatcatccataaggaagcaatatgggattaacgttcacaaagctcttcagtcggctctttgccaagaaagagatgcgcattctgatggtaggtcttgatgcagctggtaagaccaccatcttgtacaagctcaagctcggagagattgtgaccaccattcccactattggttttaatgttgagactgttgagtacaagaacattagcttcaccgtttgggatgttggtggtcaggacaagatccgtcccttgtggaggcactacttccaaaacacacagggccttatctttgtggtggatagcaatgatagagatcgtgttgtggaagcaagggatgaattgcacaggatgttgaatgaggatgagctgcgagatgcagtgttgcttgtatttgccaacaaacaagatcttcccaatgcaatgaatgctgctgaaataaccgataagcttggtctgcactccctccgacagcgccactggtacatccagagcacctgtgccacttctggagaaggactttacgagggactggattggctttctaacaacattgctaataaggcataaagcaagacaggaaatattttcgtgggttgacactggatgcaggcggctttttatctagttttttcctgttatggtgtttatgaatttcagtttttaagtcaactatatcttttaactggctaattgtactaaagtgctcagttttatgtaattgcaagtatcggtctaggtttttgaatatattgcccgaagataatgagcccgcgaactcatattttgttgctggtagtattgtaaacagagatttataagctgtgtcattcaccttggtttcttaatggcttaatacttgtagtattctttttggatttcttgtccattttgttggtccatattgtttcataatgtcaaggtttttcaagt

SEQ ID NO: 12601 - DNA, 796 bp, Centaurea maculosa
cctcaaatcgatcgattcatccatctccaacaagctttttctcagggatcctcaccaacaagaggaggatggggttaactttcaccaaactattcagccggctttttgccaagaaagagatgcgtatattgatggtgggtctcgatgcggctggtaagacaaccattttgtacaagctcaagctcggcgagattgtgaccacgatcccaaccataggttttaatgtggagactgttgagtacaaaaacattagcttcacagtgtgggacgttgggggtcaggacaagattcgtccactatggaggcattatttccagaacacacaggggcttatctttgtggtggatagcaatgacagggacagagttgttgaggcaagagatgaattgcacaggatgttgaatgaggatgagttaagagatgcagttctccttgtgtttgctaacaaacaagatctcccaaatgcaatgaatgctgctgaaatcactgataagctcggcctccactccctccgacagcgccactggtacatccagagcacttgtgcaacctctggagaagggctttatgaaggactggattggctgtccaacaacatagcaaacaaggcatgaagaggtgattgattttgttgtgagggtggaggtggatgcaagttttgcttttagcttggccagtttatcgttgttcgttcgttcgttgtgcttctgtgcactacctgtggtttgggaaacatgttcttttaaaaggtctttggcttttgatatagaagttatggatgtgtctaattgaatat

SEQ ID NO: 12602 - DNA, 921 bp, Centaurea maculosa
tctgaaagccctttaaatactaccctccttctctgcatctctcttatctcacgaattccgtcggtgatcggcggctccccgttttcaaaccatctccgtcactctccggccgatcatatcaagatggggatgtcttttggaaagctttttagccgcttgtttgctaagaaagagatgcgcattttgatggttggtctcgatgcagctggtaaaacaacaattttgtacaagctcaagttgggagagattgtaaccacaattcccactattggctttaatgtggagactgttgagtacaagaacatcagctttactgtttgggatgttgggggtcaggacaagatccgacccttgtggaggcactacttccagaacacacaggggcttatctttgtggtcgatagcaatgaccgtgaccgtgtggtcgaagctagagacgagctgcacaggatgcttaacgaggatgaactaagagatgcagtgttgcttgtgtttgccaacaaacaagatcttccaaatgctatgaatgctgctgagatcactgataagcttggcctgcattctctcagacaacgacactggtacatccagagcacatgtgccacctctggagaaggtctatatgagggactggattggctttccaacaatatcgctggcaaggcataaacagggctgggtggtgaacttcctgttagttagtgtggtttgagttgaagtttctttttacttaatgttacgaatgaaatgacattttaatccctccgaccgacctctgttcttgaatgaatccgtttggtggttggtcgttcattgtaatctaaattctgcagggttgatcttattgtatccttgaaactcacttgtgcaacttttccaacactatgaaacaaatgagaaaagctataaagactatatgtt

SEQ ID NO: 12603 - DNA, 921 bp, Centaurea maculosa
tcagggatcctcaccaagaagaggaggatggggctaactttcaccaaactattcagccggctctttgccaagaaagagatgcgtatattgatggtgggtctcgatgcggctggtaagaccaccattttgtacaagctcaagctcggcgagattgtgaccacgatcccaaccataggttttaatgtggagactgttgagtacaaaaacattagcttcacagtgtgggacgttgggggtcaggacaagattcgtccactatggaggcattatttccagaacacacaggggcttatctttgtggtcgacagcaatgacagggacagagttgttgaggcaagagatgaattgcacaggatgttgaatgaggatgagttaagagatgcagttctccttgtgtttgctaacaaacaagatctcccaaatgcaatgaatgctgctgaaatcactgataagctcggcctccactccctccgacagcgccactggtacatccagagcacttgtgcaacctctggagaaggactttatgagggactggattggctttccaacaacatagcaaacaaggcatgaggaggtgattgattttgttgtgagggtggaggtggatgcaagttttgcttttagcttggccagtttatcgtcgttcgttcgttgtgcttctgtgcactacctgtggtttgggaaacatgttcttttaaaaggtctttggcttttgatatagaagttatggatgtgtctaattgaatatattgtttgtttttttgttgttttgtttggattgcaagtattatgtactaggttttgattcatatatctgaagttgtaagagattattaagtttttagaagatgtagtttgtctggtattcttataccaatttattatgctgcaagaaatgcttcatgctatcctaccatc

SEQ ID NO: 12604 - DNA, 896 bp, Chelidonium majus
gcttgctcggatccgtcgaagaaccaaaaaataaactgattttcgcccccccttagacaaagatggggctgtctttcaccaagctttttagtcgtctctttgccaagaaagagatgcgtattcttatggtgggtctcgatgcagctggtaagaccacaattctttacaagctcaagctcggagagattgttaccaccattcctaccattggatttaatgtagagactgttgaatacaagaacatcagtttcactgtgtgggatgttggaggtcaagacaagatccgacccttgtggagacattacttccaaaacacacaaggtcttatctttgttgttgacagtaatgatcgtgatcgtgtggttgaggctagagatgagctgcacaggatgttgaatgaggatgagttgagagatgcagtcctcttggtctttgctaacaagcaagatcttccaaatgcaatgaatgctgctgagatcactgataagcttggtctccactctcttcgccaacgccattggtacattcagagcacatgcgccacttcaggagaagggctgtacgagggacttgactggctctccaacaacattgctaacaaggcgtagaagtcgagatgattttgggtttgcgatcgatgttggattagagatgttattagtattatcttcattactgctattgttattattcggtggcttgttgttcgttacctttttttttttcttttttttcttctctttctctctctccctctcctgttaattgttgtgagaaaggaactggttatctatcaacctttctttcagctaaattgtgaatggtttctctattacacagacgaaggcatttgtttatcttagatccataataagtgcagattatttttcatactt

SEQ ID NO: 12605 - DNA, 987 bp, Castanea mollissima
ctcatttcccgttcgcaaacaaacgtgtggaaggacagctcttttacttttcacgcggagacagagagagagacacacacagtcgtgtaccagatctctctcttgtcatcgccaagccaagatatagaatacgtgaaaaatggggctgtctttcaccaagcttttcagtcgtctgtttgctaagaaagagatgcgtatacttatggtgggtctcgatgctgcgggtaagactaccattctctacaagctcaagctgggagagatagtcaccaccattcctaccatcggatttaacgtggagactgtggaatataagaacatcagcttcactgtctgggatgttggtggtcaagacaagatccgacctttgtggagacattacttccaaaacacccagggacttatttttgtggttgatagcaatgacagggaccgtgtagttgaagctagggatgagctgcacagaatgttaaatgaggatgagttgagggatgccgtgctgctagtgtttgcgaacaagcaagatcttccaaatgccatgaatgctgctgagataactgataagcttggacttcactccctccgtcaacgtcactggtatatccagagcacttgtgccacttctggtgaagggctctatgaaggacttgactggctctcaaacaatattgcaaacaaggcttagattgcttgttcttgagttttgggttccagcaactgctggagtataaactgggaattttctatggtattctggattttgcttgcctgtctagtgttacctgttataccatgttaacggtttccctggaagacattgtcctttgttacctgtagtttcagaataattttaaagatttttctttctcgtgatattacctcactagaattgttttgtgaatgtaatgacattttatcttttgttggaaattgtagagctatatcatctctgccatggttcccctagcatatggcgaccaaaagttt

SEQ ID NO: 12606 - DNA, 1242 bp, Cicer arietinum
ttttaagcgaaggaaaagaaaaaaaaaaaaaaaaaaaaaaaaaagaagtgtggtacccttttgttggcgtaataaaattgattctcgtacacatctctcttcccatttcgcgttgctgcaaagcattcttcatctctctctgcggtttctgcttctcaacttttcatctcaaaagggagaattaactaagtgaaggagaaatggggctgacattcacgaagctgtttagtcggctttttgcgaagaaggaaatgagaattctgatggttggtctcgatgctgctggtaagacaactatcctctataagctcaagcttggagagatcgtcaccactattcctaccattgggttcaatgtggagaccgtggagtacaaaaacattagcttcactgtttgggatgtcgggggtcaagacaagattcgtcccttgtggaggcactacttccagaacacccagggtcttatatttgttgtagacagcaatgacagggatagagttgttgaagccagagatgagttacataggatgttgaatgaggatgaacttagagatgcagtattgcttgtgtttgccaacaaacaagatcttcccaatgcaatgaatgctgctgagattactgacaagctgggtctccactctctcagacagcgccactggtacatccagagcacctgtgcaacctctggggagggtctttatgaaggtttggactggctttccaacaacatagccaataaggcataatgctttttgggagtgtttggatcggtaattctggatgcaggggtgaatattatctagcttttatttcttggtcctctttcaaaacaacttgaatttgtgttcatgtattgtggtttaggacatattggtggctacaagtagtaggaatttgtttcatgggatgtttaatacttttgagttttctattgggttttgatgcaatgtccttaactgtaatggagatactaactgaatgtgccatcaggttctgatttatacttttgtcatggtcatatacctttcatataatgagtattggatggagattttgtttatagtaagatatggatggaaatacaatattcgtactttactagacgattatgcttcagcttgtgcacaatatgcatacgtgaatttgatgggttgtcatgatatgacatataggaattttttagtttgaaatttaatgataaatatttggacgtatgttctttaaaagctatacgttgtcgcc

SEQ ID NO: 12607 - DNA, 774 bp, Chrysanthemum coronarium
cctttctcataactctccttcattccttgtttctctctcgatccctcccttccattaacactttttttctctctctcagggatcttttccgccaaaagaatggggctaacgttcaccaagctctttagccggctttttgccaagaaggagatgcgtattttgatggtgggtctcgatgcagctggtaagaccaccattttgtacaagctcaagctcggagagattgtcaccaccatccctaccattggatttaacgttgagactgttgaatacaaaaacatcagttttacagtgtgggatgtcgggggtcaagacaagatccgtcctctatggaggcattacttccagaacacacagggtcttatctttgtggttgatagcaacgacagggacagagttgttgaggcaagagatgaactgcacaggatgttgaatgaggatgagctaagagatgcagttctccttgtatttgctaacaaacaagatcttccaaatgccatgaatgctgctgagatcaccgataagcttggcctccactcccttcgacagcgccactggtacatccagagcacttgtgcaacctctggagagggactttatgaaggattggactggctctcaaacaacatagcaaacaaggcttaggcaatgaatgatctttgtgtttatgagggtggatcttggccagtttgtggttctgcgctacctgtggttttggaacttggtgttttgttttttaatatagaagttatggattgtgtcgaattgaataca

SEQ ID NO: 12608 - DNA, 772 bp, Chrysanthemum coronarium
gaagatggggctgtcttttggcaagttattcagtcgcttgttcgctaagaaggagatgcgtattctgatggttggtctcgatgcagctggtaaaaccaccattttgtacaagctcaagttgggagaaattgtcaccactatccctactattggattcaatgttgagactgttgaatacaaaaacatcagttttactgtgtgggatgttggaggtcaagacaagattcgtcctttgtggaggcactactttcagaacacacaaggtcttatctttgtggtcgacagcaatgatcgtgatcgtgttgttgaagccagagatgagctacacaggatgcttaatgaggatgaactgagagacgcagtgttgcttgtttttgccaacaagcaagatcttccaaatgccatgaatgctgctgagatcactgacaagcttggcttgcaatctctccgacagcgacactggtatatccagagcacctgtgccacctctggggaaggtctatatgagggactggattggctttcaaacaacattgctaacaaggcttaaaagggactcatgcaagtgtggagtatattttatgaagagcattgttagtattttatatctatctgttgataaggaataggtgatctccatcagctttcctagacaatatacattatcacatgtagaatttgtacgcttttattcctgtaatacagtattttgcaatatggagacaaaaacgtttacccttgagttgacctgagttatcgtggttttttaagt

SEQ ID NO: 12609 - DNA, 1052 bp, Chrysanthemum coronarium
aatactcgccctccctctcacaactcaacccccttccccttctttctctctcgatcgatcccttccattaacacatcttctctcagggatcttttccgccaaaagaatggggctaacgttcaccaagctctttagccggctctttgccaagaaagagatgcgtattttgatggtgggtctcgatgcggctggtaagactaccattttgtacaagctcaagcttggtgagatcgtcacaacaatccctaccattggatttaatgtggagactgtagagtacaagaacatcagcttcactgtctgggatgtcgggggtcaagacaagattcgtccactatggaggcactacttccagaacacgcaaggtcttatctttgtggttgacagcaatgacagggatagagttgttgaggcaagagatgagctacataggatgttgaacgaggacgagcttcgtgatgcagtcttgcttgtatttgctaacaaacaagatcttccaaatgcaatgaatgctgctgaaattaccgataagcttggtctccattccctccgacagcgccactggtacatccagagcacctgtgcaacctcaggagagggactttacgagggtttggattggctttctaacaacattgctaacaaggcataaggtgacactgaactgtttcatgaatgtggatttggatgcgagcttatactgccagtggtgacgttcttatcatccactttccccattcttgttcttgtatgagctgtgtgcgattctgggatttcttcgttaaacagctttattgtgcttttctggtagcaatgtgtctgatataatatttggttgtattgcaagtacttttacaagtattgtctaggttttactttataaacctaaagttgtaacagaggttaattttgattgttttatatgtttcttagattatacttttgcttgtatgctattctttctgcagtttgcatattactctgtacttgataaaatatcggcaccaaaactgttttaattgttacacatgagattcttttttatactcaat

SEQ ID NO: 12610 - DNA, 858 bp, Chrysanthemum coronarium
cattttgctttgctgatcgacggctcccgatttcaaaaacttttcatcacttttccggtcgccggcgatcattcaaagatggggctgtcttttggcaagttattcagtcgcttgttcgccaagaaggagatgcgtattctgatggttggtctcgatgcagctggtaaaaccaccattttgtacaagctcaagttgggagaaattgtcaccactatccctactatcggattcaatgttgaaactgttgaatacaagaacatcagcttcactgtgtgggatgttgggggtcaagacaagattcgacctttgtggaggcactactttcagaacacacaaggtcttatctttgtggtcgacagcaatgaccgtgatcgtgttgtcgaagccagagatgagctacacaggatgcttaatgaggatgaattaagagatgcagtgttgcttgtttttgccaacaaacaagatcttccaaacgctatgaatgctgctgagatcactgacaagcttggcttgcaatctctccgacagcgacactggtatatccagagcacctgtgccacctctggggaaggtctatacgagggactggattggctttccaacaacattgctaacaaggcttaaaagggagagtatacatcttatgacgagcattggtagcatttcatatctatctgttgataaggaataggtgatttccatcagctttcctagacaatatacattatcacatgtagaatttgtacgtttttatttctgtaatacaatattttgcaacatggagacaaaaacttttacccttgatttgacttgagttatcgtggttcttgaaagtaaacaactttgtattatttttcc

SEQ ID NO: 12611 - DNA, 1055 bp, Chrysanthemum coronarium
cctttctcataactctccttcattccttgtttctctctcgatccctcccttccattaacactttttttctctctctcagggatcttttccgccaaaagaatggggctaacgttcaccaagctctttagccggctctttgccaagaaagagatgcgtattttgatggtgggtctcgatgcagctggtaagactaccattttgtacaagctcaagcttggtgagatcgtcacaacaatcccaaccattgggttcaatgttgagaccgttgagtacaagaacatcagttttactgtgtgggatgtcgggggtcaagacaagattcgtccactatggaggcactacttccagaacacacaaggtcttatctttgtggttgatagcaatgacagggacagagttgttgaggcaagagatgagttgcataggatgttgaacgaggatgagcttcgtgatgcagtcttgctggtatttgctaacaaacaagatcttccaaatgctatgaatgctgctgaaattaccgataagcttggtctccattccctccgacagcgccactggtacattcagagcacctgtgcaacctcaggagagggactatacgagggtctggattggctttctaacaacattgctaacaaggcataaggcgacactgaactgttttatgaatgtggattttggatgtgagcttatacttctagtggtgacgttcttatcattcactttctccattcccgttctcttatgacttaatgagctgtgtgcaattatgggatttctttgttaaacagcgttattgtgctttttcgggtagcaatgtgtctcgtataatatttggttgtattgcaagtacttttaaaagtatcgtctaggttttactttataaacctaaagttgtaacagaggttaattttgattgttttatatgtttcttagattatacttttgcttgtatgctattctttctgcagtttgcatattactctgtacttgataaaatatcggcaccaaaactgttttaattgttacacatgagattcttttttatactcaat

SEQ ID NO: 12612 - DNA, 855 bp, Chrysanthemum coronarium
ctcgccctccctctcacaactcaacccccttccccttctttctctctcgatcgatcccttccattaacacatcttctctcagggatcttttccgccaaaagaatggggctaacgttcaccaagctctttagccggctctttgccaagaaagagatgcgtattttgatggtgggtctcgatgcggctggtaagactaccattttgtacaagctcaagcttggtgagatcgtcacaacaatccctaccattgggtttaatgtggagactgtcgagtacaaaaacatcagcttcactgtctgggatgtcgggggtcaagacaagattcgtccactatggaggcactactttcagaacacgcaaggtcttatctttgtggttgacagcaatgacagggatagagttgttgaggcaagagatgagctacataggatgttgaacgaggacgagcttcgtgatgcagtcttgcttgtatttgctaacaaacaagatcttccaaatgcaatgaatgctgctgaaatcaccgataagcttggtctccattccctccgacagcgccactggtacatccagagcacctgtgcaacctcaggagaaggactttacgagggtttggattggctttctaacaacattgctaacaaggcataaggtgatactgaactgtttaatgaatgtggattttggatgcgagcttatactgctagtggtgacgttcttatcatccactttccccattctcgttcttgtatgagctgtgtgcgattcttggatttcttcctttaacagctttattgtgcttttctggtagctatgtgtctgatataatatttggttgtattgcaagtacttttacaa

SEQ ID NO: 12613 - DNA, 820 bp, Chrysanthemum coronarium
ccgatctcgacggctccgatctcaaaaaaatctcatcacttttcaggtcgccggcgatcatacaaagatggggctgtcttttggcaagttattcagtcgcttgtttgctaagaaggagatgcgtattctgatggttggtctcgatgcggctggtaaaacaactattttgtacaagctcaagctgggagaaattgtcaccactatccctactatcggatttaatgttgaaactgttgaatacaagaacatcagcttcactgtgtgggatgttgggggtcaagacaagattcgacctttgtggaggcactactttcagaacacacaaggtcttatctttgtggtcgacagcaatgaccgtgatcgtgttgtcgaagccagagatgagctacacaggatgcttaatgaggatgaattaagagatgcagtgttgcttgtttttgccaacaagcaagatcttccaaatgctatgaatgctgcggagatcactgacaagcttggcttgcaatctctccgacagcgacactggtatatccagagcacctgtgccacctctggggaaggtctatacgagggactggattggctttccaacaacattgctaacaaggcttaaaagggagagtatacatcttatgacgagcattggtagcatttcatatctatctgttgataaggaataggtgatttccatcagctttcctagacaatatacattatcacatgtagaatttgtacgtttttatttctgtaatacaatattttgcaacatggagacaaacttttacccttgatttgacttgagttatcgtggttcttgaaa

SEQ ID NO: 12614 - DNA, 1919 bp, Cichorium intybus
aagaaaaaatgttgatggtcactcatctccgttgacgcgtcacaccctcttattttacgagcctcttacctctcctctccctcccacacttttagatcgatcgatcgctctccacaaaccttctctctcagggatcctcatcagaaaaaagatggggcttacattcaccaaactcttcagccggctgtttgccaagaaagagatgcgtatacttatggtgggtctcgatgcagctggtaagaccaccattttgtacaagctcaagctcggtgagattgtcacaacaatccccaccattggctttaacgtggagactgttgagtacaaaaacattagcttcactgtgtgggatgtggggggtcaagacaagattcgtccactatggaggcactacttccagaacacacaggggcttatctttgtggttgatagtaatgacagggatagagttgttgaggcaagagatgaattgcacaggatgttgaatgaggatgagctaagagatgcggttcttcttgtatttgctaacaaacaagatttgccaaatgcaatgaatgctgctgaaatcactgataagcttggcctccactccctccgacagcgccactggtacattcagagcacttgtgccacttctggggaaggactttatgagggattggactggctctccaacaacattgctaacaaggcatgaggtgattgtattttgagggtggagataccagaggcaggttttgctttttgtttggtcggtcactttcttggttatggaactatgttaaaaaggcttctttttttatttttgaatttgatatataggacagttatgggacatgtatgatgatacaatgtttggttggattgttgcaagtattttaaaggtatatgttgtctttcttgtttctaggttttggttgattactataacctaaagtctcaacagagattggtttttaatgttggttgacattgtattcaatgaaaattcaacatttattttctgtttctcttctactcatctaagcatatcacaatatataaagatcaaataaatcaacagcttattaccagtaattcttcaagttcgtgttcagaaaactatcaagaaacaagttcccactaattcacaatggatcaaagaccaaagcaatagtcaacccataaaaaatcaagaaccaaggttcaaaggtcttctttaagaccagttattcgctctttttcttcttcaaaacaaccagaaaaattattcagagaatcaagaatcgaggtccataccatttgttcctctagaaagactttgaattaacaatttcttcagaatcaaaaaatgatatttgtatcatcaaaaatcggcaagctattttgcagattcagttaacctaccaaatgttccattagattcctgatatttctgactcctcttttcttgcttaaaacgtgtttgaccctctcaacaaaaatgatcaagtttctgaaagagaaagtttgaaacagcaaaaatgtatattttctatggaggacaaatgttggttttttgcttctgcttaaaccgataaagcgagagaactaatgccagccgctagtctaatgatcaaatctagaatagtgcaaatcatcccttcgaaccagtcacatacagctgcaaacctttacttagtcgaccactgctaccctaatcgagcaccgccacatcctaatcgcaccctaatcgaccaatcccccaccgtcgcatcccagccgcacgctaatcgaccaaaacacatcccaatcgcataccactcacctcctaatcgaccaccaacgtcctaagcgaccaattgccgaagctcaatcatcgccgaccacatcccaatcgccccctcatgtaccatcgtttggagaaacgagaaccagaccccagtcaccccacccaacta

SEQ ID NO: 12615 - DNA, 910 bp, Cichorium intybus
cccccatatttcacaagcccctctctctcgttcacttttcgatcgatccctctccaaaagctctttcgcagggatcctcaccagcaacaaaatggggctaacattcaccaaactctttagccggctctttgccaagaaagagatgcgtatcctgatggtgggtctcgatgcagctggtaagacaaccattttgtacaaactcaagcttggtgagatcgtgacaacaatccctaccattgggtttaatgtggagactgttgagtacaaaaacatcagcttcactgtgtgggatgttgggggtcaggacaagattcgtccactatggaggcactatttccagaacactcagggtcttatctttgtggttgacagcaatgacagagatagagttgttgaggcaagagatgagttgcataggatgttgaacgaggatgagcttcgagatgcagtgttgcttgtatttgctaacaaacaagatcttccaaatgcaatgaacgccgcggaaatcaccgataagctcggcctccattccctccgacagcgccactggtacatccagagcacgtgtgcaacctcgggtgaaggactttacgagggtctggattggctttctaacaacattgctaacaaggcataatgtgatacttgaatgcggatcctggatgggaggttttctcattctcgttcttgttctgagctgtgtgcggttgtgggatttgttggttaaacagctttttgtgcttttgtgttggtagcaatgtttctgtctgatataatatttggttgtattgcaacttctttttttttttttttaaaagtattcttgtctagattttgctttataaacctaaagctgtaacagaggttaattttgcttgttttatatagtttgctcctattctattaaaaa

SEQ ID NO: 12616 - DNA, 878 bp, Cichorium intybus
acgatcgattgatccttcccgaacaatcttttctcagggatcctcactaccaagaggatgggacttactttcaccaaactcttcagccggctctttgccaagaaagagatgcgaatattgatggtgggtctcgatgcagctggtaagacaaccattttgtacaaactcaagcttggtgagatcgtgacaacaatccctaccattgggtttaatgtggagactgttgagtacaaaaacatcagcttcactgtgtgggatgttgggggtcaggacaagattcgtccactatggaggcactatttccagaacactcagggtcttatctttgtggttgacagcaatgacagagatagagttgttgaggcaagagatgagttgcataggatgttgaacgaggacgagcttcgagatgcagtgttgcttgtatttgctaacaaacaagatcttccaaatgcaatgaatgccgctgaaatcactgataagctcggcctccattccctccgacagcgccactggtacattcagagcacgtgtgcaacctcgggtgaaggactttacgagggtctggattggctttctaacaacattgctaacaaggcataatgtgatacttgaatgcggatcctggatgggaggttttctcattctcgttcttgttctgagctgtgtgcggttctgggatttgttggttaaacagctttttgtgcttttgtgttggtagcaatgtttctgtctgatataatatttggttgtattgcaacttcttttttttttttttataaagtattcttgtctagattttgctttataaacctaaagctgtaacagaggttaattttgcttgttttatatagtttgctcctattctattattctcc

SEQ ID NO: 12617 - DNA, 1015 bp, Cichorium intybus
gtttcattatctgttttctcgccctcttattttacagactccctttctcgctttctctctcctcttcccgatctctctcttcaaaacgatcgattgatccttcccgaacaatcttttctcagggatcctcactaccaagaggatgggacttactttcaccaaactcttcagccggctctttgccaagaaagagatgcgaatattgatggtgggtctcgatgcagctggtaagacaaccattttgtacaagctcaagctcggtgagattgtcaccacaattcctaccataggtttcaatgtggagactgtcgagtacaaaaacatcagcttcacagtgtgggatgtcgggggtcaagacaagattcgtccactatggaggcattacttccagaacacacaaggtcttatctttgtggttgacagcaatgacagggacagagttgttgaggctagagatgaattgcacaggatgttgaatgaggatgaattaagagatgcagttctccttgtatttgctaacaaacaagatctcccaaatgcaatgaatgctgctgaaatcaccgataagctcggcctccactctctccgacagcgccactggtacatccagagcacttgtgcaacatctggagagggactttatgagggattggattggctttccaacaacatagcaaacaaggcatgaggggagtgattgatattttgtgtttatgagggtggatcttggaagcaagttttggttttgaggtttggccagttttctgtggttttggaagttgttctttaaaaaaagtgttttacttttgatatagtggaattgaatatattgtttgtttgaattgcaagttatgtgttaggttttgattcttttatctcaagttgtaagaggtttaagtttttcgtggctgttaggtgtctgagtacttaagtagtttgcaggtatgctcactccattgtttgtgtaccatctggtaaacattatatgctaaattcaactactactactactact

SEQ ID NO: 12618 - DNA, 1659 bp, Cichorium intybus
atcataccaagatggggttgtcattcaccaagctttttagccgcttgtttgctaagaaagagatgcgtattttgatggttggtctcgatgcagctggtaaaacaacaatcttgtacaaactcaaattgggagagattgtaaccacaattcccactattggatttaatgtggagactgttgagtacaagaacatcagctttacagtgtgggatgttggaggtcaggacaagatccgaccattgtggaggcactatttccagaacacacaaggccttatctttgtggttgatagcaatgatcgcgaccgtgttgttgaggctagagatgaactacacaggatgctcaatgaggatgaattaagagatgcagtgttgcttgtgtttgccaacaaacaagatcttccaaatgccatgaatgctgctgagatcactgataaacttggcctccattctctcagacaacgacactggtacatccagagcacatgtgccacctctggagaaggtctatatgagggactcgattggctttccaacaatattgctaacaaggcataaagaggacttggattgtcttgagttatagatgttggtgaaagtcccgtgttagtttgttttgagtttaagatttttttttttttcttgttaatgttgggaatgaaatgttgttgactggtgtttaaatttaaatatacaatgaattgagatggttggaattgtgtaaatctaaatttgcctacttttaaatacttttttaatataatataccttaccattagtgtcttgtttctttctattctagctttatatcttaacacaagaagaatgttatatgttagttcaaccgaatgcaatattctcaaaaattacaacttaattttgattttaataacgtcaaaatgccattaagctcagtaaaagaaaatatcattttaccaaattttcaggttagtttgatatgcataaatcggcatgtatcactaggtttagtcagaacatttaatattttgtttggcaaaatttaggttatgttaagcctgtgacccacaaaaacctttgatttataatgtttaaaaattcgaaatatttaatgtgttatatgattgagaattatattatttagtgacaacttaaaaatcgtaacgaagcaattcattatattttatgcaaaataagttaattttaccatgcatgttcataccaactttcttatgtaactcggttttcttcttctaccaatttgacttcttacaaaataagttataatttaaattaacacatatccataaataaatggaaatgttcacgtttaggtttatatgttaaagcatgtcacttacagtgacatttgccgtgaaatcatcccccccccccccccccccccccccccccccccccccccccccccccccccccccgctttaattatgtttctgtaacctaaagcctcagctgcaatcacacaaacaaacaacaattcatgcacccatgcatgatttagcataggcaattacgttacaaaacttataccagtaaggcaccttccacaagcatcgatgcatggtgaattggtgttttagcttgtgctacaagtattcatgcatgaaaattacactaaaagttaccaatgatatcagtggagagtctgccattggtgaac

SEQ ID NO: 12619 - DNA, 884 bp, Cichorium intybus
cgggggcccactggattctcttcaggaatttgcgagagtgtccagtaaaaaggtaatctataactatctgaagcaacaacaagatgggactgactttcaccaagttgtttagccggttatttgccaaaaaagagatgcgcattttgatggtaggtcttgatgctgctggtaagactactatattatacaaattaaagcttggagaaattgtgaccacaattcctaccattgggttcaatgttgagactgttgaatataagaacatcagcttcactgtttgggatgttggtggccaagacaagatccgtcccttgtggaggcactacttccaaaacacacaggggcttatctttgtggtggacagcaatgacagggatcgagttgttgaggcaagggatgaattacacaggatgttaaatgaggatgaacttagagatgctgttttgttggtctttgctaacaaacaagatctgccaaatgccatgaatgctgctgaaatcaccgacaaacttggtctccattcgcttcgtcaacggcactggtacattcagagcacatgcgcaacatctggcgaggggctctatgaagggctagattggctctcaaacaacattgctaacaaggcatgagagtaccaagtggtttcacgtggcgttttattaagatgatcagatttatacgtctttagcagtgttgtaggtaaaatggtttctaggaaatatattaaaactaatgttgttttaatgtttttttgactttgactttgacttaagcttttggtggaaattaatcaattatgttgtatgagctcaaaactttggagtaatttgagttgtaatagcccaattttccaatacaaaatacaaacatcaagtttcataaag

SEQ ID NO: 12620 - DNA, 1874 bp, Cichorium intybus
cgctctccacaaaccttctctctcaggtaaactcttaatccaaatctaaatctgaatctgaatctgaatcttcatttatcatttctctcccgggccttatcgcttatacgttgaattcagagtttgttaatcgcagggatcctcatcagacaaaagatggggcttacattcaccaaactcttcagccggctgtttgccaagaaagagatgcgtatacttatggtgggtctcgatgcagctggtaagaccaccattttgtacaagctcaagctcggtgagattgtcacaacaatccccaccattggctttaacgtggagactgttgagtacaaaaacattagcttcactgtgtgggatgtggggggtcaagacaagatccgtccactatggaggcactacttccagaacacacagggacttatctttgtggttgatagtaatgacagggatagagttgttgaggcaagagatgaattgcacaggatgttgaatgaggatgagctaagagatgcggttctccttgtatttgctaacaaacaagatttgccaaatgcaatgaatgctgctgaaatcactgataagcttggcctccactccctccgacagcgccactggtacattcagagcacttgtgccacttctggggaaggactttatgagggattggactggctctccaacaacattgctaacaaggcatgaggtgattgtattttgagggtggagataccagaggcaggtttcgctttttgtttggtcggtcactttcgtggttatggaactatgttaaaaaggcttctttttttatttttgaatttgatatataggacagttatgggacatgtatgatgatacaatgtttggttggattgttgcaagtattttaaaggtatatgttgtctttcttgtttgtaggttttggttgattactataacctaaattttcatcagagattgattttaatgttggttgacattgtattcaatgaaaattcaacatttattttctgtttctcttctactcatctaagcatatcacaatatataacgatcaaataaatcaatagcttattagcagtaattcttcaagttcctgttcagaaaactatcaagaaacaagttcccactaattcacaatggatcaaagaccaaagcaatagtcaacccataaaaaatcaagaaccaaggttcaaaggtcttctttaagaccagttattcgctctttttcttcttcaaaacaaccagaaaaattattcagagaatcaagaatcgaggtccataccatttgttcctctagaaagactttgaattaacaatttcttcagaatcaaaaaataatatttgtatcatcaaaaatcggcaagctattttgcagattcagttaacctaccaaatgttccattagattcctgatatttctgactcctcttttcttgcttaaaacgtgtttgatcctctcaacaaaaatgattaagtttctgaaagagaaagtttgaaacagcaaaaatgtatattttctatggaggacaaatgttggttttttgcttctgcttaaaccgataaagcgagagaactgatgctagccgcaagtctaatgataaaatcaagaatagtgcaaatcatccttcgaaccagtcacatacagccgcaaaactttacttactcgaccacctctaccctaatcgagcacctccacatcctaatcgcatcctaatcgaccaatcccccaccgtcgcatcccagccgcacgctaatcgaccaatccgcatcccaatcgcataccactcacctcctaatctgccaccaacgtcctaagcgacaaatagccggagctcagtcatcggcgaccacatcccaatctcccccctcgtgta

SEQ ID NO: 12621 - DNA, 876 bp, Cirsium arvense
gtcggtgatcggcggctccccgttttcagaccatctccgtcactctccggccgatcatatcaagatggggatgtcttttggcaagctttttagccgcttgtttgctaagaaagagatgcgcattttgatggttggtctcgatgcagctggtaaaacaacaattttgtacaagctcaagttgggagagattgtaaccacaattcccactattggctttaatgtggaaactgttgagtacaagaacatcagctttactgtttgggatgttggtggtcaggacaagatccgacccttgtggaggcactacttccagaacacacaggggcttatctttgtggtcgatagcaatgaccgtgaccgtgtggtcgaagctagagacgagctgcacaggatgcttaatgaggatgaactaagagatgcagtgttgcttgtgtttgccaacaaacaagatcttccaaatgctatgaatgctgctgagatcactgataagcttggcctgcattctctcagacaacgacactggtacatccagagcacatgtgccacctctggagaaggtctatatgagggactggattggctttccaacaatatcgctggcaaggcataaacagggctgggtggtgaacttcctgttagttagtgtggtttgagttgaggtttctttttacttaatgttacgaatgaaatgacattttaatccctccgaccgacctctgttcttgaatgaatccgtttgatggttggtcgttcattgtaatctaaattctgcagggttgatcttattgtatccttgaaactcacttgtgcaacttttccaacactatgaaacaaatgagaaaagctataaagactatatgttctattaaaaaagaa

SEQ ID NO: 12622 - DNA, 944 bp, Cirsium arvense
tctcacttacaaatcgatccatcgatccatctcgaacaaccttttctcagggatcctcaccaagaagaggaggatggggctaactttcaccaaactattcagccggctctttgccaagaaagagatgcgtatattgatggtgggtctcgatgcggctggtaagacaaccattttgtacaagctcaagctcggcgagattgtgaccacgatcccaaccataggttttaatgtggagactgttgagtacaaaaacattagcttcacagtgtgggacgttgggggtcaggacaagattcgtccactatggaggcattatttccagaacacacaggggcttatctttgtggtcgatagcaatgacagggacagagttgttgaggcaagagatgaattgcacaggatgttgaatgaggatgagttaagagatgcagttctccttgtgtttgctaacaaacaagatctcccaaatgcaatgaatgctgctgaaatcactgataagctcggcctccactccctccgacagcgccactggtacatccagagcacttgtgcaacctctggagaaggactttatgagggactggattggctttccaacaacatagcaaacaaggcatgaggaggtgattgattttgttgtgagggtggaggtggatgcaagttttgcttttagcttggccagtttatcgtcgttcgttcgttgtgcttctgtgcactacctgtggtttgggaaacatgttcttttaaaaggtctttggcttttgatatagaagttatggatgtgtctaattgaatatattgtttgttttttgttgttttgtttggattgcaagtattatgtactaggttttgattcatatatctgaagttgtaagagattattaagtttttagaagtatgtagtttgctggtattcttataccaatttatatgctgcaagaaat

SEQ ID NO: 12623 - DNA, 884 bp, Cirsium arvense
ggatttcctccaatctgaaagcccttaaatactacgctccccctctgcatatacttgcgtcaatctcacgaatttcgtcggtgatcgacggctccccatttcaaacgatctccgtcacactcctacaatcgccggcgaccgatcaaatcaagatggggttgtcttttaccaagctttttagccgcttgtttgctaagaaagagatgcgaattttgatggttggtctcgatgcagctggtaaaacaacaattttgtacaagctcaagttgggagagattgtaaccacaattcccactattggctttaacgtggagactgttgagtacaagaacatcagctttactgtttgggatgttggtggtcaggacaagatccgacctttgtggaggcactacttccagaacacacaagggcttatctttgtggtcgatagcaatgaccgtgaccgtgtggtggaggctagagacgagctgcacaggatgcttaatgaggatgaactaagagatgcagtgttgcttgtgtttgccaacaaacaagatcttccaaatgccatgaatgctgctgagatcactgataagcttggtctgcattctctccgacaacgacactggtatattcagagcacatgtgctacctctggagaaggtctatatgagggactggattggctttccaccaatatcgctaacaaggcctaaacagggctgggtgaacttccttccttccttcctgttagttagttagtgtggttggttttttttttttttaatcttattgttacgaatgaaaagacgttttaatcctcccaccaacctcagttcttgttaacgatggttggtccttctatgtaatctaattctgctagggttgttgtatttgtattc

SEQ ID NO: 12624 - DNA, 815 bp, Trifolium pratense
agagtagttgaatatgggtctgtcattcacgaagctgtttagccggcttttcgcgaagaaggagatgcgtatacttatggtcggtctcgatgccgctggtaagaccaccattctgtataagctcaagcttggagaaattgtcaccaccattcccaccattgggtttaatgtggaaactgtggagtataagaacatcagctttactgtctgggatgttggaggccaggacaagattcgtcctctgtggagacattacttccaaaacacacaagggcttatttttgttgttgatagtaacgatcgagatcgtgttgttgaagctagggatgagttgcacaggatgttaaatgaggatgagttgagagatgctgtgcttctagtttttgcaaacaaacaagatcttccaaatgctatgaatgctgctgaaataactgataagcttggtcttcattcacttcgtcagcgtcactggtatatccagagcacatgcgccacttctggcgaaggactttatgaaggtcttgactggctctcaaacaacattgcaaacaaggcttagttattgttagtaatgggctgcatgaagttcagttgagattagagatttatgatttcaaatgtttgaatgtggttaccctgtttaaaattttaccagctctagcatgtattgtttcatttgtttttgaaaaagaacaaacgtacctagtaggtttaatacatttgcaattgtttttccgtgtataacctaaaatcattgtttcacccattgatctgtgtggtcaattaaatcattgaaagcttttacatttatacat

SEQ ID NO: 12625 - DNA, 981 bp, Trifolium pratense
gttctataaatccgcgaaggtctgacggtgagagaagctccttttattttcttttctctttgttacaaggagaagagatccatccatccgcgccttcatcttcttcttctccaagaaaacttgaaaatgggattgtctttcaccaagctgttcagtcggctatttgccaagaaagagatgcgtatacttatggtaggtctcgatgcggctggtaagaccacaattctttataagcttaagcttggagagatcgtcaccaccattcctaccatcgggttcaatgtggaaactgtggaatataagaacatcagtttcactgtttgggatgtcggaggtcaggacaagatccgtcctctgtggagacattacttccaaaatacacaaggacttatttttgtggttgatagcaatgacagggatcgtgttgttgaagctagagatgagctgcataggatgttgaatgaggatgaattgagagatgccgtgcttctagttttcgcaaacaagcaagatcttccaaatgctatgaatgctgctgagataactgataagcttggtcttcattctctccgtcagcgtcactggtacatccagagcacatgtgccacatctggtgaaggactttatgaaggacttgactggctctcaaacaatattgcaaacaaggcatagagatttattagttaaagggtgcaagaagttgagcttactgtagcgattacgatctccggagtctggttttcttgccctgcttagatttcattgctcgagcatgtattatttttcttaaaaagaactgcagtctattactgaagaataatttgatttttttccccatgtataaccaaatagcattgtttaatgtttacccttttgattgtgaagtcgattgaattatttatagccacatgtttatgtgtttgtctatatctattagattcttaggagctaccatttggcagagcacgtcaaagaggaagg

SEQ ID NO: 12626 - DNA, 887 bp, Trifolium pratense
agagtagttgaatatgggtctgtcattcacgaagctgtttagccggcttttcgcgaagaaggagatgcgtatacttatggtcggtctcgatgccgctggtaagaccaccattctgtataagctcaagcttggagaaattgtcaccaccattcccaccattgggtttaatgtggaaactgtggagtataagaacatcagctttactgtgtgggatgttggaggccaggacaagattcgtcctctatggagacactacttccaaaacacacaagggcttatttttgtggttgatagcaatgatcgagaccgtgttgttgaagctagggatgagctgcacaggatgttaaatgaggatgagctgagagatgccgtgcttctagtttttgcaaacaagcaagatcttccaaatgctatgaatgctgctgaaataactgacaagcttggtcttcattcacttcgtcagcgtcactggtatatccagagcacatgcgccacttctggtgaaggactttatgaaggacttgactggctgtcaaacaacattgcaaacaaggcttagttattgttagtaatgggctgcatgaagttcagttgagattagagattatgatttcaaatgtttgaatgtggttaccctgtttaaatttttaccagctctagcatgtattgtttcatttgttttcgtaaaagaacaaacgtacctaggtttaatacatttgcaattgtttttccgtgtataacctaaaatcattgttttttgtttcacccattgatctgcgtggtcaattaaatcattgaaagcttttacatttatacatatatattagcgagtataaaacaaacaatcttatatgggtttgtttgatgaccatcaaaatctgtcgttc

SEQ ID NO: 12627 - DNA, 1392 bp, Conyza canadensis
cgtatctctctatataattcatcaggtagcccctttctgtttctcctccttgtttctctctttcttgatcgatccctctccatctaaatacacaacaattaccttttctcagggatccttgcaagaaatagaatggggctaacattcaccaaactctttagccggctttttgccaagaaagagatgcgtatcttgatggtgggtctcgatgcggctggtaagacaaccattttgtacaagctcaagcttggtgagatcgtcacaacaatccctaccattgggtttaatgtggagactgttgagtacaaaaacatcagcttcactgtctgggatgtagggggtcaagacaagatccgtccactatggaggcactacttccagaacacacagggtcttatctttgtggttgatagcaatgacagggatagagtggttgaggcaagagatgagttgcacaggatgttaaatgaggatgagttaagagatgcagttcttcttgtctttgccaacaaacaagatttgcctaatgcaatgaatgctgctgagatcactgataagctcggccttcactccctccgacagcgtcactggtacatccagagcacttgcgcaacatctggggaaggactttatgagggtttggactggctctccaacaacattgctaacaaggcatgaggttacgagcaaactatattgagggtggggaataccagaggcaagtttttctttcatttgatcaggctgctttcttgttctcgtccttctttgacagaggtgtggatggttatggtgctctgttcgtgaaaaggcttttagatatataggacatttggatatgtatgatacagtatttggttggattgcaagtattttaaaaggtacatgttttcatgtttgtaggtcttgattcatataaactaaatatttaagagagattacttttggtggttcatatatttttctcaagtgctgtacctcttgctttattttttgctctgatgttgtaaccttgtgcttgtcacataccaatatgataaacgtctaggccagtaaatagtaataccaatgaaggacttgtaagttgtaccaatttgctggagatcaataacaatacatgaccctggattcatctgttcagctaatcgttgaatatttccatggtgaattgagcttgatacttctttaaaatcttgtctgatcatctgttttggaacctgtaccattacgatgcaactgagaaggcaacctgcaaggttgagcttacgatccgcttgcagattttgcccaaacaggtctactacatttttctattatacaaaaggatcaagccaaatgctgccaagagcatgagatatcgagctgtgcttaaacatgacacccggcataatg

SEQ ID NO: 12628 - DNA, 1112 bp, Conyza canadensis
tctctctctcttcaaatcgatcgtctctaaaaatctttttctcagggatcctcgatagtataagaggatggggctaactttcaccaagctttttagtcggctctttgccaagaaagagatgcgtatattgatggtgggtctcgatgcggctggtaagaccaccattttgtataagctcaagctcggtgagattgtcaccaccatccctaccatcggtttcaatgtggagactgttgagtacaaaaacattagcttcacagtgtgggatgtcgggggtcaggacaagatccgtccactatggaggcactatttccaaaatacacaaggtcttatcttcgtggttgatagcaatgacagggacagagtcgttgaggcaagagatgaattgcacaggatgttgaatgaggatgagttaagagatgcagttctccttgtatttgctaacaaacaagatctccccaatgcaatgaatgctgctgaaatcactgacaagcttggactccactccctccgacagcgccactggtacatccagagcacctgtgcaacctctggagagggactttatgagggattggactggctttccaacaacatagcaaacaaggcataaggcgttgattgatgtttctttttacgagggtggatcttgggcggtttctccttctagtgatacctgtagttttggaaactgttgtttgaaaagatgttttgcttttgatatagaggttatggatgtgtctaattgaatgaatacattgtttgtttgtctggatttgcatgtatgtctttaggaagttattattcttttatctgaagttgcaagagactaaacctttttcttttgtcgtctttagaatatgtagtttgttggtatgctttgtataccatttggtaaacattatatgctaaattcaactactctgagaatgtttcatgctttgtagttttcggttttcctctgctttattttctggtaaacattatatgtaaattcctagtcgcaaaatttgatacttgtaagctgtaatggcatgaattttaaggggttaacatatgtattgcagctttacatatgtttggttattcgtactccaagtgcattttcaggg

SEQ ID NO: 12629 - DNA, 858 bp, Cucumis sativus
agagtcctcatatatcgcgaatgcgcatttgatcgtgaaggacagcttctcccttgtgttcaagagagagagatctatcattcttatttggggccgatctctctattctcctctcttcaattcctttacttgaaaaatggggctgtcttttaccaagcttttcagccggctctttgccaagaaggagatgcgtattctcatggtgggtcttgacgcagctggtaagacgacaatcctttacaagctcaagctgggagaaattgtcaccaccattcctaccatcggttttaatgttgagactgtggaatacaagaacatcagcttcaccgtctgggatgtggggggccaagacaagatccgaccattgtggaggcattatttccagaacacccaaggacttatttttgtggtggatagcaatgacagagaccgtgttgttgaagctagggatgagctgcacagaatgttgaatgaggatgagctgagggatgctgtgcttttggtatttgccaacaagcaagatcttcctaatgccatgaatgctgctgagatcaccgacaagcttggtcttcactccctccggcaacgtcactggtacatccagagcacatgtgccacatccggtgaagggctgtatgaaggacttgactggctctcaaacaatattgccaacaaggcgtagatggggatttctttcgagctgggattgcttctggaaaatcaaattgatgtgatttatcccttgtttacgggcatttttgttggattacctgatctatacgacgttcctaatggatgattcctaggttggtgttggatctatgaataatgaaagaaattttgaagtattttgtcatg

SEQ ID NO: 12630 - DNA, 894 bp, Cucurbita pepo
ccgagcgccataatccgcgttctgaagctcgccttcttttgttctctccatccctttcaatacacttctgacctctctgtgaagctctcagtggaaattctccgttacgaacagaaatgggactgaccttcgcaaaactcttcagtcggctgtttgctaaaaaggagatgagaattctgatggttggtcttgatgctgctggtaagacgaccattctctataaactcaagcttggagagattgtcacaactattcctaccatcggatttaacgtggagactgtggaatacaagaacatcagcttcactgtttgggatgtcggtggtcaggacaaaattcgtccattgtggaggcactacttccaaaacactcaaggtcttatatttgtggtggacagtaacgatagagaccgtgttgttgaggcaagggacgaattgcatagaatgctgaatgaggatgagcttcgagatgcagtattacttgtgtttgctaacaaacaagatctccccaatgcaatgaacgccgctgagattactgataagcttggtcttcactcacttcggcagcgccattggtatatccagagcacttgtgcaacctccggtgaagggctttatgagggattagattggctctcaaacaacattgctaacaaggcataaagctgataaagagttgtcgtgtagaccgacaatcctggatgcaggggtgaatgttatctactttttttctatggtcatattgtaatgggcttctgtgacaatgagatacatctaattcaaacttatcccgtcgcattcacatctgaaattcgtttaatctcgcgttcttttgcaaagtatttgacttgaactttgaaggtgaccaatatcagctcctaatagatgctggaag

SEQ ID NO: 12631 - DNA, 928 bp, Cucurbita pepo
tgctcgtgcgctccaagacacggtagtcacgacccagagcggcggggggcataaaatggaccgcggttaacttttgttcgccccttcggccctcctcctcccattcagagctttccacagcgccacctttccaactccactcctcagacaaatagagatagccagctaaggcaaagcagaaatggggttgaccttcaccaagctcttcagcaagctttttgctaagaaagagatgcgcattttgatggttggtcttgatgctgctggtaagaccacgatattgtacaagctcaagctcggagaaattgtcacgaccattcctacaatcggatttaatgtggagactgtggaatataagaacatcagcttcacagtatgggatgttggtggtcaggacaaaattcgtccgctgtggaggcattacttccaaaacacacagggtcttatatttgttgtggatagtaatgacagggatcgtgttgttgaagcaagagatgagttgcacagaatgttgaatgaggatgaactgagagatgctgtgttgctcgtatttgccaacaagcaagatcttcctaatgcgatgaatgctgcagaaattaccgacaagcttggtcttcattcactccgtcaacgacactggtacatccagagcacgtgtgcaacatctggagagggtctatacgagggtttagactggctttccaacaatattgctagcaaggcatgaagcggttgaggctcttgaatgtcagactgagctgtgggtgaagtttggcgatgataggggtatggttcacttttctcaagaagtgtcattagcagcagaacagtttgaaacttctatatgtattttctatttgtatacttgtgacttgatctaaaatgatcaaaaccatgttatagtttctctgagaagtcaaccttgtta

SEQ ID NO: 12632 - DNA, 805 bp, Cyclamen graecum
ccccatctcaatttcttcatttctagctatttcttttgatcatcgaggtgaggcaataagttgataattgtagtgaagcagagatgggcctcactttcaccaagctgttcagcaggctttttgctaagaaggagatgaggatccttatggtaggtctcgatgcagctggtaagactacaatactgtataaactcaagctcggggaaatcgtcacaacaattcctacaattggattcaatgttgagacagtggagtacaagaacattagcttcaccgtgtgggatgttgggggtcaggataagattcgtccattgtggaggcattacttccaaaatacacaggggcttatatttgtggtagatagcaatgacagggatcgagttgttgaggcaagggatgagttgcataggatgttgaatgaggatgagctgcgggatgcagtgttgcttgtgtttgccaacaagcaagatctgccaaatgcaatgaatgctgcagaaattaccgacaagcttggtcttcattcactccgtcaacgccactggtacatccagagcacatgtgcaacttctggagaaggtctttatgaagggctggattggctttctaacaatatcgctaacaaggcataaaagttcctttgtttcgggagctgctggacttttcatgatgcatggtgtgataagctttggcccggtatgatctcggtgaactctaggagctatagcgtctcgtttgcgttgtaggaaattcgacttgatatacattctgaaactagtgtttaatggtaattctgctacttctgctc

SEQ ID NO: 12633 - DNA, 923 bp, Cynara scolymus
gcgggggactatctgccccatattctacaatcccccctcgcgctctcgttcccttttcgatcgatccctctccaaaagcttttcgcagggatcctcaccagcaataaaatggggctaacattcaccaaactctttagccggctctttgccaagaaagagatgcgcatcctgatggtgggtctcgatgcagctggtaagacaaccatattgtacaagctcaagcttggtgagatcgtgacaacaatccctaccattgggtttaatgtggagactgtcgagtacaagaacatcagcttcaccgtgtgggatgttggtggtcaagacaagattcgtccactatggaggcactacttccagaacacacagggtcttatctttgtggttgatagcaatgacagggatagagttgttgaggcaagagatgagttgcataggatgttgaacgaggatgagcttcgtgatgcagtcttgcttgtatttgctaacaaacaagatcttccaaatgcaatgaatgctgctgaaatcactgataagctcggcctccattccctccgacagcgccactggtacatccagagcacctgtgcgacatctggagagggactttatgagggtttggattggctttctaacaacatcgctaacaaggcataagtgtgatatgaaaccattccctgaatgcggatcttggatgcgagcatttgcttggtttaagtggtgagcttcgtatcatctggttgtgctcaatgtgtgcatttctgggcagggtttttgtgcttttgttctgtagcgagcgatgttgtgtctggtataatatttggttgtatttcagtactttttaaaacctaaagttgtacagagattaatttggttgttttttatatgtttcctagattcaactaaacttcactttacttggctgc

SEQ ID NO: 12634 - DNA, 869 bp, Taraxacum officinale
tcgacggtccccatttcaaacgatctccgtcactacctgcaatcgccagccgatcgatatcataccaagatggggctgtcatttaccaagctttttagccgcttgtttgccaagaaagagatgcgtattctgatggtaggtctcgatgcagctggtaaaaccacaatcttgtacaagctcaagttgggagagattgtcaccaccattcccaccatcgggtttaatgtggagactgtggagtacaaaaacatcagctttacagtgtgggatgttggaggtcaggacaagattcgaccattgtggaggcactacttccagaacacacaaggccttatctttgtggttgatagcaacgatcgtgaccgtgttgtggaggctagagacgagctccacaggatgcttaatgaggatgaactgagagatgcggtgttgcttgtatttgccaacaaacaagatcttccaaatgccatgaatgctgctgagatcactgataagcttggcctccattctctcagacaacgacactggtacattcagagcacatgtgccacttctggagaaggtctatatgagggtcttgattggctttccaacaatatagctaacaaggcatagacaggagtgggatgatgttggatttataggtgttgctggaactcttatgttagttttgtttttcttgttaatgttgggaatgaaaaaatgttgactggtgtttaaatttaaatatacgatgttggaagtgtgtaaatgtgtctatctagattggctttggctgcctttttttttttaatgcttgaaattgtatccactatatgtgcatggggataagactcaattggacaaataaggccgtttatgtctttctc

SEQ ID NO: 12635 - DNA, 916 bp, Solanum melongena
ttaccataattcgcgttattctcaagcgcgctctctctctctctctctatctatctctctctctctgtctccgctcgtgctttctctcactagattcctcttccccaaactgttcttcagggatcattaagaaaaaagagaaatggggctgacattcaccaagcttttcagtcggctctttgccaagaaggaaatgcgcatcctcatggttggactcgatgcagctggtaagaccaccatattgtacaagctcaagctgggagagatcgtcaccactattccaactattggtttcaatgtggaaactgtcgagtacaagaacatcagcttcactgtttgggatgtcgggggtcaggacaagatccgtccattgtggaggcactatttccagaacactcagggtctcatttttgtggttgatagcaatgacagagaccgtgtagtggaggcaagagatgaattgcacaggatgttgaatgaggatgagcttagggatgcagtgctgcttgtttttgctaacaaacaggatcttcctaatgcaatgaatgctgctgaaataactgataagcttggactccattccctcaggcagcgtcactggtacatccagagcacttgtgcaacttctggagagggactctatgaggggctcgattggctttctaataacattgccaataaggcctaaagtcaaagtagagttgttgcggtttttgatcctggatgcaggcgggtttttatctagttccattttctttcatctcgttttttctttttgtgttgttatgaacacgtcccctaacagtcatttgcttcttaggaggatacttttgaaatgttttgtaatacaatggttggatgtatgtaatttgcttattgtttaggtttaacttgtaacaaaactccccttttctgg

SEQ ID NO: 12636 - DNA, 867 bp, Solanum melongena
atatttcagcgttaatctcaggtttctctctcaatagatccctcctccaaaagctcttctcagggatcatcatcaagtaagcggaatggggctcacattcaccaagctctttagtcggctttttgccaagaaggaaatgcgcattcttatggttggtcttgatgcagctggtaagacgaccatattgtacaagttgaagctgggagagatcgtgactactattcctacaattggtttcaatgtggagactgttgagtacaagaacatcagcttcactgtttgggatgtcggaggtcaggacaagattcgtccattgtggaggcactacttccagaacactcagggtctcatttttgtggttgatagcaatgatagagaccgtgttgtagaagcaagggatgaattgcataggatgttgaacgaggatgaacttcgggatgctgtgttgcttgtatttgctaacaaacaagatcttcctaatgcaatgaatgctgccgaaataactgataagcttggactgcactccctcaggcagcgtcactggtacatccagagcacttgtgcaacttctggagaggggctttatgagggacttgattggctttctaacaacattgctaacaaggcttaaagtgatgcagatttgttattgtgggttgatcctggatgcagacggggttttatctagttattttttcttgtcatgtcagtgtggttatggatatcttgttgaaagcattttgtgtttgattagggctttttgtaatggctgtgtaaaacaatggtcgaatatatgtaattgctgtttgattaggtatactgtcataagtttgtaaacaaagactagctttcatatttgttaatgtt

SEQ ID NO: 12637 - DNA, 865 bp, Epimedium sagittatum
tctagttgtggtcgacagctcctcctcggatctctccacgctaactttcccttcttcctttctgttgtacgaagatggggctgtctttcacgaaacttttcagtcggctttttgccaagaaggagatgcgtatccttatggtcggtctcgatgcagctggtaagaccaccattttatataagcttaagctcggagagatcgtcaccaccattcctaccattggatttaatgtggagactgtggaatacaagaacattagcttcactgtttgggatgtagggggtcaggacaagatccgtccattgtggagacattatttccaaaacacgcaaggtcttatcttcgtggttgacagcaatgatcgtgatcgtgtggtggaggctagggatgagctgcacagaatgttgaatgaggatgaattgagggatgctgtgctgcttgtgtttgctaacaaacaggatcttccaaatgcaatgaatgcagctgagatcactgataagctcggtcttcactccctccgccagcgccactggtacatccagagcacgtgtgccacatctggagaagggctttatgagggactggactggctctccaacaacattgctaacaaggcatagatggtaattggcaattttgttgatttttgagctccaacctctggtcagggtagagatgttactactattatcttgtttagtgcttttcattttgaactgtgttgctcttcgagcactctctgttttaaaggatttggttacattggtatttctctgttagatccaagaataactttgaaaactttgaaggcttttgttgtatttgtcgtgaacttcctcacatgcaatatactaatagactttct

SEQ ID NO: 12638 - DNA, 874 bp, Eschscholzia californica
cctatctttctaattcattcgctcgatcacttgcgaatcattcttcgcaaggttggagtattaaaagctaaagagagatggggttgacattcacaaagcttttcagtcggctttttgccaagaaagagatgcgtattctgatggttggtctcgatgcggctggtaagactactatcttgtacaagctcaaacttggagagatcgtcacaaccattcccacaattggattcaacgtggagacagtggaatacaagaacatcagctttactgtttgggatgtcgggggtcaggacaagatccgtccattgtggaggcactatttccaaaacacacaaggcttaatctttgtggtggatagcaatgacagagatcgagttgttgaagcaagggatgagttgcacaggatgttgaatgaggatgagttgcgagatgctgtgttgcttgtatttgctaacaaacaggatcttcctaatgcaatgaacgctgctgagataactgataagcttggcctccactctcttcgtcaacgccattggtacatccagagtacatgtgcaacatcaggcgagggtctttacgagggtttggattggctttcaaacaacatagctaacaaggcttaaggtaattggtgcagagtggaagtattttctaggtattttgccctgagagatatatggtgtgtggtaatatgatttgagagagggaaacctctcattttgctttggcttacaaactttttatatcatatgttgtaatagcaagaattgaatggctgagacttaagatttcattggtttatattatctctacttgaaaatcttgacgtggttcttattatcatttagctattgctacaaatcaaacagttatt

SEQ ID NO: 12639 - DNA, 1160 bp, Eucalyptus grandis
acgccgttgaggttcgggcagccataaaatgtcgtcatcttcttcccttccctttccccgatttcacaccgcagcgcgacacgagagcccgcgaccttcgttccagcgcagcgccaccttccttccgacttccgagggaagtgtttttgtttggggctgaactagagcgttcgggaccatggggctcacgttcacgaagctgtttagccggcttttcgccaagaaagagatgaggattttgatggtgggtcttgacgctgctggtaagaccaccatcttgtacaagcttaagctcggagaaatcgtcaccaccatccccaccattggttttaatgtagagactgttgaatacaagaacatcagcttcacagtttgggatgtcgggggccaagacaagatccgtccattgtggaggcactacttccaaaacacgcagggtttaatttttgtcgtggatagcaatgatagggatcgagttgttgaggcaagagatgagttgcataggatgctgaatgaggatgaactgagagatgctgtgttgctcgtctttgccaacaaacaagatctccctaatgcaatgaatgcagcggaaataactgacaagcttggtcttcattctctccgtcaacgtcactggtacatccagagcacctgtgcaacctccggagagggcctttatgagggtctggactggctttccaacaatattgccaacaaggcttgaggctttctcagcatggcaccagaagcacgtggtttgtaagggattagttttttgtcttgttgttggtatactattgtaaaagctcaattgttgcttcaactttatatgtaatgtgacgtgggattgcattgctgctgttttggccaacactcttaagcggtgaaagtgacttgcaagacctttcagatttcctggcaaggttgacatggggttaactgagctgtattaggattttgcagaagttaaaccggaagtttattctcgtgacctcttatgatctactttcttgtttatctatttgaaaacatccaaagcccgctgcatgtataagctcattattataaagttgattgtgctactgccttcatcaccattacagacagaatggcggtggagttttgcgaccagtggaagaatatttctttttgtgtttgct

SEQ ID NO: 12640 - DNA, 1027 bp, Eucalyptus grandis
atcgcagctatcaacgcagagtggccatctgcggggggatacgtcgtcattctttcgtcgaggaacaacagctccttcgtcgcggcttcgttccttcagatctcccttctccctccctctctctctctctctagatcgagctccatttgcgacatcgccaggcttgaaaatggggctgtctttcacgaaacttttcagtaggctgtttgctaagaaggagatgcgtattttgatggtgggtcttgatgctgctggtaagactacaatcctgtacaagctcaagctgggagaaattgtcaccaccattccaaccattggattcaatgttgagactgttgagtacaagaacatcagcttcaccgtttgggatgttgggggccaggacaagattcgccccctgtggaggcattacttccaaaatacccaaggcctgatctttgtggttgacagcaatgatcgagaccgtgtggttgaagctagggatgagctgcacagaatgttgaatgaggatgagttgagggatgctgtcttgctagtgtttgctaacaagcaagatcttccaaatgcaatgaatgcagctgaaatcaccgacaaacttggccttcactctctccgtcaacgtcattggtacatccagagcacgtgcgccacttccggagaaggcctttatgaaggactggactggctctccaacaacattgcaaacaaggcataattgtgttgatcctgaggcatctcggttcgagtgttcgattaggaaacttcgctttactttccattgttcttgaatttcgaatctttttcacagtttgtgtcagtttgatatgttactgatttacattgtcggtgatacctgtagttaaacaatattcggcggatcttattctttattgtcattgtaaaacgttattctttttcccaccgtggcatttgcatgcgtaaccgcaaattctcgtccatctattttggatctttcttaaagaaaaaaaaattgcccaggtttagcattaagccccgttaaagtgcg

SEQ ID NO: 12641 - DNA, 844 bp, Euonymus alatus
gaagaacggacagatatttttctccctgtttgagagaagacgagaagaggtagatctctcttgctcgcattcctcgcctaaggcactctcctctcgggcttgaagaaaatggggctttcattcaccaagctttttagtcggctctttgccaagaaagagatgcgcatcctcatggtgggtcttgatgcggctggtaagaccaccattctctacaaactcaagttgggagagatagtgaccaccattcccactattgggtttaatgtggagaccgtagaatacaagaacattagcttcacagtctgggatgttgggggccaggacaagatccgacctttgtggagacattacttccaaaatactcaagggcttatctttgtggttgatagcaatgaccgagaccgtgtggttgaggccagggatgagctacacaggatgttgaatgaggatgaattgagagaggcagtgttgctagtgtttgctaacaagcaagatctgccaaatgctatgaatgctgctgagataactgataagctcggtcttcactctctccgtcagcgccactggtatatccagagtacatgcgccacttctggtgaggggctgtacgaaggacttgactggctatcaaataatattgcaagcaaggcatagactgccaaaatctaagttttgtattgcagcaagttctggaacacagctggccgttccgtatttcattttaccttatcattactaaatagaatcattgtaacaaattcatagaatatttgagtttttctcatacaaacgttgctattgtttacccggagttgcagaataattcaaattttgcatctttgcc

SEQ ID NO: 12642 - DNA, 1692 bp, Euphorbia peplus
cgacttcttcaacatcagcagattgccgcaaaattccttcaactttagttccaaacttttctagaaactgtagagctttctccaggaatgatggacctccatctatgtcttcaagggcaagcaaaattggtcttccaacaaccatcgacttaactggacgtttatctctccattggttaaaagacccttcgatagcatcatttgtatccgtacggaaaatcccattatgtcccataacaagggcagcacttggtgcttgtgcaagggcatgttcaagagcagtcttccactcaaacagatcctctgatgtctccgccttaagggtgaatgctcgcccatcacgaccatcaggaaacaaaacggttaacaacttcttatcctctctaaccacaacactccctgaattatttaagtcaattccccccaaagttagatttacttcggcacctctttgcggaagggcactcggatcatttttaaagaacaccaaggacgtgcgtgtcaatataaaccaccgcttcttccatgatttccagcctaaccctttagaagatatgaaaagcggtccactcttgaaaaccgtactcgaagctccaactctcgggcgctcgaacgcagctgaaacctccatagctagctcaagcagagtagctccacatcgagtagatcggagccgctcactaataacttcaagatctgaccgtcgaatgtagtcctaatgatttcagattcggtagaacaaggaaaaagaaaaagcaacaccataaattaaccaataaattactataaaaccctcaattttctctcattttcttcatcttcctcatttcgtggtgaggacgacgctgtagatctcatcttttcctctcgattcttctctcaggtctgaaacatggggctgtctttcactaagttgttcagccggctctttgcgaagaaagagatgcgtatactgatggtgggtctcgatgcggctggtaagaccaccattctgtataagctcaagcttggagagatcgtcaccaccatccctactatcggttttaatgtggagaccgtggaatacaagaacattagcttcactgtgtgggatgtcggaggtcaggacaagattcgaccattgtggagacattacttccaaaacacacaaggacttatctttgtggtggatagcaatgacagagaccgtgtggttgaagctagggatgagctacacaggatgttgaacgaggatgagttgagggatgcagttctccttgtatttgccaacaaacaagatcttccaaacgcaatgaacgctgctgaaataactgataagcttggacttcactccctccgtcaacgccactggtacatccagagcacatgtgccacttccggtgaagggctgtatgagggactcgactggctctctaacaatattgcaaacaaggcgtagtagccataccccggagttttggattgcaaaaagtactcgaaatatatagttgatagtgctccttgtgttttttgattttttgttctttctttacaacctttagcggttgcgcctgtttaactgtgtttttttccctttctcttgcagacattgcaatttgtttttgtagcttcagaataattcataaatttgcattattatttttcattttgacattctagtagcatttatttgtttatgggatgcttttgtaa

SEQ ID NO: 12643 - DNA, 962 bp, Euphorbia peplus
aaattttgaaactccgttagtttttgaaactccgtctgttattttcactcttctacctctctctttctctctctagccctccccttctgagcatctctctgagataagaagatggggctctctttcacgaagcttttcagccggctctttgcgaagaaagagatgcgtattcttatggtgggtctcgatgcggctggtaagaccaccatcttgtacaagctcaagctgggagagattgtgaccaccattcctaccattgggttcaatgtggagactgttgaatacaagaatattagctttactgtctgggatgtcggaggtcaggacaagattcgacctctatggagacactacttccagaacacccaggggctgatttttgttgttgacagcaatgatcgtgatcgtgtagttgaggcccgtgatgagctgcatcgtatgctgaatgaggatgaattgagggatgcagtgctgcttgtgtttgccaacaaacaagatcttccaaatgcaatgaatgctgctgagatcacggataagcttggccttcactcacttcgtcaacgccattggtatatccagagtacatgtgcaacttctggtgaaggtctatatgaagggttggactggctgtccaacaatattgctaacaaggcatagtggaattgctgaagttactgtgaactttttggaatgcactttgcttgaaattggttatttggtatctgtggattgcttatccggtgtaattgttgaagagaatgtattttttcttagatatttgttactgtaatagaaaacgttaaaaaaatgttcttgtagatttttaaataattgcatgattcacagtttatacatgtgctttgatgagcattagcgtaagtaatggttggtgatccatttacattgcaggatttggacaagttgaaacatgtataactttcaagaggttgctaggtcgtttt

SEQ ID NO: 12644 - DNA, 899 bp, Fagopyrum esculentum
cgcattggccatcgttcgaacgcgtccattccaagctgcatcgcatttctctgacaacaggggaaaatggggctctcattcacaaagctgtttagtcgcctttttgctaagaaggagatgcgaattttgatggtcggtctcgatgcggctggtaagaccaccattttgtacaagctcaagctcggtgagatcgtcaccactatccctaccatcggatttaacgtggagaccgttgaatacaagaacatcagcttcactgtttgggatgtcgggggtcaagacaagatccgtccattgtggaggcactacttccaaaacactcagggtttgatttttgtggttgatagtaatgacagagaccgtgttgttgaggcaagagatgagcttcacaggatgcttaatgaggatgagctgcgagatgccgtattgcttgtgtttgctaacaagcaggatcttccaaacgccatgaatgcagctgagatcactgacaagcttggcctacactctcttcgacaacgtcactggtatatccagagcacctgtgcaacctctggggagggactgtacgaggggcttgattggctatccaacaacatcgctaacaaggcgtaaaacgaattcgaagtctttgtggactttgaagtcctggatgcaggggtcagaattatctagttatttcatgttcttatctttctagtaaaacacctttctttgtgggtttgtaactgctgctgaggaaggaactaagccctttcggctttgaacttctttgatggtagacttgtgttgaacatcgaggcatgtactaaaggatgctttgcttttgtttttacgtactggaattcctccaggtgtaattgagattgcggttttatggatgactgaattgtttaaaatag

SEQ ID NO: 12645 - DNA, 1021 bp, Fagopyrum esculentum
ttggtgggtctataaatatagctccttcgtcctagaagcaatatcgccgaaactactggctccaccacatttcagatctacatccgacattcgtagtcccagagcactccatctctttcaaaatggggctatccttcaccaagctgtttagtaggctgtttgccaagaaggagatgcgaattctcatggtgggtctcgatgctgctggtaagaccaccattttgtacaagcttaagttgggagagattgtcacaacgattccaaccattggattcaatgttgaaactgtggaatacaagaacatcagctttactgtctgggatgtcggaggtcaggacaagattcgtccattgtggagacactacttccagaacactcaagggctaatctttgtggtggatagcaacgatcgcgaccgtgttgttgaggcaagagacgaattgcatagaatgttgaatgaagatgagctaagggatgcagtgcttcttgtttttgccaacaaacaagatcttccaaatgcaatgaatgcagctgagattactgacaagcttggtcttcactcccttcgtcagcgccattggtacattcagagcacatgtgccacctctggagaaggtctatatgaagggctggactggctctcaaacaacattgcaaacaaggcatgaaagcagtagtgtttccattgcgagttagctgaattttggtcacagggatttaagaaaggatttacggccttgctgtctgtgtcaagattgaacggtgcttttataattcattcccctttgttccagccgttatgaatgagtgaagaacgtgtcttttcagatgatgagacttcattgtggctgtgtttaaacttgtcatattctatcttattataatatgtagagattcagaagttctgtacttgctgttaatataaattgacaggttattatctttatttgttttgggatgcttgattatgaaaaattcccagtgaacttgaagagctaatctataagtgacgttgtgtgct

SEQ ID NO: 12646 - DNA, 840 bp, Flaveria ramosissima
tctctcctctccaacccacatttccagatcgctcgatccctctccaaaaaactcatctctcagggatcctcatcagagacaggatggggctcacattcaccaaactcttcagccggctttttgccaagaaagaaatgcgtatattgatggtgggtcttgatgcagctggtaagacaaccattttgtacaagctcaagctcggggagattgtgactaccatccctaccattggatttaatgtggagactgttgagtacaaaaacatcagcttcactgtgtgggatgtggggggtcaggacaagatccgtccactatggaggcactacttccaaaacacacagggtcttatctttgtggttgatagcaatgatagggatagagttgttgaagcaagagatgagctgcacaggatgttgaacgaggatgagctaagggatgcagttcttctggtatttgccaacaaacaagatctacctaatgcaatgaatgccgctgaaattactgataagcttggccttcactctcttcgacagcgccattggtacatccagagcacctgtgccacctctggggaaggactttacgagggtttggactggctttccaacaacattgctaacaaggcatgaggtatggttgattgaactgtatttgagggtggaaaaaccggaggcaggttttgctttttgtgcggtcgggtcactttcttgtactagttctcgttcttctgtgactgaggtgcggttggttatgaactatagttaaaaaggtgtttgctatttacatatagtccttgtatgtataaaattctttggttggtaactttgttcgttcgttatt

SEQ ID NO: 12647 - DNA, 948 bp, Linum usitatissimum
gacaggcgttggtttcaagcttcgcatttatttcgacttcttttccttcagctctctcgccgatcccatctgcgacactctccagaaagggatcaaaccagcaaggaagagaaaatgggattgacgttcacgaaactgttcagcaggctgtttgccaagaaggagatgagaattctgatggttggtctcgatgcggctggtaagaccaccatcttgtacaagctgaaacttggtgagatcgtcaccaccattcctaccattggattcaatgtggagactgtggaatacaagaacatcagcttcacagtgtgggatgtcgggggtcaagacaagatccgaccattgtggaggcactatttccaaaacactcagggtctcatctttgttgtggacagtaatgacagagatcgtgttgttgaggccagagatgaattgcataggatgttgaacgaggatgaactccgagatgcagtgttgctcgttttcgctaacaaacaggatctgccaaatgcaatgaatgccgctgagatcactgacaagctcggcctccactcactccgccaacgacactggtacatccagagcacctgtgctacatcaggtgagggtctttacgaaggcctggattggctctccaacaacatcgccaacaaggcttaaatgttgggaagcagcaagacttgaggttggcaaagttctggatgcaggggggtgaatgttatctagttctttgttatttttccatttttatttttcttcttgtgagatgtttggattgtgtgttagctctctctctctctctctctctctgcatatttgttacccccttctcccttatggcttatactgacttgacttgtgggagtatttgccttctgtatgttaggaaactctgttttttttgtaatggattgattatgtaatagaatattgtatcttggtctttac

SEQ ID NO: 12648 - DNA, 765 bp, Linum usitatissimum
gaaaggaagaggaaatggggttgacattcacgaaactgttcagccggctgtttgccaagaaggagatgagaattctgatggttggtctcgatgcggctggtaagaccaccatcttgtacaagctcaagcttggtgagattgtcaccaccattcctactattggattcaatgttgagaccgttgagtacaagaatatcagcttcacagtgtgggatgtcgggggtcaagacaagatccgtccattgtggaggcactacttccagaacactcagggtctcatctttgttgtggacagtaatgatagagatcgtgtcgttgaggccagagatgagttgcataggatgttgaatgaggatgaactccgagatgcagtgttgcttgttttcgccaacaagcaggatctgcccaatgcgatgaacgctgctgagatcactgacaagcttggcctccattccctccgccagcgacactggtacatccagagcacatgtgctacatcgggcgaggggctttatgaaggtctggattggctctccaacaacatcgctaacaaggcataaatgtggaaaggcagtaatttgtggatacagcgctgagtgttatctagtttcttcttatttcttcgtcatctttgtttcttagtccgagacatttggattgtatttgtttttgcatatttcttaacctctttgaacatgtaacaaccttattcctagattgaagcatgtaagtccataaatcaagttcaaataaaaaatctatacc

SEQ ID NO: 12649 - DNA, 821 bp, Fraxinus spp
gcagctccgtatctctctctctaacttcgcgtcagaactaatttttagggcttaaaggaagaagagaaatggggttgacattcacgaagttgttcagtcggctttttgccaagaaggagatgcgcattctgatggttggtctcgatgcagctggtaagaccaccatcctgtacaagctcaagcttggagagatcgttactacgattccaaccattggtttcaatgtggaaactgtcgagtacaagaacatcagcttcactgtttgggatgttggtggtcaggacaagatccgtccattatggaggcactacttccaaaacacacaaggtctcatatttgtggtggatagcaatgacagagaccgtgtggtggaggcaagagatgaattgcataggatgttgaatgaggacgagctaagagatgcagtattacttgtatttgccaacaaacaagatcttcctaatgcaatgaatgctgctgaaataactgataagcttggcctgcactcgttgaggcagcgtcactggtacatccagagcacctgtgctacctccggagaggggctatacgagggtctagattggctctctaacaacattgctaacaaggcataaaactttatccggttatgctgagttgatgatgggtgcaggcaggtttttatctagtcttatatctctagtttgtgtggttatgaatttttcacttttcaagtctttttgtttaggacctctgtaatggttactggtttgttttatgtgattgtttagatttgaatataatctatctacaatatacgtatattacaagtgtgtattgag

SEQ ID NO: 12650 - DNA, 859 bp, Zingiber officinale
gcacgaggcgaagacctctctcgtcctcgtctcctccaatctacctaccttgcttcccaggtgaggaacaatggggcttcctttcgcgaagctgtttagccgcctgtttgcgaagaaggagatgagaatcctgatggtcgggcttgatgctgccggtaagacgaccatcctgtacaagctcaagcttggagagattgtaaccaccattccaacaatcggattcaatgtggagactgttgagtacaagaacattagtttcactgtatgggatgttggtggtcaggacaagattagacctctatggaggcattatttccagaacacacaaggacttatttttgttgttgatagcaatgatcgagatcgtgttgttgaggcaagagatgaactacacaggatgcttaatgaggatgaactaagggacgctgtcttgctcgtgtttgctaacaaacaagaccttccaaatgcaatgaatgctgctgaaatcactgataagcttggccttcattctctacgtcagcgacactggtacatacaaagcacctgcgctacatctggtgaggggttgtatgaagggcttgattggctctccaacaacattgccagcaagtaatcaaagcctgcttcgaaggttcatatcttaacatcagcagtgttcgcgtttgatgcttttgtgacaacggaagcaaggagactattaattttccacttgggacatcgttttcccctttcccatctgcatttaaaaacctaatacaaatctgtaaaacaaatatatgcttgattacccatttttcaatgttttgacgatggacgcagcaaacgatttcgtttctctcgttgtcatatttattttttc

SEQ ID NO: 12651 - DNA, 1318 bp, Panax ginseng
tttttttcttgcctaaaagtaggctggtgaacagtcttcattataaaatttaccaagtattgtgagttatgactgacttctacatcttaatacatctccttaatcaagtacaagtgtacaacttaagacaccaatgaatgatttctatacaagtacagcttattggagaataattaagcagtggtatcaacgcagagtacatggggatgttaaaatacgaacaggaaggagagaagagattatcgtctctgagaacctctgactctccatcttgaaatcaataatcagtgaagctttgaagagtgttgagtgaattataaccagtgaggcataagaaagatggggctatctttcacgaagctgttcagcaggctctttgcgaagaaagagatgcgcattctgatggtaggtcttgatgctgctggtaagactaccatcttgtataagctcaagcttggagaaattgtcacaacaatccctacaattggatttaatgttgagactgtggaatacaaaaacattagcttcactgtttgggatgttggaggccaggacaagatccgtccattgtggaggcactactttcagaacacacaaggtcttatctttgtggtggatagcaatgacagagatagagttgttgaggcgagggatgagttgcataggatgttgaatgaggatgaacttagggatgctgttttgcttgtctttgccaacaaacaagatttgcccaatgcaatgaatgctgcggagataacagacaagcttggtcttcattctctccgtcaacgtcactggtacattcagagcacatgtgccacctcaggtgagggactttatgaagggctggattggctttctaacaacatcgctaacaaggcatgagctgaatgagttcagttacgaatgggattttccatgaatccattggatagatactattaggccttgtatgagatgtatgaagacgatgcttgtccctgtattttcaagagatgtagcaatatgggtgcttttgaagttactgtctgcttgataccgttgctagtttggttattacccgactgcaaaagatgcttattatgctatagtaattttatgtccaatgaactacacgatagtacgtgttaagacttgtggaagtgttaaatgatctacacttcagtaaatgttaagaagtatggaactggttaataccttttcaatggactagatttattgcccaaccttgtattgagtaatggaacttgtacgccacagtcgagccattcagtctgtctttatttttcgtacttgggatatgattattaattttatg

SEQ ID NO: 12652 - DNA, 1540 bp, Panax ginseng
tgagtgaagatggggctatctttcacgaaactgttcagcaggctctttgcgaagaaagagatgcgcattctgatggtaggtcttgatgctgctggtaagactaccatcttgtataagctcaagcttggagaaattgtcacaacaatccctacaattggatttaatgttgagactgtggaatacaaaaacattagcttcactgtttgggatgttggaggccaggacaagatccgtccattgtggaggcactactttcagaacacacaaggtcttatctttgtggtggatagcaatgacagagatagagttgttgaggcgagagatgagttgcataggatgttgaatgaggatgaacttagggatgctgttttgcttgtctttgccaacaaacaagatttgcccaatgcaatgaatgctgcagagataacagacaagcttggtcttcattctctccgtcaacgtcactggtacattcagagcacatgtgccacctcaggtgagggactttatgaagggctggattggctttctaacaacatcgctaacaaggcatgagctgaatgagttcagttactaatgggattttccatgaatccattggatagatactattaggccttgtatgagatgtatgaagacgatgcttgtccctgtattttcaagagatgtagcaatatgggtgcttttgaagttactgtctgcttgataccgttgctggtttggttattacccgactgcaaaagatgcttattatgctatagtaattttatgtccaatgaactacacgatagtacgtgttaagacttatggaagtcgtgttaagacttatggaagtgttaaatgatctacacttcagtaaatgttaagaagtatggaactggttaataccttttcaatggactagatttatttcccaaccttgtattgagtaatggaacatgtacgccacagtcgagccattcagtctgtttatttttcgtacttgggatataattattaattttaagacaaaaaaaaaaaaaaaaagaaaaaaaaaagaaaaacgaactagatatagaggaaggtagtacgaacgtaaagtaaccgtccgttgtagtagtagaagtaattaactaacttagttcgttacgtaagtttaaggtttaaggtaaagtagtacttacggttaaggttaaaggttaaaggtaaggtagggtacgttacgtttagttttaagtttaaaggttaaagggttaaagggtaaacgaccgtacggtacggttaacggttaaaggtaaaggtaggtacgttcgttagtactacttacttaccttacgttagttacgttccgttccgtttttacggttttaggtagttagtttttactttaccacgtacggttccgggtttagggttagggttttttggggggtttttttggggtttagttacggtttacccggttaaaccggtttttaaggggggtttttgggggttagttaggttacgtttactttacggtaacccgtaaccggttggggttttacggcctaggtgtggg

SEQ ID NO: 12653 - DNA, 1101 bp, Panax ginseng
gtcagttctgtattctgtattcctaattcttagtcgtaattggtgtacgtgttgttgtggtcacaactgtgactgtcttgttgtgtcaagttaaattaatgttggttagtagtcgcctcagatcgtctctgaaaacctctgactctccatcttgaaatcaataatcagtgaagctttgaagagtgttgagtgaattataaccagtgaggcataagaaagatggggctatctttcacgaagctgttcagcaggctctttgcgaagaaagagatgcgcattctaatggtaggtcttgatgctgctggtaagactaccatcttgtataagctcaagcttggagaaattgtcacaacaatccctacaattggatttaatgttgagactgtggaatacaaaaacattagcttcactgtttgggatgttggaggccaggacaagatccgtccattgtggaggcactactttcagaacacacaaggtcttatctttgtggtggatagcaatgacagagatagagttgttgaggcgagagatgagttgcataggatgttgaatgaggatgaacttagggatgctgttttgcttgtctttgccaacaaacaagatttgcccaatgcaatgaatgctgcagagataacagacaagcttggtcttcattctctccgtcaacgtcactggtacattcagagcacatgtgccacctcaggtgagggactttatgaagggctggattggctttctaacaacattgctaacaaggcatgagctgaatgagttcagttgccaatgggattttccatgaatccattggatagatactattaggccttgtatgagatgtatgaagacgatgcttgtccctgtattttcaagagatgtagcaatctgggtgcttttgaagttattgtctgcttgataccgttgctggtttggttattactcgactgcaaaagatgctcttattatgctatagtaattttatgtccaatgaactacacgatagtatgtgttaagacttgtggaagtgttaaatgatctacacttcagtaaatgttaagaagtatggaactggttaataccttttcaatggactagatttat

SEQ ID NO: 12654 - DNA, 1052 bp, Panax ginseng
agattatcgtctctgaaaacctctgactctccatcttgaaatcaataatcagtgaagctttgaagagtgttgagtgaattataaccagtgaggcataagaaagatggggctatctttcacgaagctgttcagcaggctctttgcgaagaaagagatgcgcattctaatggtaggtcttgatgctgctggtaagactaccatcttgtataagctcaagcttggagaaattgtcacaacaatccctacaattggatttaatgttgagactgtggaatacaaaaacattagcttcactgtttgggatgttggaggccaggacaagatccgtccattgtggaggcactactttcagaacacacaaggtcttatctttgtggtggatagcaatgacagagatagagttgttgaggcgagagatgagttgcataggatgttgaatgaggatgaacttagggatgctgttttgcttgtctttgccaacaaacaagatttgcccaatgcaatgaatgctgcggagataacagacaagcttggtcttcattctctccgtcaacgtcactggtacattcagagcacatgtgccacctcaggtgagggactttatgaagggctggattggctttctaacaacatcgctaacaaggcatgagctgaatgagttcagttactaatgggattttccatgaatccattggatagatactattaggccttgtatgagatgtatgaagacgatgcttgtccctgtattttcaagagatgtagcaatatgggtgcttttgaagttactgtctgcttgataccgttgctggtttggttattacccgactgcaaaagatgcttattatgctatagtaattttatgtccaatgaactacacgatagtacgtgttaagacttatggaagtgttaaatgatctacacttcagtaaatgttaagaagtatggaactggttaataccttttcaatggactagatttattgcccaaccttgtattgagtaatggaacatgtacgccacagtcgagccattcagtctgtttatttttcg

SEQ ID NO: 12655 - DNA, 1278 bp, Vitis vinifera
actaaacccatccatgcaaacgaagacatataaaggtcaccccattaccctgagtaagaacccatccccatcctctacgtggaactcagaagctccgctgccaaacagtcaagtaaaaaaagtaataaacggcgtcgtctcaacgctaccacccattcacttggatctcactataaattcccaattcctctgccacattgctacacagcagggagagaaagaagagagagagatctgttctctccatttcccaaaaatactctttgttccgagacacaaaaatggggctgtctttcaccaagctttttagtcggctttttgctaagaaagagatgcgaatactgatggtgggtcttgatgctgctggtaagactaccattctgtacaagctcaagctgggagagatagtcaccaccattcctactattggatttaatgtggagactgtggaatataagaacattagctttactgtttgggatgtgggtggccaggacaagatccgacctttgtggagacattatttccaaaacactcagggtctgatctttgtggttgatagcaatgaccgtgatcgtgttgttgaagctagggatgagctgcacaggatgttgaatgaggacgagttgagggatgccgtgctgctagtatttgctaacaaacaagatcttccaaatgcgatgaatgctgctgagatcactgacaagcttggccttcactctctccgccaacgccattggtacatccagagcacatgtgccacatccggtgaagggctgtatgagggattggactggctctccaacaatattgcaaacaaggcataaactgtacgatcctgactttcgggcgcggtcaatgctaggagacactttacctgttgttcccttctgtcacagttttttaccatgtcaacaatgttaactttttaccatgattgtggattctgtagcagacactgccatttgcttcctcggttccagaattattcatgaatttttattcttcctcatcatggattttatctcaatggctttgtttgtctaaatatttcatgaaacaatcctatgaatttagagcatctaatttgttcttttggaggaaattatatggaatgcccatacgataacactttgattaacaagtgcagtgggaaggtgttttaaatatcggaatgcttgttgtgagtttaactctacgggaaggaaaagatgatatcaccaattgccaaacaaggcaaagtagaaacaagaataataaaaatgacattggaagtag

SEQ ID NO: 12656 - DNA, 783 bp, Mesembryanthemum crystallinum
cgaactagtctagagcgatcgcggccgcgtcgaccctctctctgctgctcgcaggggtttgtgacacaacaaacagaaaaaatggggttgacatttacaaagctgtttagccggctctttgccaagaaggaaatgcgaattctgatggttggtctcgatgcagctggtaaaaccaccatcctctacaagctcaagcttggcgagattgtcactactatccccaccattggattcaatgtggaaactgttgagtacaaaaacatcagcttcacagtctgggatgttggaggccaggacaagatccgtccattgtggaggcattacttccaaaacacacaaggtctgatttttgttgttgacagtaatgacagagatcgtgttgttgaggcaagagatgaattgcacaggatgttgaacgaggatgagctgcgtgatgctgtgttgctagtttttgctaacaagcaagatcttccgaatgccatgaacgctgctgaaataaccgataagcttggcttgcattctcttcgacagcgtcactggtatatccaaagcacttgtgcaacctctggagagggactttatgaaggattagattggctttccaacaacattgcaaacaaggcttaaggaatctggttttgcgatggactggtagtcctggatgcagggtgaacatttatctagtcgtttccgttttccacccactttacttagaaacgaattccggctgtaattttgcctgattggagggataagctttttgcttaaaacttctggatcgat

SEQ ID NO: 12657 - DNA, 890 bp, Actinidia deliciosa
aatccgataatcccgtgaagctttcgagagtgccaggggacaagcccataagcgaagtgaaacagaatggggttgaccttcacaaagctgttcagcaggctttttgccaagaaggagatgcgaattcttatggtaggtcttgatgctgccggtaagactaccatcctttacaaactcaagcttggagaaattgtcactacaatccccaccatcggatttaacgtggagacagtggagtacaagaacattagcttcacagtttgggatgtcgggggtcaggacaagatccgtccattgtggaggcattacttccagaatacacaggggcttatatttgtggtggatagcaatgatagggatcgagttgttgaggcgagagatgaattgcataggatgttgaatgaggatgagttgagagatgctgccttgcttgtctttgctaacaaacaagatcttcccaacgcaatgaatgcagcggaaataactgacaagctcggtcttcattcactccgacaacgccactggtacattcagagcacttgtgcaacctctggagaagggctttatgaagggctagattggctttctaacaacattgctagcaaggcatgaggctgtcgagggttttggttgctgctggaattttgttgctgatgcacggtcggatactatctaggtttttataagatcttggcagttcctagattcattctctcttgaatatgtttgagtgacgatgttatagtaagattggtttgataaattttctgaaactattgtttgcttgtatcactgctgcttttggctaatacttttagctgttatggtcttaccttctactttggaaatgagcagcaggtgttctgtctttgggttgtaaaaaaaaaaaa

SEQ ID NO: 12658 - DNA, 784 bp, Actinidia deliciosa
ccattgtttgttgagaaccggaggatagagagggcgagatctgtttcgctcttatctcccaattcgcttccttcctcggacacaaagatggggctgtctttcaccaagcttttcagtcggctgtttgcaaagaaagagatgcgcatattgatggtgggtcttgatgcagctggtaagactaccattctgtacaagctcaagctgggagagatagtcaccactattcctactattggatttaatgtggaaactgtggagtacaagaacattagctttactgtttgggatgtcggtggccaggacaagatccggcctttgtggagacattacttccaaaatactcagggtctgattttcgtggttgatagcaatgaccgagatcgtgtggttgaagcaagggatgaactgcacagaatgttaaatgaggatgagttgagggatgctgtgctgttggtgtttgcaaacaagcaagatcttccaaatgcaatgaatgctgccgagataactgataagcttggccttcactccctccgccaacgccactggtacatccagagcacttgtgccacttctggggaagggctgtatgaaggacttgactggctctcaaacaacattgcaaataaggcatagacattggatactcagtttggtttgctactgctgctgagtagagaatttaacatttgtttggtgttcctaccttcgctcgtgttattctgttactatttgaggtttctattgatgattgttatagacttatagtttgtttcctgtagtttca

SEQ ID NO: 12659 - DNA, 940 bp, Actinidia deliciosa
gtgatgaatgcttccccctctccctcctgtcgcgctctccatctagatcccctctgcaaaatccgctcgcagggatctaccccaagaaagataaaatggggttgacattcaccaagcttttcagccggctttttgccaagaaagagatgcgtatccttatggttggtcttgacgctgctggtaagaccaccattttgtacaagctcaagcttggggagattgtgaccacaattcctaccattggctttaatgtcgaaactgttgagtataaaaacatcagcttcaccgtgtgggatgttggtggccaggacaagattcggccattgtggaggcactatttccagaacacacagggtctcatttttgtggtggatagcaatgatagagaccgtgttgttgaggcaagggatgaattgcatcgcatgttgaatgaggatgagttgcgagatgcagtgttgctcgtatttgctaacaaacaagatcttcctaatgcgatgaacgctgctgaaataactgataagcttggcctccactctctccgacagcgtcactggtacatccagagcacttgtgcaacctctggggagggactctatgaggggttggattggctctccaacaacattgctaacaaggcatgaggtgacccggaacacgtccttgtggcgtgatcctggatgcagggtggtttttatctagtctcttattcctctttcttccctccctctgtcagacaatgtgtggttatgaattcattcttcgagagtcgtttcaaaacattttggatttcgctatggatttgtctggtagaaatgttttgcggaatatagtatatgtacttgcaaatgtggtttaggtttgtaactgagactaatttgctctttgacattccttttgcgatagtttaatacagatcatggttttgtttaaaaaaaaaaaa

SEQ ID NO: 12660 - DNA, 2643 bp, Lactuca sativa
ttttaatatccttttttaaaatatgtgttagaaatgttgattaatggtaaccagcgatatccgggggttatttaacctcatattcattatctgttttctcgccctcttattttacagactccctttctcgctttctctctcctcttctcaatctctcacttcaaaacgtccgattgatccttctcgaacaatcttttctcagggatcctgagtagcaagaggatagaatggggcttactttcaccaaactttttagccggctctttgccaagaaagagatgcgaatattgatggtgggtctcgatgcagctggtaagacaaccattttgtacaagctcaagcttggggagattgtcaccacaattcctaccataggttttaatgtggagactgttgaatacaaaaacattagcttcacagtgtgggatgttgggggtcaggacaagattcgtccattatggaggcattatttccagaacacacaaggtcttatctttgtggttgatagcaatgacagggacagagttgttgaggcaagagatgaattgcacaggatgttgaatgaggatgagttaagagatgcagttcttcttgtatttgctaacaaacaagatctcccaaatgcaatgaatgctgctgaaatcactgataagcttggcctccactccctccgacagcgccactggtacatccagagcacttgtgcaacatctggagagggactttatgagggattggattggctgtccaacaacatagcaaacaaggcatgagggagggggtgattgatgttttgtgtttatgaatgagggtggatcttggaagcaagttttggttttgaggttggccagtttctgtggttttggaagttcttttaaaaaaaatgttattttttgcttttgatatagaagtgatggatgaacatgtggaattgaatatattgtttgtttgaatttgcaagtatgtggtaggtttgattccttttttttttttttttgttatctcaacttgtaagaggttttaattgtttttgtggttgctaggtgttgagtaactaactacctatgtagtttgctggtatgatctctcattctccctcttgtttaaatacatctagtaaggcattatatgccaaattcaaaaaaaaaaaagttgggacttttgagatcatatttaaaagaaaaaaatataaactacaaacagcagcagttaaaacaagaaaaagtaaagtaacaacacaataggacccaatcaccaaatttgaagcaccagagtattttggctgaaatagcaacaaacttttccgtctattttctttttttataaaaatacagttgccttcacattaaaccattggcaccgaaagtttgagttagtatcacaatattcagaagttagaaccattgggaacttcagaccatgctaattcagaagtcagaacttagcgattgaaaagtatccccgttacatcatagttacgccattgttgaatatcttttgtgaaaagtacatgttagaaatagatgttccgactcctcattagagtttttgcatgatgcacccaatctatacaaaacaattaactttatttgggacccggttgttgtattcaaactcggggtaacatgtcgggaatattttagatgcaattacttgacttatgatttgaccgacaagaacaccatgtgtctatggtatccatgtgattgggggaaggtggcaatggtccaacatgaatttttgttttttcagagccccagttgtggctgttgcagaatgcacagaccctctgctgctcgacattacgtttttttggccctctacaactaatacaacagctcattccagaattgacttcttatccctaaagtccattttcttatggaagtaaccggaaacattaatctcaagttctggaagtcattcccaatagatgcaattgttgtccaagtaccggaaggaccttgttttgccatattgagccaagatgatactcttttagtctccacctccacacctacacacctagcaagtagtgcaagtgttgtacctcttaagcacccgacaccaagtccaccagatcgtttagggcaaaggattttgtttcaagctacccgacatttttgcattgtttgacttgcagatggtatccatctctcccaaccacttaaattttttttttaaattaaatacaaagcaattaaaatcatacaaaattagttaacaaaaatatttaaaaaatacaaactaattaaaacatacaaaactaaattggtacaagttttaatgcatgacgtataaacaaggttgtaaaaaacgttcggcaaatgattaattggggaccataaattgttaattttgaattttaaaaaattaaatatgactaatatcatcacaaattttgtaaataccacaaatatcataataaaataggttaatattatttatacaacatcaaacattcctcaaatagtttctatcggtatataattttttcaaaatgttaaaatttcattgtttgctgctgcattgctcattctagttgctcggataaaacctagggaataattggagattaatcgggatctaatcgagatttttacaacattgtgtataaataaccaaaacatgagagagagagag

SEQ ID NO: 12661 - DNA, 956 bp, Glycyrrhiza uralensis
ggttcttcctctctgactctgattaaaggaagaaaaaatcgcgattcgctcttctcttcgaaaacctcgacatcgagaagagcaagtggtgtgagtgaagatggggttaacgttcacgaagctgttcagcaggctattcgcgaagaaggaaatgaggattctgatggttggtctcgatgctgctggtaagaccaccatactctacaagctcaagctcggagaaatcgtcaccaccatccctaccattggatttaatgttgaaaccgtggagtacaagaacatcagcttcactgtgtgggatgttgggggtcaggacaagatccgtccactgtggaggcactacttccagaacactcagggtcttatttttgtggttgatagcaatgatagagatcgagtggtagaagcaagggatgagttgcacaggatgttgaatgaggatgaacttagagatgctgttttgcttgtttttgccaacaaacaagatcttcccaatgcaatgaacgctgcagaaataactgacaagcttggacttcattcactccgccaacgccactggtatatccagagcacttgtgcaacttctggagagggtctctacgagggtctggactggctttctaacaacattgccaccaaggcatgagacatttgaaatattttggtgtggtctgagcctttaatgccgagtccgttggttcttgaagaaggatgcttttcctttcaagtgaatgttgtaatagcagaatggttgttagaaatattttcctctttttgtaacttgggtttgtgtgattgcttaaatcagctaatacttttagctataattggaactcttgaatctcctttagagtgccttgttcatttttattttgtcagtttgattatcggttgaatatttccattggttatgttcttggagtattactggtaatgatattgtctagcgattggtg

SEQ ID NO: 12662 - DNA, 991 bp, Cucumis melo
ttgttctgaaggtcctccatttttcttgctctctccatccccttcaatacacctccgtgcagctctcagagaaaagaaggaacttccgagttacgaaaagagatggggctcaccttcgcaaagctcttcagtcggctgtttgctaaaaaagagatgagaattctgatggttggtcttgatgccgctggtaagacgaccattctctataaactcaagcttggagagatcgtcacaactattcctaccatcgggtttaacgtggagacggtggaatataagaacatcagcttcactgtctgggatgtcggtggtcaggacaaaattcgtccattgtggaggcactatttccagaacactcaaggtcttatatttgtggtggacagtaacgatagagaccgtgttgttgaggcaagagatgagttgcatagaatgttgaatgaggatgagcttcgagatgcagtactactggtgtttgctaataaacaagatcttcccaatgcaatgaatgccgctgagattacagataagcttggtcttcattctcttcggcagcgccactggtatatccagagcacttgtgcaacctccggggaagggctttatgagggattagattggctttcaaacaacattgctaacaaggcataaaagctgtaaaaagagttgtcttgtcgactggcaatcccggatgcagggatggacgttatctactttttcttgtttttttggggattagtatttcatgccttttctttagggattgatctttcgtagtggtgtcggtctatggtcattattgtaatggttgttcgtgtactcacctgagcttgtgtgtttaatgagatgatgtaattcaaaatttaaccccctcacttcatctgaaattcgttttatctttgcattctttttgaaaaatatctaccttgtcttggcttgaagtggccacaactcgaagttccttttcaccaaaagtatgagattcatttttatt

SEQ ID NO: 12663 - DNA, 1200 bp, Cucumis melo
atcgcgaatgcgcatttgatcgtgaaggacagcttctcccttgtgttcaagagagagagatctatcattcttatttggggccgatctctctattctcctctcttctattcctttacttgaaaaatggggctgtcttttaccaagcttttcagccggctctttgccaagaaggagatgcgtattctcatggtgggtcttgacgcagctggtaagacgacaattctttacaagctcaagttgggagaaattgtcaccacaattcctaccatcggttttaatgttgagactgtggaatacaagaacatcagcttcactgtctgggatgtggggggccaagacaagatccgaccattgtggaggcattatttccaaaacacccaaggacttatttttgtggtggatagcaatgacagagaccgtgttgtcgaagctagggatgagctgcacagaatgttgaatgaggacgagctgagggatgctgtgcttttggtatttgccaacaagcaagatcttcctaatgccatgaatgctgctgagatcaccgacaagcttggtcttcactccctccgacaacgtcactggtacatccagagcacatgtgccacatccggtgaagggctgtatgaaggacttgactggctctcaaacaatattgccaacaaggcgtagatgggggtttcttttaagcagggattgcttctggaaaatcaaattgatgtgatttatcccttgtttacgggcatttttgttggattacctgatctatacgacgttcctaatggatgattcctaggttggtgttggatctatgaataatgaaagaaattttgaagtattttgtcatgttatcgactcaatagcattgttttcttttctttcttttctttttttttttttttctctttttataaattttaatgtaatgaattaaatgatgctcttaaaataggtgtatttgtacgagaaccatgtttgttatttggaatggattgctgaaaagaaattactttggacctttttattgcatcactctcttcatttgcttcccattatcctccatggccttcctagtttctgctatgccagagttctcttttcccatgtttttatcttgctgttatgttttattttatccactcgtgaaaaatgcagtctataaaagcaaacaaacaaaacggttttattataaagaagaaagaa

SEQ ID NO: 12664 - DNA, 931 bp, Momordica charantia
taacgtcagagttcgtcctatttacggtccgggggcatttgatcgtgaaggacagttctctcttgtgtgcaagagagagagatctatttggggccgatcgctcaaatccgctctcttcaattcctttacgtgaaatatggggctgtctttcaccaagcttttcagccggctctttgccaagaaggagatgcgtattctcatggtgggtcttgatgcagctggtaagacgacaattctttacaagctcaagctgggagagattgtcaccactattcccaccattggttttaatgttgagactgtggaatacaagaacatcagcttcactgtctgggatgttggtggccaagacaagatccgaccattgtggaggcactatttccaaaacacccaaggacttatttttgtggtggatagcaatgacagagaccgtgttgttgaagccagggatgagctgcacagaatgttgaatgaggacgagctgagggatgcagtgcttttggtatttgccaacaagcaagatcttcccaatgccatgaatgctgctgaaatcaccgacaagcttggtcttcactccctccgacaacgtcactggtacattcagagcacatgtgccacatccggtgaagggctgtatgaaggacttgactggctctcaaacaatattgccaacaaggcgtagatggctttctttgagcttgcattgcttctggaaattcaaatttatgtcatttgtccccttgtttttgggcatatttttgttgcattacctgatctatacgatgttcctacttgatgatattctaagatctgcctttgatttcctgaataattaaagaaaattttgaagtctttctcattctcatgttcatgttatcgactcaatagcattgtttttatgtaatgaattcatgatgttcttaaatagatg

SEQ ID NO: 12665 - DNA, 1114 bp, Mimulus guttatus
actcctccccaaaaaaagagctgttaataatctctcgcgttattctcaagcggctccatatttctctctgcgcacactctctatccaccttttcgccagatctaccgttctcggggatctaaagtactaaatagaaatggggctgacattcacaaagctttttagccggctattcgccaagaaggaaatgcgcattctgatggttggtctcgatgcggctggtaagaccaccatcctctacaagctcaagcttggagaaatcgtcaccactattcctaccatcggtttcaatgtggagactgtcgaatacaagaacattagcttcaccgtttgggatgtcgggggtcaggacaagatccgtccattgtggaggcactacttccaaaacacccagggtctcatattcgtggtggatagcaacgatagggatcgtgttgttgaggcaagggatgaattgcacaggatgttgaatgaggacgagctgagagatgccgttttgctcgtgtttgctaacaaacaagatcttcccaatgcaatgaacgctgctgaaattactgacaagcttggtctgcactcactcaggcagcgtcactggtacatccagagcacctgtgctacctccggtgaggggctatacgaggggctggattggctatcgaacaatattgctaacaaggcgtaagttctcgtggagttgtttcgaagattctgggtgcagattggtttttatctagttttatatactagtctgtgtgactatgttttctttttttaattttttgatgaagtgtttttttttttttttttttctttttttgtttaggacctttcaaatggctttgtaaaacacactggtttgtttcatatatttgcaaaacactttgctagtttttgtttatgtaatgcctatatatccattcatgtaacactagcttcattttaatcttgttcccgttttatcccttctttcgaaattctctaccatttggctgcgggattgcatttggctgcattttatcggcttattgcactcgttacctgtgttatgctagaaaactacctcatggcattttattggcaaaataaaattaaatcatccgagggttactgccca

SEQ ID NO: 12666 - DNA, 1105 bp, Mimulus guttatus
accagaaatagtcatttttactctctctctcgcgttgttctcaggcagctccatatttttctctccgaatttcataagaaatactcgctttctctctctaggatctcatcaaatctgccgttctcaggtgtcaaaaacagtaacgagaaatggggttgacattcacgaagcttttcagtcggctttttgccaagaaggagatgcgcattctgatggttggtctcgatgcggctggtaagaccaccatcttgtacaagctcaagcttggagagattgtcactactatccctaccatcggattcaatgtggagactgttgagtacaagaacattagcttcactgtttgggatgtcgggggtcaagacaagatccgtccactatggaggcactacttccagaacacccagggtctcatattcgtggtggatagcaacgatagagaccgtgttgttgaggcgagggatgaattgcacagaatgttgaatgaggatgagctgagagatgcagtactgcttgtattcgcaaacaaacaggatcttcctaacgcaatgaatgctgctgaaataaccgacaaacttggcctgcactcactcaggcagcgccactggtatattcagagcacctgcgccacatctggagagggtctgtacgaggggctcgattggctctcgaacaacattgctaacaaggcttaaaagctttttcggagagctaatctgggatgccaccgactttttcacccagccttttggcaatgtaatatttctttacaatatttttttgctatgtttaggaggaccctttgaaaatgtctgtttaacaaaggattatttgtttcataaatttcgaaaatatttgcttagttgaatgtaatacacaatcgttggtttttggattttgtccttttcgtttgccgatgcacatttattttaacatgtaagttcttgattttaggtggtagtcgaaatcaaatattcgtgctgaacctgcttatatttttcaaaaaacttgaacgtctccattcaaatggaatcttttactcgacgtctgatttactaatctgtttgttcggggaataaattcaacaacttgatcataagataaa

SEQ ID NO: 12667 - DNA, 1133 bp, Tropaeolum majus
cggccgggacccaaacaacaccgcgtagaagctaagcatagtataaacggcgtcacaagcatcaaacgcataatcacaaaaatattcataaactaatttgacagcgtgataacgtttaaatctggtgtgtttggatctataaataagagatcctgagtaagtataaccatcgaaagacagctccattccattcccctctttttctctctccacgcaaaaattacgctcttctctcagatttgaaaaatggggctgtcttttaccaagcttttcagcaggctctttgcgaagaaagagatgcgtatacttatggtaggtctcgatgctgctggtaagaccaccattctttacaagctaaagttgggagagattgtcactaccattccaaccattggattcaatgtggagactgtggaatacaagaacatcagcttcactgtgtgggatgttggaggtcaggacaagatccgtcctttgtggagacactacttccaaaacacacaaggacttatctttgtggttgatagcaatgacagagaccgtgttgttgaagccagggatgaattgcacagaatgttgaatgaggacgagttgagggacgctgtgctgctagtattcgcaaacaaacaagatcttcctaatgcaatgaatgctgctgagataaccgataaacttggccttcactctttgcgtcaacgacactggtatattcaaagtacatgtgctacttctggtgaaggattgtacgagggacttgattggctctcaaacaacattgcaaacaaggcgtaagtgacatgattgtgagatttggctcattacagatgttgaattaggtagtaaaaaagtttttaattgtgttctggatttgtggttaaacattattactacatattgggttactgttggttttgtaaaagctggctacttttgctttttgtaaacgttggttatttggctttgtaacctgtctttttagtttcagaatattttatcaaattttgttttgccaatatggtaccacccaaattcgtaattgatttggcatgtgctaccataccaccactcatttcttttattagactctttaatgtcctcaaaataacgaataaatccatctggattttgtaacc

SEQ ID NO: 12668 - DNA, 969 bp, Tropaeolum majus
tacaacatttcccctcttcactcaccgtgaaaacaaccgttatctttggaccagagataaaattgtggtatcacaaaattcaattcttcccctgcttttttcatttcatttctcctttctctagatctgctcctcttccctcctatatcatcatcatcatcatcatcatattaaaagatggggctgtcatttggcaagctattcagtcggctatttgccaagaaagagatgcgcatactcatggttggtcttgatgcagctggtaagaccaccattttgtacaagctcaagctgggagagatcgtgacaacaattcccactattggttttaatgtggagactgtagagtataagaacataagcttcactgtctgggatgtcgggggccaagacaagatacgtcctctatggagacattacttccaaaatactcaaggacttatttttgtggttgatagtaatgatcgcgatcgtgttgttgaggctagggatgaactgcacaggatgctgaatgaggatgagttgagggatgccgtgctgcttgtttttgccaacaaacaggatcttccaaatgctatgaatgccgcagagatcactgataagcttggtctccattccctccgtcaacgccactggtatattcagagcacatgtgctacatctggtgaagggctttatgaaggactagactggctctccaacaacattgctaacaagtcgtaaaagatttatcaagttttcgagtggcatttcggaaggcatatctgctccaaagtagatagtttgcggtatgaatgtctgtttgatttcgtactgtggaaaaaactatggagaagttgtatcttttgtttatgttagatatggttatactagaaattggcaatttcatgtttttgtagattttccaataattgttgattcatatttgagatacaattgttttgatttacatttgttgtttataaagcg

SEQ ID NO: 12669 - DNA, 841 bp, Tropaeolum majus
tcttcctccagatctgccttctctttcgtcgcgttcctcatcatatagaaagatggggctgtcatttgctaaactgttcagtcggctttttgccaagaaggagatgcgtattctcatggttggtctcgatgcagctggtaagaccaccattttgtacaagctcaagcttggcgagatcgtgactaccattcccaccattggttttaatgtggagaccgtcgagtacaaaaacataagcttcactgtttgggatgttggaggtcaggacaagatccgtcctctgtggagacattacttccagaacacacaagggcttatatttgtgattgatagtaatgatcgcgatcgtgtggttgaggctagagatgaactgcatcggatgctgaatgaggatgaattgcgggatgcagtgctgcttgtttttgcaaacaaacaagatctcccaaatgctatgaatgctgcagagatcactgataagcttggtctccactccctccgacaacgtcactggtatatccagagcacttgcgccacatctggtgaaggtctttacgaggggctggactggctctcaaacaacattgctagcaaggcctaaaatgaagtgaagttttagcaaaaattttggaagccatattatatatatgttccgaagtagaaagattgcagtgtatggatgtttttgtggttgtgaaacttgttcaagaaatttgtatgtgctgtttatgttagatattgtcataccagaaaattggctgtttttgcctattgtagatttctaataattgttgattcttgaaatgcaaatctttaattatgatattatcttacaaaaaaaaaa

SEQ ID NO: 12670 - DNA, 943 bp, Nicotiana benthamiana
acctcttaaataaatatttcgcgttagtatcaggcttctctctctcgctctctctcgtgttctctcactagatccctctttccaaagctttcttcagggatccttaagaagaaagagaaatggggctgacattcaccaagcttttcagccggctatttgccaagaaggaaatgcgcattctcatggttggtcttgacgctgctggtaagaccaccatattgtacaagctcaagttgggcgagatcgtcaccactattcctactattggtttcaatgtggagactgttgagtacaagaacatcagcttcacagtttgggatgtcgggggtcaggacaagatccggccattgtggaggcactatttccagaacactcagggtctcatttttgtggttgatagcaatgacagagaccgtgttgtggaggcaagagatgaattgcaccggatgttgaacgaggatgagcttcgggatgctgtgctgcttgtttttgctaacaaacaagatcttcctaatgcaatgaatgctgctgaaataactgataagcttggactccactccctcaggcagcgtcactggtacatccagagcacttgtgcaacttctggagagggactttacgaggggcttgattggctttctaacaatattgctaacaaggcctaaaccaacgtagagttgttgcgggttgatcctggatgcagtcgggtttttatctagttctttttcctttttcccccattctcagaatctgtgtggttatgaatatcccttgaaagtgatttgcttcttggtaggacctcttgaaatgtttttgtaatacagtggttggatatatgtaattgctgtttgtttggtttcaagtataatgctataatttgtaacggagaatagatgtttcattggtaaatgataatggaatacttccctgtttgttcctttcc

SEQ ID NO: 12671 - DNA, 908 bp, Nicotiana benthamiana
gcaatcaaattcctttccgatcactacatattttccagcgttaatctcaggtttctcctctcattagatccctcctccaaaagctcttttcagggatcatcaacaaggaagtgaaatggggctgacattcaccaagctcttcagtcggctttttgccaagaaggaaatgcgcattctaatggttggtcttgatgcagctggtaagactaccatattgtacaagttgaagctgggagagatcgtcactaccattcccaccattggtttcaatgtggagactgttgagtacaagaacatcagcttcactgtttgggatgtcgggggtcaggacaagatccgtccattgtggaggcactacttccagaacactcagggtctcatctttgtggttgatagtaatgatagagaccgtgtcgtagaagcaagagatgaattgcataggatgttgaatgaggatgaacttcgggatgctgtgctgctagtttttgctaacaaacaagatcttcctaatgcaatgaatgctgctgaaataactgataagcttggactgcactcccttaggcagcgtcactggtacatccagagcacttgtgcaacatctggagaggggctttatgagggacttgattggctttctaacaacatcgctaacaaggcctaaagtggtgcagacttgttattgcgggttgatcctggatgcaggcgggtttttatctagctatttttttcttctcaagtcggtggttgtgaacatctccttaaaagcattttgtgtcttcatagggctttttgtaatggctgtgtaaggcgatggttgaatatatgtaattgctgtctgttttaggtatattttcataaatttgtataacaaagactagctttcatattgcatagcatttgttaatgat

SEQ ID NO: 12672 - DNA, 935 bp, Nicotiana benthamiana
gcaatcaaattcctttccgctctctacatattttccagcgttaatctcaggtttctcctctcattagatccctcctccaaacggtcttttcagggatcatcaacaaggaagtgaaatggggctgacattcaccaagctcttcagtcggctttttgccaagaaggaaatgcgcattctaatggttggtcttgatgcagctggtaagactaccatattgtacaagttgaagctgggagagatcgtcactaccattcccaccattggtttcaatgtggagactgttgagtacaagaacatcagcttcactgtttgggatgtcgggggtcaggacaagatccgtccattgtggaggcactacttccagaacactcagggtctcatctttgtggttgatagtaatgatagagaccgtgtcgtagaagcaagagatgaattgcataggatgttgaatgaggatgaacttcgggatgctgtgctgctagtttttgctaacaaacaagatcttcctaatgcaatgaatgctgctgaaataactgataagcttggactgcactcccttaggcagcgtcactggtacatccagagcacttgtgcaacatctggagaggggctttatgagggacttgattggctttctaacaacatcgctaacaaggcctaaatgatgcagatttgttattgcgggttgatcctggatgcaggcgggtttttatctagttattttttttcttctcaagtcagtgtggttatgaacatctccttaaaatcattttgcatcttcatagggctttttgtaatggctgtaagacgatggtcgaatatatgtaattgctgtctgttttaggtatattttcataaatttgtataacaaagactagctttcttataacatagcatttgttaatgattaaagccttgtggttccctttcttttc

SEQ ID NO: 12673 - DNA, 1007 bp, Quercus alba
atcgtgtggaaggacagctcttttccttttcacgcagagacggagagagagacacacacagtcgtgtaccagatctctctcttctcatcgccaagccaagatatagaatacgtgaaaaatggggctgtctttcaccaagcttttcagtcgtctgtttgctaagaaagagatgcgtatacttatggtgggtctcgatgctgcgggtaagactaccattctctacaagctcaagctgggagagatagtcaccaccattcctaccatcggatttaatgtggagactgtggaatataagaacatcagcttcactgtctgggatgttggtggtcaagacaagatccgacctttgtggagacattacttccaaaacacccagggacttatttttgtggttgatagcaatgacagggaccgtgtagttgaagctagggatgagctgcacagaatgttaaatgaggatgagttgagggatgcagtgctgctagtgtttgcgaacaagcaagatcttccaaatgccatgaatgctgctgagataactgataagcttggacttcactccctccgtcaacgccactggtatatccagagcacttgtgccacttctggtgaagggctttatgaaggacttgactggctctcaaacaatattgcaaacaaggcttagattgcttgttcttgagtttcgggttccagcaactgctggagtataaactgggaattttctatggtattctggattttgcttgcctgtttagtgttacctgttataccatgttaatggtttccctggaagacactgtcctttgttacctgtagtttcagaataattttaaagatttttctttctcgtgatattacctcactagaattgttttgtgaatgtaatgacattttatcttttgttggaaattgtagagctatatcatctctgctatggttcccctggctaatggcgaccaaatgttttatttttttaaatgtttgtttcgatgttatactagtagaaa

SEQ ID NO: 12674 - DNA, 850 bp, Olea europaea
ctcacgaatttcatcctcccgaaaaactaatcaatttatcgcgttaatctcaggcagttcactcactgcctctctcgccagatccatctctcagggatcgaaaactagaaagagaaatggggctgacattcacgaagctcttcagccggcttttcgccaagaaggaaatgcgcattctgatggttggccttgatgctgctggtaagaccaccattctgtacaagcttaagctcggagagattgtaactaccattcctaccatcggttttaacgtggagactgttgagtacaagaacatcagcttcactgtttgggatgtcggtggtcaggacaagatccgtccattgtggaggcactacttccaaaacactcaagggctcatatttgtggtggatagcaatgacagggatcgtgttgtggaggcaagggatgaattgcacaggatgttgaatgaggatgagctgagagatgctgtattgcttgtatttgcgaacaaacaagatcttcccaatgcaatgaatgctgctgaaataacagacaagcttggcctgcactcgctgaggcagcgtcactggtacatccagagcacctgtgctacctccggagaggggctttacgagggtctcgactggctctcaaacaacattgctaacaaggcataatgctttatggaattgtttatgcgttgatgctggatgcgagttggtttttatctagtcttatacctacatatagtttgtgtgtgatgaattttaatacgagtcttttggtttttgtttaggacttcttatgctattatcacagagctaagttttatgtgattgcaaacatatgtgtacttatataatgc

SEQ ID NO: 12675 - DNA, 910 bp, Olea europaea
cccaagggcagccttcaacaagatctgcccttctcttcttcccaaatcagtctactttttgtatttttgatcacgaaagcaaaatggggttgtcttttaccaagcttttcagccgtctgttcgccaagaaagagatgcggattcttatggtgggtcttgatgctgctggtaagaccaccatattatacaagctcaagctgggagaaatagttacaaccattcctacaattggattcaatgtggagacagtggaatacaagaatatcagcttcaccgtctgggatgttgggggtcaagacaagatccgaccattgtggaggcattactttcagaacactcaagggctgatctttgttgttgatagtaatgatcgtgatcgtgttgttgaggctagggacgaactgcataggatgttgaatgaggacgaactgagggatgcagtgcttcttgtttttgcaaacaaacaagatcttccaaatgctatgaatgctgctgagataactgacaagcttggacttcactctctccgtcaacgccattggtatatccagagcacatgtgccacctctggggaagggctttatgagggtctggactggctctccaacaacatcgccaacaaggcataaaggagacaatatttgatgactatgatcgctcgactcttgtcaaagaggagattgtcttttttccgggtcttttttatctagtcaacttgagtattccgtactttgatcagtttattgttttcttagatattttgtcatttctgtcgtgtaggtttatgttcaaatcatgtgattttagcattcctgaatacgctatgtacctttttggattgattaattttgaaaatggcgctcttctgctcagcgaatgaattggaaaatagtacattttaaatttcaca

SEQ ID NO: 12676 - DNA, 873 bp, Olea europaea
agctccatatttctctctctaataacttcgcgtcagaactaatatttcaggggttaaaaggaagaaagagaaatggggttgacattcacgaaattgttcagtcggctttttgccaagaaagagatgcgcattctgatggttggtctcgatgcagctggtaagaccaccatcctgtacaagctcaagcttggagagatcgttactacaattccgaccatcggtttcaatgtggaaactgttgagtacaagaacatcagcttcactgtttgggatgtcgggggtcaggacaagatccgtccattatggaggcactacttccaaaacacacagggtctcatctttgtggtggatagcaatgacagagaccgtgtggtggaggcaagagatgaattgcataggatgttgaatgaggacgagctaagagatgcagtattacttgtatttgccaacaaacaagatcttcctaatgcaatgaatgctgctgaaataactgataagctcggcctgcactcgttgaggcagcgtcactggtacatccagagcacctgtgctacctccggagaggggctatatgaggggctagattggctctctaacaacattgctaacaaggcatagaactttatgcagttacttgtgctgagttgatgatggatggatgcaggcaggtttttatctagtcttatgtatctagtctgtgtggttatggatttttcacttttcaagtccttgttttaggacctctgtaatggttactggtttgttttatatgattgtttagatatgaatataatgctgttaaacctgcatatgaatcgatcgaagatctaccctttgattagtaaaatgcgactctgcgttgactaccactga

SEQ ID NO: 12677 - DNA, 974 bp, Olea europaea
ataataaatttctcattcagccaaagacgtttaatttccttttctcctgcgatagtcacttataatctcaggcaagcaccgtctctaacgtttcaccagatctgtctctcagggatctaaagcaagaaggcaaatggggctgacattcacaaagctgtttagccggctttttgccaagaaggagatgcgtattctgatggttggtctggatgctgctggtaagaccaccattctgtacaagctcaagcttggagagattgtcactaccattcctaccatcggttttaatgttgagactgtcgagtacaagaatattagcttcacggtttgggatgttggtggtcaggacaagattcgtccattgtggaggcactacttccaaaacacacagggtctcatatttgtggtggatagcaatgacagggaccgtgttgtggaggcaagagatgagttgcataggatgttgaatgaggatgagctaagagatgcagtattacttgtatttgccaacaaacaagatcttcctaatgcaatgaacgcggctgaaataactgacaagcttgggctacactcactcaggcagcgtcactggtacatccagagtacttgtgctacatccggagaagggctttacgaggggctcgattggctctccaataacattgcaaacaaggcataaagctgtatggaatttttgcgagtcaatgcttggagccacagtcgggttcttatctggccttatacctttagtccttgtgtttatggatattcatttttcatgttctctggttttgtttaggccctctttaagtgatatataacacaatgatggtttgttttatgtaattgcaaatatttgtctgggtttatgacatattgctatgttgacctgcaatttatgggtatagttaagtatgcatttgtttttgtataataagcattccttttattaaaagttacgtggtatggcatta

SEQ ID NO: 12678 - DNA, 880 bp, Olea europaea
ttaatctcaggcactctctctaacttttcacaagattcatctctctgggatcaaaagcaaaaaggaaaaatggggctgacattcacaaagctgtttagcaggctttttgctaagaaggagatgcgtattctgatggttggtctggatgctgctggtaagaccaccattctgtacaagctcaagcttggagagattgtcactaccattcctacaattggttttaatgtcgagactgttgagtacaagaacatcagtttcactgtttgggatgttggtggtcaggacaagattcgtccattgtggaggcactatttccaaaacacgcagggtctcatatttgttgtggatagcaatgacagggaccgtgttgtggaggcaagagatgagttgcataggatgttgaatgaggatgagctaagagatgcagtattacttgtatttgccaacaaacaagatcttcctaatgctatgaacgctgctgaaataactgacaagctcgggctccactcactcaggcaacgtcactggtacatacagagtacctgtgctacatctggggaaggcctttacgaggggctcgattggctctccaataatatcgctaacaaggcataaagttatatgaagtttttgtgagtcgatgcttattagtcccggcagccgggttcttatctagccttatacatttagtctgtgtgtttatggatattcattttcaagtcgtcttgttttgttcacgacagctttaaccaatgtatatcacaatgatggtttgttttatgcatttgcaaatatttttctagtattaacatattatattgacctgcattttaaaactaaatggatattacctgttataggcctaggccggtctgagggc

SEQ ID NO: 12679 - DNA, 901 bp, Olea europaea
cgttaatctcaggtagctccatatttctctctctaacttcgcgtccggactaatttttcaggagtcaaaagcaagaaagagaaatggggttgacattcacgaagttgttcagccggctttttgccaagaaggagatgcggattctgatggttggtcttgatgcagctggtaagaccaccatcctgtacaaactcaagcttggagagatagtcactacaattcccaccattggtttcaatgtggaaactgttgagtacaagaacatcagctttactgtttgggatgttgggggtcaggacaagatccgtccattgtggaggcactacttccaaaacacacagggtctcatatttgtggtggatagcaatgacagagaccgtgtggtggaggcaagagatgaattacataggatgttgaatgaggacgagctaagagatgcagtattacttgtatttgccaacaaacaagatcttcctaatgcaatgaatgctgcagaaataactgataagctaggcttgcactcgttgaggcaacgtcactggtacatccagagcacttgtgctacctctggagaggggctttacgaggggcttgattggctctctaacaacattgctaacaaggcataaaacttcatgcagttagttatgctgagttgatgatgggtggaggcggttcttatctagtcttatatctctattctgtgtggttatggatttttctcttttcaagtctttcttcgtctaggacctttataatggttggctgtatgatgcactggtttgttttgtatgatcacaaatgtttgtgtagatttgaatataatgctgttaaaccaagcatatgaattgatcgaagatcacccattttgatggttaatgttttcgtgctcatttatttt

SEQ ID NO: 12680 - DNA, 816 bp, Petroselinum crispum
ctctctctctcgtcgaatcttccattcttcagaagtgtagaagatggggttgtcatttaccaaactctttagtcggctttttgccaagaaagagatgcgcatactgatggtgggtctcgacgcagctggtaaaacaaccattttgtacaagctcaagctgggagagattgtaacaacaattcctactattggatttaacgttgagactgtggaatataagaacatcagtttcactgtctgggatgttggaggccaggacaagatccgtcctttgtggagacattactttcaaaatactcagggcctcatttttgtggttgatagcaatgatcgagatcgtgtagttgaagccagagatgagctgcacagaatgcttaatgaggatgaattgagggatgcagtcctacttgtatttgccaacaagcaagatcttccgaatgcaatgaatgctgctgagatcacggataaacttggactacattctcttcgtcagcgccattggtacattcagagcacatgcgcgacttcaggtgaaggtttatatgagggtctggactggctctcgaacaacattgcaaacaaggcttagtttgttgaagtttggatcttctctgcatcaagatagagttcttcatattccagtgttttaatatctgtcatgacagtttgatagagtattttgtatttcctttgttccgagtggtggtctcttttgttgtaggattgttacatttcgtatgaatttatatcatttcttatatatggctgttacaaattgtaatgagactatgatctatgagcaaggcattctttttt

SEQ ID NO: 12681 - DNA, 680 bp, Capsicum annuum
tcactagatccctctttccctaacctttttcagggatcgttaagaagaaagagaaatggggttgacattcaccaagcttttcagccggctatttgccaagaaggaaatgcgtattctcatggttggactcgatgcagctggtaagacgaccatattatacaagctcaagctgggagagatcgtcaccaccattccaactattggtttcaatgtggaaactgttgagtacaagaacatcagcttcaccgtttgggatgtcgggggtcaggacaagatccgtccattgtggaggcactatttccagaacactcagggtctcatttttgtggttgatagcaatgacagagaccgtgtagtggaggccagagatgaattgcacaggatgttgaatgaggatgaacttcgggatgctgtgctgcttgtttttgctaacaaacaagatcttcctaacgcaatgaatgctgctgaaattaccgataagcttggactccactccctcaggcagcgtcactggtacatccagagcacttgtgcaacttctggagagggactctatgaggggcttgattggctttcaaacaacatcgccaataaggcctaagctggaatagagttgttgcggtttgatactggatgcaggggagtttttatctagttactttttcgtttaattctcttct

SEQ ID NO: 12682 - DNA, 1406 bp, Capsicum annuum
ataaaattaaataaaaaaatcataagtaattaattaaattaataaaatccctgtaagttaccagaaattaaagaattaaatcgtggcagtctgtgattgcacttgccaacgtacatgaaacagattggcggtggaaaacgcacccaccattagaattgagtggcattctcgttattttctcaaatctgtaaccccattttcgttacattaaaaaggatctccttcactttatttattcccatcaaattttctctacgctctttgtatatttcagcgttaatctcaggtttctctcatccagatcccttctccaaaatctcttttcagggatcatcaacaagtaagcggaatggggctcacattcaccaagctcttcagtcgactttttgccaagaaggaaatgcgcattctaatggttggtcttgatgcagctggtaagaccacaatattgtacaagttgaagctgggagagatcgtgactactattcctaccattggtttcaatgtggagactgttgaatacaagaacatcagcttcaccgtttgggatgttgggggtcaagacaagatccgtccattgtggaggcactacttccagaatactcagggtctcatttttgtggttgatagcaatgatagagaccgtgttgtagaagcaagagatgaattgcataggatgttgaacgaggatgaacttcgggatgctgtgcttctagtctttgctaacaaacaagatcttcccaatgcaatgaatgctgccgaaataactgataagcttgggctgcactccctcaggcagcgtcactggtacatccagagcacttgtgcaacttctggagaggggctttacgagggtcttgattggctttctaacaacattgctaacaaggcttaaagtgatgcagatttgttatagtgggttgatactggatgcaggcgggtttttatctagttattttttcttctcaagtcagtgtggttatgaatatctcttcatgaaagcattttgcgcgttcataggattttttgtaatggttgttatacaatggtcgaatatatataatttgttgtttgattagatatattgttttaaatttgtaaataaggactagctttcatatttgttaatggttaaagtcttgcagtccccatttctttttattcgagttcctgtttgcgttttctgtgtgttcagcgaaagttattagagatcctgataagaggccggtgatttgattctgccatgtgaagtgagagtaaggagcctctgaagcctaaacaaagtggtccataaatgtccttgtacatcattgattttgcagttttcatcttttccaatttttgttccagagatggattcatccctccaattttttttggaccgacaaaacttttgtactctcgtg

SEQ ID NO: 12683 - DNA, 932 bp, Petunia hybrida
gcggggattctcaggtttctctctctaaaaaactctctctctactttctctctctagatcccttcttcaaaaaagctcttttcagggatcatcaataaggaagcaaaatggggttgacattcacgaagcttttcagtcggcttttcgccaagaaggaaatgcgtattctaatggttggtctcgatgcagctggtaagaccaccatattgtacaagttgaagctgggagagatcgtgaccaccattcctaccattggtttcaacgtggagactgttgagtacaagaacatcagcttcactgtttgggatgtggggggtcaggacaagatccgtccattgtggaggcactacttccagaacactcagggtctcatttttgtggttgatagcaatgatagagaccgtgtcgtagaagcaagagatgaattgcataggatgttgaatgaggatgaacttcgtgatgctgtgctgctagtgtttgctaacaaacaagatcttcctaatgcgatgaatgctgctgaaataactgataagctaggactgcactccctcaggcagcgtcactggtacatccagagcacttgtgcaacttctggggagggtctttatgaggggcttgattggctttctaacaacatcgctaacaaggcgtaatgtgatgcagatgtcattgcggtttgatcctggatgcaggcgggtttttatctagtctttgttcccttgtcgatttagtgtggttatgaacatctccctggaaagcattttcataggacctttttttttctaatggctgtgtaatacaatggtcgaatatatgtaattgctgtttgctttaggtatattgtcattaattttttgtaaacaaagactagctttcatacggttgatgcatttgttaatggtaaagtccttggaattcgcttttattttttc

SEQ ID NO: 12684 - DNA, 930 bp, Phalaenopsis aphrodite
gcttagatctcccggccgctcggattccgcaaacactgtctcgatacctctcgcgtgaagatggggttgtctttcaccaaactctttagtcggctcttcgccaagaaggagatgcgtattcttatggttggtcttgacgctgctggtaaaaccaccattttatataagttgaagcttggagagattgtgacaaccatcccaaccattgggtttaacgtggagactgtcgaatacaagaatatcagcttcactgtttgggatgttggtggtcaggataagatccgtccattgtggagacactacttccagaacacgcaaggcctcatcttcgtggtggatagcaacgacagagaccgtgttgttgaggcaagagatgagcttcacaggatgcttaatgaggatgaactgagagatgcagtgctgctcgtctttgctaacaaacaagaccttcccaatgcaatgaatgctgcagagattaccgataagctaggtctccattctcttcggcaacgccattggtatatccagagcacctgtgccacatcaggagaaggtttgtacgagggattggattggctctcaaacaatatcgctaacaaggcgtagaaatttctggtggcctttgctgcatctgaagctaaaagataagtacatgagcgtactatctagacgaacattatattataaactttttgattaacctgctgccattcataattctagaatttgttatttatagttttaggaggagatatatataatcttgacattgctttcacgttgtgcttcactcctttattcttggtttttgaatttagtcatgattgctactttgttctgtgtcttttgcaatggatcataatctactgtgttctctgtctgtgtgttctgaatggtgtattgaattttactcttttaagataagatgag

SEQ ID NO: 12685 - DNA, 968 bp, Lippia dulcis
tctctctggagctcaaaaagtactttttctctgaacatctagccaaatctacgtcctcagggacccaaaggaacaaagagaaatggggttgactttcacgaagcttttcagccggctttttgccaagaaggagatgcgcattcttatggttggtcttgatgctgctggtaagaccaccattctgtacaagctgaagctcggagagattgtcactactattcctaccatcggatttaatgtggagactgtcgagtacaagaacatcagcttcactgtttgggatgtcgggggtcaggacaagatccgcccattgtggaggcactacttccagaacacccagggtctcatattcgtggtggatagcaatgacagggaccgagttgttgaggcaagagatgaattgcataggatgttgaatgaggatgagctgagagatgcagtattacttgtatttgctaacaaacaagatcttcccaatgcaatgaatgctgctgaaataactgacaaacttggcctacactcactccggcagcgccactggtacatccagagcacctgtgctacctccggtgaggggctttacgaagggcttgattggctctccaacaacattgctaacaaggcttaaacgctttatggtgtttgcgtgagagctgatgctgcgtgcagcccggtttttatctagtgtggaattattttgttatgttatttttttttacggtgtttttcggttgtataacagacggtgtttttggttttctccatacttgcagaaacatttattttagttttgaatgtaagacacgaaaaattaggttttggatattatatttcgctcgactttgggtactttctcgccatgcctacattgaaaagttaggtattctggattctagatttagcatgatcggtttcctcatttctgtaattttttggcatgagtccgaaatttgtgagtgtgggttctg

SEQ ID NO: 12686 - DNA, 966 bp, Cajanus cajan
agtaaggagcattgagcagcgtacggggattgagggagcttcttcttggatctaccctctcaagttcgcaaataaccccaattttgtttctctgcttcttctccttttgaaataagagatggggttgtctttcactaaactttttagccggctctttgccaagaaagagatgcgtattctcatggtaggtcttgatgctgctggtaagacaaccatcttgtacaagctcaagttgggggaaattgtgacaaccattccgacaattggatttaatgtggagactgtggaatataaaaatattagctttactgtatgggatgtgggtggccaagataagattcgtcctttatggagacactacttccaaaacactcaggggcttatctttgttgtggatagcaatgatcgagaccgtgttgttgaggctagagatgagctccaccggatgttgaatgaggatgaattgagagatgcagttctccttgtatttgccaacaaacaagatcttccaaatgctatgaatgcagcagaaatcacagacaagcttggtcttcattctcttcgccaacgccactggtatatccagagtacatgtgccacctctggagaaggactctatgaaggactggactggctctccaacaatatagctaacaaggcttaggggcatttttgtggaacgctgctatcttgcttggctttacgattatattatgaggttgactggttgttgcttctcttatagcattaaaatctacgcttttttcttaaactctataatggtgttgtctttatttaggtgtttgatactatatcatagcaaattctatttgttcctgtagaatttctgaataattaatgaattacgaaactatacatgcctggatcatgtttttcatagaattgtgcatcggtcaataatctctaaacctttcatttaaagcttcgatgaatcagttgttccgg

SEQ ID NO: 12687 - DNA, 954 bp, Pinus taeda
ggggagccattctttttccctcaaatctcagatctgacccttcaacttgggatatctaacaagcggtcaatatgggattgtgacttggactgggactgggaatggggctgacattcacagtatctccccctccccttttcggcagcagtgctaggtgttcgagaggcgtctcagatctctttgcggggagccattcttgtcccctcgaatctcagatctgacccttcaactcgggatctctaacaggcggtcaagatgggactcacttttaccaagctttttagtcggctcttcgcaaagaaggaaatgcgcattctgatggttggtctcgatgccgctggtaagacgaccatcttgtataagctgaagctgggagaaatcgttacgaccatccctaccatcggattcaatgtggaaaccgtcgagtacaagaacatcagcttcactgtgtgggatgttgggggtcaggacaagatccgtccactatggagacactacttccaaaatactcagggtctcatctttgtggttgatagcaatgatagagaccgtgttgtagaagcaagggatgaactacatagaatgctgaatgaggatgaactacgtgatgctgtattgcttgtgttcgcaaataagcaagatcttccaaatgctatgaatgctgcagagataactgacaaacttgggctgcattcccttaggcagcgccactggtatatccaaagcacttgtgccacttctggcgagggcttgtatgagggcttggattggctctctaacaacattgcaaacaaggcttgaagaaatatggtgaactgggttcctggaattttgtagggcaatgtcgtcatatttcatttttgtcagagacagtttggagaaattagtgcagtcaaactgacttttgactactattcaatttcttctatgggtttgattggaagtgttatgaag

SEQ ID NO: 12688 - DNA, 739 bp, Pinus taeda
tctccccccccctttcgattgcagtgctaggtgttcgagaggcgtctcagatctctttgcggggagccattcttgtcccctcgaatctcagatctgacccttcaactcgggatctctaacaggcggtcaagatgggactcacttttaccaagctttttagtcggctcttcgcaaagaaggaaatgcgcattctgatggttggtctcgatgccgctggtaagacgaccatcttgtataagctgaagctgggagaaatcgttacgaccatccctaccatcggattcaatgtggaaaccgtcgagtacaagaacatcagcttcactgtgtgggatgttgggggtcaggacaagatccgtccactatggagacactacttccaaaatactcagggtctcatctttgtggttgatagcaatgatagagaccgtgttgtagaagcaagggatgaactacatagaatgctgaatgaggatgaactacgtgatgctgtattgcttgtgttcgcaaataagcaagatcttccaaatgctatgaatgctgcagagataactgacaaacttgggctgcattcccttaggcagcgccactggtatatccaaagcacttgtgccacttctggcgagggcttgtatgagggcttggattggctctctaacaacattgcaaacaaggcttgaagaaatatggtgaactgggttcctggaatttttgtagggcaatgttgccttatttgagtttt

SEQ ID NO: 12689 - DNA, 1460 bp, Populus trichocarpa
attaaataagagcctgataacaatgacgcgaggcaaagagtttccaagtgccgggatcagaaaggcccgatcccgaaatgggaaacacacctcctatttccaaacagggtgcaatctccaactaacgcaggccaccgcgtcgtgtaaacggcgtaacaagggtaaccatccattaataggcaaccacatggtcacagatattgacggcgtattggacagttaaaaaaaagaaaaaaaaggaaaaggatcccgttacgtcctataaatacacaccatcaatctcttggaacgtgaaaatatttttccctgaaagacagctcctcctcctactcttcaatttaattcctctttattctctcttctgaggtagatccctctctccctctctcggctccttgacagacgtgagaaaatggggctgtctttcaccaagttgtttagccgactgtttgctaagaaggaaatgcgtattctgatggtgggtcttgatgctgctggtaagaccaccattctctacaagctcaagctcggtgagattgtcaccaccattcctaccattggatttaatgtggagactgtggagtacaaaaacattagctttactgtttgggatgtcgggggtcaggacaagatccgccccttgtggagacattacttccagaacacacaaggacttatctttgtggttgatagcaatgacagagatcgtgtggttgaagctagggatgagctacacaggatgttgaatgaggatgagttgagggatgctgtgctgctagtgtttgcaaacaaacaggatcttccgaatgcaatgaatgccgctgagattactgataagcttggccttcactcccttcgtcagcgccactggtacatccagagcacatgcgccacctctggtgaggggctgtatgagggattggactggctctcaaacaacattgcaaacaaggcttagatgacacaactccaagttcgcaatcgcagtgagtgctggaatactcggtctatatttgttttgtattctggattttcctccaactcattttgtcgtctttacctgtctaaacatgtttgtggttgcttttgcaaactctgccatttgtttcctgtagcttcagaatattccgtaaattttcgttttcttggtgatttttattcaaatagcaaagcccagttctcctaaagacgagccatccttgacatggagtcaggggtaccatagtgcctgcctaccaggctttagtgcgtaaacaatctcctccgaattgaaccaaaaaactatacatgtatattatatgtggtggtgtccctcggacatctcaccgtaggagttggtctaacgctcgctgccacacaacctgaacgggggagaagcttttgtaggggcacacattgctactaccagacttttgtctcctagtagtcccagaattggaaggtcgttgaccactttaccc

SEQ ID NO: 12690 - DNA, 1025 bp, Solanum tuberosum
aaagagattttgagagtggtgggtgctgttggacaatagagatctactgatttcatcctctctcatcggccgatcttcgattaacggagatggggctgtctttcactaaactctttagtcgcctctttgcaaagaaagaaatgcgaattcttatggttggtctcgatgctgctggtaaaaccacaattctgtacaagctcaagttgggagaaattgttaccactatcccaaccattggcttcaatgtggagactgttgaatacaaaaacatcagctttactgtgtgggatgttggtggtcaggacaagattagacctctatggaggcactatttccagaacacacagggcctcatctttgtggttgatagcaatgacagagaccgtgtagttgaggcaagggatgagcttcacaggatgttaaatgaggatgaattaagagaagctgtgttgcttgtttttgcgaacaagcaagatcttccaaatgcaatgaatgcggctgaaatcaccgacaagcttggccttcattctctcagacaacgacactggtatatccagagtacatgtgctacttctggagaagggctatatgagggactggattggctttcaaacaacatcgccagcaaggcctaatgcaatgatgtggtactatgcttcttgcgttgctatatccggagaaataaacatcattgtctcgtcgtaatttctttcgtttggagattttaaatatctgttcagctcacaattctggggaaggccttacccttcttcactctctatggtttatcgtcaaagagcatggcatagtttccacattgctggatgcacattggcaatgtaatgatattttagtataatatctggttttgaaacttggcgcagccgtgtgcaccattttgttgtccggtgtgtctgatgttggaatgggtgtacaaaatgcaatacagataaatagtaagtatcggaattttgcgagtagtaagaatatcacctgagttgctgttaaaaaaaaaaaaaaaaaaa

SEQ ID NO: 12691 - DNA, 1040 bp, Prunus persica
cacattcacgcgttgatttaaagcttctctcccctccgctctctccctccctcgatctctatctttaactaagatccctctgcgaaagctcatcgaagggatccacagccggaatggggcttacattcacgaagcttttcagccggctttttgccaagaaagagatgcgaattctgatggttggtcttgatgctgctggtaagaccaccatcctctacaagctcaagctcggtgagatcgtcacaacaattcccaccattgggtttaatgtggagaccgtggagtacaagaacatcagcttcacagtctgggatgtcgggggtcaggacaagatccgacctttgtggaggcattacttccagaacacacagggtcttatctttgttgtggacagcaatgacagagaccgtgttgttgaggcaagggatgaattgcataggatgttgaatgaggatgagctgcgagatgccgtgttgcttgtatttgctaacaaacaagatcttcccaatgcaatgaatgctgctgaaattactgataagcttggcctccactctctcagacagcgtcactggtacatccagagcacttgtgcaacctctggagagggtctatatgaggggctggattggctctccaacaacattgctaacaaggcatgatcctattggggagtcattttgtggactggaaattctggatgcaggggtgaatattatctagttctttttttctttgagacaagacgatcgaattgttgttaaatcatctatttcttccttctgggagtggtctttttcatttaggacgttttaatggttatattgtgatagaaagaatggttggtcaaatgtatacatttgagcttttggttggattttggatacagttcggagttgtagttggatttcaatagatgcctcctttttttttctttttttttttcataactgctctgagttgtaattggttttggttggattttggatacatgtttcaaatgtatacatatttccaagtcatgcaaaaccacacttgaatta

SEQ ID NO: 12692 - DNA, 863 bp, Raphanus sativus
ggatataagtgtcgcagaaaaataatacatcatcgtgaaacgttgaaaggccatcagagctaagatctcctgcggcgttgtttcttcggtttggaaaaaaaaaggatggggttgtcatttgggaaactgttcagcaagctgtttgcgaagaaagagatgcgtattctgatggtgggtcttgatgctgctggtaagactaccatcctctacaagctcaaacttggtgagatcgtcaccactatccctaccattggtttcaatgttgaaactgtggaatacaagaacatcagctttaccgtctgggatgtcgggggtcaggacaagatccgtccattgtggagacactacttccagaacacacagggacttatctttgttgtggacagcaacgatcgcgaccgtgttgttgaagccagggacgagcttcacaggatgttgaacgaggatgagttgagggatgcagttctgcttgtctttgctaacaaacaagatcttcccaacgcaatgaacgctgctgagattactgacaagcttggccttcactctctccgccaacgacactggtacattcagagcacatgtgccacctctggagaaggactctacgagggacttgactggctctccaacaacatcgcaaacaaggcatagaaacatggtagcaggattcctcttcacttgttttctcataccttcttcttcttcttcttcttcaattctcagtctcaaaactgaaaaccatatcatactttgtactttcatttaacaacactatgtttctttgtttttgtttttgttcttccttagttgtaaaaaaaaccttttgtttcttctttttaaccggatatttacttttggctata

SEQ ID NO: 12693 - DNA, 879 bp, Raphanus sativus
gaaaaagaaaagaaaatcgtgaaacgtaggaagggggaggaggagcatctaggcatcagatctcgtgcggcgttgtttcttcgaaagaaagagaaaaaaaaaggaagggagagatgggggtatcatttggaaagctgttcagtaggctgtttgcgaagaaggagatgaggatccttatggttggtctcgatgctgctggtaagactaccatcctctacaagctcaagcttggtgagatcgtcaccaccattcccaccattggtttcaatgttgaaactgtggaatacaagaacattagcttcaccgtctgggatgtcgggggtcaggacaagatccgtcctttgtggagacactacttccagaacacacagggtcttatctttgttgttgacagcaacgatcgtgaccgtgttgttgaagccagggacgagcttcacaggatgctcaacgaggatgaattgagggatgcagttttgcttgtttttgctaacaaacaagatctccccaacgcaatgaacgccgctgagattactgacaagcttggccttcactctctccgccaacgtcactggtacattcagagcacatgtgccacctctggagaaggactctacgagggacttgactggctctccaacaacatcgctaacaaggcatagaaaggaggttgcaagattcctccttgcttgttaatcaaggaaggggtccgtttcgctagtactataaaaaacgaaaccaagattttattatcatatgttcttcttcttctacgtctcgcatctgaaactcaaaatcatatcacgttttgtactttcctttaataactcagatctttttactttcagatattaatatcgttatttacatttgaacttcgga

SEQ ID NO: 12694 - DNA, 822 bp, Raphanus sativus
ggcctcttttactcgttggaagacccatttgcttggttctttggacgaccacccatcggcgacgagactgtgaaaggcttttggattgaaagatggggctgtcctttgggaagttgttcagtaccctgtttgcaaagaaagagatgcgtatcctcatggttggtctcgatgctgctggtaagaccaccatcttgtacaagctcaagcttggcgagatcgtcaccaccattccaaccattggtttcaatgtggagactgtggagtacaagaacatcagcttcaccgtctgggatgtcgggggtcaggacaagattcgtcccttgtggaggcactacttccagaacacccaagggctgatcttcgtggtcgacagcaatgaccgtgaccgtgttgtcgaagctagagacgagcttcacagaatgctcaacgaagatgagttgagagatgcagtgcttctggtctttgctaacaagcaagatcttccaaacgccatgaacgccgctgagattactgacaaacttggccttcactctctccgtcaacgtcactggtacatacagagcacatgtgctacctccggagaagggctctatgagggtcttgattggctctccaacaacatcgctaacaaggcttagagcagtttgtgggagagtgtcttgtcttcttggactctgttttgttcctttcctctcaacactttttatcatttcatttcgtactttgttcttcgctcttttttttcttctatcctaaattcagaatattatgaaatgtcggattttccaatctcttcctacatttatttgtattttatgagtt

SEQ ID NO: 12695 - DNA, 915 bp, Raphanus sativus
attcatcgtcgtcgcgcatttagcgtttctcttaagcagagctcagtttctccagagtttaaaaagcaaaaaaaagggatggggttgagtttcgcgaagctgttcagcaggctctttgccaagaaagagatgaggattctgatggttggtctcgatgctgctggtaagaccaccattctctacaagctcaagctcggtgagattgtcaccaccatccccactattggtttcaatgtggaaactgtggagtacaagaacatcagtttcactgtgtgggatgtcgggggtcaggacaagatccgtcctttgtggaggcactacttccagaacactcagggtctgatctttgtcgtcgacagcaacgacagagacagagttgttgaagctagagatgaacttcacaggatgctcaatgaggatgagctgcgtgatgctgtgttgcttgtgtttgccaacaagcaagatcttccaaatgccatgaatgcagctgaaatcacagataagcttggccttcactccctgcgtcagcgtcactggtacattcagagcacatgcgccacttcaggtgaaggactctacgaaggtcttgactggctgtccaacaacatcgctggcaaggcttaatgaagtgaaagcagcattgcatcgagagatgattcttcctgctgtatgttggtaaagtttctggatgcaagagagagattataaatattatatgaacctttttgctactggctttatgaatgttctggttgtgcaagtagtagatatgtacctaaaaacttacgagcatgagccccttttaaacagttttcgtgttgttcacacctggattgatgattgaatgttcttcctttcttgctatcccctattttcatttgcaacataataacataaagtctttggtcttaaata

SEQ ID NO: 12696 - DNA, 993 bp, Oryza sativa
cgcaagcgcaagcccagccgcctcgtcgtgttcgcgttcgtcgcgcggctccgacctccaaagccgccgctacccttcccgtcttcgtcgtcgccgcgcacgcagatcgcgaaccagcccgcgcgccgcgcagcagcgccgcggagaggaaaggagagctccgccgcgcaccccccgccaccatcttgtagggagagatggggctcacgttcacgaagctgttcagccgcctcttcgcgaagaaagagatgaggattctcatggtcgggctcgatgcagccggtaagaccaccatcctctacaagctcaagcttggcgagatcgtcacgaccatccccaccatcggatttaatgttgaaaccgtggaatacaagaacatcagcttcactgtttgggatgtcggtggccaggacaagatcaggcccctgtggaggcactatttccagaacacacagggactcatctttgttgtggacagcaatgatagggagcgtgttgttgaggccagagacgagcttcacaggatgctgaacgaggatgagctgcgtgatgctgtgctgcttgtatttgcaaacaaacaagatcttcctaatgccatgaatgcagctgaaatcactgacaagcttggtttgcattccctgcgccagaggcactggtacattcagagcacttgtgctacatctggtgaagggttgtatgagggtcttgactggctttccaacaacattgccagcaaggcttgagcgttttggcagctggatatctgaacaattcactagtgccggtttacatattatataacatatacaccctaccacacatagtgtgggtgcctgtgaaggaaaaaactcctttgtggaggctagtaccagattgttccttttcgtgggcactataagtgcttatattttgtttggttttacaacatttactgtgctgtccatatgtacccgtttgttctgagatggtctagtaaattgatatgctttgtca

SEQ ID NO: 12697 - DNA, 948 bp, Rosa hybrid cultivar
cagatctgccccctctaagtgaattcaaagatggggttgtctttcaccaagttgttcagtcggctttttgccaagaaggaaatgagaatccttatggtcggtctcgatgctgcgggtaaaactaccattttgtacaagctcaagctcggagagattgtgaccaccattcctacaatcggattcaatgttgaaaccgtggagtacaagaacattagctttaccgtgtgggatgtcgggggtcaggacaagattcgacctttatggagacactacttccaaaatactcaagggctcatttttgtggttgatagcaatgatcgtgaccgtgtcgttgaggctagggatgagctgcaccgcatgttgaatgaggacgagttgagggatgctgtgctgcttgtatttgccaacaagcaggatcttccaaatgctatgaatgctgcagagatcactgacaaacttggtctccactctcttcgtcaacgccactggtacatccagagtacatgtgccacttctggtgaagggctctacgagggtcttgactggctctcaaacaatatcgcaaacaaggcttaaatgatcagtaatcttcagcaaccgcttgtttgcaagttgtgtgacggctcacattatcttctgtttctcgggtccccgagaatgtatgtgtttagatattattacaaagtgattgacggctgtagattttaaataattcaagacttctacattctacatacaaatttgtttgtatcggtttaggattccaatcaatggattttgaaccttactgttccttcaccatgttttgatagacttaatgcatgctgtgttgaatcattcatggattgtcaataaaatttagtctttttagtaaaaaaaaaaaaaaacaaaaaaaaaaacaaaaaactcgagacttagttctctctgaggcgggtcgtggacgaaggc

SEQ ID NO: 12698 - DNA, 784 bp, Rosmarinus officinalis
cggccgggggatccaacccggagcaacagtatccattaaaataaatatggggctaccctcgtgcccttttcctccttttcgattcttgcatccagacggacggtaacaacgaagagaaccgcgttatctctccacgcccttttttatatttcatcccctgcgaagctctcgagagtaacaagtcattgggagcccatcagctgaagtgaaaccgagatgggtctgaccttcactaaactgttcagcaggctttttgccaagagggagatgcgcattcttatggtaggtcttgatgctgctggtaagaccaccatcttgtataagctcaagcttggagaaattgtgacgacaatccctaccattggatttaatgtagagacagtggaatataagaatattagcttcactgtttgggatgttggtggtcaagacaagatccgtccattgtggaggcattatttccaaaacacacaaggtcttatatttgttgtggatagcaatgacagggatcgagttgttgaagcaagggatgaattgcacaggatgttgaatgaggatgaactgagagatgctgttttgcttgtatttgctaacaaacaagatctacctaatgcgatgaatgctgcggaaataactgacaagcttggtttgcattcacttcgccaacgccactggtacatccagagcacatgtgcaacatcgggggagggcctttatgaaggtttggattggctttccaataacattgctagtaaggcataaggatactgagtattttgttttg

SEQ ID NO: 12699 - DNA, 1021 bp, Rosmarinus officinalis
aattaattgaaattcttaagggcaattcctgctctgcgataagatcagatcatgcattagggcagcgactctgacgacaatctgcctgtcttctttccgaatcatttcatttggctttcttcatcaccaatttagaaaatggggttgtctttcaccaagcttttcagccgactgttcgccaagaaggagatgcggatccttatggtaggtcttgatgctgctggtaagaccacaatattatacaaactaaagctgggagaaatagtcacaaccattcctacaattggattcaatgtggagacagttgaatataagaacatcagcttcactgtttgggatgttgggggtcaagacaagatccgaccattgtggagacattactttcagaatactcaaggtctaatctttgtggttgatagtaatgatcgagatcgtgttgttgaggctagagatgagctgcataggatgttaaatgaggatgaattgagggatgctgtgttgctagtttttgctaacaaacaagaccttccaaatgctatgaatgctgctgagataactgacaagctaggacttcactctctccggcaacgccattggtacatccagagtacatgtgccacctccggggaagggctatacgaggggctggactggctctcaaacaacattgccaacaaggcttaagaattaagaagaaaagatgctggatgatttttggtgactgaatgaagatttagattttcgttatcatttgcgtctttgattcaaaccaattatgtacttagataacgtctttctgtctcgtattatgtacattgatactcactttatatagtttctgcaattatgttatgtcaagacatccttttttccaggttacttattgaaatatcgagtaactgcacttgctagtcgacaattattgttttatcaaagtaatactagtaaactcaaagtttacatcaattgcggatataacaccactgcaccggacaggttactttaattatttcaatataat

SEQ ID NO: 12700 - DNA, 796 bp, Carthamus tinctorius
ccgggggccccttatttacacactccatttctctctctctcttctccatctctcacttcaaatcgatccattgatccatctccaacaagcttttctcagggatcctcaccagcaagaggatggggttaactttcaccaaactgttcagccggctctttgccaagaaagagatgcgtatattgatggtgggtctcgatgcggctggtaagacaaccattttgtacaagctcaagctcggcgagattgtgaccacgatcccaaccataggttttaatgtggagactgttgagtacaaaaacattagcttcacagtgtgggacgttggaggtcaggacaagattcgtccactatggaggcattatttccagaacacacaggggcttatctttgtggtcgatagcaatgacagggacagagttgttgaggcaagagatgaattgcacaggatgttgaatgaggatgagttaagagatgcagttctccttgtgtttgctaacaaacaagatctcccaaatgccatgaatgctgctgaaatcactgataagctcggcctccactccctccgacagcgccactggtacatccagagcacttgtgcaacctctggagaaggtctttatgagggactggattggctttccaacaacatagcaaacaaggcatgaggaggtgattgattttgttgtgagggttggaagtggatgcaagttttgcttttaacttggccagtttatcgtcgtcgtgactatctgtgcactacccgtggtttgggaaaacatgttcttttaacaggtct

SEQ ID NO: 12701 - DNA, 914 bp, Carthamus tinctorius
cgggggacccttatttccgaacctctctctctatctctctttctctccctccctcccacgcttttagatctccatcgatccttctccaaaaagcttctcttctcttttctctctctcagggatcctcatcagaaaaaggatggggcttacattcaccaaactcttcagccggctgtttgccaagaaagagatgcgcatattgatggtgggtctcgatgcagctggtaagacaaccattttgtacaagctcaagctcggcgagattgtgactacaattcctaccatcggttttaatgtggagactgttgagtacaaaaacataagcttcacagtttgggatgtggggggtcaggacaagattcgtccactatggaggcactacttccagaacacccagggtcttatctttgtggttgatagcaatgacagggacagagttgttgaggcaagagatgagttgcacaggatgttgaatgaggatgagctaagagatgcagttcttcttgtatttgccaacaaacaagatctgcctaatgcaatgaatgctgctgaaatcactgataagctcggcctccactccctgcgacagcgccactggtacatccagagcacctgtgccacctccggggaaggactttatgaggggttggactggctttccaacaacattgcaaacaaggcataaggtgagaattgaatttgtattttgagggtggattctggaggcaagttttgctttatatttggtgtagccactttcctgtttctcgttcttcatcgacttgaggtgcaagtgggtattgaaaaaaactttgttggttaaaaaaaaagggtttttgcatttgataatataggacatcatgtatgatacaacgtttggttggattgcaagtatttttaaaggtatggatgtg

SEQ ID NO: 12702 - DNA, 1059 bp, Salvia sclarea
ataatctattgcgttcttctgaagcagcttcctatttttccgcatacctctctaccacttccccagatctatcgttttctgggagctaagtagaaaacagaaatggggctgactttcacaaagctgtttagccggctttttgccaagaaggagatgcgcattttgatggttggtctcgatgctgctggtaagaccaccatcctgtacaagctgaagctcggagagattgtcaccaccattcctaccattggtttcaatgtggagactgttgaatacaagaacattagcttcactgtttgggatgttgggggtcaggacaagatccgcccattgtggaggcactacttccaaaacacacagggtctcattttcgtggttgacagcaatgatagggaccgtgttgtggaggcaagggatgaattgcataggatgttgaatgaggatgagctgagagatgctgtattacttgtatttgccaacaagcaagatcttcccaatgccatgaatgctgctgaaattactgacaagcttggcctgcactcactcaggcagcgtcattggtacatccagagcacctgtgctacctccggtgaggggctatacgaggggctggattggctctctaacaatatcgctaacaaggcttaaatgttgttgggagttgcttggataatgcgtgcagctgtgttttttcatagccatatactagtctgtgtggaatgatttcgttccaaaaattttggaagttctttggtaccctgtgaaacggttgtgtaaaactaaatgaaattgtttcatatgtttgcgtacactagttctaaatgtaatgctatattcattcataaacattaatattaatattgtctgcattcactactcttgactattgagtaacatattatggtatggcgggtatgtcactgttcttggttgagtgtaagcatgtttcctttgattatcaactaggatgactatgtaagatgcccaatcttggttgtgtaatgtgtccttgctcttcttacttaagtcacgtccgttttgttaatagaaaatcgtatt

SEQ ID NO: 12703 - DNA, 886 bp, Sarracenia psittacina
gtactgtctgtcgtcgtcgtgggagacagtatatggtgtagtgagagagagagagagagggggatcaagaaggggcacagatctgtttcgctctttgtccctcagacacagatggggctgtccttcaccaagcttttcagtcggctgtttgcaaagaaagagatgcgcatattgatggtgggtcttgacgcagctggtaagacaaccattctttacaaactgaagctgggagagatagtcactacaattcctaccattggatttaatgtggagactgtggaatataagaacattagctttactgtttgggatgttggtggccaagacaagatccgacctttgtggagacattacttccaaaacacccaaggactcatctttgtggttgatagcaatgaccgagatcgtgtggttgaagcaagagatgagctgcacagaatgttgaatgaggatgagttgagagatgctgtgctgctggtgtttgcaaacaagcaagatcttccaaatgcaatgaatgctgcagagataactgataagcttggccttcactctcttcgccaacgccactggtacatccagagcacgtgtgccacttctggcgaagggctgtacgaaggactggactggctttcaaacaacattgcaaataaagcatagacagttcgatgttgagtttggatttcgaccattgctgaagtacagatttaacatttatttggtgcttgtattttcaatcttgttgatttgttacctacctaccgtttgaggtttcatttgcagacattgccattgtttccttagtttcagaataagtcttaagtttttattcattcacatctatatcttgtttccttttatcatcccacccgtggggatgctaaaatta

SEQ ID NO: 12704 - DNA, 938 bp, Scabiosa columbaria
ttattacgcgttggtgtcagccttcctcctctttttctctctctcacaaccagtgagatccctttcacaacttttctacagggatcgttactaagaaagagaatggggctaacgttcaccaagcttttcagccggctttttgccaagaaagaaatgcgtattcttatggttggtctcgatgctgcgggtaagacgaccatattatacaagctcaagcttggcgagattgtgacgacaattcctaccattggttttaatgtggagactgttgaatacaaaaacatcagcttcactgtttgggacgttggaggccaggacaaaattcgtccattgtggaggcattacttccagaacacacaaggtctaatatttgtggttgatagcaatgacagagaccgtgttgttgaggcaagagatgaactgcacaggatgttgaatgaggacgagcttcgagatgccgtgctactggtatttgctaacaaacaagatcttccaaatgcaatgaatgctgccgaaatcaccgataagcttggcctccactctctcagacaacgtcactggtacatccagagcacatgtgcaacctctggagagggtctttacgagggactcgattggctctcaaacaacatcgccaacaaggcatgagctgatgcagattgcagagtcgtttaactttcttgtcaagcgatatcctggatgcaggcatgtttttatctagttttttctttgttactttctccccaacacttcccttttcttgattccgatagtgtgtgcttatgaatttggttttgaagggaaaatgcttttgatgttaggtttgttttgaattgggttgtagtagaatgaatgatttggatgtatgcacatgaatgcatatgtttaggtattaatacaattctgaagttgtaatacaaactaatttggtgttgata

SEQ ID NO: 12705 - DNA, 881 bp, Scabiosa columbaria
ctattgtttcttgtttgcttgtggtggacagctcctgttccttttatcgttttctctctcaatctcctttcacagatctgctactttcaacattcctttgaggggagatctttgcttcgctctcatcgcttccttcttcaggagaaacaaagatggggctgtctttcaccaagctcttcagtaggctctttgccaagaaagagatgcgcatactcatggtgggtctcgatgctgctggtaaaacaactattttgtacaagctcaagctgggagagatagtcactacaattcctaccattggatttaatgtggagaccgtggaatacaagaacatcagctttactgtttgggatgtcggaggtcaggacaagattcgtcctttgtggagacattacttccaaaacactcagggactcatttttgtggttgatagcaacgatcgagatcgtgtagttgaagcaagggatgagctccacagaatgttgaacgaggacgaattaagggatgctgtgttactggtatttgcaaacaaacaagatcttcccaatgcaatgaatgctgctgagataaccgataagcttggtcttcactctctgcgtcaacgccactggtacattcagagcacatgtgcaacttctggtgaaggactgtacgagggtcttgattggctctcaaacaatattgctaacaaggcgtaataagtgggggctggtattgagtttggatcagcaactgcaagcagatagacttataaattccgaaatatgtatgtaccttgttaatttgttgttacctttgtccttgaggtttgtttcgcaaacatgtatttgtttcatgtagttacagaataacttttattctcaatatatatgtttttgttg

SEQ ID NO: 12706 - DNA, 682 bp, Senecio madagascariensis
ctcaacaaacctcttttctcagggatcttctctagcaatcaatagaatggggttaacattcaccaaactctttagccggctttttgccaagaaggagatgcgtatcttgatggtgggtctcgatgcggctggtaagacaaccattttgtacaagctcaagcttggtgaaatcgtgacaacaatccctaccattgggtttaacgtggagactgttgaatacaaaaacatcagcttcactgtgtgggatgtcgggggtcaagacaagatccgtccactatggaggcactacttccagaacacacaaggccttatctttgtggttgatagtaatgacagggatcgagttgttgaggcaagagatgagttgcataggatgttgaacgaggatgagcttcgagatgcagtgttgcttgtatttgctaacaaacaagatcttccaaatgcaatgaatgctgctgaaatcactgataagcttggcctccattcccttcgacaacgccactggtacatccagagcacttgtgcaacttccggagagggactttatgagggtcttgattggctctcaaacaacatcgctaacaaggcataaggtgatacggaatgtggatataggatgcgagcttttgcatctaagtctcatgttcttgtctgagctgtatgcggttctgggatttgttcg

SEQ ID NO: 12707 - DNA, 822 bp, Solanum phureja
acatatttcagcgttaatctcaggtttctctctcaatagatccctccttcaaaaagctcttttcagggatcatcatcaaggaagcaatatggggctcacattcaccaagctcttcagtcggcttttcgccaagaaggaaatgcgcattctaatggttggtcttgatgcagctggtaagaccaccatattgtacaagttgaagctgggagagatcgtgactactattcctaccattggtttcaatgtggagactgttgagtacaagaacataagcttcactgtttgggatgtcgggggtcaggacaagatccgtccattgtggaggcactacttccagaacactcagggtctcatttttgtggttgatagcaatgatagagaccgtgttgtagaagcaagagatgaattgcataggatgttgaacgaggatgaacttcgggatgctgtgcttctagtttttgctaacaaacaagatcttcctaatgcaatgaatgctgccgaaataactgataagcttggactgcactccctcaggcagcgtcactggtacatccagagcacttgtgcaacttctggagaggggctttacgagggacttgattggctttctaacaacattgctaacaaggcttaaagtgatgcagatttgttgttgtgggttgatctggatgcaggcggagttttatctagttgttttttcttctcatgtcagtgtggttatgaatatcatgttgaaagcattttgtgtttccttagggctttttgtaatggctgtgtaatacaatggtcgaatatatgtaattgctgtttgattaggtatat

SEQ ID NO: 12708 - DNA, 1007 bp, Solanum phureja
ctctccttttcggtgaccgagcaaaagagattttgagagtggtggttgctgttggacaatagagatctactgatttcatcctctctcatcggccgatcttcgattaacggagatggggctgtctttcactaaactctttagtcgcctctttgcaaagaaagaaatgcgaattcttatggttggtctcgatgctgctggtaaaaccacaattctgtacaagctcaagttgggagaaattgttaccactatcccaaccattggcttcaatgtggagactgttgaatacaaaaacatcagctttactgtgtgggatgttggtggtcaggacaagattagacctctatggaggcactatttccagaacacacagggcctcatctttgtggttgatagcaatgacagagaccgtgtagttgaggcaagggatgagcttcacaggatgttaaatgaggatgaattaagagaagctgtgttgcttgtttttgcgaacaagcaagatcttccaaatgcaatgaatgcggctgaaatcaccgacaagcttggccttcattctctcagacaacgacactggtatatccagagtacatgtgctacttctggagaagggctttatgagggactggattggctttcaaacaacatcgccagcaaggcctaatgcaataatgttgtactatgcttcttgcgttgctatatccggagaaataaacatcattgtctcatcgtaatttctttcgtttggagattttaaatatctgttcagctcacaattctggggaaggccttacccttcttcactctctatggtttatcgtcaaagagcatggaatagtttccacattgctggatgcacattggcaatgtaatgatattttagtataatatctggttttgaaacttggcgcagccgtgtgcaccattttgttgtccggtgtgtctgatgttggaatgggtgtacaaaatgcaatacagatcaatagtaagtatcggaattttgcgagtagtaa

SEQ ID NO: 12709 - DNA, 1523 bp, Glycine max
ttttctccttttaactggttttgtcgtaaatatgtgcttggaagcttcggaagaattaagaattgatagagagaggcatagacggtgctttaggttattttcttaagtaaaaagaaggaaataaataattctcgtagctttgttgctcttataaattctattctggttgacgcttctctcaccatccccatttcgcgttggtgcaaagcatccttcgtttcaatttctctctctcagcgctttctgcaatcgaacctttcatctccaaagggatccacaggccgaaggagaaatggggctgacattcacaaagcttttcagtcggcttttcgcgaagaaggaaatgcgaattctgatggttggtcttgatgctgctggtaagaccactatcctgtacaagctcaagctcggagagatcgttaccacaattcctaccatcgggttcaatgttgagactgtggaatacaagaacattagcttcactgtttgggatgttggtggccaggacaagattcgtcccttgtggaggcactacttccagaacacccagggtcttatttttgttgtagacagcaatgatagggacagagttgttgaggccagagatgagttgcataggatgttgaatgaggatgaactgagagatgcagtattgcttgtgtttgccaacaaacaagatcttcctaatgcaatgaatgctgctgagattaccgacaagttgggtctacactctctcagacagcgccactggtacattcagagcacctgtgcaacctctggggagggcctttacgaaggtctggactggctttccaacaacattgccaataaggcttaatgcctttgggagtcttgcggattggtaattctggatgcaggggtgaacattatctagcttttatttcttggtcctcttccaagacaactcgaatttgtgctcatgtaatgcggtttaggacatctcgaatttgtgctcatgtaatgcggtttaggacatctcggtgctaaattgtagtaggattttacttcttgggatgcgtaatactctgatctttctattgggtttggatgcaatgtccataactgtaatggagatactaattcaatgcgccaccgggttctgtctgatttatagttttattttggtcatgtatcattcatatattgagtatgaaatggagattttgtttattgttttgtaagattcccgaaaaaaaaaaaactatatacacttcgtaccttctatgtttgcttcgtggatagcataggcaatgggcaactcatcaaaggagtgggtcttgaatctgaattaggctcccaacaatccgtaatgattatttttttaacaattttaaatattacacataaggaatggactcaagtttttaaaattttggtgtgatgttgatgtttcttgctcatttattttcaattcaaatgcaacaggatatccaagtccctttttgaaatttctcccagaaattcagtttttgacaaaactattttcaataaaaacatgtacg

SEQ ID NO: 12710 - DNA, 1226 bp, Glycine max
taaaatgtttaaaattaaacgagagaaatggtaaatttgaggatgtaatttgattatgcagaagaaaaaaaaaaaaagcgaaaaacctcgttaaaaaaaaagaagaagttaacgagcgtaaagtggtaaaccgaaattataaggagagggaataaacgacgttatgacggggaaacacgaattttggatcttagtccgcgttctataaatccggcaaggcctgcctgtgagaccatctcaatttcttttctctttgtcgcaaagagaagagatctgcctccttttttttatcaaatctatctcttcttcaagaatagttgaaaatggggctgtctttcaccaagttgttcagccgactgtttgccaagaaagagatgcgtatactgatggtgggtctcgatgctgcgggtaagaccaccattctgtacaagctcaagcttggagagattgtcaccaccattcccaccattgggtttaatgtggaaactgtggaatataagaacatcagcttcactgtctgggatgttggaggtcaggacaagatccgtcctttgtggagacattacttccaaaatacacaaggacttatttttgtggttgatagcaatgacagggaccgagttgttgaagctagagatgagttgcatagaatgttgaatgaggatgagttgagagatgctgtgcttctagtttttgccaacaagcaagatcttccaaatgctatgaatgctgctgagataactgataagcttggtcttcattccctccggcagcgtcactggtatatccagagcacatgtgccacatctggtgaagggctctatgaaggacttgactggctctcaaacaacattgcaaacaaggcatagagatttgttagttaaatgcaaggaagttgagcttacttcggccattatgatctccagtttctaattttcttgccctacttagattttcattacttgagcatgtatttttcttgaaaaagaacaacggtttgctactgaagaataatttgaatttttttccatgtataaccaaatagcattgtttactatttgatttgtgaagtcaattgaattatatgaaacctcgtattatgtctatgattcttacgatcatttgtattcgactgtgtcccggcaaattgaagaaaagaagacattgtttttattttggaaatgcttaataaatttaaattactattattattattattcagccac

SEQ ID NO: 12711 - DNA, 1527 bp, Glycine max
atcgatttttttataaacaaatatataaaaaagctaaattacatgaaaaaaatgaccttaattttatttaagtaaaaagaaggaaataaataattcccgtacctttgtcgctcttataaaatctattcttgttgacgcttcttcacccccatctcgcgttggtgcaaagcatccttcgcttcaatctctctctctctctttgcgctttctgcaaaccgaacatttcatctccaaagggatcaacaggtcgaaggagaaatggggctgacattcacgaagcttttcagccggcttttcgcgaagaaggaaatgcgaattctgatggttggtcttgatgctgctggtaagaccactatcctctacaagctcaagctcggagagatcgttactacaattcctaccattgggttcaatgttgagactgtggaatacaagaacattagcttcactgtttgggatgttggtggccaggacaagattcgtcccttgtggaggcactacttccagaacactcagggtcttatttttgttgtagacagcaatgatagggacagagttgttgaggccagagatgagttacataggatgttgaatgaggatgaactgagagatgccgtattgcttgtgtttgcaaacaaacaagatcttcctaatgcaatgaatgctgctgagattactgacaagttgggtctccactctctgagacagcgtcactggtacattcagagcacctgtgcaacctctggggagggcctttacgaaggtctggactggctttccaacaacattgccaataaggcttaatgcctttgggagacgggagtcttgcggattggtatttctggatgcagggttgaacattatctagcttttatttcttggtcctcttccaagacaactcgaatttgtgttcatgtaatgtggtttaggacatctcggtgctaaactgtagtaggattttactttttgggatgtgtaatactctgagctttctattgggtttggatgcaacgcccataactgtaatggagatactaattcaatgtgccaccaggttttgtctgatttttagttttattttggtcatgtatcattcatataatgaaatggagattttgtttattgtttgtaagataccaggaaaaaaaaaactatattcacttcatacctttaaaagatatgcatgcttaatttgtgttcagtgaagtctcccttgtgttttgcttcgtggatagcatgggcaatgggtaacacttcaaaggagtgggccttgaatctgaattaggttcccagcaatccgtaataatagtaagcgtgagcatacttttataacaatttttaaatattacacaatcaaaacagattcaagttattacaattttggtgtgatgtttgatgtttcctgctcatgtattttcaattcaaatgtaacaagatatccaagtccatttttgaaatttctcctagaaattttcagtttttgacagtactattttcttattcacaaaaatgtgtagctattttttc

SEQ ID NO: 12712 - DNA, 1662 bp, Glycine max
aattaagaatccaccacattcatatgaagctaaatatgttttaacttattattattttatcttaaaataaacctattattatttgtgattagattattagatctagatgatagatggtggcattacgaataaattcaaaatataaatacgttaattaagcttatttgaataatagaattatttaaaagggagcattgcttttggaaggttcgaaaccattagcgtgtgagatgcattgcagggtgcaaatggtatttgatccaaaacgcgcatataaatcgggtacccccgttcttgtctctccctcctatataaaaccctttctttccattttgcgttattgtaaagcattcttcgcctttctctctcttctttttactctctctctgtctctctctacgctttctcgttcgagatccctcaagggatccactaactgaaggagaaatggggttgacattcaccaagcttttcagccggcttttcgccaagaaggaaatgcgaattctgatggtgggtctcgatgcagctggtaagaccaccatcctgtacaagctcaaacttggagagatcgttaccacaattcccaccattgggttcaatgtggagactgtggaatacaagaacattagtttcactgtctgggatgttggtggccaggacaagattcgtcccttgtggaggcactacttccaaaacacacagggtctcatttttgtggttgacagcaacgacagggacagagttgttgaggccagagatgagttgcacaggatgttgaatgaggatgaactgagagatgcagtattgctcgtatttgctaacaaacaagatcttcccaatgcaatgaatgctgctgaaattaccgacaagctgggtctccactctctcagacagcgccactggtacatccagagcacctgcgcaacctctggggagggtctttatgagggtttggactggctttccaacaacatagccaacaaggcttgatgctttttgggagtcttcttgtggattggtgattctggatgcaggggtgaatattatctagtttgtttttttggttctctcatgagacaaattggctttatgttaatgttttatggcttaggacatcttgatggctaaaattatagtaggaatttgtttcatgggatgtctaaatacttttgagttttttttttttttaattgagtttggattcaatgtttataactgtaattgataccaatcaatgcgccatcccattgagttatgattttattttgctaatattcctcatgattattattgcatgatacccaaaaaatgagaaatctttgaatatttgtagtgctcggtgatactgcaatattcatccttcgttgcatagtgcaactatgcaactagccaggccatttttatatttttcgacaatcatgttcctctgttgctccactataggataaaatcgaacaccatagaacagagtaatgtttcccagttgtcacgccaagcagaatttcaacaatggcgtagatctgtagttagcttcaatgggtgtaacttctatctcaccttttagggtaaagggttaaaggccttaataaggtcttcacatatgaagttgctcttcattttaactaagtttgtaatgggtgtatttttttctttgaaagc

SEQ ID NO: 12713 - DNA, 1344 bp, Glycine max
atataaacgagagaaatggaaaatctgaggatgtaagtcatgtagaagaaaaaagaaaagaaaagaagcgaatatcttagttaatagaaagttaacgagcgtaaagtggtaaaccgaaattataagtagagggaataaacgacgttatgacggggaaacacgaattttggatcttataaatccggcaaggcctgcctgtgagaccatctcaatttcttttctctttgtcgcaaagagaagagatctgcctcctttttccttcccaaatcaaatctatctcttcttcaagttgaaaatggggctgtcgttcaccaagttgttcagccggctgtttgccaagaaagagatgcgtatactaatggtgggtctcgatgctgcgggtaagaccaccattctgtacaagctcaagcttggagagattgtcaccaccattcccaccattgggtttaatgtggaaactgtggaatacaagaacatcagcttcactgtctgggatgttggaggtcaggacaagatccgtcctttgtggagacattacttccaaaatacacaaggactcatttttgtggttgatagcaatgacagggaccgagttgttgaagctagagatgagttgcatagaatgttgaatgaggatgagttgagagatgccgtgcttctagtttttgccaacaagcaagatcttcctaatgctatgaatgctgcagagataactgataagcttggtcttcattccctccgtcagcgccactggtatatccagagcacatgtgccacatctggtgaagggctctatgaaggacttgactggctctcaaacaacattgcaaacaaggcgtagagatttgttagttaaacgcaaggaagttgagtttacttcggccattatgatctccagtctctaattttcttgccctacttagattttcattacttgagcatgtatttttcttgaaaaagaacagcggtttgttactgaagaacaatttgaattttttttccatgtataaccaaatagcattgtttactatttgatttgttaagtcaattgaattatataaagcctcgtattatgtctatgattcttgccacaatttgtattcgactgtgtcccggcaaattgaagggaagacatggtttttattttggaacccatctctctttcctttgaaggaaagatattatactatgtaaaatcaaattctaaagcatattaaatttaaattattattatggagccactaattgagtaaaacatgtgaaagaacaattttacaaaaaaatgagctaaaatttaattaattgaattaatgggtggacgtacaaacaggatttggcttggtg

SEQ ID NO: 12714 - DNA, 1395 bp, Glycine max
aaaaaaatccacgatacctatatgaagtaaattatatgttttaacctattattattattattattattattattagataatagatggtggcattacgattaaattcaaattgcaaatatttaatttagcttatttgaataattgaatttatttaaaagggagcattgcttttggaaggttcgaaacaatgtagcgtgtgagatgcattgcattgcagggtgcaaatggttatttgatccaaagcgcacatataaatcgggtacccccgttcttctctctccctcctatataaaaccctttcattccattttacattattgtaaagcattcttctcttttctttcttttctctttcctctctctctctctacgctttctcgtttgagatccctcaagggatccactaactgaaggagcaatggggttgacatttaccaagctttttagccggcttttcgccaagaaggaaatgcgaattctaatggttggtcttgatgccgctggtaagaccaccatcctgtacaagctcaaacttggagagatcgttaccacaattcccaccattgggttcaacgtggagactgtggaatacaagaacattagtttcactgtctgggatgttggtggccaggacaagattcgtcccttgtggaggcactacttccaaaatacacagggtctcatttttgttgttgacagcaatgacagggacagagttgttgaggccagagatgagttgcacaggatgttgaatgaggatgaactgagagatgcagtattgcttgtatttgctaacaaacaagatcttcccaatgcaatgaatgctgctgaaattactgacaagctgggactccactctctcagacagcgccactggtacatccagagcacctgtgcaacctctggggagggtctctatgagggtttggactggctttccaacaacatagccaataaggcttgatgctttttgggtgtcttgtggatgcaggggtgaatattatctggttttgttttttggttctcttctgagacacattggctttatgttcatgttttctggtttaggacatcttgatggctaaaattatagcaggaatttgtttcatgggatgtctaatacttttgagtttttttattgggcttggattcaatgtttataactgtaattgataccaatcaatgtgccatcccattgagcttttatttttttattttgctaatactcctcccatgattattattgcgcgatacccaaaaaacatgagaaaacttctcttaactaaatctttaaatatttgtagtgctcgatgatacagcattatgcatccttctttgccatagtgcaactagccaagacatttttatatttttcgacaatcactaaagtacttg

SEQ ID NO: 12715 - DNA, 1361 bp, Glycine max
ctgtacatgttttaacataatactattatattatgtaaaaatattattcgttaaatgaaacggaattatgataaaagaaaaaaagaatttaatttccacatcgacgcaatataatttgttgtttagaatattaaaaatccctgtgaatagagttataagaagaagaagaaaaaaaaataggggccacccaaaattgaacaagaagtcctgagaaggcatctagaacaaagctctgaatctgattttgaaaactggaacgcgtaaaatgaacggtacccctccctcataaataaaatctactactaaacgctcttctcttctgcaatcaatttgcaaaccaaacacaacacaaggagaagaaccagatctctctttctcaaatcaccaagaatagttgaaaatggggctgtctttcacgaagctgttcagccggctctttgcgaagaaggagatgcgtattcttatggtgggtctcgacgccgccggtaagaccaccattctctacaaactcaagctaggagagatcgtcacaaccattcccaccattgggtttaatgttgaaactgtggaatacaagaacatcagcttcactgtctgggatgttggtggccaggacaagatccgtcctctgtggagacactacttccaaaatacccaagggcttatctttgtggttgatagcaatgaccgggatcgtgtggttgaagctagggatgagctgcacaggatgttgaatgaggatgagttgagagatgctgtgcttctagtttttgcaaacaagcaagatcttccaaatgctatgaatgctgctgaaataactgataagcttggtcttcattctcttcgtcagcgtcactggtatatccagagcacatgtgccacatctggtgaagggctttatgaagggcttgactggctctcaaacaacattgcaaacaaggcatagtgattatcggtcatgggttgcatcaaagttcatttgagtttagcggttgtgacttccaatgtttgatgtgcttaccctgtttagaatcttattttctctagcatgtattatttgtcttcgataaagaacagattgtctactacctaatatcaaaataatttgcattttttctccgtgtataaccaaaaggcatttgtcttacccatcgatttgtgaagtcaatttatcattgaaatttttacatttattcataaatattaaacataaaattaacctttgttttctaaagcctaccaattttgttcattctcaattagcctttgttttctaaagcctaccaatttgaattcctctattgatgataaacccaacaatgccaagaaggacaaacttcaatgcacaaactatggagggg

SEQ ID NO: 12716 - DNA, 1149 bp, Glycine max
taatattttgtactaaagtaaataaataaatattaaaaccgaggagcattcatctgcgtatggtttcgggggagtttcttcttggatcttaccctcttgtttgctaatattctcattcttctgtctctgcttcttctccttctgaactaagagatggggttgtctttcaccaagctttttagccggctctttgctaagaaagagatgcgtattctcatggtaggtcttgatgctgctggtaagactaccatcttgtacaagctcaagctgggagaaattgtcacaaccattcccacaattggattcaatgtggagactgtggaatataagaatattagctttactgtatgggatgtgggtggccaagataagatccgtcctttatggagacactacttccaaaacactcaggggcttatctttgttgtggatagcaatgatcgtgaccgtgtagttgaggctagagatgagctccaccggatgttgaatgaggatgagttgagagatgctgttctcctggtatttgccaacaaacaagatcttccaaatgctatgaatgctgcagaaatcacagacaagcttggtcttcattctctacgccaacgccactggtatatccagagcacatgtgccacctctggggaaggactatatgaagggctggactggctctccaacaatatagctaacaaggcttaagggacattttgtggaatgccgctatcttcttgcttggctttacgattatattatgaggttgatgggttgttgcatctcttatatagcattataatattttcttttttactcttttaagtcttttctttttctttatttaggtgtttgatactatatcatagcaatcgtattggatcctgtagaatttttaaataattaatgaattacaaactatacatgacccgatcatgtttttcaatcctgcatcagtcaataatctctaaacctttaaatttaaagcttccattaatcagttgttccggtggacgctttagaaatttcacttaatatggagtacagtactttgattatgcggaaacagtgctaattctgtaatcaatgggattccaatatttctccttcctgggtgttattggaaaccagctactttataataatgattctggtagc

SEQ ID NO: 12717 - DNA, 892 bp, Spinacia oleracea
gaacaacacaaaagatgattacgtttttctattgcaatttgataacaaataacattaaggcttgttttagattgttcgagttaataggaagcgaaaatggggctttcttttggcaagctgttcagcagactattctcgaagaaggagatgcgtatacttatggtaggtctcgatgcggctggtaagaccaccatcttgtataagctcaagttgggagaaattgtcactaccatcccaaccattggatttaatgtggagactgttgagtacaagaacatcagcttcactgtgtgggatgttggaggtcaggataagattcgtccgttgtggagacactacttccagaacacacaaggactcatctttgtggttgacagtaatgatagagatcgtgttgttgaagcgagggatgagcttcaccggatgctgaatgaggatgaactaaaggatgccgtcctactagtgtttgctaacaaacaggatcttcccaatgcgatgaatgcagcagaaatcaccgacaagctcggtctccactccctccgtcaacgacactggtacatccagagtacatgtgcaacatcaggtgaagggctgtatgagggtctagactggttgtccaacaacatagcaagcaaggcttaaatgacagcctctctggttcacatttagaacgaagatagttgagttttcgccagcattttcaggacttttgttattacattacgttgcaagtttttcatagctaatgttgttcggtgacagtttaagccatttgcttcctgtagtctaagtttgagacatgagattgattaatcaattacttgtaatattatcttgtcagagctgttatagtcctctgtcattctttggaaccttattgtaactcctttca

SEQ ID NO: 12718 - DNA, 1084 bp, Picea glauca
cagcgctaggtgttcgagaggcaccagagatctctttgcgggagtcattcttctcccctggaatctcagatctgactcttcaactcgggatctctaacaggtggtcaagatggggctcacttttactaagctttttagccggctcttcgcaaagaaggaaatgcgcattttgatggttggtcttgatgctgctggtaagactaccatcttgtataagctgaagctgggagagattgttaccaccatccctaccatcggattcaatgtggagactgtagagtacaagaatatcagcttcactgtttgggatgttggaggtcaggacaagatccgaccgctctggagacattacttccagaatactcagggtctaatatttgtggttgacagcaatgatagagaccgtgtagttgaggctagagatgaattgcaccggatgctgaatgaggatgaactacgtgatgctgtcttacttgtattcgcaaacaagcaagatcttccaaatgctatgaatgccgcagagatcactgataagcttggtctgcattctctgcgacagcgccattggtatattcagagcacttgtgcaacttctggtgaaggcctttatgaaggcttggattggctttcaaacaacattgccaacaaggcataatttggaatgcgtctaatttctatattgggcacgaagtttattagccatgaagtagattccttcagaattacaatgatcgacagccactggcatggattttttaaagaagaccttgactcggttcattttcttgatagcttgattgctatgtattttacaacttgtcattattgtgcgagaatctgggatttttctgtctgccagttgtgctatattgactatattagctctgctacacatctaactattatcttttgattgagaagacttgtataattagattttagtggattgaaaggcttttctatgttcaataggaacaaatataatgctgctttccaaatttattagttgggaaaaacagaaagtagttcagtatttacattagtatctgaagcttctataagatattttacatctgtattcttt

SEQ ID NO: 12719 - DNA, 817 bp, Euphorbia esula
aattccttgtgttgggggacctctgttttccccttctctgcgtctctctgagataagaagatgggcctatctttcacgaagctttttagccggctctttgccaagaaagagatgcgtattctgatggtgggtctcgatgctgctggtaagaccaccattttgtacaagctcaagctgggagagattgtgaccaccattcctaccattgggttcaatgtggagactgttgaatacaagaacattagctttactgtttgggatgtcggaggtcaggacaagattcgacctctatggagacattacttccagaatactcaggggctgatttttgttgttgacagtaatgatcgtgaccgtgtagttgaggcccgtgatgagctgcatcgtatgctgaatgaggatgaattaagggatgcagtgctgcttgtatttgctaacaaacaagatcttccaaatgctatgaatgctgctgagatcaccgataagcttggccttcactcgcttcgtcaacgccattggtatatccagagcacatgcgcaacttctggtgaaggtctatatgaaggattggactggctgtccaacaatattgctaacaaggcatagtggaattgctgaagttgccgtggaactttttggaatgcactttgcttgaacttggttattttggtatcatctgtggattgcttatccggtgtaattgttgaagagaatgtattttttcctagatatttgttactgtaatagaaaacggtaaaaaaatgttcttgtagattttttaaataatatgcatgattcacagtttaaaaaaaaaaaa

SEQ ID NO: 12720 - DNA, 980 bp, Fragaria vesca
ccatatcatttgtcctcctcattcctctctagggcagcttctcagatctgccccctctaagcgaattcaaagatggggttgtcattcaccaagctgttcagtcggctttttgccaagaaggaaatgagaattcttatggtcggtctcgatgctgctggtaaaactaccattttgtacaagctcaagctcggagagattgtgaccaccattcctaccatcggattcaatgttgaaactgtggagtacaagaacatcagctttaccgtgtgggatgtcgggggtcaggacaagattcgacctctatggagacactacttccaaaatacccaagggctcatttttgtggttgatagcaatgatcgcgaccgtgtcgttgaggctagggatgagctacatcgcatgttgaatgaggacgagttgagggatgctgtgctgcttgttttcgccaacaaacaggatcttccaaatgctatgaatgctgcagagatcactgacaaacttggtctccactctcttcgtcaacgccactggtacatccagagtacatgtgccacttctggtgaagggctctatgagggtcttgactggctctcaaacaatattgccaacaaggcttaaatgatcagtaatcttcagcaacctcatgtttgcaaggtgtctgatggctcgcatatcttggtgtctgatggctcgcatatcttctgtttatggatttcttacaatgtgttactatcccgagattgtatctgtttagatattattacaaagtgattgacggctgtagatttaaataattcgacttatacattctacatacgaatttgtttgtatcggtttagggttccaattttgaacctttactattgcttcaccatcttttgatggacttgatgcatgctgtgttgaatgattcatggattgtccataaaatttatctttttgtatttgatgccgtttatattccggaggctgacgtacct

SEQ ID NO: 12721 - DNA, 1612 bp, Panicum virgatum
aaaaagaccaaaaaggagccgactcaatttcgacaaccggtcaaaagaacaagatgcggcactctagccagggcgggccgcctgaagcctcgtatccaactagcagcccagatcaaaccaaacttgcccacttcccggcccgccgaataaagagcggctaagatcgaatccgcaccgcgccacacgccactagcccattttgtctagcctccatttgggcccatgcctggaagccccccacacggcagcctcacagcgaagcgtcccggtcaggagctggctccatccgccgcccgccgcgggtcgattcggccgggccccgcgcgagcgctcctcctctctattttatcgcagcccgcctcgggccagccgctcgcaccgcaccgcaggccgcagccagccacaggctcccgtcgcattcgctcgctctctcgcgtcgtcgctcccgcccggtgctcccgcctccgccgatccgcgcacgcagatcgccgaagcccggcggcgcaggggcaaaggggatcgagcgagggagggagctcgcgcggcggcggaggaggaaggcgttcgccaccgtctcgaggaagagatggggctctcgttcgggaagctgttcagccgcctcttcgccaagaaggagatgaggatcctcatggtcgggcttgatgccgccggtaagaccaccatcctctacaagctcaagctcggcgagatcgtcactaccatccccaccatcggattcaacgttgaaactgtcgagtacaagaacattagctttactgtttgggatgttggtggccaggacaagatcaggcccctgtggaggcactacttccagaacacgcagggtctcatttttgttgtggacagcaatgacagggagcgtgttgttgaggctagggatgagctccacaggatgctgaatgaggatgagctgcgtgatgctgtgctgcttgtgtttgcaaacaaacaagatcttcctaatgctatgaatgctgctgaaattactgacaagcttggcctgcattccctgcgccagcggcactggtacatccagagcacttgtgctacatctggtgaagggttgtacgaggggcttgattggctttccaacaacatcgccaacaaggcttgaagcttttcggcagggctcccaggaagaggaagatgtctgaacaacttattgctgccttattacatattataattatacaatctacaatagatagtgtgggtgtttgtgaagaaaaagaaactagctctcttttgaggggctagtgccagattcgtatgtttttgtttttggctcggtattatcacctgtccagtttcacagaactgactctgtcaatcatgtgtacttatattcggagatgtgtggtaaattaaatttacatactttgccatagatctttgccgatacattgctatgccagatgtggattgctagattttttgttggatcacatatccgagatgctttgtacaagtgtacattaacttttgcccctcactgttgcatcttggtgggtatgtaccgcaaacatcctgttcttttgagatgcttcctgttctttttggagatggcaatcaacacgcctgccttacatagtta
